(12) United States Patent
Daniell

(10) Patent No.: US 10,676,751 B2
(45) Date of Patent: Jun. 9, 2020

(54) PRODUCTION AND USE OF PLANT DEGRADING MATERIALS

(75) Inventor: Henry Daniell, Winter Park, FL (US)

(73) Assignee: The Trustees of the University of Pennsylvania, Philadelphia, PA (US)

( * ) Notice: Subject to any disclaimer, the term of this patent is extended or adjusted under 35 U.S.C. 154(b) by 1402 days.

(21) Appl. No.: 12/396,382

(22) Filed: Mar. 2, 2009

(65) Prior Publication Data

US 2009/0325240 A1 Dec. 31, 2009

Related U.S. Application Data

(60) Provisional application No. 61/032,536, filed on Feb. 29, 2008.

(51) Int. Cl.
| | |
|---|---|
| C12N 15/82 | (2006.01) |
| C12P 7/12 | (2006.01) |
| C12N 9/42 | (2006.01) |
| C12N 9/24 | (2006.01) |

(52) U.S. Cl.
CPC ....... *C12N 15/8214* (2013.01); *C12N 9/2437* (2013.01); *C12N 9/2445* (2013.01); *C12N 9/2482* (2013.01); *C12N 15/8242* (2013.01); *C12N 15/8257* (2013.01); *C12P 7/12* (2013.01); *C12Y 302/01004* (2013.01); *C12Y 302/01008* (2013.01); *C12Y 302/01021* (2013.01); *C12Y 302/01091* (2013.01)

(58) Field of Classification Search
CPC ................................................ C12N 15/8214
See application file for complete search history.

(56) References Cited

U.S. PATENT DOCUMENTS

| | | | | |
|---|---|---|---|---|
| 6,326,470 B1 * | 12/2001 | Cosgrove | ............. | C07K 14/415 435/183 |
| 6,458,928 B1 * | 10/2002 | Swanson | ................ | C07K 14/37 435/262 |
| 6,818,803 B1 * | 11/2004 | Austin-Phillips | ........................... | C12N 15/8242 435/410 |
| 7,923,236 B2 * | 4/2011 | Gusakov | ............ | C11D 3/38645 162/174 |
| 8,481,810 B2 * | 7/2013 | Lebel et al. | ................... | 800/284 |
| 2002/0062502 A1 * | 5/2002 | Lebel | ................. | C12N 15/8214 800/298 |
| 2002/0138878 A1 * | 9/2002 | Sticklen | ............. | C12N 15/8207 800/288 |
| 2005/0106699 A1 * | 5/2005 | Reddy et al. | ................. | 435/200 |
| 2005/0233423 A1 | 10/2005 | Berka et al. | | |
| 2007/0192900 A1 | 8/2007 | Sticklen | | |
| 2008/0022425 A1 | 1/2008 | Lebel et al. | | |

FOREIGN PATENT DOCUMENTS

| | | | | |
|---|---|---|---|---|
| WO | WO 9811235 A2 * | 3/1998 | ......... | C12N 15/8214 |
| WO | WO 00/05381 A2 | 2/2000 | | |
| WO | WO 2007/1157263 | * 10/2007 | | |
| WO | WO 2007115723 A3 * | 11/2007 | ........... | A23L 1/3055 |

OTHER PUBLICATIONS

Xu et al (Journal of Biotechnology 131 (2007) 362-369—cited in Applicant's IDS filed on Jan. 28, 2013).*
Gramauf et al. "Degradation of Plant Cell Wall Polymers by Fungi" The Mycota,vol. IV: environmental and Microbial Relationships, p. 325-340,2007.*
Malburg et al (Applied and Environmental Microbiology, Mar. 1996, p. 898-906).*
Gamauf et al (The Mycota, vol. IV: (2007) Environmental and Microbial Relationships, pp. 325-340).*
Zverlov et al (Microbiology (2002), 148, 247-255).*
Roy et al (Journal of Bacteriology, Jun. 1999, p. 3705-3709).*
Han et al (Enzyme and Microbial Technology, 2007).*
Han et al (Enzyme and Microbial Technology, 2007) (Year: 2007).*
Yu et al (Journal of Biotechnology 131 (2007) 362-369) (Year: 2007).*
Gamauf et al (The Mycota, vol. IV: (2007) Environmental and Microbial Relationships, pp. 325-340) (Year: 2007).*
Zverlov et al (Microbiology (2002), 148, 247-255) (Year: 2002).*
Roy et al (Journal of Bacteriology, Jun. 1999, p. 3705-3709) (Year: 1999).*
Degani et al (Applied Biochemistry and Biotechnology (2002) vol. 102, 277-289). (Year: 2002).*
Ladanyia et al (Citrus Fruit : Biology, Technology and Evaluation, Elsevier Science & Technology (2008) 127-178—Published Feb. 6, 2008 (Year: 2008).*
Carvalhoet al (Electronic Journal of Biotechnology, North America, 115 12 1998) (Year: 1998).*
Queiroz, Lídia N., et al. "Evaluation of lettuce chloroplast and soybean cotyledon as platforms for production of functional bone morphogenetic protein 2." Transgenic research 28.2 (2019): 213-224. (Year: 2019).*
Stewart "Fuel Ethanol Production From Citrus Waste Biomass" citrus Energy LLC, Bioenergy Projects grant application Mar. 8, 2007 [online] downloaded from: http://www.floridaep.org/energy/energyact/files/grant/2006%20award%20winners/Original%20Proposals/citrus.pdf: downloaded on Aug. 9, 2009; p. 1 para 4 and p. 2 para 2/.

(Continued)

*Primary Examiner* — Lee A Visone
(74) *Attorney, Agent, or Firm* — Kathleen D. Rigaut; Howson & Howson LLP

(57) ABSTRACT

Disclosed herein are materials useful for degrading plant biomass material. In exemplary embodiments, the plant material comprises one or more enzymes that are expressed in plants and/or bacteria. Specifically exemplified herein are plant degrading enzymes expressed in chloroplasts. The chloroplast expressed enzymes may be provided as cocktails for use in conjunction with conventional methods of converting biomass into biofuels, such as cellulosic ethanol.

15 Claims, 7 Drawing Sheets
Specification includes a Sequence Listing.

(56) References Cited

OTHER PUBLICATIONS

Gramauf et al. "Degradation of Plant Cell Wall Polymers by Fungi" The Mycota, vol. IV: environmental and Microbial Relationships, p. 325-340, 2007, p. 329 col. 1 para 3 to col. 2 para 1.
Sorensen, H.R. et al., "Efficiencies of designed enzyme combinations in releasing arabinose and xylose from wheat arabinoxylan in an industrial ethanol fermentation residue" Enzyme and Microbial Technology, vol. 36, No. 5-6, Apr. 1, 2005, pp. 773-784.
Yu, Long-Xi et al, "Expression of thermostable microbial cellulases in the chloroplasts of nicotine-free tobacco", Journal of Biotechnology, vol. 131, No. 3, Sep. 2007, pp. 362-369.
Leelavathi, Sadhu et al., "Overproduction of an alkali- and thermostable xylanase in tobacco chloroplasts and efficient recovery of the enzyme", Molecular Breeding, vol. 11, No. 1, Jan. 2003, pp. 59-67.
Verma, Dheeraj et al., "Chloroplast-derived enzyme cocktails hydrolyse lignocellulosic biomass and release fermentable sugars", Plant Biotechnology Journal, vol. 8, No. 3, Apr. 2010, pp. 332-350.
Dan, Siegel et al., "Cloning, Expression, Characterization, and Nucleophile Identification of Family 3, Aspergillus niger B-Glucosidase", The Journal of Biological Chemistry; Feb. 2000, vol. 275, No. 7, pp. 4973-4980.
McKenzie, Belinda, "Heterologous expression of cellulase enzymes in transplastidic Nicotiana tabacum cv. Petit Havana", Doctor of Philosophy Thesis, School of Applied Sciences, RMIT University, Jan. 2008.

* cited by examiner

Figure 2
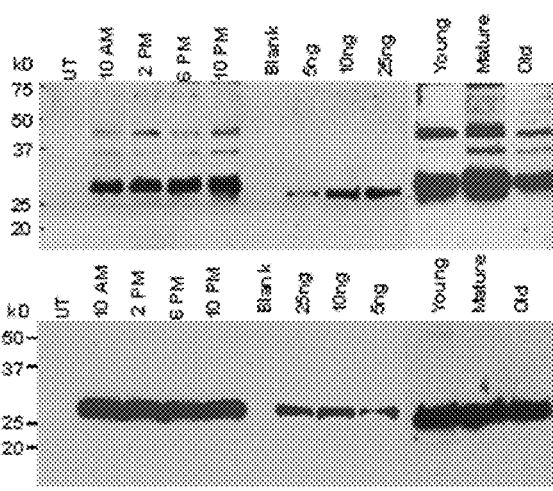
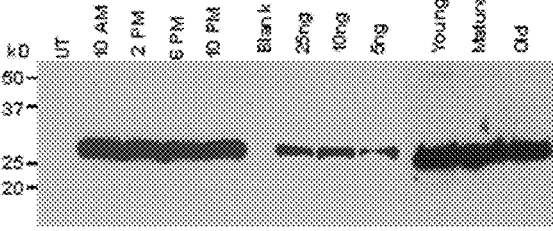
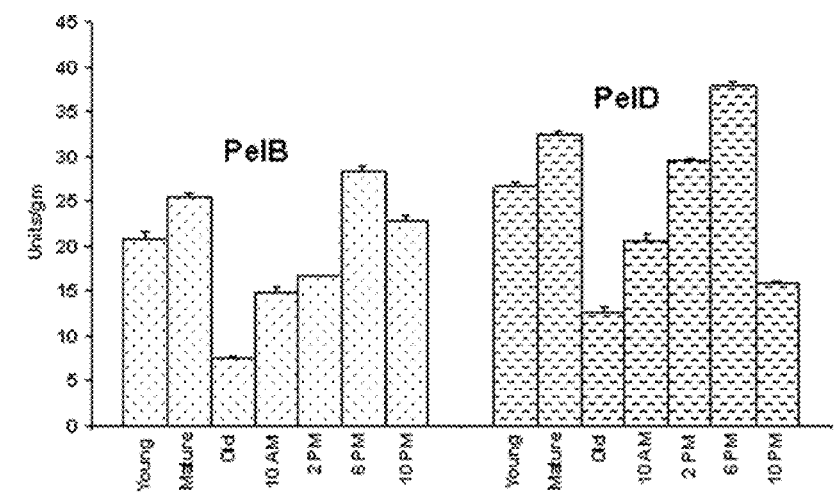
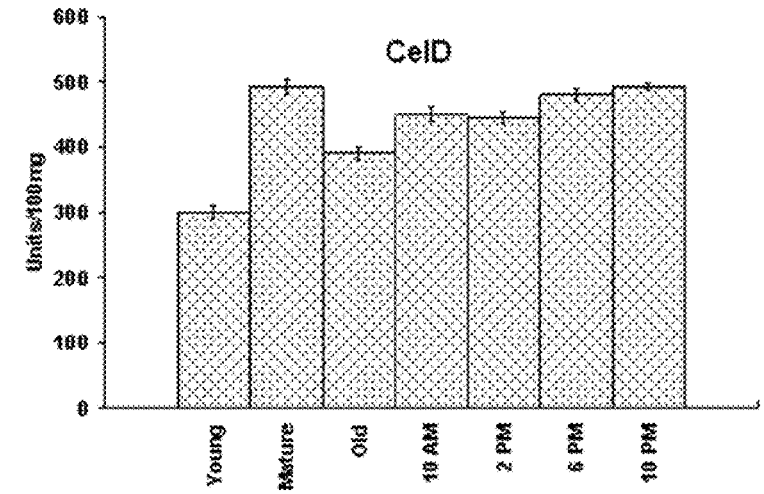

Figure 4
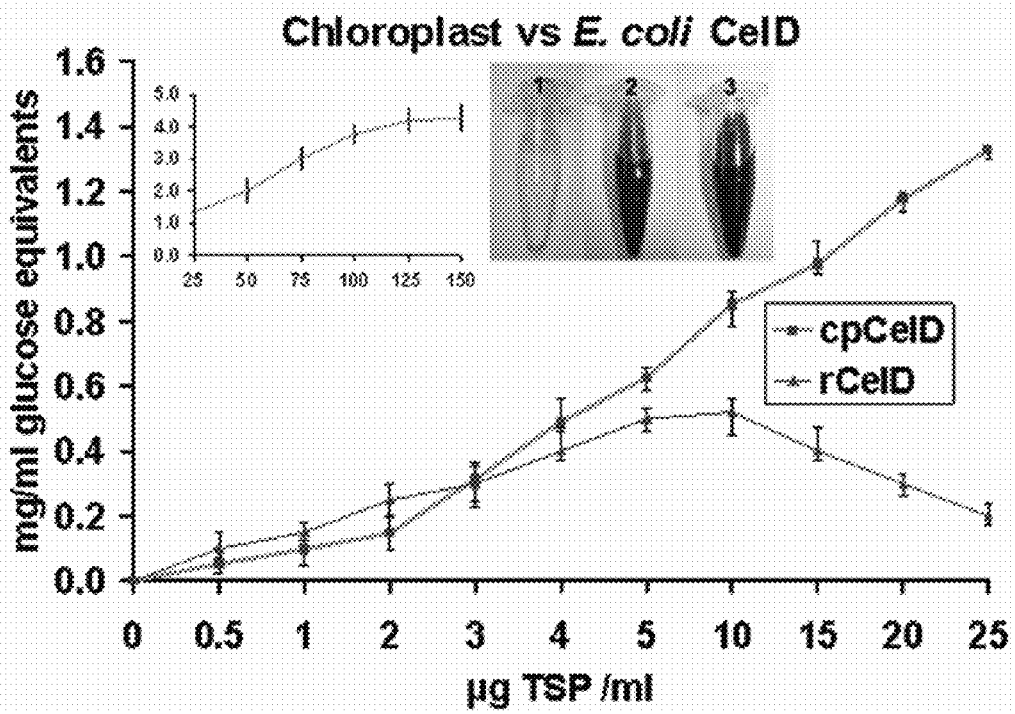
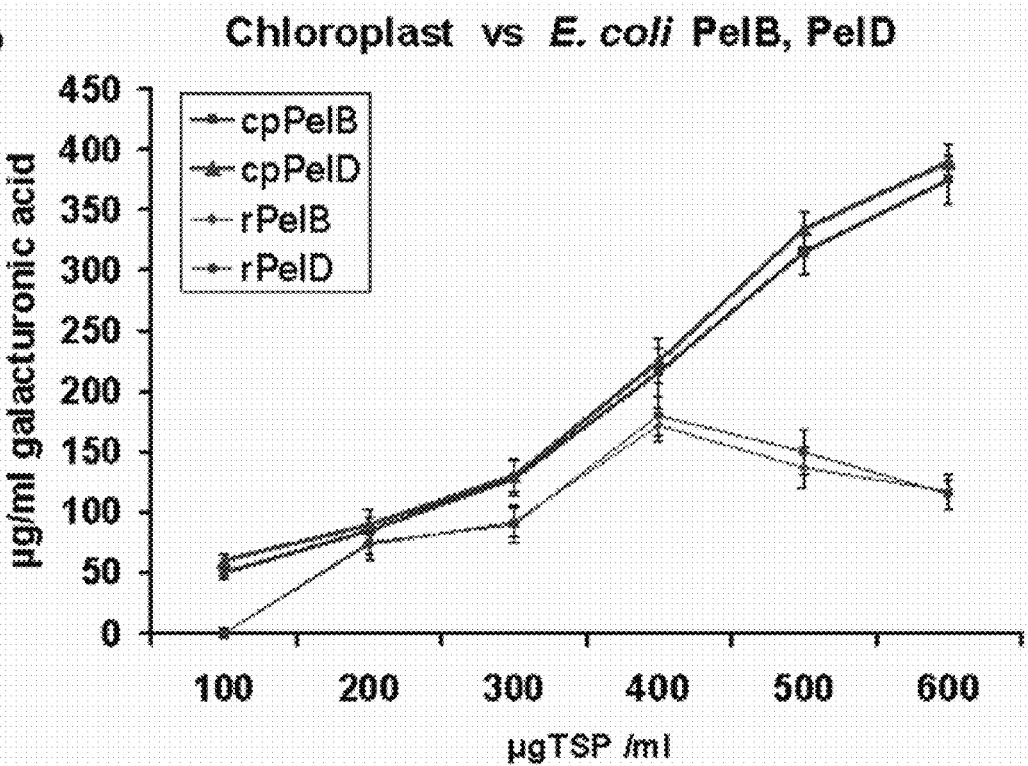

PRODUCTION AND USE OF PLANT DEGRADING MATERIALS

CROSS-REFERENCE TO RELATED APPLICATIONS

This application is related to U.S. Provisional Patent Application No. 61/032,536 filed Feb. 29, 2008 to which priority is claimed under 35 USC 119 and is incorporated by reference.

GOVERNMENT RIGHTS

This invention was made with government support under grant no. 2009-39200-19972 awarded by the United States Department of Agriculture/National Institute of Food and Agriculture; under grant no. GM063879 awarded by the National Institute of Health; and under grant no. 58-3611-7-610 awarded by the United States Department of Agriculture/Agricultural Research Service. The government has certain rights in the invention.

BACKGROUND

The composition and diversity of biomass for producing cellulosic ethanol requires multiple enzyme systems, in very high concentrations, to release constituent sugars from which cellulosic ethanol is made. All currently available enzymes for cellulosic ethanol are produced in expensive fermentation systems and are purified in a process very similar to biopharmaceuticals like insulin. Therefore, reagent grade enzymes for ethanol production are extremely expensive. For example, B-glucosidase, pectolyase and cellulase are currently sold by Novozyme through the Sigma catalog for $124,000, $412,000 and $40,490 per kg, respectively. These enzymes are sold as formulations to biorefineries without disclosing the actual enzyme components. Therefore, the actual cost for each enzyme, sold in bulk quantities, is not publicly available. Most industrial estimates for enzymes to produce cellulosic ethanol are in the $2 to $3 per gallon range, making large scale use cost prohibitive. Current capacity of fermentation systems will also be a major limitation. With increase in demand for enzymes and limited production capacity, the enzyme cost is likely to increase further.

A major limitation for the conversion of this biomass to ethanol is the high cost and large quantities of enzymes required for hydrolysis. B-glucosidase, pectolyase and cellulase are currently sold by Novozyme or other industries through the Sigma catalog for $124,000, $412,000 and $40,490 per kg, respectively. Therefore, the US DOE has long identified the cost of enzymes and their high loading levels required for most lingo-cellulosic feedstocks as one of the major barriers to cellulosic ethanol production. Currently, all commercially-available enzymes are produced through a fermentation process. Unfortunately, the building and maintenance of the fermentation production process is very expensive, costing $500M-$900M in upfront investment. No viable alternative to fermentation technology has yet emerged for mass-producing critical, yet prohibitively expensive industrial enzymes. This void in the marketplace for an alternative process is addressed directly by this proposal.

BRIEF DESCRIPTION OF DRAWINGS

FIG. 2 Western blot analysis and quantitation of transplastomic lines. Western blot of transplastomic lines expressing (a) PelB or (b) PelD. UT: untransformed, mature leaves harvested at 10 AM, 2 PM, 6 PM and 10 PM; 5 ng, 10 ng and 25 ng: PelA purified protein, young, mature and old leaves. (c) Enzyme units of PelB and PelD (c) or CelD (d) from one g or 100 mg leaf of different age or harvesting time.

FIG. 4 E. coli vs chloroplast derived enzymes at different protein concentrations of crude extracts. (a) Enzyme kinetics of cpCelD and rCelD using carboxymethyl cellulose (2%) substrate. The reaction mixture contained increasing concentration of cpCelD and rCelD TSP (μg/ml) with 10 mM $CaCl_2$ and 50 mM sodium acetate buffer, pH 6.0. Enzyme hydrolysis was carried out for 30 minutes at 60° C. Figure inset shows enzyme kinetics saturation point for cpCelD TSP amount (μg/ml) towards CMC (2%). Eppendorf tubes with reaction mixture shown in inset represents, 1 untransformed plant, 2 and 3 rCelD and cpCelD 10 μg TSP. (b) Effect of cpPelB, cpPelD, rPelB, and rPelD on hydrolysis of 5.0 mg/ml sodium polygalacturonate substrate. The reaction mixture contained increasing concentration of cpPelB, cpPelD, rPelB, and rPelD (μg/ml) in 20 mM Tris-HCl buffer (pH 8.0). Sodium polygalacturonate (Sigma) was measured using DNS method and measured from the D-galacturonic acid standard graph. Enzyme hydrolysis was carried out for 2 hour at 40° C. on rotary shaker at 150 rpm.

GENERAL DESCRIPTION

Figure 1:
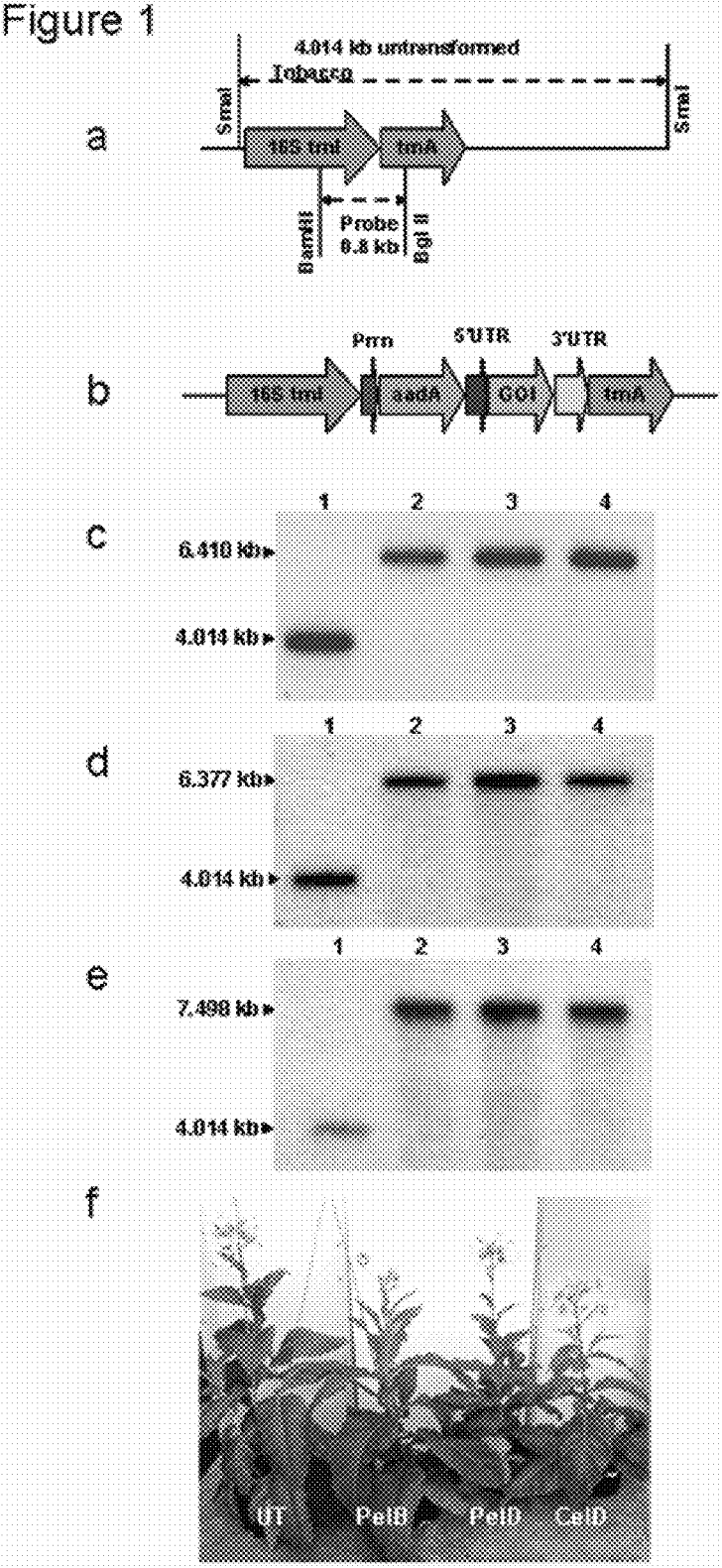
FIG. 1 (a) Schematic representation of the chloroplast 16S trnI/trnA region. Transgenes were inserted at the trnI/trnA spacer region in the tobacco chloroplast genome. (b) Schematic representation of the chloroplast transformation vectors. The gene of interest (GOI) is celD, celO, pelA, pelB, pelD, cutinase, lipY, egl1, egl, swo1, xyn2, axe1 or bgl1. Prrn, rRNA operon promoter; aadA, aminoglycoside 3'-adenylytransferase gene confers resistance to spectinomycin; 5' UTR, promoter and 5' untranslated region of psbA gene; 3' UTR, 3' untranslated region of psbA gene. (c) Evaluation of transgene integration and homoplasmy by Southern blot of pelB, (d) pelD and (e) celD transplastomic lines hybridized with the flanking sequence probe (1, untransformed; 2 to 4, transplastomic lines). (f) Phenotypes of untransformed (UT) and transplastomic lines grown in green house showing normal growth.

Certain embodiments of the invention address the major problems discussed above by producing all required enzymes in plants or bacteria or a combination of both, thereby dramatically alleviating the cost of fermentation and purification. According to one embodiment, the invention pertains to a method of degrading a plant biomass sample so as to release fermentable sugars therein. The method involves obtaining a plant degrading cocktail comprising at least two cell extracts, each cell extract having an active plant degrading compound that was recombinantly expressed in cells from which each said cell extract is derived. The at least two cell extracts are either plant extracts or bacterial extracts, or a combination of both. The plant degrading cocktail is admixed with the biomass sample to release fermentable sugars. In a more specific embodiment, the plant degrading cocktail includes cell extracts that include plant degrading enzymes such as cellulase, ligninase, beta-glucosidase, hemicellulase, xylanase, alpha amylase, amyloglucosidase, pectate lyase, lipase, maltogenic alpha-amylase, pectolyase, or compounds that facilitate access of such enzymes, or so called, accessory plant degrading compounds, including but not limited to cutinase or expansin (e.g. swollenin). The inventors have found that such accessory plant degrading compounds serve to facilitate the action of plant degrading enzymes which synergistically elevates the amount of fermentable sugars produced for any given biomass sample.

Plant cell extracts will in most cases include an amount of ribulose-1,5-bisphosphate carboxylase_oxygenase (rubisco) from the plant cells from the plant cell extracts are derived. Rubisco is the most prevalent enzyme on this planet, accounting for 30-50% of total soluble protein in the chloroplast; it fixes carbon dioxide, but oxygenase activity severely limits photosynthesis and crop productivity (Ogren, W. L. (2003) *Photosynth. Res.* 76, 53-63, 2. Spreitzer, R. J. & Salvucci, M. E. (2002) *Annu. Rev. Plant Biol.* 53, 449-475). Rubisco consists of eight large subunits (LSUs) and eight small subunits (SSUs). The SSU is imported from the cytosol, and both subunits undergo several posttranslational modifications before assembly into functional holoenzyme (Houtz, R. L. & Portis, A. R. (2003) *Arch. Biochem. Biophys.* 414, 150-158.).

The use of genetic transformation of plants is generally not considered a viable alternative to the conventional fermentation processes for producing plant degrading enzymes in light of the fact that the expressed proteins would be deleterious to plant life and growth. The inventors have endeavored to devise a method of expressing plant degrading enzymes in such a way that does not disrupt the plant cell. It is the inventors' belief that the present invention is the first demonstration of viable plant degrading enzyme expression in plants. The inventors have realized that the expression of many plant degrading enzymes can be expressed in chloroplasts without adverse effects on the plant. The chloroplasts appear to insulate the plant cell from damage from the enzymes. Though expression in chloroplasts is exemplified herein, unless specifically stated, embodiments of the present invention should not be construed to be limited to chloroplast expression of plant degrading enzymes. Certain embodiments related to a combination of plant and bacterial extracts from cells engineered to recombinantly express plant degrading compound(s).

The term "recombinantly expressed" as used herein refers to production of a polypeptide from a polynucleotide that is heterologous to the cell in which the polynucleotide has been transfected. Recombinant expression may result from heterologous polynucleotides that are stably transformed in the genome of the cell, or genome of the cell organelle, or which are merely present in the cell via a transfection event.

The term chloroplast is interpreted broadly to cover all plastids, including proplastids, etioplasts, mature chloroplasts, and chromoplasts.

A comprehensive cellulase system consists of endoglucanases, cellobiohydrolases and beta glucosidases. The cellobiohydrolases and endoglucanases work synergistically to degrade the cellulose into cellobiose, which is then hydrolysed to glucose by the beta glucosidases. Cellobiase, or beta-glucosidase, activity is responsible for the formation of glucose from cellobiose and plays an important role in cellulose degradation by relieving the end product (cellobiose) inhibition. Gene sequences for most of these enzymes, from different microorganisms, have been deposited in public data bases.

Pectins, or pectic substances, are collective names for a mixture of heterogeneous, branched and highly hydrated polysaccharides present as one of the major components in plant cell walls. These polysaccharides comprise mostly neutral sugars, such as arabinan, galactan, and arabino galactan. Activepectolytic enzyme preparations have the following enzymes: Two alpha-L-rhamnohydrolases, polygalacturonase, pectin methylesterase, endo-pectate lyase (pectintranseliminase), pectin lyase and small percent of xylanase. Nucleotide sequence for pectin degrading enzymes, xylanases, cellulases are available in public data bases. See Example 9 herein for discussion on sequences.

The inventor has realized that enzyme requirements are very different for each type of biomass used in cellulosic ethanol production. Accordingly, certain embodiments of the present invention relate to cocktails of enzymes obtained from plant expression and/or bacteria expression that the inventors have developed to be particularly effective for the targeted biomass material.

Biomass sources that can be degraded for ethanol production in accordance with the teachings herein, include, but are not limited to, grains such as corn, wheat, rye, barley and the grain residues obtained therefrom (primarily leftover material such as stalks, leaves and husks), sugar beet, sugar cane, grasses such as switchgrass and *Miscanthus*, woods such as poplar trees, eucalyptus, willow, sweetgum and black locust, among others, and forestry wastes (such as chips and sawdust from lumber mills). Other biomasses may include, but are not limited to, fruits including citrus, and the waste residues therefrom, such as citrus peel.

Throughout this document, tobacco is referred to as an exemplary plant for expressing plant degrading enzymes. However, unless specifically stated, embodiments of the invention should not be construed to be limited to expression in tobacco. The teachings of gene expression taught herein can be applied to a wide variety of plants, including but not limited to tobacco; lettuce, spinach; sunflower; leguminous crops such as soybean, beans, peas, and alfalfa; tomato; potato; carrot; sugarbeet; cruciferous crops; fibre crops such as cotton; horticultural crops such as gerbera and chrysanthemum; oilseed rape; and linseed.

In one embodiment, genes from *Aspergillusniger, Aspergillus aculeatus, Trichodermareesei* andor *Clostridium thermocellum* encoding different classes of enzymes are isolated using gene specific primers. In order to express different classes of genes in a chloroplast of interest, the following strategies are used. The chloroplast vector contains flanking sequences from the chloroplast genome to facilitate homologous recombination. In one embodiment, foreign genes are integrated individually into the spacer region of chloroplast genome. The coding sequence of different enzymes can be regulated by appropriate regulatory sequences. Recombinant plasmids will be bombarded into tobacco to obtain transplastomic plants.

In a specific embodiment, powdered tobacco leaves are used as enzyme sources for commercial evaluation of ethanol production from a biomass source. In a more specific embodiment, the biomass source is a grain such as corn, a grass, or is citrus waste.

For chloroplasts that are transformed, it has been realized that obtaining homplasmy with respect to the transgenic chloroplasts is desired. The transgene integration and homoplasmy is confirmed by PCR and Southern blot analysis, respectively. Expression of the transgenes is confirmed by western blot analysis and quantified by ELISA. The protein extract from transplastomic tobacco plants is tested for its ability to degrade citrus waste biomass. Based on the results, more enzyme classes are added to increase the breakdown of plant biomass to sugars for fermentation to ethanol. Each tobacco plant, engineered to produce an enzyme, will be able produce a million seeds, to facilitate scale up to 100 acres, if needed. Homogenized plant material, such as powdered tobacco leaves or plant extracts, or purified enzymes from plant material are used as the enzyme source for commercial evaluation of ethanol production from citrus waste.

While current methods involve placing a foreign gene in the plant cell nucleus, CT transforms the genome of the approximately 100 chloroplasts that are within each tobacco plant cell. Each tobacco plant chloroplast contains about 100 copies of the chloroplast's genetic material, so the amount of protein (in this case, enzyme proteins used to break down biomass into sugar for ethanol production) is increased exponentially. This is the primary reason why massive volume production of cell wall degrading enzymes for cellulosic ethanol production is so cost effective. Secondly, tobacco has large volume biomass (40 metric tons of leaves per acre) and it can be harvested multiple times during a given growing season in Florida. And, as previously mentioned, it is easy to plant 100 acres from a single tobacco plant. Lastly, because chloroplasts are inherited maternal, they are not functional in the tobacco plant's pollen.

According to one embodiment, the invention pertains to a method of degrading a plant biomass sample to release fermentable sugars. The method includes obtaining a plant degrading cocktail having at least one chloroplast genome or genome segment having a heterologous gene that encodes cellulase, ligninase, beta-glucosidase, hemicellulase, xylanase, alpha amylase, amyloglucosidase, pectate lyase, cutinase, lipase or pectolyase, or a combination thereof, and wherein said plant material has cellulase, ligninase, beta-glucosidase, hemicellulase, xylanase, alpha amylase, amyloglucosidase, pectate lyase, cutinase, lipase, maltogenic alpha-amylase, pectolyase or expansin, or a combination thereof, that has been expressed in a plant from which said plant material is derived; and admixing said plant degrading material with said biomass sample. In a more specific embodiment, the enzyme or combination of enzymes pertains to more than 0.1 percent of the total protein in the plant material.

According to another embodiment, the invention pertains to a method of producing a plant biomass degrading material sufficient to release fermentable sugars, the method including producing at least one plant comprising chloroplasts that express cellulase, ligninase, beta-glucosidase, hemicellulase, xylanase, alpha amylase, amyloglucosidase, pectate lyase, cutinase, lipase, maltogenic alpha-amylase, pectolyase, or expansin, or a combination thereof; harvesting said plant; and processing said plant to produce an enzyme source suitable for mixing with and degrading a biomass sample. In a specific embodiment the plant is tobacco; lettuce, spinach; sunflower; fibre crops such as cotton; horticultural crops such as gerbera and chrysanthemum; leguminous crops such as soybean, beans, peas, and alfalfa; tomato; potato; sugarbeet; cruciferous crops, including oilseed rape; and linseed. In a more specific embodiment, plant is tobacco.

One aspect of the invention is to provide an abundant inexpensive source of enzyme for degrading biomass. Accordingly, the plant or bacterial material in which plant degrading compounds have been expressed may be processed by drying and powderizing the plant or a portion thereof. In another embodiment, crude liquid extracts are produced from the plant and/or bacterial material. In alternative embodiments, the plant degrading material may be enzymes that have been purified fully or partially from the plant and/or bacteria in which they are expressed. However, providing the plant degrading material as a dry form or as crude extract of the plant and/or bacterial material avoids the need for time-consuming and potentially expensive purification steps. In this way, the plant material has a longer shelf life and may easily be mixed with the plant biomass sample according to conventional plant degrading and fermenting processes.

In one specific embodiment, the method of producing a plant entails producing a first plant with chloroplasts transformed to express a first enzyme and a second plant with chloroplasts transformed to express a second enzyme. Plant material from both first and second plants may be combined to produce a plant degrading sample that includes more than one plant degrading enzyme. In a more specific embodiment, the invention pertains to a method of producing a plant that entails at least two of the following: producing a first plant comprising chloroplasts that express cellulase, producing a second plant comprising chloroplasts that express lignanse, producing a third plant comprising chloroplasts that express beta-glucosidase; producing a fourth plant comprising chloroplasts that express hemicellulase; producing a fifth plant comprising chloroplasts that express xylanase; producing a sixth plant comprising chloroplasts that express alpha-amylase; producing a seventh plant comprising chloroplasts that express amyloglucosidase; producing an eighth plant comprising chloroplasts that express pectate lyase; producing a ninth plant comprising chloroplasts that express cutinase; producing a tenth plant comprising chloroplasts that express lipase; producing an eleventh plant comprising chloroplasts that express maltogenic alpha amylase, producing a twelfth plant comprising chloroplasts that express pectolyase and/or a thirteenth plant comprising chloroplasts that express expansin (e.g. swollenin).

As alluded to above, the inventors have recognized that according to certain embodiments, plant derived enzymes are augmented with plant degrading enzymes recombinantly expressed in bacteria. Thus, a plant degrading cocktail may include enzymes recombinantly expressed in plants and enzymes that are recombinantly expressed in bacteria, such as but not limited to E. coli.

According to a further embodiment, the invention pertains to a plant material useful for degrading a plant biomass, the material including at least one chloroplast genome or genome segment having a heterologous gene that encodes cellulase, ligninase, beta-glucosidase, hemicellulase, xylanase, alpha amylase, amyloglucosidase, pectate lyase, cutinase, lipase, maltogenic alpha-amylase, pectolyase, or expansin, or a combination thereof; and wherein said plant material comprises cellulase, ligninase, beta-glucosidase, hemicellulase, xylanase, alpha amylase, amyloglucosidase, pectate lyase, cutinase, lipase, maltogenic alpha-amylase, pectolyase, or expansin, or a combination thereof. In a more specific embodiment, the plant material includes at least two of the following: a first chloroplast genome or genome segment having a heterologous gene that encodes cellulase, a second chloroplast genome or genome segment having a heterologous gene that encodes lignanse, a third chloroplast genome or genome segment having a heterologous gene that encodes beta-glucosidase; a fourth chloroplast genome or genome segment having a heterologous gene that encodes hemicellulase; a fifth chloroplast genome or genome segment having a heterologous gene that encodes xylanase; a sixth chloroplast genome or genome segment having a heterologous gene that encodes alpha-amylase; a seventh chloroplast genome or genome segment having a heterologous gene that encodes amyloglucosidase; an eighth chloroplast genome or genome segment having a heterologous gene that encodes pectate lyase; a ninth plant chloroplast genome or genome segment having a heterologous gene that encodes cutinase; a tenth chloroplast genome or genome segment having a heterologous gene that encodes lipase; an eleventh chloroplast genome or genome segment that encodes maltogenic alpha-amylase, a twelfth chloroplast genome or genome segment having a heterologous gene that encodes pectolyase and a thirteenth chloroplast genome or genome segment having a heterologouse gene that encodes expansin (e.g. swollenin).

According to another embodiment, the invention pertains to a plant having a plant cell having a more than natural amount of cellulase, ligninase, beta-glucosidase, hemicellulase, xylanase, alpha amylase, amyloglucosidase, pectate lyase, cutinase, lipase pectolyase or expansin, or a combination thereof, and wherein said plant material comprises cellulase, ligninase, beta-glucosidase, hemicellulase, xylanase, alpha amylase, amyloglucosidase, pectate lyase, cutinase, lipase, pectolyase, or expansin, or a combination thereof, active enzyme therein. In a more specific embodiment, the enzyme or combination of enzymes represents is more than 0.1 percent of the total protein of the cell. In an even more specific embodiment the enzyme or combination of enzymes represent more than 1.0 percent of the total protein in the cell.

In a further embodiment, the invention pertains to a plant derived composition comprising cellulase, ligninase, beta-glucosidase, hemicellulase, xylanase, alpha amylase, amyloglucosidase, pectate lyase, cutinase, lipase, maltogenic alpha-amylase, pectolyase and/or swollenin, and an amount of rubisco. In a specific embodiment, the rubisco to enzyme ratio ranges from 99:1 to 1:99.

In an additional embodiment, the invention pertains to commercial cultivars that recombinantly express one or more plant degrading compounds. Commercial cultivars of tobacco, such as, but not limited to, LAMD and TN90, produce substantially more leaf material than experimental cultivars. However, commercial cultivars are more sensitive to introduction of foreign genes. Surprisingly, the inventor, through significant trial and error, has been able to successfully transfect cells and induce expression of plant degrading compounds in commercial cultivars.

EXAMPLES

Example 1: Assembly of Chloroplast Expression Constructs

For the integration of transgenes, transcriptionally active spacer region between the trnI and trnA genes was used (FIG. 1a). PCR resulted in the amplification of various genes of interest (GOI) including endoglucanase (celD), exoglucanase (celO) from *Clostridium thermocellum* genomic DNA, lipase (lipY) from *Mycobacterium tuberculosis* genomic DNA, pectate lyases (pelA, pelB, pelD) and cutinase from *Fusarium solani*. Using a novel PCR based method, coding sequences of GOI including endoglucanases (egl1 and egI), swollenin (swo1 similar to expansins), xylanase (xyn2), acetyl xylan esterase (axe1) and beta glucosidase (bgl1) were cloned without introns (ranging from 1-5) from *Trichoderma ressei* genomic DNA. Tobacco chloroplast transformation vectors were made with each GOI (FIG. 1b). All chloroplast vectors included the 16S trnI/trnA flanking sequences for homologous recombination into the inverted repeat regions of the chloroplast genome and the aadA gene conferring resistance to spectinomycin. The aadA gene was driven by the constitutive rRNA operon promoter with GGAGG ribosome binding site. The GOI was driven by the psbA promoter and 5' UTR in order to achieve high levels of expression. The 3' UTR located at the 3' end of the GOI conferred transcript stability.

Example 2: Generation and Characterization of Transplastomic Tobacco Expressing Pectate Lyases (PelB & PelD) and Endoglucanase (CelD)

Transplastomic tobacco plants were obtained as described previously[28, 29]. Southern blot analysis was performed to confirm site specific integration of the pLD-pelB, pLD-pelD and pLD-celD cassettes into the chloroplast genome and to determine homoplasmy. Digestion of total plant DNA with SmaI from untransformed and transplastomic lines generated a 4.014 kb fragment untransformed (UT) or 6.410 kb in pelB, 6.377 kb in pelD or 7.498 kb fragment in celD when hybridized with the [$^{32}$P]-labeled trnI-trnA probe, confirming site specific integration of the transgenes into the spacer region between the trnI and trnA genes (FIG. 1c-e). Furthermore, the absence of a 4.014 kb fragment in the transplastomic lines confirmed that homoplasmy was achieved (within the levels of detection). The phenotypes of transplastomic lines appeared to be normal when compared to untransformed plants and were fertile (produced flowers, seeds FIG. 1f).

Immunoblots with antibodies raised against PelA showed that PelB and PelD are immunologically related to PelA[30]. Therefore, PelA antibody was used to detect the expression of PelB and PelD, although their affinity was variable in transplastomic lines. All transplastomic lines showed expression of PelB or PelD protein. Expression levels did not change significantly corresponding to their enzyme activity depending on the time of harvest even though the PelB and PelD are regulated by light (FIG. 2a,b). This may be because of variable affinity between antigen epitopes of PelB, PelD and PelA antibody. Enzyme concentration slightly changed with leaf age and decreased in older leaves (FIG. 2a,b).

Example 3: Quantification of Pectate Lyases (PelB, PelD), and Endoglucanase (CelD) at Different Harvesting Time and Leaf Age The activity of the enzyme varied significantly depending on the developmental stages and time of leaf harvest. Maximum enzyme activity was observed in mature leaves of PelB, PelD and CelD, with reduced activity in older leaves (FIG. 2c,d). Mature leaves harvested at 6 PM showed maximum activity in both PelB and PelD whereas CelD showed maximum activity at 10 PM (FIG. 2c,d). This may be due to increased stability of endoglucanase against proteases in plant extracts. Activity of cpCelD did not significantly decrease in plant crude extracts stored at room temperature, for more than thirty days (data not shown).

CelD enzyme activity was calculated using DNS reagent[31] according to the IUPAC protocol[32]. The specific activity of cpCelD using 2% CMC substrate was 493 units/mg total soluble protein (TSP) or 100 mg leaf tissue, in crude extracts prepared from mature leaves harvested at 10 PM. Using the glucose hexokinase assay, which is highly specific for glucose, the specific activity was 4.5 units/mg TSP and 6.28 units/mg TSP, when 5% avicel and sigmacell solution respectively was used as substrate (at pH 6.0, 60° C.). Commercial cellulase enzyme (*Trichoderma reesei*, EC 3.2.1.4, Sigma) gave 4.2 units/mg and 3.43 units/mg solid for the same substrate. FIGS. 2c and 2d show that approximately 26 units, 32 units and 4,930 units of PelB, PelD and CelD were obtained per gram fresh weight of mature leaves harvested at 6 PM or 10 PM. Thus, 2,048, 2,679 and 447,938 units of PelB, PelD and CelD can be harvested from each tobacco plant (experimental cultivar, Petit Havana). With 8,000 tobacco plants grown in one acre of land, 16, 21 and 3,584 million units of PelB, PelD or CelD can be obtained per single cutting (Table 1). Based on three cuttings of tobacco in one year, up to 49, 64 and 10,751 million units of PelB, PelD or CelD can be harvested each year. The commercial cultivar yields 40 metric tons biomass of fresh leaves as opposed to 2.2 tons in experimental cultivar Petit Havana. Therefore, the commercial cultivar is expected to give 18 fold higher yields than the experimental cultivar.

Figure 3:
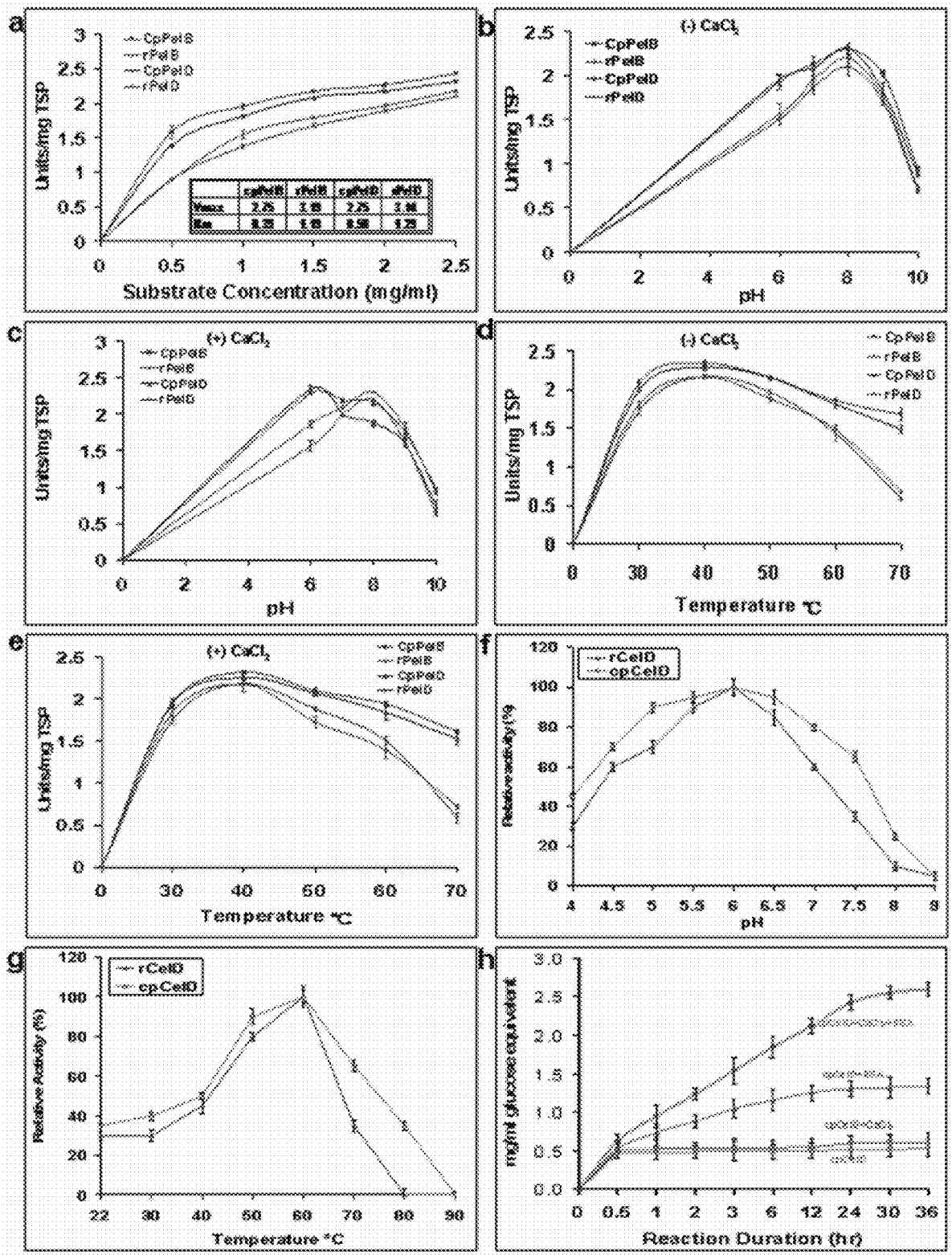
FIG. 3 Effect of substrate, pH, temperature and cofactors on cpPelB, rPelB, cpPelD, rPelD, rCelD and cpCelD enzyme activity. (a) Effect of increasing PGA concentration on pectate lyases activity. (b) Effect of pH on pectate lyases activity in the absence of $CaCl_2$ and (c) in the presence of $CaCl_2$. The buffers used were following: 50 mM phosphate buffer (pH 6-7), Tris-HCl buffer (pH 8), glycine/NaOH buffer (pH 9) and CAPS buffer (pH 10.0) with 4 μg of TSP of PelB and PelD from both plant and E. coli. The optimal pH was determined at 40° C. using 2.5 mg/ml PGA as a substrate. (d) Effect of temperature (30-70° C.) on enzyme activity at pH 8.0 in the absence of $CaCl_2$ and (e) in the presence of $CaCl_2$. (f) Optimization of pH for cpCelD and rCelD activity using CMC (2%) at 60° C. for 30 minutes. Relative activity (%) was measured with reference to maximum activity obtained with 25 μg/ml for cpCelD and 10 μg/ml for rCelD (g) Effect of increasing temperature on relative activity of cpCelD and rCelD using CMC (2%) for 30 minutes at pH 6.0. Relative activity (%) was measured with reference to maximum activity obtained with 25 μg/ml for cpCelD and 10 μg/ml for rCelD (h) Enhancement of cpCelD (25 μg TSP/ml reaction) activity using 10 mM $CaCl_2$ and 20 μg/ml BSA individually or in combination with 50 mM sodium acetate during the prolonged enzymatic hydrolysis. The hydrolysis was carried out up to 36 hours at 60° C., pH 6.0 in the presence of CMC (2%)

Example 4: Effect of pH & Temperature on Pectate Lyases (PelB & PelD) and Endoglucanase (CelD) Enzyme Activity Both plant and *E. coli* extracts showed optimal activity at 2.5 mg/ml PGA (FIG. 3a). Therefore, all enzyme characterization studies were performed at this substrate concentration. Kinetic studies carried out by using 4 µg of TSP, with increasing concentration of PGA (0-2.5 mg), under standard assay conditions gave Km values of 0.39 and 1.19 µg/ml in chloroplast (cp) and *E. coli* (r) PelB respectively, whereas values for chloroplast and *E. coli* PelD were 0.50 and 1.29 µg/ml respectively. The Vmax values obtained were 2.75, 3.19, 2.75 and 3.14 units/mg for cpPelB, rPelB, cpPelD and rPelD, respectively (FIG. 3a).

The crude extract (4-5 µg TSP) from plant or *E. coli* was used to study the effect of pH and temperature on the activity of enzymes. The optimal temperature for the *E. coli* and chloroplast derived pectate lyase under the standard assay conditions was 40° C. and the optimal pH was 8.0. Plant derived pectate lyases showed a pH optimum of 6.0 in the presence of 1 mM CaCl$_2$. The *E. coli* crude extracts showed an optimal pH of 8.0 irrespective of presence or absence of CaCl$_2$ in the reaction (FIG. 3b,c). The temperature increase had minimal effect on the activity of plant derived pectate lyases, whereas the *E. coli* enzyme showed comparatively lower activity at higher temperatures (FIG. 3d,e). These differences in enzyme properties from two different hosts may be due to their folding. This possibility was supported by the observation that it was possible to detect the *E. coli* enzyme with HIS-tag antibody but not the chloroplast enzyme (data not shown). It is well known that foreign proteins form disulfide bonds in chloroplasts[33-35] but not in *E. coli* when expressed in the cytoplasm. Both PelB and PelD enzymes have even number (12 or 14) cysteines that could form disulfide bonds[30].

CpCelD activity with 2% CMC was measured at different pH and temperature. The cpCelD showed pH optima between pH 5.0 to pH 7.0 (FIG. 3f) whereas E. coli enzyme had a pH optimum of 6.5. Temperature optima was between 50-60° C. for E. coli and 50-70° C. for plant enzyme (FIG. 3g). Clostridium thermocellum CelD is structurally known to have affinity for $CaCl_2$ ions and it also provided thermostability[36]. Even though 10 mM $CaCl_2$ increased CelD activity in 2% CMC to 2 fold in E. coli crude extract, this was not apparent in chloroplast CelD crude extract during initial period of incubation. This may be due to optimum concentration of calcium ion present in plant cells. However, $CaCl_2$ with 20 µg BSA yielded 5 fold increased activity at the end of 24 hour incubation for cpCelD crude extract (FIG. 3h).

Example 5: E. coli vs Chloroplast CelD, PelB & PelD

E. coli crude extract containing CelD enzyme showed decrease in enzyme activity when the reaction mixture contained more than 10 µg TSP, where as plant crude extract containing CelD released more reducing sugar with increasing protein concentration (FIG. 4a). Chloroplast expressed CelD activity was saturated (in 2% CMC) at 150 µg TSP (FIG. 4a inset) and there was no decrease in chloroplast CelD enzyme activity even up to 500 µg TSP as determined by end point assay. These results show that crude plant extracts containing cpCelD can be directly used for biomass degradation without any need for purification whereas E. coli extracts probably contain endoglucanase inhibitors. Similarly, at higher protein concentrations, E. coli expressed rPelB and rPelD showed reduced pectate lyase activity whereas cpPelB or cpPelD continued to increase activity even up to 600 µg TSP (FIG. 4b). There may be inhibitors of pectate lyase in E. coli extracts, which are not present in plant crude extracts. This finding is potentially of high practical significance because use of crude extracts eliminates the need for purification of enzymes. Large amounts of crude plant enzyme can be utilized in the cocktail as shown below without causing detrimental effect on enzyme activity, hydrolysis or yield of end products.

Example 6: Enzyme Cocktail for Hydrolysis of Filter Paper

Figure 5:
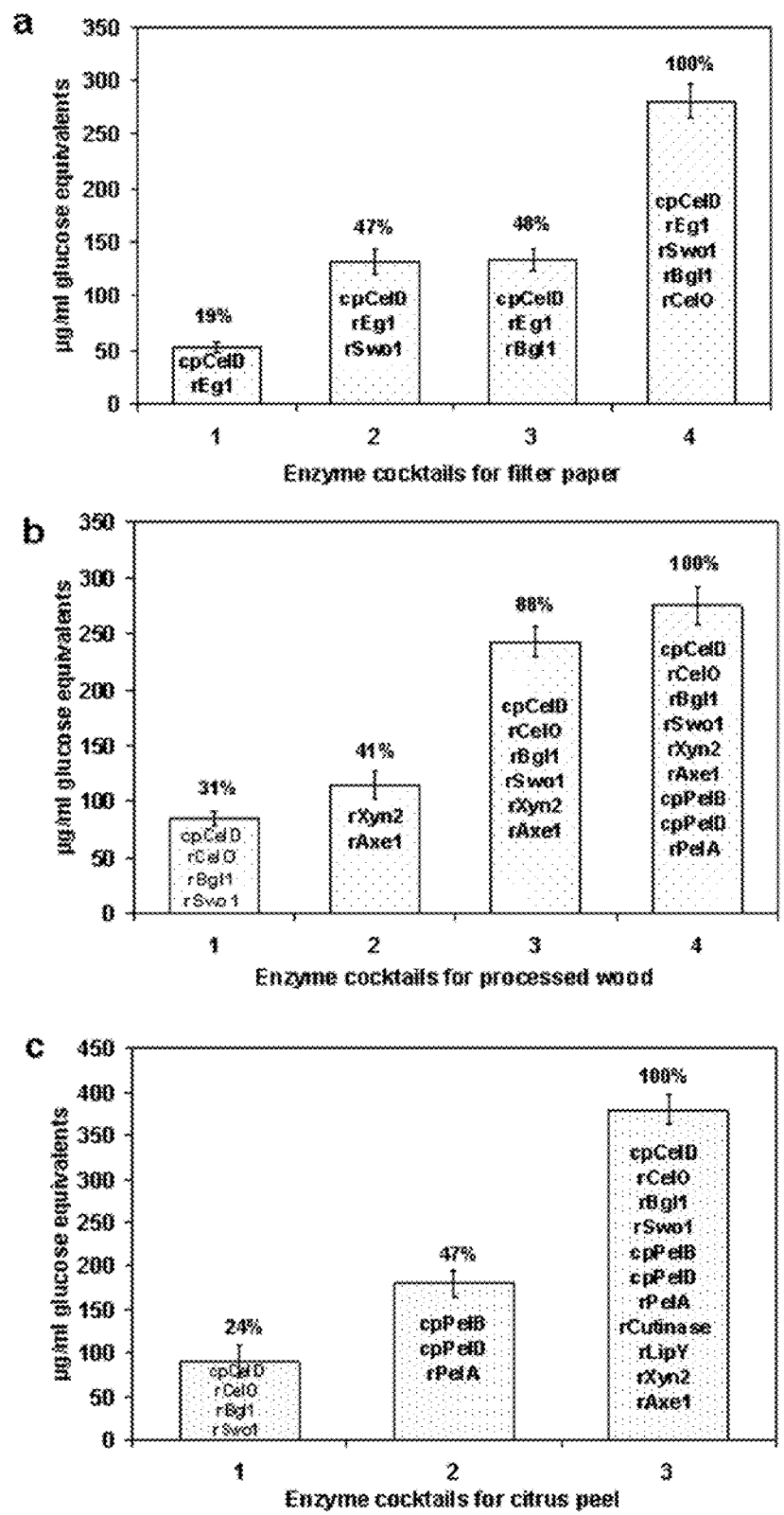
FIG. 5 Enzyme cocktails for filter paper, processed wood and citrus peel. (a) Filter paper activity was determined using Whatman No. 1 filter paper strip (50 mg/ml assay) at pH 5.5 and 50° C. Different combinations of crude extracts containing rEg1 (100 μg/ml), rBgl1 (200 μg/ml), rSwo1 (120 μg/ml), rCelO (100 μg/ml) and cpCelD (100 μg/ml) were used in the cocktail. The samples were incubated with 10 mM $CaCl_2$, 20 μg BSA in a rotary shaker at 150 rpm for 24 hours. (b) Hydrolysis of processed wood sample (200 mg/5 ml reaction) was done by using a cocktail of crude extracts of cpPelB (250 μg/ml), cpPelD (250 μg/ml) (at pH 8.0), cpCelD (200 μg/ml), cpXyn2 (200 μg/ml), rEg1 (100 μg/ml), rBgl1 (200 μg/ml), rSwo1 (120 μg/ml), rCelO (100 μg/ml), rAxe1 (100 μg/ml), rPelA (200 μg/ml), rCutinase (50 μg/ml), rLipY (100 μg/ml). The reaction mixture containing 10 mM $CaCl_2$, 20 μg/ml BSA was incubated for 36 hours in a rotary shaker at 150 rpm; pH (5.5-8.0) and temperature (40° C.-50° C.) were adjusted based on optimal conditions. Endpoint analysis of release of glucose equivalents was determined using DNS method. (c) Hydrolysis of Valencia orange peel (200 mg/5 ml reaction) was done using a cocktail of crude extracts of cpPelB (250 μg/ml), cpPelD (250 μg/ml) cpCelD (100 μg/ml) and cpXyn2 (100 μg/ml), reg1 (100 μg/ml), rBgl1 (200 μg/ml), rSwo1 (120 μg/ml), rCelO (100 μg/ml) and cpCelD (100 μg/ml), rAxe2 (100 μg/ml), rCutinase (50 μg/ml), rLipY (100 μg/ml), rPelA (200 μg/ml). End product analysis of reducing sugar was determined using DNS reagent[31] and D-glucose and D-galacturonic acid as standards. Ampicillin and kanamycin 100 μg/ml was added to prevent any microbial growth during hydrolysis. The samples were incubated with 10 mM $CaCl_2$, 20 μg/ml BSA in a rotary shaker at 150 rpm for 24 hours; pH (5.5-8.0) and temperature (40° C.-50° C.) were adjusted based on optimal conditions. In all experiments control assays contained substrate without enzyme or enzyme without substrate. All experiments and assays were carried out in triplicate.

Before evaluation of enzyme cocktails, activity of each enzyme was tested independently with an appropriate substrate. Chloroplast or E. coli expressed endoglucanase (cpCelD or rEg1) alone did not release any detectable glucose from filter paper but when mixed together up to 19% of total hydrolysis was observed (FIG. 5a, bar1). This could be due to different carbohydrate binding domains of endoglucanases towards filter paper. The synergistic activity was further enhanced up to 47 or 48% when the endoglucanases (cpCelD and rEg1) were mixed with swollenin (rSwo1) or beta-glucosidase (rBgl1, FIG. 5a, bar2&3). Addition of cellobiohydrolase (rCelO) to this cocktail doubled the hydrolysis of filter paper, releasing maximum amount of reducing sugar (FIG. 5a, bar4). This synergism observed was probably due to the exo-mode of action of cellobiohydrolase[37] from reducing ends that were formed by random cuts in cellulose chains through endoglucanases (cpCelD and rEg1), along with the action of expansin and beta-glucosidase.

Example 7: Enzyme Cocktail for Hydrolysis of Processed Wood Sample

The enzyme cocktail that released highest glucose equivalents with filter paper (except rEg1) was tested on processed wood substrate. After 24 hour hydrolysis, 31% of total hydrolysis was observed with this cocktail (FIG. 5b, bar1). An enzyme cocktail of endoxylanase and acetyl xylan esterase showed 41% of total hydrolysis (FIG. 5b, bar2). When these two cocktails were combined together, the hydrolysis increased up to 88% (FIG. 5b, bar3). When processed wood substrate was first treated with pectate lyases, followed by the addition of the enzyme cocktail in bar 3, the overall hydrolysis was further enhanced, with release of up to 275 µg of glucose after 36 hour incubation (FIG. 5b, bar4). Addition of cutinase and lipase enzyme extracts (both with lipase activity) did not have significant effect on the release of fermentable sugars (data not shown). Novozyme 188 enzyme cocktail did not yield any detectable glucose equivalents from processed wood, whereas Celluclast 1.5 L yielded 10% more than the crude extract cocktail, with equivalent enzyme units based on CMC hydrolysis.

According to one embodiment, the invention pertains to a method for digesting a wood-based biomass sample comprising obtaining a plant material comprising endoxylanase or acetyl xylan esterase, or a combination thereof, that has been expressed in a plant from which all or a portion of said plant material is derived; and admixing said plant material with said wood based biomass sample. The method of this embodiment may further include admixing with the wood-based biomass sample, either prior to or contemporaneous to, admixture with the endoxylanase and/or acetyl xylan esterase plant material, a plant material comprising a pectate lyase that has been expressed in a plant from which all or a portion of said plant material is derived. The plant material may comprise rubisco.

Another embodiment pertains to a plant degrading enzyme cocktail useful in digesting a wood-based biomass sample comprising cellulase, beta-glucosidase, xylanase, alpha amylase, amyloglucosidase, pectin lyase, swollenin or pectate lyase, or a combination thereof expressed in a plant, optionally with an amount of rubisco.

Example 8: Enzyme Cocktail for Hydrolysis of Citrus Waste

The enzyme cocktail of endoglucanase (cpCelD), exoglucanase, swollenin and beta-glucosidase released up to 24% of total hydrolysis with citrus peel (FIG. 5c, bar1). When citrus peel was treated with pectate lyases (cpPelB, cpPelD and rPelA), hydrolysis was doubled (FIG. 5c, bar2). Pectate lyases contributed to 47% of total hydrolysis in this cocktail because of high pectin content (23%) in citrus peel[41]. Addition of endoxylanase, acetyl xylan esterase, cutinase and lipase to the both these cocktails released up to 360 µg/ml glucose equivalents from 100 mg ground citrus peel after 24 hour incubation period (FIG. 5c, bar3). Enzymes like cutinase and lipase may have hydrolyzed oil bodies present in the citrus peel, providing greater access to endoglucanase, endoxylanase and pectate lyases for efficient hydrolysis of citrus peel. Novozyme 188 enzyme cocktail yielded 11% more glucose equivalents with citrus peel, whereas Celluclast 1.5 L yielded 137% more than the crude extract cocktail with equivalent enzyme units based on CMC hydrolysis.

According to one embodiment, the invention pertains to a method for digesting a citrus biomass sample comprising obtaining a plant material comprising cellulase, beta-glucosidase, xylanase, alpha amylase, amyloglucosidase, pectin lyase or pectate lyase, or a combination thereof, that has been expressed in a plant from which all or a portion of said plant material is derived; and admixing said plant material with said citrus biomass sample.

Another embodiment pertains to a plant degrading enzyme cocktail useful in digesting a citrus biomass sample comprising cellulase, beta-glucosidase, xylanase, alpha amylase, amyloglucosidase, pectin lyase, swollenin or pectate lyase, or a combination thereof expressed in a plant, optionally with an amount of rubisco.

Methods Related to Examples 1-8

Isolation of Genes and Construction of Plastid Transformation Vectors

Genomic DNA of *Clostridium thermocellum* and *Trichoderma reesei* was obtained from ATCC and used as template for the amplification of different genes. Gene specific primers using a forward primer containing a NdeI site and a reverse primer containing a XbaI site for cloning in the pLD vector were designed for celD, celO and lipY genes. The mature region of cellulose genes celD (X04584) and celO (AJ275975) were amplified from genomic DNA of *Clostridium thermocellum*. LipY (NC_000962) was amplified from genomic DNA of *Mycobacterium tuberculosis*. Overlapping primers were designed for the amplification of various exons of egl1 (M15665), egI (AB003694), swoI (AJ245918), axe1 (Z69256), xyn2 (X69574) and bgl1 (U09580) from genomic DNA of *Trichoderma reesei* using a novel method. Full length cDNA of these genes was amplified from different exons by a novel PCR based method using the forward of first exon and reverse of last exon containing a NdeI site and XbaI site respectively. Pectate lyase genes pelA, pelB & pelD from *Fusarium solani* with similar restriction sites were amplified using gene specific primers from pHILD2A, pHILD2B[30] and pHILD2D[45] respectively. A similar strategy was used to amplify cutinase gene[46] from recombinant clone of *Fusarium solani*. All the full length amplified products were ligated to pCR Blunt II Topo vector (Invitrogen) and were subjected to DNA sequencing (Genewiz). Each gene cloned in Topo vector was digested with NdeI/XbaI and inserted into the pLD vector[17, 47] to make the tobacco chloroplast expression vector.

Regeneration of Transplastomic Plants and Evaluation of Transgene Integration by PCR and Southern Blot

*Nicotiana tabacum* var. Petite Havana was grown aseptically on hormone-free Murashige and Skoog (MS) agar medium containing 30 g/l sucrose. Sterile young leaves from plants at the 4-6 leaf stages were bombarded using gold particles coated with vector pLD-PelB, pLD-PelD and pLD-CelD and transplastomic plants were regenerated as described previously[28, 29]. Plant genomic DNA was isolated using Qiagen DNeasy plant mini kit from leaves. PCR analysis was performed to confirm transgene integration into the inverted repeat regions of the chloroplast genome using two sets of primers 3P/3M and 5P/2M, respectively[17]. The PCR reaction was performed as described previously[17, 29]. Leaf from the PCR positive shoots were again cut into small pieces and transferred on RMOP (regeneration medium of plants) medium containing 500 mg/l spectinomycin for another round of selection and subsequently moved to MSO (MS salts without vitamins and growth hormones) medium containing 500 mg/l spectinomycin for another round of selection to generate homoplasmic lines. Southern blot analysis was performed to confirm homoplasmy according to lab protocol[48]. In brief, total plant genomic DNA (1-2 μg) isolated from leaves was digested with SmaI and hybridized with $^{32}P$ α[dCTP] labeled chloroplast flanking sequence probe (0.81 kb) containing the trnI-trnA genes. Hybridization was performed by using Stratagene QUICK-HYB hybridization solution and protocol.

Immunoblot Analysis

Approximately 100 mg of leaf was ground in liquid nitrogen and used for immunoblot analysis as described previously[48]. Protein concentration was determined by Bradford protein assay reagent kit (Bio-Rad). Equal amounts of total soluble protein were separated by SDS-PAGE and transferred to nitrocellulose membrane. The transgenic protein expression was detected using polyclonal serum raised against PelA in rabbit.

*E. coli* Enzyme (Crude) Preparation

*E. coli* strain (XL-10 gold) harboring chloroplast expression vectors expressing rCelD, rEg1 (EC 3.2.1.4), rCelO (EC 3.2.1.91), rXyn2 (EC 3.2.1.8), rAxe1 (EC 3.1.1.72), rBgl1 (EC 3.2.1.21), rCutinase (EC 3.1.1.74), rLipY (lipase, EC 3.1.1.3), rPelA, rPelB, rPelD (EC 4.2.2.2) or rSwo1 was grown overnight at 37° C. Cells were harvested at 4° C. and sonicated four times with 30 s pulse in appropriate buffer (50 mM sodium acetate buffer with pH 5.5 for CelD, Eg1, CelO, Swo1, Xyn2, Axe1, Bgl1, 100 mM Tris-Cl with pH 7.0 for cutinase, lipase, PelA, PelB and PelD) containing protease inhibitor cocktail (Roche) and sodium azide (0.02%). Supernatant was collected after centrifugation at 16,000×g for 10 minutes and protein concentration was determined.

Enzyme Preparation from Tobacco Transplastomic Leaf Material

Fresh green leaves were collected and ground in liquid nitrogen. Total soluble protein was extracted in 50 mM sodium acetate buffer, pH 5.5 for cpCelD, cpXyn2 or 100 mM Tris-Cl buffer, pH 7.0 for PelD and PelB. All buffers contained protease inhibitor cocktail (Roche) and sodium azide (0.02%). Total soluble protein was filtered using 0.22 μm syringe filter, Protein concentration (mg/ml) in TSP was determined using Bradford method.

Enzyme Assays for Pectate Lyase B and Pectate Lyase D

Pectate lyases B and D were assayed spectrophotometrically by measuring the increase in $A_{235}$[30, 49, 50]. Kinetics of the pectate lyase B and D were studied to optimize substrate concentration (0.0-2.5 mg) under identical protein and cofactor concentration. The reaction mixtures contained 1 ml of 50 mM Tris-HCl buffer (pH 8.0) with 1 mM $CaCl_2$ (freshly prepared), 1 ml of 0.0-2.5 mg/ml sodium polygalacturonate (Sigma) and 0.5 ml of suitably diluted enzyme solution. Measurements were carried out at 40° C. One unit of enzyme was defined as the amount of enzyme which forms 1 μmol of product per min with a molar extinction coefficient of 4,600 $\mu mol^{-1}$ $cm^{-1}$. Kinetic studies were carried out in 50 mM Tris-HCl buffer, pH 8.0 at 40° C. Kinetic parameters (Km & Vmax) were calculated using non linear regression using Graphpad Prism 5.0. The initial slopes of each substrate concentration were calculated, where as the velocity (units/mg/min) was defined through the release of unsaturated galacturonic acid. The temperature optimization for pectate lyase B and D activity was carried out in 50 mM Tris-HCl buffer, pH 8.0 at different temperatures ranging from 30° C. to 70° C. In each case, the substrate was pre-incubated at the desired temperature for 5 min. In order to study the thermal stability of the enzyme, buffered enzyme samples were incubated for fixed time period at different temperatures.

The pH optimum of the pectate lyase B and D was measured at 40° C. using different buffers ranging from pH 6 to 10, with the same ionic strength. The stability of the crude extract of the enzyme was optimized by incubating the enzyme at the different pH. The influence of the cofactor CaCl$_2$ on pectate lyase activity was studied by conducting the reactions in its presence and absence at different pH and temperature.

Enzyme Assay for CelD and Commercial Cocktail (Celluclast 1.5 L and Novozyme 188)

Cellulase enzyme activity of cpCelD was determined by incubating crude extract in 2% carboxylmethylcellulose, avicel and sigmacell (Sigma) as substrate according to IUPAC recommendations[32] in 50 mM sodium acetate buffer pH 6.0 and incubated at 60° C. for 30 minutes for CMC and 2 hours for avicel and sigmacell. Enzyme units of commercial cocktails Celluclast 1.5 L and Novozyme 188 were determined using 2% CMC, under identical assay conditions. Reducing sugar amount was determined using 3,5-dinitrosalicylic acid[31]. D-glucose and D-galacturonic acid were used as standard to measure release of glucose equivalents and unsaturated galacturonic acid molecules. CMC (2%) was used in determining the pH and temperature activity profile of cpCelD. One unit of enzyme was defined as the amount of enzyme that released 1 µmole glucose equivalents per minute/ml. Cellulase unit calculation for avicel and sigmacell was based on glucose hexokinase method according to the manufacturer's protocol (Sigma).

Enzymatic Hydrolysis of Filter Paper, Processed Wood and Citrus Peel

Enzyme assays were carried out either with one enzyme component or as cocktail on filter paper, processed wood and orange peel and released reducing sugar was determined using DNS method. Orange peel prepared from Valencia orange (*Citrus sinensis* cv Valencia) fruit was air dried overnight and ground in liquid nitrogen. Ground Valencia orange peel and pretreated wood biomass were washed several times in distilled water until no reducing sugar was detected by DNS reagent as well as by glucose hexokinase method.

For enzymatic digestion, 50-200 mg of processed wood sample or ground orange peel was used. Crude extracts containing enzymes from *E. coli* and plants were used in the cocktail for hydrolysis. End product reducing sugar was determined using DNS reagent[31] and D-glucose as standard. Ampicillin and kanamycin 100 µg/ml was added to prevent any microbial growth during the long durations of enzyme hydrolysis. Commercial enzyme cocktails Celluclast 1.5 L and Novozyme 188 were tested for hydrolysis of citrus peel and processed wood in the same assay conditions used for enzyme cocktails from crude extracts. Enzyme units of Celluclast 1.5 L and Novozyme 188 used for hydrolysis assays were equivalent to cpCelD enzyme units (based on CMC hydrolysis) present in cocktails of crude extracts. In all experiments control assays contained substrate without enzyme or enzyme without substrate. All experiments and assays were carried out in triplicate.

The inventors have used coding sequences from bacterial or fungal genomes to create chloroplast vectors. A novel PCR based method was used to clone ORFs without introns from fungal genomic DNA. *E. coli* expression system was used to evaluate functionality of each enzyme independently or their efficacy in enzyme cocktails before creating transgenic lines; enzymes of fungal origin were active without any need for post-translational modifications (disulfide bonds or glycosylation). The phenotypes of homoplasmic transplastomic lines were normal and produced flowers & seeds. Based on three cuttings of tobacco in one year, 49, 64 and 10,751 million units of pectate lyase and endoglucanase activity can be obtained each year in an experimental cultivar. This yield could be increased 18-fold when these enzymes are produced in commercial cultivars. Based on USDA Economic Research Service, the cost of production of Burley tobacco in 2004 was $3,981 per acre. Because most enzymes for hydrolysis of plant biomass are active at higher temperatures, it is feasible to harvest leaves and sun dry them, as reported previously for chloroplast derived xylanase[25]. Based on enzyme activity observed in plant crude extracts in this study, there is no need for purification. Therefore, excluding processing cost, enzymes could be produced as low as 0.008 cents for PelB, 0.006 cents for PelD per enzyme unit (as defined in the commercial source Megazyme). This is 925-1,233 fold less expensive for pectate lyase B & D, when compared with current commercial cost (Megazyme produced from *C. japonicus*). While this cost or yield comparison may not be the same for all chloroplast-derived enzymes, this concept provides a promising new platform for inexpensive enzyme cocktails to produce fermentable sugars from lignocellulosic biomass.

To the best of our knowledge, this is the first study using enzyme cocktails expressed in plants for hydrolysis of lignocellulosic biomass to produce fermentable sugars and direct comparison of enzyme properties produced via fermentation or in planta, using identical genes and regulatory sequences. Majority of enzyme hydrolysis studies on natural substrates like pretreated wood, corn stover or wheat straw have used commercially available enzymes[3, 42] or purified recombinant enzymes spiked with purified commercial enzymes[40, 43]. Accurate comparison of crude extract enzyme cocktails with commercial cocktails is not possible because of their unknown enzyme compositions. Therefore, equivalent enzyme units based on CMC hydrolysis was used as a basis for general comparison. ACCELLERASE™ 1000 (Genencor) was not available for this study because of required institutional agreements. Novozyme 188 purified enzyme cocktail did not yield any detectable glucose equivalents from processed wood and 11% more glucose equivalents with citrus peel, whereas Celluclast 1.5 L yielded 10% and 137% more with both biomass substrates than the crude extract cocktail, with equivalent enzyme units based on CMC hydrolysis. It is not surprising that crude extract cocktails performed equal to or better than purified enzyme cocktails because the later are produced by submerged fermentation from selected fungal strains that secerete several enzymes, simultaneously. According to Novozymes, a careful design of a combination of single component enzymes is necessary for rational utilization of these enzyme cocktails[44].

Example 9: Expression of Plant Degrading Enzymes

The teachings set forth in Examples 1-8 may be adapted for preparing expression cassettes of the heterologous gene, constructing transformation vectors; transforming chloroplasts and chloroplast expression any of a numerous list of enzymes that the inventors have identified will be helpful in degrading plant biomass sources. Also, Applicants refer to U.S. Patent Pubs 20070124830 and 20060117412 for techniques of chloroplast transformation and expression of proteins.

A non-limiting list of exemplary enzymes includes the following in Table I:

TABLE I

GOI (Genes of Interest)

1. Endoglucanases
   a) celD (*Clostridium thermocellum*)
   b) egI (*Trichoderma reesei*)
   c) egl1 (*Trichoderma reesei*)
2. Exoglucanase
   a) celO (*Clostridium thermocellum*)
3. Lipase
   a) lipY (*Mycobacterium tuberculosis*)
4. Pectate lyases
   a) pelA (*Fusarium solani*)
   b) pelB (*Fusarium solani*)
   c) pelD (*Fusarium solani*)
5. Cutinase
   a) cut (*Fusarium solani*)
6. Swollenin similar to expansins
   a) swo1 (*Trichoderma reesei*)
7. Xylanase
   a) xyn2 (*Trichoderma reesei*)
8. Acetyl xylan esterase
   a) axe1 (*Trichoderma reesei*)
9. Beta glucosidase
   a) bgl1 (*Trichoderma reesei*)
10. Mannanase
    a) man1 (*Trichoderma reesei*)
11. Arabinofuranosidase
    a) abf1 (*Trichoderma reesei*)
12. Lignin peroxidase
    a) lipJ (*Mycobacterium tuberculosis*)

In addition to the above list, attached table II-VII set forth a list of different enzymes that may be used in conjunction with embodiments of the invention. The EC nos. are recognized designations found on the world wide web at chem.qmul.ac.uk and NV-IUBMB) defining each of the cross references to relevant polypeptide sequences and encoding polynucleotide sequences. Accession Nos. pertain to identifications sequences in either Genbank (one letter followed by five digits, e.g. M12345) or the RefSeq format (two letters followed by an underscore and six digits, e.g., NT_123456). Each of the sequences and related accession nos. are stored in the Corenucleotide division of the GenBank database system. An accession no. listed on table II-VII for a specific gene can be easily found by inputting the accession number in the search field of the Entrez system found at ncbi.nlm.nih.gov.on the world wide web In a specific embodiment, the sequences of the accession nos. specifically listed in tables II-VI include those in their original state or as revised/updated in the Genbank system as of Feb. 28, 2008. In other embodiments, it is contemplated that sequences may be revised/updated after Feb. 28, 2008 but otherwise recognized by the art as the more accurate sequence of the accession no. compared to the sequence stored prior to Feb. 28, 2008. In these other embodiments, sequences as revised but recognized as the true sequence and having at least a 95% sequence identity to the sequence as stored in database prior to Feb. 28, 2008 shall be considered as the sequence for the relevant accession no.

Applicants also incorporate by reference the ASCII text file entitled 10669-034 seqid filed with the present application. This text file contains sequence information of the accessions nos listed in Tables II-VII.

In addition, nucleotides and peptides having substantial identity to the nucleotide and amino acid sequences relating plant degrading enzymes (such as those provided in tables II-VII) used in conjunction with present invention can also be employed in preferred embodiments. Here "substantial identity" means that two sequences, when optimally aligned such as by the programs GAP or BESTFIT (peptides) using default gap weights, or as measured by computer algorithms BLASTX or BLASTP, share at least 50%, preferably 75%, and most preferably 95% sequence identity. Preferably, residue positions which are not identical differ by conservative amino acid substitutions. For example, the substitution of amino acids having similar chemical properties such as charge or polarity are not likely to effect the properties of a protein. Non-limiting examples include glutamine for asparagine or glutamic acid for aspartic acid.

The term "variant" as used herein refers to nucleotide and polypeptide sequences wherein the nucleotide or amino acid sequence exhibits substantial identity with the nucleotide or amino acid sequence of Attachment B, preferably 75% sequence identity and most preferably 90-95% sequence identity to the sequences of the present invention: provided said variant has a biological activity as defined herein. The variant may be arrived at by modification of the native nucleotide or amino acid sequence by such modifications as insertion, substitution or deletion of one or more nucleotides or amino acids or it may be a naturally occurring variant. The term "variant" also includes homologous sequences which hybridise to the sequences of the invention under standard or preferably stringent hybridisation conditions familiar to those skilled in the art. Examples of the in situ hybridisation procedure typically used are described in (Tisdall et al., 1999); (Juengel et al., 2000). Where such a variant is desired, the nucleotide sequence of the native DNA is altered appropriately. This alteration can be made through elective synthesis of the DNA or by modification of the native DNA by, for example, site-specific or cassette mutagenesis. Preferably, where portions of cDNA or genomic DNA require sequence modifications, site-specific primer directed mutagenesis is employed, using techniques standard in the art.

In specific embodiments, a variant of a polypeptide is one having at least about 80% amino acid sequence identity with the amino acid sequence of a native sequence full length sequence of the plant degrading enzymes provided on the attached 10669-034SEDID ASCII file. Such variant polypeptides include, for instance, polypeptides wherein one or more amino acid residues are added, or deleted, at the N- and/or C-terminus, as well as within one or more internal domains, of the full-length amino acid sequence. Fragments of the peptides are also contemplated. Ordinarily, a variant polypeptide will have at least about 80% amino acid sequence identity, more preferably at least about 81% amino acid sequence identity, more preferably at least about 82% amino acid sequence identity, more preferably at least about 83% amino acid sequence identity, more preferably at least about 84% amino acid sequence identity, more preferably at least about 85% amino acid sequence identity, more preferably at least about 86% amino acid sequence identity, more preferably at least about 87% amino acid sequence identity, more preferably at least about 88% amino acid sequence identity, more preferably at least about 89% amino acid sequence identity, more preferably at least about 90% amino acid sequence identity, more preferably at least about 91% amino acid sequence identity, more preferably at least about 92% amino acid sequence identity, more preferably at least about 93% amino acid sequence identity, more preferably at least about 94% amino acid sequence identity, more preferably at least about 95% amino acid sequence identity, more preferably at least about 96% amino acid sequence identity, more preferably at least about 97% amino acid sequence identity, more preferably at least about 98% amino acid sequence identity and yet more preferably at least about 99% amino acid sequence identity with a polypeptide encoded by a nucleic acid molecule shown in Attachment B or a specified fragment thereof. Ordinarily, variant polypeptides are at least about 10 amino acids in length, often at least about 20 amino acids in length, more often at least about 30 amino acids in length, more often at least about 40 amino acids in length, more often at least about 50 amino acids in length, more often at least about 60 amino acids in length, more often at least about 70 amino acids in length, more often at least about 80 amino acids in length, more often at least about 90 amino acids in length, more often at least about 100 amino acids in length, or more.

"Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured DNA to re-anneal when complementary strands are present in an environment below their melting temperature. The higher the degree of desired identity between the probe and hybridizable sequence, the higher the relative temperature which can be used. As a result, it follows that higher relative temperatures would tend to make the reaction conditions more stringent, while lower temperatures less so. For additional details and explanation of stringency of hybridization reactions, see Ausubel et al., Current Protocols in Molecular Biology, Wiley Interscience Publishers, (1995).

"Stringent conditions" or "high stringency conditions", as defined herein, are identified by those that: (1) employ low ionic strength and high temperature for washing, 0.015 M sodium chloride/0.0015 M sodium citrate/0.1% sodium dodecyl sulfate at 50° C.; (2) employ during hybridization a denaturing agent, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42 degrees C.; or (3) employ 50% formamide, 5×SSC (0.75 M NaCl, 0.075 M sodium citrate), 50 mM sodium phosphate (pH 6.8), 0.1% sodium pyrophosphate, 5.times. Denhardt's solution, sonicated salmon sperm DNA (50 μg/ml), 0.1% SDS, and 10% dextran sulfate at 42 degrees C., with washes at 42 degrees C. in 0.2×SSC (sodium chloride/sodium citrate) and 50% formamide at 55 degrees C., followed by a high-stringency wash consisting of 0.1×SSC containing EDTA at 55 degrees C.

"Moderately stringent conditions" are identified as described by Sambrook et al., Molecular Cloning: A Laboratory Manual, New York: Cold Spring Harbor Press, 1989, and include the use of washing solution and hybridization conditions (e.g., temperature, ionic strength and % SDS) less stringent that those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5×Denhardt's solution, 10% dextran sulfate, and 20 mg/ml denatured sheared salmon sperm DNA, followed by washing the filters in 1×SSC at about 37-50 degrees C. The skilled artisan will recognize how to adjust the temperature, ionic strength, etc. as necessary to accommodate factors such as probe length and the like.

Typically, for stringent hybridization conditions a combination of temperature and salt concentration should be chosen that is approximately 12-20° C. below the calculated $T_m$ of the hybrid under study. The $T_m$ of a hybrid between an polynucleotide having a nucleotide sequence shown in SEQ ID NO: 1 or the complement thereof and a polynucleotide sequence which is at least about 50, preferably about 75, 90, 96, or 98% identical to one of those nucleotide sequences can be calculated, for example, using the equation of Bolton and McCarthy, Proc. Natl. Acad. Sci. U.S.A. 48, 1390 (1962):

$$T_m = 81.50° C. - 16.6(\log_{10}[Na^+]) + 0.41(\% G+C) - 0.63(\% \text{ formamide}) - 600/l),$$

where l=the length of the hybrid in basepairs.
In a specific embodiment, stringent wash conditions include, for example, 4×SSC at 65° C., or 50% formamide, 4×SSC at 42° C., or 0.5×SSC, 0.1% SDS at 65° C. Highly stringent wash conditions include, for example, 0.2×SSC at 65° C.

Example 10: Optimization of Recombinant Expressed Enzyme Cocktails

Having demonstrated by several examples that plant-degrading enzymes can be expressed in plants and bacteria, cocktails of enzymes can be produced that are especially adapted for degrading a targeted class of biomass. The inventors have discovered that certain combinations of selected enzymes are capable of hydrolyzing biomass materials in a synergistic fashion. For example, it has been discovered that two or more enzymes from a particular class work synergistically to degrade targeted material in biomass to increase the yield of fermentable sugars achieved. Based on the known composition of a target biomass sample, more than one enzyme in a particular class is included in the plant degrading cocktail. Furthermore, the amount of enzyme of a specific enzyme class known to degrade a specific compound in a biomass sample is increased relative to other enzyme in the cocktail as a function of the ratio of the specific compound/mass of biomass sample. General information concerning exemplary classes of enzymes are discussed below in relationship to the type of substrates on which they act. Equipped with the teachings and techniques discussed herein, one skilled in the art is able to determine cocktails suitable for a given biomass, and methods by which synergy of the enzymes in the cocktails can be determined.

Enzyme Assays

Most enzyme assays were determined spectrophotometrically by measuring the increase in $A_{235}$[30, 47, 48]. Enzyme kinetics were studied to optimize substrate concentration (0-2.5 mg) under identical protein and cofactor concentrations. The reaction mixtures contained appropriate buffers, substrates and standard enzymes when commercially available. Measurements are made at different temperatures and pH. One unit of enzyme is defined as the amount of enzyme which forms 1 μmol of product per min with appropriate molar extinction coefficient. Kinetic parameters (Km & Vmax) are calculated using non linear regression using Graphpad Prism 5.0. The initial slopes of each substrate concentration are calculated where as the velocity (units/mg/min) is defined through the release of appropriate product. The temperature optimization is determined in proper buffers with required co-factors, substrates at optimal pH. In order to study the thermal stability of each enzyme, buffered enzyme samples are incubated for fixed time periods at different temperatures. Similarly, the pH optimum of each enzyme are measured at optimal temperatures using different buffers ranging from pH 6 to 10, with the same ionic strength. The stability of the crude extract of the enzyme is optimized by incubating the enzyme at the different pH. The influence of various cofactors for optimal enzyme activity is studied by conducting the reactions in the presence or absence of each cofactor, at different pH and temperature.

Endoglucanase, Cellobiohydralase and Beta-Glucosidase:

Cellulose is the most abundant renewable bioresource produced in the biosphere through photosynthetic process (~100 billion dry tons/year)[49-51]. Cellulose biodegradation by cellulases and cellulosomes, produced by numerous microorganisms, represents a major carbon flow from fixed carbon sinks to atmospheric CO2 and studies have shown that the use of biobased products and bioenergy can achieve zero net carbon dioxide emission[52, 53]% Cellulose is a linear condensation polymer consisting of D-anhydroglucopyranose joined together by β-1,4-glycosidic bonds with a degree of polymerization (DP) from 100 to 20,000. Approximately 30 individual cellulose molecules are assembled into larger units known as elementary fibrils (protofibrils), which are packed into larger units called microfibrils, and these are in turn assembled into large cellulose fibers[54, 55]. The breakdown of biomass involves the release of long-chain polysaccharides, specifically cellulose and hemicellulose, and the subsequent hydrolysis of these polysaccharides into their component 5- and 6-carbon chain sugars[15]. One of the most important and difficult technological challenges is to overcome the recalcitrance of natural lignocellulosic materials, which must be enzymatically hydrolyzed to produce fermentable sugars[2, 7, 8, 56, 57].

The mechanism of cellulose degradation involves three enzyme classes of cellulase. These include endoglucanases or 1,4-β-D-glucan-4-glucanohydrolases (EC 3.2.1.4) exoglucanase or 1,4-β-D-glucan cellobiohydrolases (E.C. 3.2.1.91), and β-glucosidase or β-glucoside glucohydrolases (E.C. 3.2.1.21)[55, 58, 59]. The combined actions of endoglucanases and exoglucanases modify the crystalline nature of cellulose surface over time, resulting in rapid changes in hydrolysis rates.[60] The inventor has realized that the simultaneous action of these enzyme class on cellulose substrate completely breaks down the intramolecular β-1,4-glucosidic bonds of cellulose chains. This results in release of large amount of fermentable glucose molecules.

Endoglucanases (e.g CelD, Eg1): Endoglucanases cut at random at internal amorphous sites in the cellulose polysaccharide chain, generating oligosaccharides of various lengths and consequently expose new chain ends. Exoglucanases (e.g. CelO, Cbh2): Exoglucanases or cellobiohydrolases acts processively on the reducing or nonreducing ends of cellulose polysaccharide chains, liberating either glucose (glucanohydrolases) or cellobiose (cellobiohydrolase) as major products. Cellobiohydralases can also act on amorphous and microcrystalline cellulose structure having exposed cellulose chain ends. β-Glucosidases (e.g., BglA, Bgl1): It hydrolyze soluble cellobiose as well as longer cellodextrins molecules to glucose.

CelD, Egl1, EG1 (endo-glucanases) and CelO (cellobiohydrolase): Substrate: Carboxylmethylcellulose (2%) beta D-glucan (10 mg/ml), microcrystalline cellulose, Avicel, Sigma cellulose (all 50 mg/ml). At least two dilutions are made for each enzyme sample investigated in 50 mM sodium acetate buffer containing 10 mM $CaCl_2$ and 20 µg BSA. In the assay, one dilution should release slightly more and one slightly less than 0.5 mg (absolute amount) of glucose. The sample is incubated at appropriate temperature for 30 minutes after adding 0.5 ml of substrate solution. After incubation, 0.5 ml of DNS is added to 0.5 ml of the reaction mixture followed by boiling for exactly 5 minutes in a boiling water bath along with enzyme blanks and glucose standards. Following boiling, 166 µl of 40% Rochelle salt is added and transferred immediately to a cold water bath not more than 30 minutes. The tube is mixed by inverting several times so that the solution separates from the bottom of the tube at each inversion. The mixture is measured at 575 nm in a spectrometer. The absorbance is translated (corrected if necessary by subtracting of the blank) into glucose production during the reaction using a glucose standard curve graph. Enzyme unit is defined as the amount of enzyme required to liberate 1.0 µmol per minute.[32]

Bgl1 (*Trichoderma reesei*): Beta-Glucosidase Assays: Substrate: Cellobiose, 2-15 Mm in Sodium Acetate Buffer pH 4.8

At least two dilutions are made of each enzyme sample investigated. One dilution should release slightly more and one slightly less than 1.0 mg (absolute amount) of glucose in the reaction conditions. Add 1.0 ml of enzyme dilution in sodium acetate buffer pH 4.8 to 1.0 ml of cellobiose substrate. Incubate at 50° C. for 30-120 minutes. Stop assay by boiling in water bath for 5 minutes. Determine liberated glucose using glucose hexokinase (Sigma) method. One unit of enzyme is defined as 1.0 µmol of glucose released per minute from cellobiose. Substrate: 2-15 mM para-nitrophenyl D-glucoside in sodium acetate buffer pH 4.8. Add 0.3 ml of diluted enzyme solution to 0.6 ml 50 mM sodium acetate buffer and 0.3 ml para-nitrophenyl D-glucoside. Carry out the reaction at 50° C. for 10 minutes. Stop the reaction with 1M Na2CO3. Spectrophometrically measure the liberated p-nitrophenol at 410 nm using p-nitrophenol as standard. Construct the calibration curve for p-nitrophenol in the concentration range of 0.02-0.1 mM. Enzyme unit is defined as the amount of enzyme required to liberate 1.0 µmol of p-nitrophenol per min from pNPG.

Xylanase

Endo-xylanses: Xylan is one of the major components of the hemicellulose fraction of plant cell walls and accounts for 20-30% of their total dry mass. Unlike cellulose, xylan is a complex polymer consisting of a β-1,4-linked xylose monomers substituted with side chains. Hydrolysis of the xylan backbone is catalyzed by endob-1,4-xylanases (EC 3.2.1.8) and β-D-xylosidases (EC 3.2.1.37).[61] Endoxylanases are capable of hydrolyzing the internal 1,4-β-bonds of the xylan backbone and thereby produce several xylooligomers of varying length. Complete hydrolysis of xylan involves endo-β-1,4-xylanase, β-xylosidase, and several accessory enzymes, such as a-L-arabinofuranosidase, α-glucuronidase, acetylxylan esterase and ferulic acid esterase.[62, 63] For the biofuel industry, the inventor has realized that xylanases can be used to aid in the conversion of lignocellulose to fermentable sugars (e.g., xylose). Furthermore, hydrolysis of xylan molecules is very important step in the enzymatic hydrolysis hemicellulose and lignocellulosic materials because this gives larger accessibility for cellulases to act on exposed cellulose.

Xylanase Assay[64] (Baily 1989):

Xyn2 (*Trichoderma reesei*)

Substrate: Oat spelt xylan (1%); Birch wood xylan (1%, boil for 5 minutes until dissolved) D-xylose (0.01 to 1 mg/ml xylose) standard graph will be prepared by using DNS method. Assay: The enzyme sample is diluted in 1% xylan suspension with a total volume reaction up to 2 ml. Then the mixture is incubated for 30-120 minutes at 50° C. After incubation, 2 ml of DNS reagent is added to the reaction mixture followed by boiling for 5 minutes. The release of xylose concentration is measured spectrophotometrically at 540 nm. The enzyme unit is calculated by using standard formula[64].

Cutinase:

Cutinase from the phytopathogenic fungus *Fusarium solani* pisi is an example of a small carboxylic ester hydrolase that bridges functional properties between lipases and esterases. Cutin, a polyester composed of hydroxy and hydroxy epoxy fatty acids containing 16 and 18 carbon atoms, is the major structural component of the protective barrier covering the surface of the aerial parts of plants[65, 66]. Cutinases not only degrade cutin polymers but also a large variety of short and long chain triacylglycerols are rapidly hydrolyzed. The enzyme belongs to the family of serine hydrolases containing the so called α/β hydrolase fold.[67, 68] Hydrolyses of cutin, lipase and triacylglycerols molecules that present in large amount in citrus peel waste gives tremendous accessibility for enzymes like pectinases, cellulases and xylanases. Therefore cutinase is important enzyme component in the enzyme hydrolyses of citrus peel for biofuel production.

Cutinase assay[67, 69]: Substrate: p-nitrophenyl butyrate and p-nitrophenyl palmitate (0.01% or 10 mM). The enzyme is extracted from transplastomic plants in 100 mM Tris-HCl buffer (pH7.0) and 0.03% Triton X-100 will be added at the time of initiating enzyme assay. Reactions are performed by incubating for 10-15 min at 30° C. in a tube containing 1 ml of substrate (100 mM Tris-HCl, pH 7, 0.03% Triton X-100, and 0.01% p-nitrophenol butyrate and various amount of enzyme sample (ice cold). Release of p-nitrophenol is measured at 405 nm using p-nitrophenol as standard. Background activity is subtracted from the absorption reading if necessary. One unit of enzyme activity was defined as the amount that degrades 1 μmol of substrate per minute under standard conditions.

Mannanase:

Mannanase is used in the paper and pulp industry, for the enzymatic bleaching of softwood pulp, in the detergent industry as a stain removal booster, in the coffee industry for hydrolysis of coffee mannan to reduce the viscosity of coffee extracts, in oil drilling industry to enhance the flow of oil or gas, in oil extraction from coconut meat, in the textile industry for processing cellulosic fibers and in the poultry industry to improve the nutritional value of poultry feeds.[70]

Cell-wall polysaccharides can be converted into fermentable sugars through enzymatic hydrolysis using enzymes such as cellulases and hemicellulases and the fermentable sugars thus obtained can be used to produce lignocellulosic ethanol. Mannanase is a hemicellulase. Hemicellulose is a complex group of heterogeneous polymers and represents one of the major sources of renewable organic matter. Mannans are one of the major constituent groups of hemicellulose and are widely distributed in hardwoods and softwoods, seeds of leguminous plants and in beans. Hemicelluloses make up 25-30% of total wood dry weight. Hemicelluloses in softwoods are mainly galactoglucomannan, containing mannose/glucose/galactose residues in a ratio of 3:1:1 and glucomannan with mannose/glucose residues in the ratio of 3:1[71]. Mannanases are endohydrolases that cleave randomly within the 1,4-β-D mannan main chain of galactomannan, glucomannan, galactoglucomannan, and mannan. Mannanases hydrolyzes the β-D-1,4 mannopyranoside linkages in β-1, 4 mannans. The main products obtained during the hydrolysis of mannans by β-mannanases are mannobiose and mannotriose. Additional enzymes, such as β-glucosidases and α-galactosidases are required to remove side chain sugars that are attached at various points on mannans. A vast variety of bacteria, actinomycetes, yeasts and fungi are known to produce mannanase. Among bacteria, mostly gram-positive, including various *Bacillus* species and *Clostridia* species and few strains of gram negative bacteria, viz. *Vibrio* and *Bacteroides* have also been reported. The most prominent mannan degrading group among fungi belongs to genera *Aspergillus, Agaricus, Trichoderma* and *Sclerotium*.[70]

The assay procedure for determination of the activity of Mannanase involves the incubation of the crude enzyme extract with the substrate (Galactomannan from Locust bean gum as a substrate). After the enzyme reaction the reducing sugars liberated are quantified and the enzyme activity is measured. Locust bean gum (0.5%) will be dissolved in citrate buffer (pH 5.3) and heated until boiled; this mixture is used as the substrate. The crude enzyme extract is incubated with the substrate at 50° C. for 5 minutes. The reducing sugars liberated in the enzyme reaction is assayed by adding Dinitro salicylic acid-reagent boiling for 5 min, cooling and measuring the absorbance at 540 nm[72].

Another assay method involves carob galactomannan (0.2%) as substrate in sodium acetate buffer (pH 5). Crude enzyme extract is incubated with the substrate at 40° C. for 10 minutes. The reducing sugars liberated are measured by Nelson-Somogyi method and the enzyme activity is quantified[73]. In gel diffusion assay, gel plates are prepared by dissolving 0.05% (w/v) locust bean gum in citrate phosphate buffer (pH 5.0) along with Phytagar. Crude enzyme extract is transferred to the gel plates and incubated for 24 hours. Gels will be stained by using Congo red. Cleared zones (halos) on the plates indicated endo-beta-mannanase activity[74].

Arabinofuranosidase 1 (ABF1)

ABF1 has been shown to have numerous potential uses. L-arabinose is found throughout many different plant tissues in small amounts but strategically placed as side groups. ABF1 facilitates the breakdown of these side chains and cross-linking within the cell wall to work synergistically with other enzymes such as hemicellulases. This can increase the availability of fermentable sugars for biofuel production from biomass or pulp and paper production. This enzyme can increase the digestibility of livestock feed, has been used in the clarification of fruit juices and can aid in the aromatization of wines. Finally, ABF1 has possibilities as a food additive for diabetics due to the sweet taste and inhibitory effect on the digestion of sucrose[75].

ABF1 was isolated from the fungus *T. reesei* and expressed in *Escherichia coli* in the pLD plasmid. The activity of this enzyme is assayed through the use of p-nitrophenyl-α-L-arabinofuranoside substrate in a 0.05M citrate buffer incubated at 50° C. for 10 minutes with enzyme crude extracts from plants or *E. coli*. The reaction is stopped with 1M $Na_2CO_3$ and the resultant p-nitrophenol is measured by spectrophotometer at 400 nm and compared to the positive standard (either p-nitrophenol or ABF, both of which are available commercially) to determine quantity. The pH and temperature optima studies are performed with the same substrate and measured in the same fashion 76. The activity of this enzyme has been known to be inhibited certain metal ions such as $Cu^{2+}$, $Hg^{2+}$, detergents and many chelating and reducing agents.[75]

Lignin Peroxidase (LipJ)

The enzyme Lignin peroxidase, commonly known as LipJ, remains novel and desirable for advancing the production of biofuel enzymes by means of transplastomic tobacco. Expression of LipJ should expand the spectra of exploitable biomass sources by hydrolysis of the inedible lignin and cellulose rich portions of biomass such as corn, sugarcane and wheat. Sources previously occluded as sources for biofuel due their high lignin content e.g. waste lumber, wood chips, peels from commercially prepared fruit and vegetables, could be hydrolyzed with LipJ. LipJ also advances biofuels production by ablating the intricate lignin structures within plant materials from inhibiting access to more valuable biomass substrates that provide valuable commercial, chemical and pharmaceutical products. These products are as of yet, limited in yield because of the protective nature of lignin surrounding them within biomass sources.

LipJ, was isolated from genomic DNA of *Mycobacterium tuberculosis*, expressed in a plasmid functional in both chloroplasts and *E. coli*. Three cultivars of transplastomic tobacco are expressing this vector in the primary selection round and await confirmation of chloroplast expression. Protein assays in *E. coli* have been designed for qualitative & quantitative analysis of LipJ expression, which is optimized for chloroplast derived LipJ.

Lipase (Lip Y)

Lipase Y (LipY), from *Mycobacterium Tuberculosis*, is a water soluble enzyme that catalyzes the hydrolysis of ester bonds and long-chain triacylglycerols, making it an ideal candidate for biofuel production. LipY is a membrane protein for *Mycobacterium Tuberculosis* and studies have already shown a humoral response will occur when LipY is combined with the serum of tuberculosis patients; therefore, LipY has the added benefit of being a potential vaccine for tuberculosis 77.

One simple assay for determining the activity of the cloned gene is a plate assay involving the fluorescent dye rhodamine B and a crude extract of lyses cells. If the gene was properly integrated and the protein folded correctly the assay will display an orange color when illuminated under a specific wavelength of light 80. Another assay measures the release of p-nitrophenol when p-nitrophenylstearate is incubated in various concentrations of *E. coli* or plant cell extract[81].

Example 11: Expression of Plant Degrading Enzymes in Commercial Cultivars

Tobacco chloroplasts were transformed by microprojectile bombardment (biolistic transformation) as described before. Transgene integration was confirmed by PCR analysis using primers used in previous studies. Southern blot analysis was conducted to confirm homoplasmy. Tobacco (*Nicotiana tabacum* var. Petit Havana/LAMD/TN90) seeds were aseptically germinated on MSO medium in Petri dishes. Germinated seedlings were transferred to magenta boxes containing MSO medium. Leaves at 3-7 leaf stage of plant growth were cut and placed abaxial side up on a Whatman filter paper laying on RMOP medium in Petri plates (100×15 mm) for bombardment. Gold microprojectiles (0.6 μm) were coated with plasmid DNA (tobacco chloroplast expression vector) and biolistic mediated transformation were carried out with the biolistic device PDS1000/He (Bio-Rad) as published. After bombardment, leaves were incubated in dark for 48 hours to recover from damage. After 48 hours in dark, the bombarded leaves of Petit Havana (experimental cultivar) or LAMD and TN90 (commercial cultivar) were cut into 5 mm pieces and placed on plates (bombarded side in contact with medium) containing RMOP with 500, 150 and 200 mg/l of spectinomycin respectively for the first round of selection. After 4-5 weeks, resistant shoots will appear, whereas untransformed cells will die. Resistant shoots will be transferred to new RMOP-Spectinomycin plates and subjected to subsequent rounds of selection. The putative transplastomic shoots were confirmed by PCR and Southern analysis. Expression of cell wall degrading enzymes were confirmed by their respective assays and for those that antibody was available, Western blot analysis was performed.

The commercial cultivars yielded 40 metric tons biomass of fresh leaves as opposed to 2.2 tons in experimental cultivar Petit Havana. The commercial cultivars yield biomass 18 fold more than the experimental cultivar (Cramer et al., 1999). LAMD-609 is a low nicotine hybrid produced by backcrossing a Maryland type variety, MD-609, to a low nicotine-producing burley variety, LA Burley 21 (Collins et al., 1974), Tennessee 90 (TN 90) is a commercial cultivar used by Philip Morris (Lancaster Laboratories, PA). Both experimental cultivars LAMD and TN 90 were transformed with genes encoding biomass degrading enzymes. Although it is more challenging to transform these cultivars than the experimental cultivar, we succeeded in transforming both commercial cultivars with a number of genes encoding biomass degrading enzymes pectate lyases, cellulases, xylanases and endoglucanases. Transplastomic lines of commercial cultivars were homoplasmic, fertile and activities of expressed enzymes were similar to the experimental cultivar except that their biomass yield was much higher than Petit Havana. Table 8 shows enzymes that have been successfully introduced in plants, expressed and assayed for activity in experimental and commercial cultivars.

PCR was done using DNA isolated from leaf material of control and putative transgenic plants in order to distinguish true chloroplast transformants from nuclear transformants or mutants. Two separate PCR reactions was set up, one reaction checked for the integration of selectable marker gene into the chloroplast genome and the second checked integration of the transgene expression cassette. In order to test chloroplast integration of the transgenes, one primer (3M) will land on the aadA gene while another (3P) will land on the native chloroplast genome. No PCR product was obtained with nuclear transgenic plants or mutants using this set of primers. This screening is important for eliminating mutants and nuclear transformants. In order to conduct PCR analysis in transgenic plants, total DNA from unbombarded and transgenic plants was isolated as described by DNeasy plant mini kit (Qiagen). Integration of transgene expression cassette was tested using 5P/2M primer pair. Primer 5P lands in the aadA gene and 2M in the trnA, therefore, the PCR product showed whether the gene of interest had been introduced into the chloroplast genome via the homologous recombination process. A similar strategy has been used successfully by PI lab to confirm chloroplast integration of several foreign genes. The leaf pieces from PCR-positive shoots was further selected for a second round in order to achieve homoplasmy.

Southern blots were done to test homoplasmy. There are several thousand copies of the chloroplast genome present in each plant cell. When foreign genes are inserted into the chloroplast genome, not all chloroplasts will integrate foreign DNA resulting in heteroplasmy. To ensure that only the transformed genome exists in transgenic plants (homoplasmy), the selection process was continued. In order to confirm homoplasmy at the end of the selection cycle, total DNA from transgenic plants was probed with the radiolabeled chloroplast flanking sequences (the trnI-trnA fragment) used for homologous recombination. If wild type genomes are present (heteroplasmy), the native fragment size was observed along with transformed genomes. Presence of a large fragment due to the insertion of foreign genes within the flanking sequences and the absence of the native small fragment should confirm homoplasmy.

Figure 6:
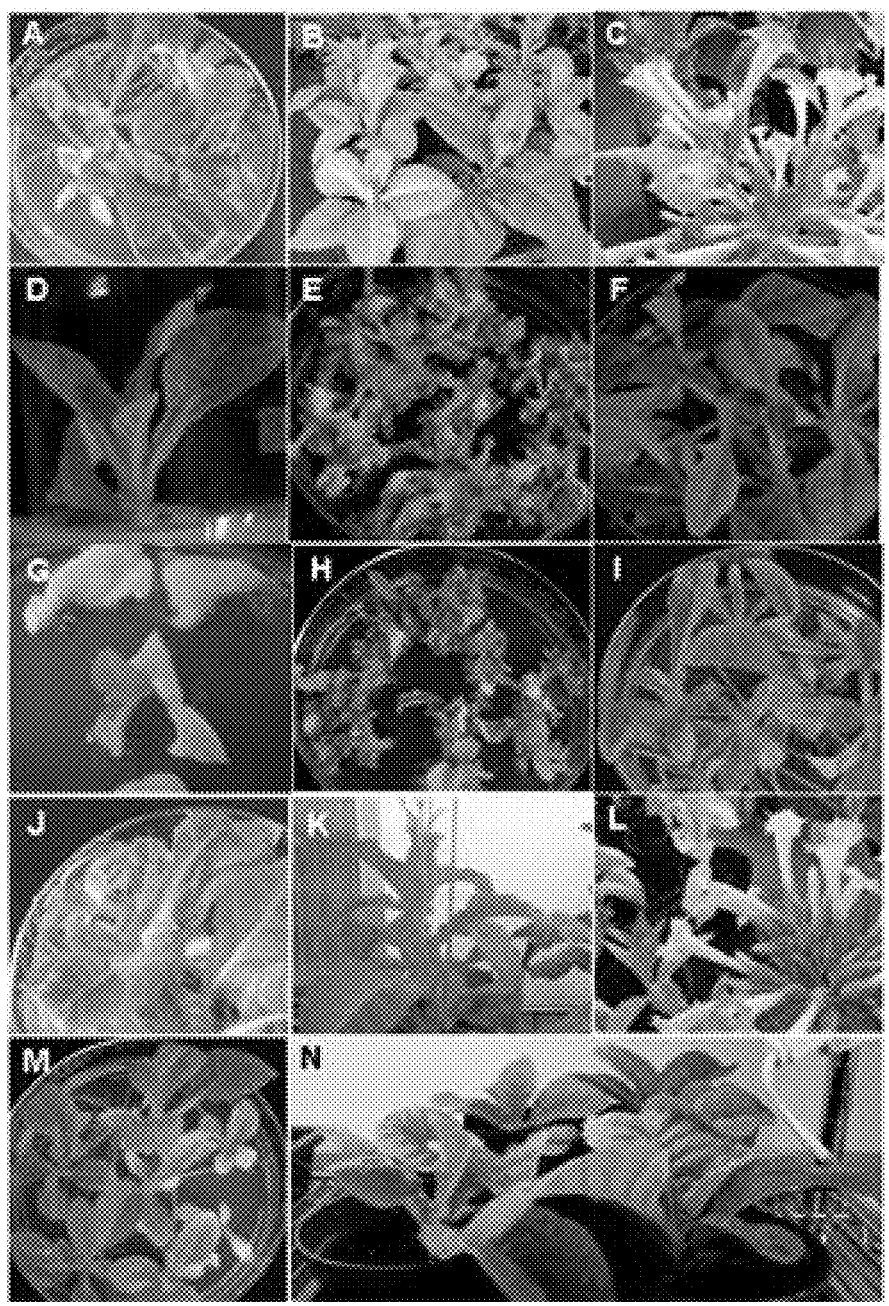
FIG. 6 Generation of transplastomic tobacco commercial cultivars (A) Rooting of CelD LAMD shoot (B) CelD LAMD transplastomic plants growing in the green house (C) CelD LAMD transplastomic plants showing normal flowering (D) CelD TN90 primary transformant (E) Second round of regeneration for CelD TN90 (F) Rooting of PelB TN90 (G-I) First, second and third round of regeneration for PelB LAMD (J) Rooting of PelD LAMD shoot (K) PelD LAMD transplastomic plants growing in green house (L) PelD LAMD transplastomic plant showing normal flowering (M) Rooting of eg1 LAMD shoot (N) eg1 LAMD transplastomic plant growing in pots.

FIG. 6 shows the generation of transplastomic tobacco commercial cultivars (A) Rooting of CelD LAMD shoot (B) CelD LAMD transplastomic plants growing in the green house (C) CelD LAMD transplastomic plants showing normal flowering (D) CelD TN90 primary transformant (E) Second round of regeneration for CelD TN90 (F) Rooting of PelB TN90 (G-I) First, second and third round of regeneration for PelB LAMD (J) Rooting of PelD LAMD shoot (K) PelD LAMD transplastomic plants growing in green house (L) PelD LAMD transplastomic plant showing normal flowering (M) Rooting of eg1LAMD shoot (N) eg1 LAMD transplastomic plant growing in pots.

Figure 7:
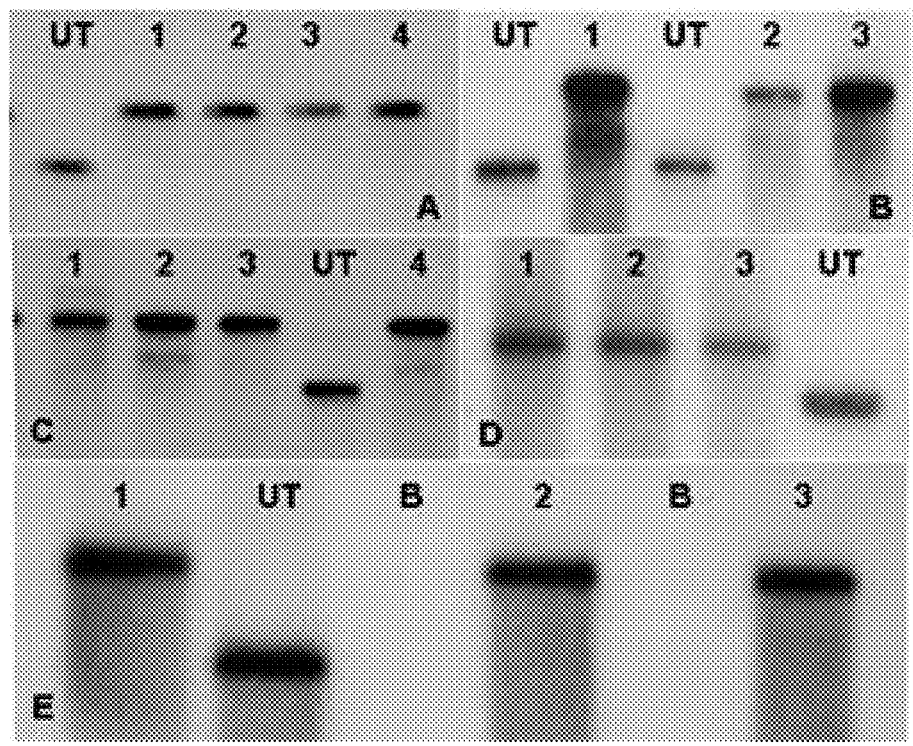
FIG. 7 Confirmation of homoplasmy by southern blots using tobacco flanking probe (A) CelD LAMD (B) PelB LAMD (C) PelB TN90 (D) PelD LAMD and (E) eg1 LAMD (UT: Untransformed plant; Numbers: Transplastomic lines and B: Blank).
Figure 8:
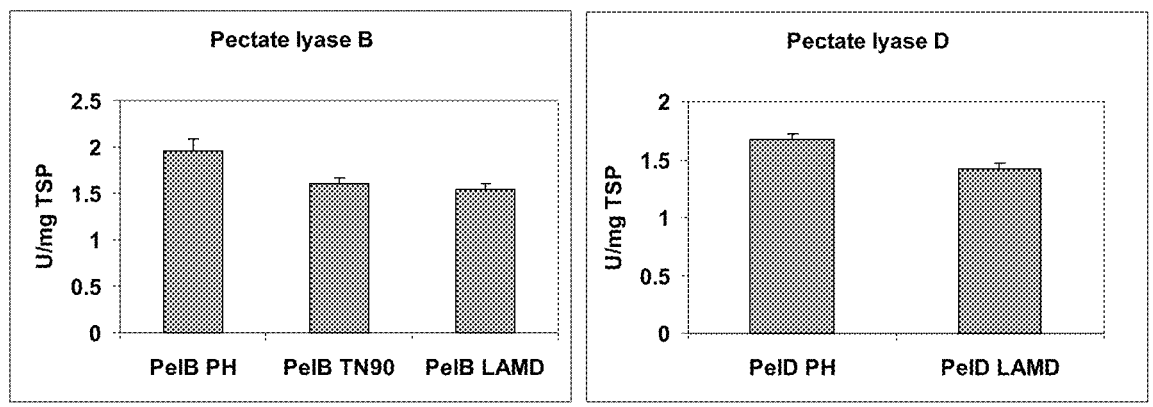
FIG. 8 Enzymatic activity of pectate lyase B and D in Petit Havana, TN90 and LAMD tobacco cultivars (A) PelB (B) PelD Note: The leaf material used for the analysis of enzyme activity for TN90 and LAMD tobacco cultivars were harvested from in vitro plants, whereas the leaf material for Petit Havana is from the green house. Since the transgene is controlled by psbA, with light and developmental regulatory elements, expression levels in commercial cultivars are expected to be higher when transferred to the green house.

FIG. 7 shows confirmation of homoplasmy by southern blots using tobacco flanking probe (A) CelD LAMD (B) PelB LAMD (C) PelB TN90 (D) PelD LAMD and (E) eg1 LAMD (UT: Untransformed plant; Numbers: Transplastomic lines and B: Blank). FIG. 8 shows enzymatic activity of pectate lyase B and D in Petit Havana, TN90 and LAMD tobacco cultivars (A) PelB (B) PelD Note: The leaf material used for the analysis of enzyme activity for TN90 and LAMD tobacco cultivars were harvested from in vitro plants, whereas the leaf material for Petit Havana is from the green house. Since the transgene is controlled by psbA, with light and developmental regulatory elements, expression levels in commercial cultivars are expected to be higher when transferred to the green house.

TABLE 8

Summary of Successful Transformation, Expression and Active Recombinantly Expressed Enzymes

| Gene Name | PCR Positive | Southern Status | At what stage | No. of plants | Frozen material (gms) | Assay with E. coli extract protocols | Assay with plant extract | Plant Health |
|---|---|---|---|---|---|---|---|---|
| celD | Yes, Petit Havana (PH) | Homoplasmy | Collected seeds | T0 seeds germinated | 400 | Yes | Yes | Normal |
|  | Yes (LAMD) | Homoplasmy | Collected seeds | T0 seeds germinated | 250 |  | Yes | Normal |
|  | Yes (TN90) | Not Checked | 2$^{nd}$ Round of selection | 4 clones |  |  | Yes | Normal |
| pelB | Yes (PH) | Homoplasmy | Collected seeds | T0 seeds germinated | 700 | Yes | Yes | Normal |
|  | Yes (LAMD) | Homoplasmy | Rooting | 18 plants |  |  | Yes | Normal |
|  | Yes (TN90) | Homoplasmy | Ready for Green house production | 30 plants |  |  | Yes | Normal |
| pelD | Yes (PH) | Homoplasmy | Collected seeds | T0 seeds germinated | 600 | Yes | Yes | Normal |
|  | Yes (LAMD) | Homoplasmy | Collected seeds | T0 seeds germinated | 340 |  | Yes | Normal |
| pelA | Yes (PH) | Homoplasmy | Ready for Green house production | 9 |  | Yes | Yes | Normal |
| egI | Yes (PH) | Homoplasmy | Ready for Green house production | 9 |  | Yes | Yes | Normal |
|  | Yes (LAMD) | Homoplasmy | Ready for Green house production | 3 |  |  | Yes | Normal |
| Egl1 | Yes (PH) | in progress | Rooting | 20 |  | in progress | in progress | Normal |
|  | Yes (TN90) | in progress | 2$^{nd}$ round of selection | 3 clones |  |  |  | Normal |
| Xyn2 | Yes (PH) | Homoplasmy | Ready for Green house production | 7 |  | Yes | Yes | Normal |
| Swo1 | Yes (PH) | Homoplasmy | Rooting | 20 |  | Yes | Yes | Thin leaves |
| Bgl1 | Yes (PH) | Homoplasmy | Ready for Green house production | 20 |  | Yes | in progress | Normal |
| Cutinase | Yes (PH) | in progress | Rooting | 15 |  | Yes | in progress | Leaves are thin |
| cello | Yes (PH) | Heteroplasmy | Rooting | 20 |  | Yes | in progress | Normal |
|  | Screening (LAMD) | in progress | 2$^{nd}$ round of selection | 5 clones |  | Yes | in progress | Normal |

TABLE 8-continued

Summary of Successful Transformation, Expression and Active Recombinantly Expressed Enzymes

| Gene Name | PCR Positive | Southern Status | At what stage | No. of plants | Frozen material (gms) | Assay with E. coli extract protocols | Assay with plant extract | Plant Health |
|---|---|---|---|---|---|---|---|---|
| Axe1 | Bombarded in all cultivars | — | In RMOP selection medium | | | Yes | | |
| lip Y | Bombarded in all cultivars | — | In RMOP selection medium | | | Yes | | |
| lipJ | Bombarded in all cultivars | — | In RMOP selection medium | | | yes | | |
| Man1 | Bombarded in all cultivars | — | In RMOP selection medium | | | Yes | | |
| Abf1 | Bombarded in all cultivars | — | In RMOP selection medium | | | | | |

The disclosures of the cited patent documents, publications and references, including those referenced in Tables II-VII, are incorporated herein in their entirety to the extent not inconsistent with the teachings herein. It should be understood that the examples and embodiments described herein are for illustrative purposes only and that various modifications or changes in light thereof will be suggested to persons skilled in the art and are to be included within the spirit and purview of this application.

REFERENCE LIST FOR EXAMPLES 1-8

1. Robertson, G. P. et al. AGRICULTURE: Sustainable Biofuels Redux. *Science* 322, 49-50 (2008).
2. Sticklen, M. B. Plant genetic engineering for biofuel production: towards affordable cellulosic ethanol. *Nat Rev Genet.* 9, 433-443 (2008).
3. Merino, S. T. & Cherry, J. Progress and Challenges in Enzyme Development for Biomass Utilization in *Advances in Biochemical Engineering/Biotechnology* 95-120 (Springer Berlin/Heidelberg, 2007).
4. Wyman, C. E. et al. Coordinated development of leading biomass pretreatment technologies. *Bioresour Technol* 96, 1959-1966 (2005).
5. Grohmann, K., Baldwin E. A., Buslig, B. S., & Ingram L. O Fermentation of galacturonic acid and other sugars in orange peel hydrolysates by the ethanologenic strain of *Escherichia coli*. *Biotechnology Letters* 16, 281-286 (1994).
6. Himmel, M. E. et al Advanced bioethanol production technologies: a prospective. In ACS Symposium 666, 2-45. 1997. American Chemical Society Washington, D.C. Ref Type: Conference Proceeding
7. Himmel, M. E., Ruth, M. F., & Wyman, C. E. Cellulase for commodity products from cellulosic biomass. *Current Opinion in Biotechnology* 10, 358-364 (1999).
8. Taylor II, L. E. et al. Heterologous expression of glycosyl hydrolases in planta: a new departure for biofuels. *Trends in Biotechnology* 26, 413-424 (2008).
9. Ziegelhoffer, T., Will, J., & ustin-Phillips, S. Expression of bacterial cellulase genes in transgenic alfalfa (*Medicago sativa* L.), potato (*Solanum tuberosum* L.) and tobacco (*Nicotiana tabacum* L.). *Molecular Breeding* 5, 309-318 (1999).
10. Kawazu, T. et al. Expression of a bacterial endoglucanase gene in tobacco increases digestibility of its cell wall fibers. *Journal of Bioscience and Bioengineering* 88, 421-425 (1999).
11. Dai, Z., Hooker, B. S., Anderson, D. B., & Thomas, S. R. Improved plant-based production of E1 endoglucanase using potato: expression optimization and tissue targeting. *Molecular Breeding* 6, 277-285 (2000).
12. Montalvo-Rodriguez, R. et al. Autohydrolysis of plant polysaccharides using transgenic hyperthermophilic enzymes. *Biotechnology and Bioengineering* 70, 151-159 (2000).
13. Xu, X. et al. Expression of a bacterial Î±-amylase gene in transgenic rice seeds. *Transgenic Research* 17, 645-650 (2008).
14. Martinez, D. et al. Genome sequencing and analysis of the biomass-degrading fungus *Trichoderma reesei* (syn. *Hypocrea jecorina*). *Nat Biotech* 26, 553-560 (2008).
15. Rubin, E. M. Genomics of cellulosic biofuels. *Nature* 454, 841-845 (2008).
16. Verma, D. & Daniell, H. Chloroplast vector systems for biotechnology applications. *Plant Physiol.* 145, 1129-1143 (2007).
17. Daniell, H., Lee, S. B., Panchal, T., & Wiebe, P. O. Expression of the native cholera toxin B subunit gene and assembly as functional oligomers in transgenic tobacco chloroplasts. *Journal of Molecular Biology* 311, 1001-1009 (2001).
18. De Cosa, B., Moar, W., Lee S B., Miller, M., & Daniell, H. Overexpression of the Bt cry2Aa2 operon in chloroplasts leads to formation of insecticidal crystals. *Nat Biotechnol* 19, 71-74 (2001).
19. Lee, S. B. et al. Accumulation of trehalose within transgenic chloroplasts confers drought tolerance. *Molecular Breeding* 11, 1-13 (2003).
20. Singh, N. D., Li, M., Lee, S. B., Schnell, D., & Daniell, H. *Arabidopsis* Tic40 Expression in Tobacco Chloroplasts Results in Massive Proliferation of the Inner Envelope Membrane and Upregulation of Associated Proteins. *Plant Cell* tpc (2008).
21. Daniell, H. Transgene containment by maternal inheritance: Effective or elusive? *Proceedings of the National Academy of Sciences* 104, 6879-6880 (2007).

22. Ruf, S., Karcher, D., & Bock, R. Determining the transgene containment level provided by chloroplast transformation. *Proceedings of the National Academy of Sciences* 104, 6998-7002 (2007).
23. Svab, Z. & Maliga, P. Exceptional transmission of plastids and mitochondria from the transplastomic pollen parent and its impact on transgene containment. *Proceedings of the National Academy of Sciences* 104, 7003-7008 (2007).
24. Gray, B. N., Ahner, B. A., & Hanson, M. R. High-level bacterial cellulase accumulation in chloroplast-transformed tobacco mediated by downstream box fusions. *Biotechnology and Bioengineering* xxx, xxx (2008).
25. Leelavathi, S., Gupta, N., Maiti, S., Ghosh, A., & Siva Reddy, V. Overproduction of an alkali- and thermo-stable xylanase in tobacco chloroplasts and efficient recovery of the enzyme. *Molecular Breeding* 11, 59-67 (2003).
26. Yu, L. X. et al. Expression of thermostable microbial cellulases in the chloroplasts of nicotine-free tobacco. *Journal of Biotechnology* 131, 362-369 (2007).
27. Brixey, P. J., Guda, C., & Daniell, H. The chloroplast psbA promoter is more efficient in *Escherichia coli* than the T7 promoter for hyperexpression of a foreign protein. *Biotechnology Letters* 19, 395-400 (1997).
28. Daniell, H., Ruiz, O. N., & Dhingra, A. Chloroplast Genetic Engineering to Improve Agronomic Traits. *Methods Mol Biol* 286, 111-138 (2005).
29. Verma, D., Samson, N. P., Koya, V., & Daniell, H. A protocol for expression of foreign genes in chloroplasts. *Nat. Protocols* 3, 739-758 (2008).
30. Guo, W., Gonzalez-Candelas, L., & Kolattukudy, P. E. Cloning of a novel constitutively expressed pectate lyase gene pelB from *Fusarium solani* f. sp. pisi (*Nectria haematococca*, mating type VI) and characterization of the gene product expressed in *Pichia pastoris*. *J. Bacteriol.* 177, 7070-7077 (1995).
31. Miller, G. L. Use of Dinitrosalicylic Acid Reagent for Determination of Reducing Sugar. *Analytical Chemistry* 31, 426-428 (1959).
32. Ghose, T. K. Measurement of cellulase activities. *Pure and Applied Chemistry* 59, 257-268 (1987).
33. Arlen P A et al. Field production and functional evaluation of chloroplast-derived interferon-alpha2b. *Plant Biotech J* 5, 511-525 (2007).
33. Cramer, C. L., Boothe, J. G. & Oishi, K. K. Transgenic plants for therapeutic proteins: linking upstream and downstream strategies. *Curr. Top. Microbiol. Immunol.* 240, 95-118 (1999).
34. Ruhlman, T. F., Ahangari, R. F., Devine, A. F., Samsam, M. F., & Daniell, H. Expression of cholera toxin B-proinsulin fusion protein in lettuce and tobacco chloroplasts—oral administration protects against development of insulitis in non-obese diabetic mice. *Plant Biotech J* 5, 495-510 (2007).
35. Bally, J. et al. Both the stroma and thylakoid lumen of tobacco chloroplasts are competent for the formation of disulphide bonds in recombinant proteins. *Plant Biotech J* 6, 46-61 (2008).
36. Chauvaux, S. et al. Calcium-binding affinity and calcium-enhanced activity of *Clostridium thermocellum* endoglucanase D. *Biochem. J.* 265, 261-265 (1990).
37. Zverlov, V. V., Velikodvorskaya, G. A., & Schwarz, W. H. A newly described cellulosomal cellobiohydrolase, CelO, from *Clostridium thermocellum*: investigation of the exo-mode of hydrolysis, and binding capacity to crystalline cellulose. *Microbiology* 148, 247-255 (2002).
38. Irwin D C, Spezio, M., Walker L P, & Wilson, D. B. Activity studies of eight purified cellulases: Specificity, synergism, and binding domain effects. *Biotechnology and Bioengineering* 42, 1002-1013 (1993).
39. Zhou, S. & Ingram, L. O, Synergistic Hydrolysis of Carboxymethyl Cellulose and Acid-Swollen Cellulose by Two Endoglucanases (CelZ and CelY) from *Erwinia chrysanthemi*. *J. Bacteriol.* 182, 5676-5682 (2000).
40. Gusakov A V et al. Design of highly efficient cellulase mixtures for enzymatic hydrolysis of cellulose. *Biotechnology and Bioengineering* 97, 1028-1038 (2007).
41. Yapo, B. M., Lerouge, P., Thibault, J. F., & Ralet, M. C. Pectins from citrus peel cell walls contain homogalacturonans homogenous with respect to molar mass, rhamnogalacturonan I and rhamnogalacturonan II. *Carbohydrate Polymers* 69, 426-435 (2007).
42. Rosgaard, L., Pedersen S, & Meyer, A. S. Comparison of different pretreatment strategies for enzymatic hydrolysis of wheat and barley straw. *Appl. Biochem. Biotechnol.* 143, 284-296 (2007).
43. Selig, M. J., Knoshaug, E. P., Adney, W. S., Himmel, M. E., & Decker, S. R. Synergistic enhancement of cellobiohydrolase performance on pretreated corn stover by addition of xylanase and esterase activities. *Bioresource Technology* 99, 4997-5005 (2008).
44. Rosgaard, L. et al. Evaluation of minimal *Trichoderma reesei* cellulase mixtures on differently pretreated Barley straw substrates. *Biotechnol. Prog* 23, 1270-1276 (2007).
45. Guo, W., González-Candelas, L., & Kolattukudy, P. E. Identification of a NovelpelDGene Expressed Uniquely in Planta by *Fusarium solani*f. sp. pisi (*Nectria haematococca*, Mating Type VI) and Characterization of Its Protein Product as an Endo-Pectate Lyase. *Archives of Biochemistry and Biophysics* 332, 305-312 (1996).
46. Soliday, C. L., Flurkey, W. H., Okita, T. W., & Kolattukudy, P. E. Cloning and structure determination of cDNA for cutinase, an enzyme involved in fungal penetration of plants. *Proceedings of the National Academy of Sciences of the United States of America* 81, 3939-3943 (1984).
47. Daniell, H., Datta, R., Varma, S., Gray, S., & Lee, S. B. Containment of herbicide resistance through genetic engineering of the chloroplast genome. *Nat Biotech* 16, 345-348 (1998).
48. Kumar, S. & Daniell, H. Engineering the Chloroplast Genome for Hyperexpression of Human Therapeutic Proteins and Vaccine Antigens in *Recombinant Gene Expression* 365-383 2004).
49. Crawford, M. S. & Kolattukudy, P. E. Pectate lyase from *Fusarium solani* f. sp. pisi: Purification, characterization, in vitro translation of the mRNA, and involvement in pathogenicity. *Archives of Biochemistry and Biophysics* 258, 196-205 (1987).
50. Gonzalez-Candelas, L. & Kolattukudy, P. E. Isolation and analysis of a novel inducible pectate lyase gene from the phytopathogenic fungus *Fusarium solani* f. sp. pisi (*Nectria haematococca*, mating population VI). *J. Bacteriol.* 174, 6343-6349 (1992).

REFERENCE LIST FOR EXAMPLES 10-11

Reference List

1. Robertson, G. P. et al. AGRICULTURE: Sustainable Biofuels Redux. *Science* 322, 49-50 (2008).

2. Sticklen, M. B. Plant genetic engineering for biofuel production: towards affordable cellulosic ethanol. *Nat. Rev. Genet.* 9, 433-443 (2008).
3. Merino, S. T. & Cherry, J. Progress and Challenges in Enzyme Development for Biomass Utilization in *Advances in Biochemical Engineering/Biotechnology* 95-120 (Springer Berlin/Heidelberg, 2007).
4. Wyman, C. E. et al. Coordinated development of leading biomass pretreatment technologies. *Bioresour. Technol.* 96, 1959-1966 (2005).
5. Grohmann, K., Baldwin, E. A., Buslig, B. S., & Ingram, L. O. Fermentation of galacturonic acid and other sugars in orange peel hydrolysates by the ethanologenic strain of *Escherichia coli*. *Biotechnology Letters* 16, 281-286 (1994).
6. Himmel, M. E. et al. Advanced bioethanol production technologies: a prospective. In ACS Symposium 666, 2-45. 1997. American Chemical Society Washington, D.C. Ref Type: *Conference Proceeding*.
7. Himmel, M. E., Ruth, M. F., & Wyman, C. E. Cellulase for commodity products from cellulosic biomass. *Current Opinion in Biotechnology* 10, 358-364 (1999).
8. Taylor II, L. E. et al. Heterologous expression of glycosyl hydrolases in planta: a new departure for biofuels. *Trends in Biotechnology* 26, 413-424 (2008).
9. Ziegelhoffer, T., Will, J., & ustin-Phillips, S. Expression of bacterial cellulase genes in transgenic alfalfa (*Medicago sativa* L.), potato (*Solanum tuberosum* L.) and tobacco (*Nicotiana tabacum* L.). *Molecular Breeding* 5, 309-318 (1999).
10. Kawazu, T. et al. Expression of a bacterial endoglucanase gene in tobacco increases digestibility of its cell wall fibers. *Journal of Bioscience and Bioengineering* 88, 421-425 (1999).
11. Dai, Z., Hooker, B. S., Anderson, D. B., & Thomas, S. R. Improved plant-based production of E1 endoglucanase using potato: expression optimization and tissue targeting. *Molecular Breeding* 6, 277-285 (2000).
12. Montalvo-Rodriguez, R. et al Autohydrolysis of plant polysaccharides using transgenic hyperthermophilic enzymes. *Biotechnology and Bioengineering* 70, 151-159 (2000).
13. Xu, X. et al. Expression of a bacterial α-amylase gene in transgenic rice seeds. *Transgenic Research* 17, 645-650 (2008).
14. Martinez, D. et al. Genome sequencing and analysis of the biomass-degrading fungus *Trichoderma reesei* (syn. *Hypocrea jecorina*). *Nat. Biotech.* 26, 553-560 (2008).
15. Rubin, E. M. Genomics of cellulosic biofuels. *Nature* 454, 841-845 (2008).
16. Verma, D. & Daniell, H. Chloroplast vector systems for biotechnology applications. *Plant Physiol.* 145, 1129-1143 (2007).
17. Daniell, H., Lee, S. B., Panchal, T., & Wiebe, P. O. Expression of the native cholera toxin B subunit gene and assembly as functional oligomers in transgenic tobacco chloroplasts. *Journal of Molecular Biology* 311, 1001-1009 (2001).
18. De Cosa, B., Moar, W., Lee, S. B., Miller, M., & Daniell, H. Overexpression of the Bt cry2Aa2 operon in chloroplasts leads to formation of insecticidal crystals. *Nat. Biotechnol.* 19, 71-74 (2001).
19. Lee, S. B. et al. Accumulation of trehalose within transgenic chloroplasts confers drought tolerance. *Molecular Breeding* 11, 1-13 (2003).
20. Singh, N. D., Li, M., Lee, S. B., Schnell, D., & Daniell, H. *Arabidopsis* Tic40 Expression in Tobacco Chloroplasts Results in Massive Proliferation of the Inner Envelope Membrane and Upregulation of Associated Proteins. *Plant Cell* 20, 3405-3417 (2008).
21. H. Daniell, S. Kumar and N. Duformantel (2005) Breakthrough in chloroplast genetic engineering of agronomically important crops. *Trends in Biotechnology*, 23: 238-245.
22. Daniell, H. Transgene containment by maternal inheritance: Effective or elusive? *Proceedings of the National Academy of Sciences* 104, 6879-6880 (2007).
23. H. Daniell (2002) Molecular strategies for gene containment in transgenic crops. *Nature Biotechnology* 20: 581-587.
24. Gray, B. N., et al., High-level bacterial cellulase accumulation in chloroplast-transformed tobacco mediated by downstream box fusions. *Biotechnology and Bioengineering* 102, 1045-1054 (2008).
25. Leelavathi, S., Gupta, & Siva Reddy, V. Overproduction of an alkali- and thermo-stable xylanase in tobacco chloroplasts and efficient recovery of the enzyme. *Molecular Breeding* 11, 59-67 (2003).
26. Yu, L. X. et al. Expression of thermostable microbial cellulases in the chloroplasts of nicotine-free tobacco. *Journal of Biotechnology* 131, 362-369 (2007).
27. Brixey, P. J., Guda, C., & Daniell, H. The chloroplast psbA promoter is more efficient in *Escherichia coli* than the T7 promoter for hyperexpression of a foreign protein. *Biotechnology Letters* 19, 395-400 (1997).
28. Daniell, H., Ruiz, O. N., & Dhingra, A. Chloroplast Genetic Engineering to Improve Agronomic Traits. *Methods Mol. Biol.* 286, 111-138 (2005).
29. Verma, D., Samson, N. P., Koya, V., & Daniell, H. A protocol for expression of foreign genes in chloroplasts. *Nat. Protocols* 3, 739-758 (2008).
30. Guo, W., Gonzalez-Candelas, L., & Kolattukudy, P. E. Cloning of a novel constitutively expressed pectate lyase gene pelB from *Fusarium solani* f. sp. pisi (*Nectria haematococca*, mating type VI) and characterization of the gene product expressed in *Pichia pastoris*. *J. Bacteriol.* 177, 7070-7077 (1995).
31. Miller, G. L. Use of Dinitrosalicylic Acid Reagent for Determination of Reducing Sugar. *Analytical Chemistry* 31, 426-428 (1959).
32. Ghose, T. K. Measurement of cellulase activities. *Pure and Applied Chemistry* 59, 257-268 (1987).
33. Cramer, C. L., Boothe, J. G. & Oishi, K. K. Transgenic plants for therapeutic proteins: linking upstream and downstream strategies. *Curr. Top. Microbiol. Immunol.* 240, 95-118 (1999).
34. Collins G B, Legg P D, Kasperbauer M C. Tobacco hybrid LAMD-609. *Crop Sci.* 14, 72-80 (1974).
35. Arlen P A et al. Field production and functional evaluation of chloroplast-derived interferon-alpha2b. *Plant Biotech. J.* 5, 511-525 (2007).
36. Ruhlman, T. F., Ahangari, R. F., Devine, A. F., Samsam, M. F., & Daniell, H. Expression of cholera toxin B-proinsulin fusion protein in lettuce and tobacco chloroplasts—oral administration protects against development of insulitis in non-obese diabetic mice. *Plant Biotech. J.* 5, 495-510 (2007).
37. Bally, J. et al. Both the stroma and thylakoid lumen of tobacco chloroplasts are competent for the formation of disulphide bonds in recombinant proteins. *Plant Biotech. J.* 6, 46-61 (2008).
38. Chauvaux, S. et al. Calcium-binding affinity and calcium-enhanced activity of *Clostridium thermocellum* endoglucanase D. *Biochem. J.* 265, 261-265 (1990).

39. Zverlov, V. V., Velikodvorskaya, G. A., & Schwarz, W. H. A newly described cellulosomal cellobiohydrolase, CelO, from *Clostridium thermocellum*: investigation of the exo-mode of hydrolysis, and binding capacity to crystalline cellulose. *Microbiology* 148, 247-255 (2002).
40. Irwin, D. C., Spezio, M., Walker, L. P., & Wilson, D. B. Activity studies of eight purified cellulases: Specificity, synergism, and binding domain effects. *Biotechnology and Bioengineering* 42, 1002-1013 (1993).
41. Zhou, S. & Ingram, L. O, Synergistic Hydrolysis of Carboxymethyl Cellulose and Acid-Swollen Cellulose by Two Endoglucanases (CelZ and CelY) from *Erwinia chrysanthemi*. *J. Bacteriol.* 182, 5676-5682 (2000).
42. Gusakov, A. V. et al. Design of highly efficient cellulase mixtures for enzymatic hydrolysis of cellulose. *Biotechnology and Bioengineering* 97, 1028-1038 (2007).
43. Yapo, B. M., Lerouge, P., Thibault, J. F., & Ralet, M. C. Pectins from citrus peel cell walls contain homogalacturonans homogenous with respect to molar mass, rhamnogalacturonan I and rhamnogalacturonan II. *Carbohydrate Polymers* 69, 426-435 (2007).
44. Rosgaard, L., Pedersen, S. & Meyer, A. S. Comparison of different pretreatment strategies for enzymatic hydrolysis of wheat and barley straw. *Appl. Biochem. Biotechnol.* 143, 284-296 (2007).
45. Selig, M. J., Knoshaug, E. P., Adney, W. S., Himmel, M. E., & Decker, S. R. Synergistic enhancement of cellobiohydrolase performance on pretreated corn stover by addition of xylanase and esterase activities. *Bioresource Technology* 99, 4997-5005 (2008).
46. Rosgaard, L. et al. Evaluation of minimal *Trichoderma reesei* cellulase mixtures on differently pretreated Barley straw substrates. *Biotechnol. Prog.* 23, 1270-1276 (2007).
47. Crawford, M. S. & Kolattukudy, P. E. Pectate lyase from *Fusarium solani* f. sp. pisi: Purification, characterization, in vitro translation of the mRNA, and involvement in pathogenicity. *Archives of Biochemistry and Biophysics* 258, 196-205 (1987).
48. Gonzalez-Candelas, L. & Kolattukudy, P. E. Isolation and analysis of a novel inducible pectate lyase gene from the phytopathogenic fungus *Fusarium solani* f. sp. pisi (*Nectria haematococca*, mating population VI). *J. Bacteriol.* 174, 6343-6349 (1992).
49. Holtzapple, M. T. Cellulose. In: Macrae R, Robinson R K, Saddler M J, editors. Encyclopedia of food science food technology and nutrition. London: Academic Press; 1993. p. 758-67.
50. Jarvis, M. Cellulose stacks up. *Science* 426, 611-2 (2003).
51. Zhang, Y. H. P. & Lynd, L. R. Toward an aggregated understanding of enzymatic hydrolysis of cellulose: non-complexed cellulase systems. *Biotechnol. Bioeng.* 88, 797-824 (2004).
52. Berner, R. A. The long-term carbon cycle, fossil fuels and atmospheric composition. *Nature* 426, 323-6 (2003).
53. Demain, A. L., Newcomb, M. & Wu, J. H. D. Cellulase, Clostridia, and ethanol. *Microbiol. Mol. Biol. Rev.* 69, 124-54 (2005).
54. O'Sullivan, A. C. Cellulose: the structure slowly unravels. *Cellulose* 4,173-207 (1997).
55. Lynd, L. R., Weimer, P. J. & van Zyl, W. H. Pretorius I S. Microbial cellulose utilization: fundamentals and biotechnology. *Microbiol. Mol. Biol. Rev.* 66, 506-77 (2002).
56. Wyman, C. E. Potential synergies and challenges in refining cellulosic biomass to fuels, chemicals, and power. *Biotechnol. Prog.* 19, 254-262 (2003).
57. Bayer, E. A., Lamed, R. & Himmel, M. E. The potential of cellulases and cellulosomes for cellulosic waste management. *Curr. Opin. Biotechnol.* 18, 237-245 (2007).
58. Knowles, J., Lehtovaara, P. & Teeri, T. Cellulase families and their genes. *Trends Biotechnol.* 5, 255-261 (1987).
59. Himmel, M. E., Adney, W. S., Baker, J. O., Nieves, R. A., Thomas, S. R. Cellulases: structure, function and applications. In: Wyman C E, editor. *Handbook on Bioethanol*. 144-61 (1993).
60. Zhang, Y—H. P., Himmel, M. E. & Mielenz, J. R. Outlook for cellulase improvement: Screening and selection strategies. *Biotechnol. Adv.* 24, 452-481 (2006).
61. Biely, P. Microbial xylanolytic systems, *Trends Biotechnology* 3, 286-290 (1985).
62. Tenkanen, M, Puls, J. & Potanen, K. Two major xylanases of *Trichoderma reesei*, *Enzyme and Microbial Technology* 14:566-574 (1992).
63. Polizeli, M. L. T. M., Rizzatti, A. C. S. & Monti, R. Xylanases from fungi: properties and industrial applications. *Applied Microbiology and Biotechnology*; 67, 577-591 (2005).
64. Baily, M. J. & Poulanen, K. Production of xylanases by strains of *Aspergillus*. Appl. *Microbiol. Biotechnol.* 30, 5-10 (1989).
65. Kolattukudy, P. E. Biopolyester Membranes of Plants: Cutin and Suberin. 208, 990-1000 (1980).
66. Kolattukudy, P. E. Polyesters in higher plants. *Adv. Biochem. Eng. Biotechnol.* 71, 1-49 (2001).
67. Kolattukudy, P. E. Detection of an N-terminal glucuronamide linkage in proteins. *Methods Enzymol.* 106, 210-7 (1984).
68. Egmond, M. R. & De Vlieg, J. *Fusarium solani* pisi cutinase. *Biochimie* 82, 1015-1021 (2000).
69. Sieber, P., Schorderet, M., Ryser, U., Buchala, A., Kolattukudy, P., Métraux, J. P. & Nawrath, C. Transgenic *Arabidopsis* plants expressing a fungal cutinase show alterations in the structure and properties of the cuticle and postgenital organ fusions. *Plant Cell* 12, 721-38 (2000).
70. Dhawan, S & Kaur, J. Microbial Mannanases: An Overview of Production and Applications, *Critical Reviews in Biotechnology*, 27, 197-216 (2007).
71. Moreira, L. R. S. & Filho, E. X. F. An overview of mannan structure and mannan-degrading enzyme systems. *Appl. Microbiol Biotechnol.* 795165-178 (2008).
72. Stalbrand, et al, Purification and characterization of two β-Mannanases from *Trichoderma reesei*, *Journal of Biotechnology*, 29, 229-242 (1993).
73. Mc Cleary, β-D Mannanase. *Methods in enzymology*, 160, 596-610 (1988).
74. Downie et al, A new assay for quantifying endo β-D mannanase activity using congo red dye. *Phytochemistry.* 36, 829-835, (1994).
75. Numan, M. T. Alpha-L-Arabinofuranosidases: the potential applications in biotechnology. *Journal of Industrial Microbiology and Biotechnology* 33, 247-260 (2006).
76. Poutanen, K. An alpha-L-arabinofuranosidase of *Trichoderma Reesei*. *Journal of Biotechnology* 7, 271-282 (1988).
77. Arora, D., et al. Comparison of two assay procedures for lignin peroxidase. *Enzyme and Microbial Technology* 28, 602-605 (2001).
78. Archibald, F. S. A New Assay for Lignin-Type Peroxidases Employing the Dye Azure B. *Applied and Environmental Microbiology*, 58, 3110-3116 (1992).
79. Mishra, K. C. et al., Functional role of the PE domain and immunogenicity of the *Mycobacterium tuberculosis* triacylglycerol hydrolase LipY. *Infect. Immun.* 76, 127-140 (2008).
80. Kouker, G., Jaeger, K. E. "Specific and Sensitive Plate Assay for Bacterial Lipases." *Applied and Environmental Microbiology* 53, 211-213 (1987).
81. Deb, C., Daniel. J. & Kolattukudy, P. E., "A Novel Lipase Belonging to the Hormone-sensitive Lipase Family Induced under Starvation to Utilize Stored Triacylglycerol in *Mycobacterium tuberculosis*." *The Journal of Biological Chemistry* 281, 3866-3875 (2006).

TABLE II

| No. | Source | Gene | Accession No. |
|---|---|---|---|
| 1 | *Aspergillus niger* CBS 513.88 | 1,4-beta-D-arabinoxylan arabinofuranohydrolase axhA | XM_001389961 |
| 2 | *Aspergillus niger* CBS 513.88 | endo-1,4-beta-xylanase A precursor (xynA) | XM_001389959 |
| 3 | *Aspergillus niger* | xylanase B | DQ174549 |
| 4 | *Aspergillus niger* | xylanase (XYNB) | AY536639 |
| 5 | *Aspergillus niger* | xylanase (XYN6) | AY536638 |
| 6 | *Aspergillus niger* | xylanase (XYN4) | U39785 |
| 7 | *Aspergillus niger* | xylanase (XYN5) | U39784 |
| 8 | *Aspergillus fumigatus* | XynC | DQ156555 |
| 9 | *Aspergillus fumigatus* | XynB | DQ156553 |
| 10 | *Bacillus licheniformis* | I5 beta-1,4-endoxylanase (xyn11) | DQ520129 |
| 11 | *Cryptococcus flavus* isolate I-11 | endo-1,4-beta xylanase (XYN1) | EU330207 |
| 12 | *Trichoderma viride* strain AS 3.3711 | endo-1,4-beta-xylanase (xyn2) | EF079061 |
| 13 | *Thermoascus aurantiacus* | xynA | AJ132635 |
| 14 | *Agaricus bisporus* | xlnA | Z83310 |
| 15 | *Thermobifida alba* | xylA | Z81013 |
| 16 | *Bacillus subtilis* | eglS gene for endo-1,4-beta-glucanase | Z29076 |
| 17 | *Chaetomium cupreum* | endo-1,4-beta-xylanase | EF026978 |
| 18 | *Paenibacillus polymyxa* | xyn D and glu B genes for endo-beta-(1,4)-xylanase and endo-beta-(1,3)(1,4)-glucanase | X57094 |
| 19 | *Neocallimastix frontalis* strain k13 | xylanase | DQ517887 |
| 20 | *Penicillium citrinum* | xynA gene for endo-1,4-beta-xylanase | AB198065 |
| 21 | *Agaricus bisporus* | endo-1,4-beta xylanase | Z83199 |
| 22 | *Bacillus* sp. (137) | endo-beta-1,4-xylanase | Z35497 |
| 23 | *Bacillus pumilus* | xynA | X00660 |
| 24 | *Aeromonas punctata* | XynX | AB015980 |
| 25 | *Penicillium canescens* | endo-1,4-beta-xylanase gene | AY756109 |
| 26 | *Cochliobolus carbonum* | endo-beta-1,4 xylanase (XYL4) | AY622513 |
| 27 | *Aspergillus* cf. *niger* BCC14405 | endo-1,4-beta-xylanase B (xylB) | AY551187 |
| 28 | *Bacillus alcalophilus* strain AX2000 | beta-1,4-xylanase (xynT) | AY423561 |
| 29 | *Trichoderma viride* strain YNUCC0183 | endo-1,4-beta-xylanase (XYL1) | AY370020 |
| 30 | *Thermotoga maritima* | endo-1,4-beta-xylanase B | AY339848 |
| 31 | *Trichoderma viride* strain YNUCC0183 | endo-1,4-beta-xylanase | AY320048 |
| 32 | *Gibberella zeae* | endo-1,4-beta-xylanase (xylA) | AY289919 |
| 33 | *Aeromonas caviae* | xynA gene for xylanase I | D32065 |
| 34 | *Bacillus pumilus* strain TX703 | beta-1,4-xylanase (xynK) gene, | AF466829 |
| 35 | *Fusarium oxysporum* f. sp. *lycopersici* | xylanase 4 protein (xyl4) | AF246831 |
| 36 | *Fusarium oxysporum* f. sp. *lycopersici* | xylanase 5 protein (xyl5) gene | AF246830 |
| 37 | *Penicillium purpurogenum* | endo-1,4-beta-D-xylanase A (XynA) | AF249328 |
| 38 | *Streptomyces* sp. S38 | xyl1 gene for endo-1,4-beta-xylanase | X98518 |
| 39 | *Bacillus* sp. NBL420 | endo-xylanase (xylS) | AF441773 |
| 40 | *Bacillus stearothermophilus* | endo-beta-1,4-xylanase (xynA) | U15985 |
| 41 | *Phanerochaete chrysosporium* strain ME446 | endo-1,4-B-xylanase B (xynB) | AF301902 to AF301905 |
| 42 | *Thermoascus aurantiacus* | endo-1,4-beta-xylanase A precursor (xynA) gene | AF127529 |
| 43 | *Neocallimastix patriciarum* | endo-1,4-beta-xylanase (xynC) gene | AF123252 |
| 44 | *Streptomyces avermitilis* | endo-1,4-beta-xylanase (xyl30) gene | AF121865 |
| 45 | *Cochliobolus carbonum* | beta-1,4-xylanase precursor (XYL3) gene | U58916 |
| 46 | *Trichoderma reesei* | beta-xylanase (XYN2) | U24191 |
| 47 | *Aspergillus tubingensis* | xylanase (xlnA) gene | L26988 |
| 48 | *Thermomonospora fusca* YX | endo 1,4-beta-D xylanase gene | U01242 |
| 49 | *Aspergillus fumigatus* Af293 | xylosidase: arabinofuranosidase | XM_750558 |

TABLE II-continued

| No. | Source | Gene | Accession No. |
|---|---|---|---|
| 50 | Aspergillus fumigatus Af293 | beta-xylosidase XylA | XM_747967 |
| 51 | Aspergillus fumigatus Af293 | beta-xylosidase | XM_744780 |
| 52 | Aspergillus fumigatus | Xld | DQ156554 |
| 53 | Vibrio sp. XY-214 | xloA | AB300564 |
| 54 | Aspergillus niger | xlnD | Z84377 |
| 55 | Bacteroides ovatus | xylosidase/arabinosidase gene | U04957 |
| 56 | Aspergillus clavatus NRRL 1 | xylosidase: arabinofuranosidase | XM_001275592 |
| 57 | Aspergillus clavatus NRRL 1 | beta-xylosidase | XM_001268537 |
| 58 | Neosartorya fischeri NRRL 181 | beta-xylosidase | XM_001261557 |
| 59 | Aspergillus niger CBS 513.88 | xylosidase xlnD | XM_001389379 |
| 60 | Aspergillus oryzae | beta-xylosidase A | AB013851 |
| 61 | Aspergillus oryzae | beta-1,4-xylosidase | AB009972 |
| 62 | Vibrio sp. XY-214 | xloA | AB300564 |
| 63 | Thermoanaerobacterium sp. 'JW/SL YS485' | xylosidase | EF193646 |
| 64 | Penicillium herquei | xylosidase | AB093564 |
| 65 | Bifidobacterium adolescentis strain Int57 | beta-xylosidase (bxyL) gene | DQ327717 |
| 66 | Aspergillus awamori | beta-xylosidase | AB154359 |
| 67 | Bacillus pumilus IPO | xynB gene for beta-xylosidase | X05793 |
| 68 | Pyrus pyrifolia PpARF2 | alpha-L-arabinofuranosidase/ beta-D-xylosidase | AB195230 |
| 69 | Clostridium stercorarium | bxlA gene for beta-xylosidase A | AJ508404 |
| 70 | Clostridium stercorarium | bxlB gene for beta-xylosidase B | AJ508405 |
| 71 | Aeromonas punctata | xysB, xyg genes for xylosidase B, alpha-glucuronidase, | AB022788 |
| 72 | Clostridium stercorarium | xynA gene for endo-xylanase | AJ508403 |
| 73 | Clostridium stercorarium | xyl43B gene for beta-xylosidase | AB106866 |
| 74 | Talaromyces emersonii | beta-xylosidase (bxl1) gene | A439746 |
| 75 | Thermoanaerobacterium sp. 'JW/SL YS485' | beta-xylosidase (xylB) and xylan esterase 1 (axe1) genes | AF001926 |
| 76 | Streptomyces thermoviolaceus | beta-xylosidase | AB110645 |
| 77 | Selenomonas ruminantium | xylosidase/arabinosidase (Xsa) gene | AF040720 |
| 78 | Bacillus pumilus | xylan 1,4-beta-xylosidase (xynB) | AF107211 |
| 79 | Bacillus stearothermophilus | b-xylosidase and gene for xylanase | D28121 |
| 80 | Azospirillum irakense | xylosidase/arabinofuranosidase (xynA) gene | AF143228 |
| 81 | Cochliobolus carbonum | major extracellular beta-xylosidase (XYP1) gene | AF095243 |
| 82 | Streptomyces lividans | BxlS (bxlS), BxlR (bxlR), BxlE (bxlE), BxlF (bxlF), BxlG (bxlG), and BxlA (bxlA) genes | AF043654 |
| 83 | Bacillus sp. KK-1 | beta-xylosidase (xylB) gene | AF045479 |
| 84 | Aspergllus nidulans | xlnD | Y13568 |
| 85 | T. reesei | beta-xylosidase | Z69257 |
| 86 | T. reesei | alpha-L-arabinofuranosidase | Z69252 |
| 87 | Clostridium stercorarium | xylA gene encoding xylosidase | D13268 |
| 88 | Butyrivibrio fibrisolvens | beta-D-xylosidase/alpha-L-arabinofuranosidase gene | M55537 |
| 89 | Thermoanaerobacter | beta-xylosidase (xynB) | M97883 |
| 90 | Paenibacillus sp. W-61 | exo-oligoxylanase | AB274730 |
| 91 | Aspergillus niger CBS 513.88 | arabinofuranosidase B abfB | XM_001396732 |
| 92 | Aspergillus niger CBS 513.88 | 1,4-beta-D-arabinoxylan arabinofuranohydrolase axhA | XM_001389961 |
| 93 | Aspergillus niger | alpha-L-arabinofuranosidase (ABF2) | U39942 |
| 94 | Aspergillus niger | alpha-L-arabinofuranosidase (abfA) | L29005 |
| 95 | Synthetic contruct | Alpha-L-arabinofuranosidase gene | BD143577 |
| 96 | Synthetic contruct | Alpha-L-arabinofuranosidase gene | BD143576 |
| 97 | Aureobasidium pullulans | alpha arabinofuranosidase (abfA) gene | AY495375 |

TABLE II-continued

| No. | Source | Gene | Accession No. |
|---|---|---|---|
| 98 | Geobacillus stearothermophilus strain KCTC 3012 | alpha-L-arabinofuranosidase (abf) gene | EF052863 |
| 99 | Hypocrea jecorina strain QM6a | Abf2 | AY281369 |
| 100 | Aspergillus sojae | alpha-L-arabinofuranosidase | AB033289 |
| 101 | Uncultured bacterium clone LCC-1 | arabinofuranosidase (deAFc) gene | DQ284779 |
| 102 | Penicillium purpurogenum | alpha-L-arabinofuranosidase 2 (abf2) gene | EF490448 |
| 103 | Acremonium cellulolyticus | Novel Alpha-L-arabinofuranosidase | DD354226 to DD354230 |
| 104 | Fusarium oxysporum f. sp. dianthi | abfB gene for alpha-L-arabinofuranosidase B | AJ310126 |
| 105 | Clostridium stercorarium | arfA gene for alpha-arabinofuranosidase | AJ508406 |
| 106 | Streptomyces thermoviolaceus | stxIV, stxI genes for alpha-L-arabinofuranosidase, xylanase I | AB110643 |
| 107 | Bifidobacterium longum B667 | arabinofuranosidase (abfB) gene | AY259087 |
| 108 | Aspergillus oryzae | Alpha-L-arabinofuranosidase gene | BD143578 |
| 109 | Aspergillus oryzae | Alpha-L-arabinofuranosidase gene | BD143575 |
| 110 | Clostridium cellulovorans | alpha-L-arabinofuranosidase ArfA, beta-galactosidase/alpha-L-arabinopyranosidase BgaA | AY128945 |
| 111 | Bacillus stearothermophilus | alpha-L-arabinofuranosidase (abfA) gene | AF159625 |
| 112 | Aspergillus oryzae strain: RIB40 | abfB for alpha-L-arabinofuranosidase B | AB073861 |
| 113 | Aspergillus oryzae strain: HL15 | abfB for alpha-L-arabinofuranosidase B | AB073860 |
| 114 | Penicillium purpurogenum | alpha-L-arabinofuranosidase (abf) gene | AF367026 |
| 115 | Cochliobolus carbonum | alpha-L-arabinofuranosidase (ARF2) gene | AF306764 |
| 116 | Cochliobolus carbonum | alpha-L-arabinofuranosidase (ARF1) gene | AF306763 |
| 117 | Cytophaga xylanolytica XM3 | alpha-L-arabinofuranosidase ArfII (arfII) gene | AF028019 |
| 118 | Cytophaga xylanolytica XM3 | alpha-L-arabinofuranosidase ArfI (arfI) gene | AF028018 |
| 119 | Clostridium stercorarium | alpha-L-arabinofuranosidase (arfB) gene | AF002664 |
| 120 | Aspergillus niger | tannase (TanAni) | DQ185610 |
| 121 | Neosartorya fischeri NRRL 181 | tannase and feruloyl esterase family protein (NFIA_029970) | XM_001262461 |
| 122 | Neosartorya fischeri NRRL 181 | tannase and feruloyl esterase family protein (NFIA_027990) | XM_001261621 |
| 123 | Neosartorya fischeri NRRL 181 | tannase and feruloyl esterase family protein (NFIA_047590) | XM_001257320 |
| 124 | Talaromyces stipitatus | faeC gene for ferulic acid esterase | AJ505939 |
| 125 | Aspergillus niger | faeB gene for feruloyl esterase | AJ309807 |
| 126 | Aspergillus awamori | AwfaeA gene for feruloylesterase | AB032760 |
| 127 | Penicillium chrysogenum | fae-1 | AB206474 |
| 128 | Neurospora crassa | ferulic acid esterase, type B | AJ293029 |
| 129 | Volvariella volvacea | acetyl xylan esterase | DQ888226 |
| 130 | Aspergillus fumigatus Af293 | acetyl xylan esterase | XM_750185 |
| 131 | Aspergillus niger CBS 513.88 | acetyl xylan esterase axeA | XM_001395535 |
| 132 | Neosartorya fischeri NRRL 181 | acetyl xylan esterase (Axe1) | XM_001258648 |
| 133 | A. niger | acetyl xylan esterase (axe A) | A22880 |
| 134 | Didymella rabiei | cut gene for cutinase | X65628 |
| 135 | Penicillium purpurogenum | acetyl xylan esterase (axeI) | AF529173 |
| 136 | Aspergillus oryzae | AoaxeA gene for acetyl xylan esterase | AB167976 |
| 137 | Fibrobacter succinogenes subsp. succinogenes S85 | acetyl xylan esterase Axe6A (axe6A) gene | AF180369 |
| 138 | Aspergillus ficuum | acetyl xylan esterase gene | AF331757 |

TABLE II-continued

| No. | Source | Gene | Accession No. |
|---|---|---|---|
| 139 | Bacillus pumilus | axe gene for acetyl xylan esterase | AJ249957 |
| 140 | Trichoderma reesei | acetyl xylan esterase | Z69256 |
| 141 | Thermoanaerobacterium sp. 'JW/SL YS485' | beta-xylosidase (xylB) and xylan esterase 1 (axe1) genes | AF001926 |
| 142 | Streptomyces thermoviolaceus | stxII, stxIII genes for xylanase II, acetyl xylan esterase | AB110644 |
| 143 | Streptomyces thermoviolaceus | stxIV, stxI genes for alpha-L-arabinofuranosidase, xylanase I | AB110643 |
| 144 | Streptomyces lividans | acetyl-xylan esterase (axeA) and xylanase B (xlnB) genes | M64552 |
| 145 | Abiotrophia para-adiacens | XynC gene for acetyl esterase | AB091396 |
| 146 | Orpinomyces sp. PC-2 | acetyl xylan esterase A (AxeA) | AF001178 |
| 147 | Caldocellum saccharolyticum | xylanase A (XynA), beta-xylosidase (XynB) and acetyl esterase (XynC) genes | M34459 |
| 148 | Talaromyces emersonii | alpha-glucuronidase (aGlu) gene | AF439788 |
| 149 | Aspergillus niger | aguA gene for alpha-glucuronidase | AJ290451 |
| 150 | Aspergillus fumigatus Af293 | alpha-glucuronidase | XM_748126 |
| 151 | Aspergillus niger CBS 513.88 | alpha-glucuronidase aguA | XM_001401166 |
| 152 | Aspergillus clavatus NRRL 1 | alpha-glucuronidase | XM_001274705 |
| 153 | Neosartorya fischeri NRRL 181 | alpha-glucuronidase | XM_001259233 |
| 154 | Neosartorya fischeri NRRL 181 | beta-galactosidase | XM_001259223 |
| 155 | Aureobasidium pullulans | alpha glucuronidase (aguA) | AY495374 |
| 156 | Aspergillus tubingensis | aguA gene | Y15405 |
| 157 | Thermotoga maritima | aguA gene | Y09510 |
| 158 | Trichoderma reesei | alpha-glucuronidase | Z68706 |
| 159 | Cellvibrio japonicus | alpha-glucuronidase (glcA67A) gene | AY065638 |
| 160 | Cellvibrio mixtus | alpha-glucuronidase (glcA67A) gene | AY065639 |
| 161 | Bacillus stearothermophilus strain T-1 | alpha-glucuronidase (aguA) gene | AF441188 |
| 162 | Bacillus stearothermophilus | alpha-glucuronidase (aguA) gene | AF221859 |
| 163 | Bacillus sp. TS-3 | abn-ts gene for arabinase-TS | AB061269 |
| 164 | Bacillus subtilis | endo-arabinase | D85132 |
| 165 | Aspergillus niger | endo-1,5-alpha-L-arabinase (abnA) gene | L23430 |
| 166 | Piromyces communis | endo-1,3-1,4-beta-glucanase (licWF3) | EU314936 |
| 167 | Neocallimastix patriciarum | endo-1,3-1,4-beta-glucanase (lic6) | EU314934 |
| 168 | Bacillus subtilis | lichenase(1,3;1,4-B-D-Glucan 4-glucanohydrolase) | E01881 |
| 169 | Clostridium thermocellum | lichenase licB gene for 1,3-(1,3:1,4)-beta-D-glucan 3(4)-glucanohydrolase | X58392 |
| 170 | Streptococcus equinus | beta-(1,3-1,4)-glucanase | Z92911 |
| 171 | Bacillus subtilis | bglS gene for beta-1,3-1,4-glucanase | Z46862 |
| 172 | Bacillus sp. | bgaA gene for lichenase | Z12151 |
| 173 | Clostridium thermocellum | licB gene for beta-1,3-1,4-glucanase | X63355 |
| 174 | Bacillus circulans | BGC gene for lichenase | X52880 |
| 175 | Anaeromyces sp. W-98 | lichenase (licB) | AF529296 |
| 176 | Bacillus licheniformis KCCM41412 | lichenase gene | AY383603 |
| 177 | Orpinomyces sp. PC-2 | lichenase (licA) | U63813 |
| 178 | Phanerochaete chrysosporium | endo-1,4-beta-D-mannanase | DQ779964 |
| 179 | Alicyclobacillus acidocaldarius | endo-beta-1,4-mannanase gene | DQ680160 |
| 180 | Clostridium cellulolyticum H10 GH26 | mannanase (man26A) and GH9 cellulase (cel9P) genes | DQ778334 |
| 181 | Aspergillus sulphureus | beta-mannanase gene | DQ328335 |

TABLE II-continued

| No. | Source | Gene | Accession No. |
|---|---|---|---|
| 182 | *Phanerochaete chrysosporium* strain RP78 | Man5C | DQ779965 |
| 183 | *Armillariella tabescens* | mannanase | DQ286392 |
| 184 | *Agaricus bisporus* | cel4 gene for CEL4a mannanase | AJ271862 |
| 185 | *Bacillus* sp. JAMB750 | man26A gene for mannanase | AB128831 |
| 186 | *Clostridium thermocellum* | man26B gene for mannanase 26B | AB044406 |
| 187 | *Bacillus circulans* isolate Y203 | mannanase gene | AY913796 |
| 188 | *Bacillus subtilis* strain Z-2 | mannose-6-phosphate isomerase and beta-1,4-mannanase genes | AY827489 |
| 189 | *Bacillus subtilis* strain A33 | beta-mannanase (man) gene | DQ269473 |
| 190 | *Bacillus subtilis* | mannanase gene | DQ351940 |
| 191 | *Bacillus circulans* isolate 196 | mannanase (man1) gene | AY907668 |
| 192 | *Bacillus* sp. JAMB-602 | amn5A gene for mannanase | AB119999 |
| 193 | *Agaricus bisporus* | mannanase CEL4b (cel4 gene) | Z50095 |
| 194 | *Piromyces* sp. | endo-b1,4-mannanase | X97520 |
| 195 | *Piromyces* sp. | endo-1,4 beta-mannanase | X97408 |
| 196 | *Piromyces* sp. | mannanase A | X91857 |
| 197 | *Clostridium thermocellum* | manA gene for mannanase A | AJ242666 |
| 198 | *Paecilomyces lilacinus* | beta-1,3-mannanase | AB104400 |
| 199 | *Bacillus circulans* | mannanase gene | AY623903 |
| 200 | *Bacillus circulans* | mannanase gene | AY540747 |
| 201 | *Dictyoglomus thermophilum* | beta-mannanase (manA) gene | AF013989 |
| 202 | *Cellvibrio japonicus* | manA gene | X82179 |
| 203 | *Bacillus circulans* | aman6 gene for alpha-1,6-mannanase | AB024331 |
| 204 | *Bacillus stearothermophilus* | beta-1,4-mannanase (manF), esterase (estA), and alpha-galactosidase (galA) genes | AF038547 |
| 205 | *Orpinomyces* sp. PC-2 | mannanase ManA (manA) | AF177206 |
| 206 | *Bacillus subtilis* | mannose-6-phosphate isomerase and endo-1,4-beta-mannosidase genes | AF324506 |
| 207 | *Rhodothermus marinus* | manA gene | X90947 |
| 208 | *Bacillus subtilis* | gene for beta-mannanase | D37964 |
| 209 | *Thermotoga maritima* | manA gene | Y17982 |
| 210 | *Cellulomonas fimi* | Man26A (man26A) gene | AF126471 |
| 211 | *Streptomyces lividans* | mannanase (manA) gene | M92297 |
| 212 | *Caldicellulosiruptor saccharolyticus* | beta-1,4-mannanase (manA) gene | U39812 |
| 213 | *Bacillus* sp. | beta-mannanase | AB016163 |
| 214 | *Bacillus circulans* | mannanase | AB007123 |
| 215 | *Caldicellulosiruptor saccharolyticus* | beta-D-mannanase (manA) | M36063 |
| 216 | *Caldocellum saccharolyticum* | beta-mannanase/endoglucanase (manA) | L01257 |
| 217 | *Aspergillus aculeatus* | mannanase (man1) | L35487 |
| 218 | *Trichoderma reesei* | beta-mannanase | L25310 |
| 219 | *Bacillus* sp. | beta-mannanase gene | M31797 |
| 220 | *Aspergillus niger* CBS 513.88 | beta-mannosidase mndA | XM_001394595 |
| 221 | *Aspergillus niger* CBS 513.88 | beta-galactosidase lacA | XM_001389585 |
| 222 | *Aspergillus clavatus* NRRL 1 | beta-mannosidase | XM_001268087 |
| 223 | *Neosartorya fischeri* NRRL 181 | beta-galactosidase | XM_001259270 |
| 224 | *Neosartorya fischeri* NRRL 181 | beta-galactosidase | XM_001259223 |
| 225 | *Aspergillus niger* | mndA gene for beta-mannosidase | AJ251874 |
| 226 | *Aspergillus niger* | aglC gene for alpha-galactosidase C | AJ251873 |
| 227 | *Aspergillus terreus* NIH2624 | beta-glucuronidase | XM_001218602 |
| 228 | *Emericella nidulans* | beta-mannosidase | DQ490488 |
| 229 | *Thermotoga neopolitana* | manA gene | Y17983 |
| 230 | *Thermotoga neopolitana* | manB gene | Y17981 |
| 231 | *Thermotoga maritima* | manB gene | Y17980 |

TABLE II-continued

| No. | Source | Gene | Accession No. |
|---|---|---|---|
| 232 | *Thermobifida fusca* | manB gene for beta-D-mannosidase | AJ489440 |
| 233 | *Thermotoga maritima* | manA gene | Y17982 |
| 234 | *Pyrococcus furiosus* | beta-mannosidase (bmnA) gene | U60214 |
| 235 | *Aspergillus aculeatus* | beta-mannosidase | AB015509 |
| 236 | *Bacteroides fragilis* | glaB gene for alpha-galactosidase | AM109955 |
| 237 | *Bacteroides fragilis* | glaA gene for alpha-galactosidase | AM109954 |
| 238 | *Aspergillus fumigatus* Af293 | alpha-galactosidase | XM_744777 |
| 239 | *Aspergillus fumigatus* Af293 | alpha-galactosidase | XM_743036 |
| 240 | *Aspergillus niger* CBS 513.88 | extracellular alpha-glucosidase aglU | XM_001402016 |
| 241 | *Aspergillus niger* CBS 513.88 | alpha-galactosidase aglA *Aspergillus niger* (aglA) | XM_001390808 |
| 242 | *Aspergillus niger* CBS 513.88 | alpha-galactosidase aglB | XM_001400207 |
| 243 | *Bacteroides thetaiotaomicron* | glaB gene for alpha-galactosidase | AM109957 |
| 244 | *Bacteroides thetaiotaomicron* | glaA gene for alpha-galactosidase | AM109956 |
| 245 | *Streptomyces avermitilis* MA-4680 | gla gene for alpha-galactosidase | AM109953 |
| 246 | *Aspergillus clavatus* NRRL 1 | alpha-galactosidase | XM_001276326 |
| 247 | *Bifidobacterium longum* | alpha-galactosidase (aglL) | AF160969 |
| 248 | *Neosartorya fischeri* NRRL 181 | alpha-galactosidase | XM_001266319 |
| 249 | *Aspergillus niger* | aglC gene for alpha-galactosidase C | AJ251873 |
| 250 | *Aspergillus niger* | aglB gene | Y18586 |
| 251 | *Lactobacillus fermentum* strain CRL722 | alpha-galactosidase (melA) gene | AY612895 |
| 252 | *Emericella nidulans* | alpha-galactosidase (AN8138-2) | DQ490515 |
| 253 | *Emericella nidulans* | alpha-galactosidase | DQ490505 |
| 254 | *Pseudoalteromonas* sp. KMM 701 | alpha-galactosidase gene | DQ530422 |
| 255 | *Lactobacillus plantarum* | melA gene for alpha-galactosidase | AJ888516 |
| 256 | *Bifidobacterium bifidum* | alpha-galactosidase (melA) gene | DQ438978 |
| 257 | *Lachancea thermotolerans* | MELth2 gene for alpha-galactosidase | AB257564 |
| 258 | *Lachancea thermotolerans* | MELth1 gene for alpha-galactosidase | AB257563 |
| 259 | *Clostridium stercorarium* | Thermostable ALPHA-galactosidase gene | BD359178 |
| 260 | *Bifidobacterium breve* strain 203 | alpha-galactosidase (aga2) gene | DQ267828 |
| 261 | *Clostridium josui* | agaA gene for alpha-galactosidase | AB025362 |
| 262 | *Trichoderma reesei* | alpha-galactosidase | Z69253 |
| 263 | *Saccharomyces mikatae* | alpha-galactosidase MEL gene | X95506 |
| 264 | *Saccharomyces paradoxus* | alpha-galactosidase MEL gene | X95505 |
| 265 | *Saccharomyces cerevisiae* | alpha-galactosidase | Z37510 |
| 266 | *Saccharomyces cerevisiae* | alpha-galactosidase | Z37511 |
| 267 | *Saccharomyces cerevisiae* | alpha-galactosidase | Z37508 |
| 268 | *Saccharomyces cerevisiae* | MEL1 gene for alpha-galactosidase | X03102 |
| 269 | *Penicillium simplicissimum* | alpha-galactosidase 1 | AJ009956 |
| 270 | *Clostridium stercorarium* | aga36A gene for alpha-galactosidase | AB089353 |
| 271 | *Bifidobacterium breve* | alpha-galactosidase (aga) gene | AF406640 |
| 272 | *Lactobacillus plantarum* | alpha-galactosidase (melA) gene | AF189765 |
| 273 | *Mycocladus corymbiferus* | Thermostable alpha-galactosidase | BD082887 to BD082889 |
| 274 | *Bacillus stearothermophilus* | alpha-galactosidase AgaB (agaB) | AY013287 |

TABLE II-continued

| No. | Source | Gene | Accession No. |
|---|---|---|---|
| 275 | *Bacillus stearothermophilus* | alpha-galactosidase AgaA (agaA) | AY013286 |
| 276 | *Bacillus stearothermophilus* | alpha-galactosidase AgaN (agaN) | AF130985 |
| 277 | *Carnobacterium piscicola* | AgaA (agaA) | AF376480 |
| 278 | *Thermus* sp. T2 | alpha galactosidase | AB018548 |
| 279 | *Phanerochaete chrysosporium* | alpha-galactosidase (agal) gene | AF246263 |
| 280 | *Phanerochaete chrysosporium* | alpha-galactosidase (agal) gene | AF246262 |
| 281 | *Zygosaccharomyces mrakii* | MELr gene for alpha-galactosidase | AB030209 |
| 282 | *Thermus thermophilus* strain TH125 | beta-glycosidase (bglT) gene | AF135400 |
| 283 | *Torulaspora delbrueckii* | MELt gene for alpha-galactosidase | AB027130 |
| 284 | *Penicillium purporogenum* | alpha-galactosidase | AB008367 |
| 285 | *Mortierella vinacea* | alpha-galactosidase | AB018691 |
| 286 | *Thermotoga neapolitana* | alpha-1,6-galactosidase (aglA) gene | AF011400 |
| 287 | *Trichoderma reesei* | alpha-galactosidase | Z69254 |
| 288 | *Trichoderma reesei* | alpha-galactosidase | Z69255 |

TABLE III

| No | Nucleotide ID | Gene name | Enzyme class | Species |
|---|---|---|---|---|
| 1 | AM397952 cDNA | lip3 | EC 1.11.1.14 | *Phlebia tremellosa* |
| 2 | AM397951 cDNA | lip2 | EC 1.11.1.14 | *Phlebia tremellosa* |
| 3 | AJ745879 cDNA | mnp | EC 1.11.1.13 | *Trametes versicolor* |
| 4 | AJ745080 cDNA | mrp | EC 1.11.1.13 | *Trametes versicolor* |
| 5 | AY836676 cDNA | mnp5 | EC 1.11.1.13 | *Pleurotus pulmonarius* |
| 6 | AJ315701 cDNA | mnp2 | EC 1.11.1.13 | *Phlebia radiate* |
| 7 | AJ310930 cDNA | mnp3 | EC 1.11.1.13 | *Phlebia radiate* |
| 8 | AB191466 cDNA | tclip | EC 1.11.1.14 | *Trametes cervina* |
| 9 | M24082 | Lig1 | EC 1.11.1.14 | *Phanerochaete chrysosporium* |
| 10 | J04980 cDNA | mp-1 | EC 1.11.1.13 | *Phanerochaete chrysosporium* |
| 11 | M80213 M36814 cDNA | lip | EC 1.11.1.14 | *Phanerochaete chrysosporium* |
| 12 | AF074951 cDNA | cdh | EC 1.1.99.18 | *Corynascus heterothallicus* |
| 13 | X97832 | cdh | EC 1.1.99.18 | *Phanerochaete chrysosporium* |
| 14 | X88897 cDNA | cdh | EC 1.1.99.18 | *Phanerochaete chrysosporium* |
| 15 | U50409 | Cdh-1 | EC 1.1.99.18 | *Phanerochaete chrysosporium* |
| 16 | U65888 | Cdh-2 | EC 1.1.99.18 | *Phanerochaete chrysosporium* |
| 17 | U46081 | cdh | EC 1.1.99.18 | *Phanerochaete chrysosporium* |
| | D90341 | celCCD | 3.2.1.4 | *Clostridium cellulolyticum* |
| | AY339624 | EglA | | *Bacillus pumilus* |
| | D83704 | celJ, celK | | *Clostridium thermocellum* |
| | EF371844 | egl | | *Ralstonia solanacearum* |
| | EF371842 | egl | | *Ralstonia solanacearum* |
| | L02544 | cenD | EC.3.2.1.4 | *Cellulomonas fimi* |
| | EU055604 | cel9B | | *Fibrobacter succinogenes* |
| | EF093188 | ega | | *Bacillus* sp. AC-1 |
| | EF620915 | endoglucanase | | *Bacillus pumilus* |
| | AB167732 | egl | | *Paenibacillus* sp. KSM-N659 |
| | AB167731 | egl | | *Paenibacillus* sp. KSM-N440 |
| | AB167730 | egl | | *Paenibacillus* sp. |
| | AB167729 | egl | | *Paenibacillus* sp. |
| | EF205153 | endoglucanase | | *Thermomonospora* sp. MTCC 5117 |
| | DQ657652 | egl | | *Ralstonia solanacearum* strain UW486 |
| | AJ616005 | celA | | *Bacillus licheniformis* |
| | DQ294349 | eglA | | *Azoarcus* sp. BH72 |

TABLE III-continued

| No Nucleotide ID | Gene name | Enzyme class | Species |
|---|---|---|---|
| DQ923327 | eg1 | | uncultured Butyrivibrio sp |
| Z12157 | cela1 | | Streptomyces halstedii |
| AJ275974 | celI | | Clostridium thermocellum |
| AB179780 | cel5A | | Eubacterium cellulosolvens |
| DQ176867 | celK | | Pectobacterium carotovorum (Erwinia carotovora) |
| X57858 | cenC | | Cellulomonas fimi |
| AY298814 | cel5B | | Thermobifida fusca |
| X79241 | celV1 | | Pectobacterium carotovorum |
| AY646113 | engO | | Clostridium cellulovorans |
| AB028320 | egV | | Ruminococcus albus |
| AB016777 | egIV | | Ruminococcus albus |
| X76640 | celA | | Myxococcus xanthus |
| Y12512 | celA | | Bacillus sp. BP-23 |
| Z83304 | endA | | Ruminococcus flavefaciens |
| Z86104 | celB, celC | | Anaerocellum thermophilum |
| Z77855 | celD | | Anaerocellum thermophilum |
| X76000 | celV | | Pectobacterium carotovorum (Erwinia carotovora) |
| X73953 | eglS | | Streptomyces rochei |
| X54932 | celB | | Ruminococcus albus |
| X54931 | celA | | Ruminococcus albus |
| X52615 | endoglucanase | | Cellvibrio japonicus |
| X69390 | celG | | Clostridium thermocellum |
| X03592 | celB | | Clostridium thermocellum |
| X17538 | end1 | | Butyrivibrio fibrisolvens |
| AJ308623 | celA | | Alicyclobacillus acidocaldarius |
| AJ304415 | engXCA | | Xanthomonas campestris pv. campestris |
| AJ133614 | celB | | Bacillus sp. BP-23 |
| AY445620 | cel9A | | Bacillus licheniformis |
| AF025769 | celB | | Erwinia carotovora subsp. carotovora |
| L20093 | E4 | | Thermomonospora fusca |
| AJ551527 | celB | | Alicyclobacillus acidocaldarius |
| M64363 | celF | | Clostridium thermocellum |
| AB044407 | celT | | Clostridium thermocellum |
| AB059267 | egl257 | | Bacillus circulans |
| AF363635 | engA | | Bacillus amyloliquefaciens |
| M31311 | eglA | | Clostridium saccharobutylicum |
| AF109242 | celZ | | Erwinia chrysanthemi |
| M31311 | eglA | | Clostridium saccharobutylicum |
| AF033262 | celA | | Pseudomonas sp. YD-15 |
| M84963 | endoglucanase | | Bacillus subtilis |
| AB047845 | celQ | | Clostridium thermocellum |
| AY007311 | celA | | Clavibacter michiganensis subsp. sepedonicus |
| AF132735 | engK | | Clostridium cellulovorans |
| U34793 | engH | | Clostridium cellulovorans |
| AF206716 | endoglucanase | | Bacillus pumilus |
| AF113404 | cel6A | | Cellulomonas pachnodae |
| X04584 | celD | | Clostridium thermocellum |
| U51222 | celA2 | | Streptomyces halstedii |
| U27084 | cel | | Bacillus sp |
| L02868 | celA | | Clostridium longisporum |
| AF067428 | Cel5A | | Bacillus agaradhaerens |
| L01577 | E3, E4, E5 | | Thermobifida fusca |
| M73321 | E2 | | Thermobifida fusca |
| L20094 | E1 | | Thermobifida fusca |
| U94825 | Endoglucanase | | Actinomyces sp. 40 |
| U37056 | engF | | Clostridium cellulovoran |
| U33887 | celG | | Fibrobacter succinogenes |
| U08621 | celB | | Ruminococcus flavefaciens FD-1 |
| Y00540 | celZ | | Erwinia chrysanthemi |
| U16308 | celC | | Caldocellum saccharolyticum |
| K03088 | celA | | Clostridium thermocellum |
| M93096 | celCCA | | Clostridium cellulolyticum |
| L03800 | celE | | Ruminococcus flavefaciens |
| L13461 | celM | | Clostridium thermocellum |
| M74044 | celY | | Erwina chrysanthemi |
| X13602 | celB | | Caldocellum saccharolyticum |
| AB078006 | CBH II | | Streptomyces sp. M23 |
| X80993 | cbhA | | Clostridium thermocellum |
| AJ005783 | cbhA, celK | | Clostridium thermocellum |
| AY494547 | cbhA | | Clostridium thermocellum |
| AF039030 | celK | | Clostridium thermocellum |
| L38827 | cbhB | EC 3.2.1.91 | Cellulomonas fimi |
| L25809 | cbhA | | Cellulomonas fimi |
| EU314939 | cbhYW23-4 | | Piromyces rhizinflatus |
| EU314933 | cbh6 | | Neocallimastix patriciarum |

TABLE III-continued

| No | Nucleotide ID | Gene name | Enzyme class | Species |
|---|---|---|---|---|
| | EF397602 | cbh1 | | *Penicillium decumbens* |
| | AB298323 | cel1, cel2 | | *Polyporus arcularius* |
| | AB298322 | cbh I | | *Polyporus arcularius* |
| | EU038070 | cbh I | | *Fusicoccum* sp. BCC4124 |
| | EF624464 | cbh | | *Thermomyces lanuginosus* |
| | AM262873 | cbhI-2 | | *Pleurotus ostreatus* |
| | AM262872 | cbhI-4 | | *Pleurotus ostreatus* |
| | AM262871 | cbhI-3 | | *Pleurotus ostreatus* |
| | AM262993 | cbhI-1 | | *Pleurotus ostreatus* |
| | XM_745507 | Cbh-celD | | *Aspergillus fumigatus* |
| | AY973993 | exo-(cbhI) | | *Penicillium chrysogenum* |
| | AF421954 | cbh | | *Thermoascus aurantiacus* |
| | XM_001389539 | cbhB | | *Aspergillus niger* |
| | XM_001391971 | cbhA | | *Aspergillus niger* |
| | DQ864992 | CBHII | | *Trichoderma viride* |
| | EF222284 | cbh3 | | *Chaetomium thermophilum* |
| | X69976 | cbh1 | | *Hypocrea koningii/Trichoderma koningii* |
| | Z29653 | exo-cbhI.2 | | *Phanerochaete chrysosporium* |
| | Z22527 | exo-cbhI | | *Phanerochaete chrysosporium* |
| | X53931 | cbh | | *Trichoderma viride* |
| | X54411 | Pccbh1-1 | | *Phanerochaete chrysosporium* |
| | DQ085790 | cbh3 | | *Chaetomium thermophilum* |
| | AY559104 | cbhII-I | | *Volvariella volvacea* |
| | AY559102 | cbhI-I | | *Volvariella volvacea* |
| | D86235 | cbh1 | | *Trichoderma reesei* |
| | DQ504304 | cbhII | | *Hypocrea koningii* strain 3.2774 |
| | E00389 | cbh | | *Hypocrea jecorina/Trichoderma reesei* |
| | AY706933 | cbh-C | | *Gibberella zeae* |
| | AY706932 | cbh-C | | *Fusarium venenatum* |
| | AY706931 | cbh-C | | *Gibberella zeae* |
| | DQ020255 | cbh-6 | | *Chaetomium thermophilum* |
| | AY954039 | cbh | | *Schizophyllum commune* |
| | D63515 | cbh-1 | | *Humicola grisea* var. *thermoidea* |
| | Z50094 | cel2-cbh | | *Agaricus bisporus* |
| | Z50094 | Exocellobiohydrolase | | *Agaricus bisporus* |
| | Z22528 | exo-cbh I | | *Phanerochaete chrysosporium* |
| | AY840982 | cbh | | *Thermoascus aurantiacus* var. *levisporus* |
| | AY761091 | cbhII | | *Trichoderma parceramosum* |
| | AY651786 | cbhII | | *Trichoderma parceramosum* |
| | AY690482 | cbhI | | *Penicillium occitanis* |
| | CQ838174 | cbh | | *Malbranchea cinnamomea* |
| | CQ838172 | cbh | | *Stilbella annulata* |
| | CQ838150 | cbh | | *Chaetomium thermophilum* |
| | AY328465 | celB-cbh | | *Neocallimastix frontalis* |
| | AB177377 | cexI, cbh | | *Irpex lacteus* |
| | AY531611 | cbh-I | | *Trichoderma asperellum* |
| | AY116307 | cbh-7 | | *Cochliobolus heterostrophus* |
| | AB002821 | cbh-I | | *Aspergillus aculeatus* |
| | AF478686 | cbh-1 | | *Thermoascus aurantiacus* |
| | AY368688 | cbh-II | | *Trichoderma viride* strain CICC 13038 |
| | AY368686 | cbhI | | *Trichoderma viride* |
| | AY091597 | Cel6E | | *Piromyces* sp. E2 |
| | AX657625 | cbh | | *Phanerochaete chrysosporium* |
| | AX657629 | cbh | | *Aspergillus* sp. |
| | AX657633 | cbh | | *Pseudoplectania nigrella* |
| | U97154 | celF | | *Orpinomyces* sp. PC-2 |
| | U97152 | celD-cbh | | *Orpinomyces* sp. PC-2 |
| | AF439935 | cbh1A | | *Talaromyces emersonii* |
| | AB021656 | cbhI | | *Trichoderma viride* |
| | AB089343 | cbh | | *Geotrichum* sp. M128 |
| | AB089436 | celC-cbh | | *Aspergillus oryzae* |
| | A35269 | cbh | | *Fusarium oxysporum* |
| | AF439936 | cbhII | | *Talaromyces emersonii* |
| | AY075018 | cbhII | | *Talaromyces emersonii* |
| | AY081766 | cbhI | | *Talaromyces emersonii* |
| | AF378175 | cbh1 | | *Trichoderma koningii* |
| | AF378173 | cbh2 | | *Trichoderma koningii* |
| | AF378174 | cbh2 | | *Trichoderma koningii* |
| | AF244369 | cbhII-1 | | *Lentinula edodes* |
| | L22656 | cbh1-4 | | *Phanerochaete chrysosporium* |
| | L24520 | cel3AC-cbh | | *Agaricus bisporus* |
| | M22220 | cbhI | | *Phanerochaete chrysosporium* |
| | AY050518 | cbh-II | | *Pleurotus sajor-caju* |
| | AF223252 | cbh-1 | | *Trichoderma harzianum* |
| | AF177205 | celI-cbh | | *Orpinomyces* sp. PC-2 |
| | AF177204 | celH-cbh | | *Orpinomyces* sp. PC-2 |
| | AF302657 | cbh-II | | *Hypocrea jecorina* |
| | AF156269 | cbh-2 | | *Aspergillus niger* |

TABLE III-continued

| No | Nucleotide ID | Gene name | Enzyme class | Species |
|---|---|---|---|---|
|  | AF156268 | cbh-2 |  | *Aspergillus niger* |
|  | AF123441 | cbh1.2 |  | *Humicola grisea* var. *thermoidea* |
|  | U50594 | cbh1.2 |  | *Humicola grisea* |
|  | M55080 | cbh-II |  | *Trichoderma reesei* |
|  | M16190 | cbh-II |  | *Trichoderma reesei* |
| 1 | NC_000961 | endoglucanase | EC 3.1.2.4 | *Pyrococcus horikoshii* |
| 2 | NC_000961/U33212/ AX467594 | cel5A | EC 3.1.2.4 | *Acidothermus cellulolyticus* 11B; ATCC 43068 |
| 3 | M32362 | cel5A | EC 3.1.2.4 | *Clostridium cellulolyticum* |
| 4 | M22759 | celE, cel5C | EC 3.2.1.4 | *Clostridium thermocellum* |
| 5 | AJ307315 | celC | EC 3.2.1.4 | *Clostridium thermocellum* |
| 6 | AJ275975 | celO | EC 3.2.1.91 | *Clostridium thermocellum* |
| 7 | X03592 | celB/cel5A | EC 3.2.1.4 | *Clostridium thermocellum* |
| 8 | Z29076 | eglS | EC 3.2.1.4 | *Bacillus subtilis* |
| 9 | M33762 | celB | EC 3.2.1.4 | *Bacillus lautus* (strain PL236) |
| 10 | L25809 | cbhA | EC 3.2.1.91 | *Cellulomonas fimi* |
| 11 | M15823 | cenA/cel6A | EC 3.2.1.4 | *Cellulomonas fimi* |
| 12 | M73321 | cel6A | EC 3.2.1.4 | *Thermobifida fusca* |
| 13 | U18978 | cel6B | EC 3.2.1.91 | *Thermomonospora fusca* |
| 14 | X65527 | cellodextrinase D | EC 3.2.1.74 | *Cellvibrio japonicus* |
| 15 | L06134 | ggh-A | EC 3.2.1.74 | *Thermobispora bispora* |
| 16 | U35425 | cdxA | EC 3.2.1.74 | *Prevotella bryantii* |
| 17 | EU352748 | cel9D | EC 3.2.1.74 | *Fibrobacter succinogenes* |
| 18 | AAL80566 | bglB | EC 3.2.1.21 | *Pyrococcus furiosus* |
| 19 | Z70242 | bglT | EC 3.2.1.21 | *Thermococcus* sp |
| 20 | M96979 | bglA | EC 3.2.1.21 | *Bacillus circulans* |
| 21 | AB009410 | beta-glucosidase | EC 3.2.1.21 | *Bacillus* sp. GL1 |
| 22 | D88311 D84489 | beta-D-glucosidase | EC 3.2.1.21 | *Bifidobacterium breve* |
| 23 | AAQ00997 | BglA | EC 3.2.1.21 | *Clostridium cellulovorans* |
| 24 | X15644 | bglA | EC 3.2.1.21 | *Clostridium thermocellum* |
| 25 | AAA25311 | BglB | EC 3.2.1.21 | *Thermobispora bispora* |
| 26 | AB198338 | bglA | EC 3.2.1.21 | *Paenibacillus* sp. HC1 |
| 27 | AF305688 | Bgl1 | EC 3.2.1.21 | *Sphingomonas paucimobilis* |
| 28 | CAA91220 | beta-glucosidase | EC 3.2.1.21 | *Thermoanaerobacter brockii* |
| 29 | CAA52276 | beta-glucosidase | EC 3.2.1.21 | *Thermotoga maritime* |
| 30 | AAO15361 | beta-glucosidase | EC 3.2.1.21 | *Thermus caldophilus* |
| 31 | Z97212 | beta-glucosidase | EC 3.2.1.21 | *Thermotoga neapolitana* |
| 32 | AB034947 | beta-glucosidase | EC 3.2.1.21 | *Thermus* sp. Z-1 |
| 33 | M31120 | beta-glucosidase | EC 3.2.1.21 | *Butyrivibrio fibrisolvens* |
| 34 | D14068 | beta-glucosidase | EC 3.2.1.21 | *Cellvibrio gilvus* |
| 35 | AF015915 | Bg1 | EC 3.2.1.21 | *Flavobacterium meningosepticum* |
| 36 | U08606 | bgxA | EC 3.2.1.21 | *Erwinia chrysanthemi* |
| 37 | Z94045 | bglZ | EC 3.2.1.21 | *Clostridium stercorarium* |
| 38 | AY923831 | bglY | EC 3.2.1.21 | *Paenibacillus* sp. |
| 38 | Z56279 | xglS | EC 3.2.1.21 | *Thermoanaerobacter brockii* |
| 39 | CQ893499 | bglB | EC 3.2.1.21 | *Thermotoga maritime* |
|  | DQ916114 | beta-glucosidase (RG11) | EC 3.2.1.21 | uncultured bacterium |
|  | DQ182493 | beta-glucosidase | EC 3.2.1.21 | uncultured bacterium |
|  | DQ916117 | beta-glucosidase | EC 3.2.1.21 | uncultured bacterium |
|  | DQ022614 | umbgl3A | EC 3.2.1.21 | uncultured bacterium |
|  | DQ916115 | RG12 beta-glucosidase gene | EC 3.2.1.21 | uncultured bacterium |
|  | DQ182494 | beta-glucosidase (umbgl3C) | EC 3.2.1.21 | uncultured bacterium |
|  | DQ916118 | Uncultured bacterium clone RG25 | EC 3.2.1.21 | uncultured bacterium |
|  | DQ916116 | RG14 beta-glucosidase gene | EC 3.2.1.21 | uncultured bacterium |
|  | U12011 | Bgl | EC 3.2.1.21 | unidentified bacterium |
|  | AB253327 | bgl1B | EC 3.2.1.21 | *Phanerochaete chrysosporium* |
|  | AB253326 | beta-glucosidase | EC 3.2.1.21 | *Phanerochaete chrysosporium* |
|  | AJ276438 | beta-glucosidase | EC 3.2.1.21 | *Piromyces* sp. E2 |
|  | AF439322 | bg1 | EC 3.2.1.21 | *Talaromyces emersonii* |
|  | D64088 cDNA | beta-glucosidase 1 | EC 3.2.1.21 | *Aspergillus aculeatus* |
|  | DQ490467 cDNA | beta-glucosidase 1 | EC 3.2.1.21 | *Emericella nidulans* |
|  | AAB27405 | beta-glucosidase | EC 3.2.1.21 | *Aspergillus niger* |
|  | AX616738 | beta-glucosidase | EC 3.2.1.21 | *Aspergillus oryzae* |
|  | AJ130890 |  | EC 3.2.1.21 | *Botryotinia fuckeliana* |
|  | L21014 | beta-glucosidase | EC 3.2.1.21 | *Dictyostelium discoideum* |
|  | U87805 | bgl1 | EC 3.2.1.21 | *Coccidioides posadasii* |
|  | AM922334 | beta-glucosidase | EC 3.2.1.21 | *Rhizomucor miehei* |
|  | DQ114396 | bgl1 | EC 3.2.1.21 | *Thermoascus aurantiacus* |
|  | CS497644 | beta-glucosidase | EC 3.2.1.21 | *Penicillium brasilianum* |
|  | DD463307 | beta-glucosidase | EC 3.2.1.21 | *Aspergillus oryzae* |

TABLE III-continued

| No Nucleotide ID | Gene name | Enzyme class | Species |
|---|---|---|---|
| DD463306 | beta-glucosidase | EC 3.2.1.21 | *Aspergillus oryzae* |
| DD463305 | beta-glucosidase | EC 3.2.1.21 | *Aspergillus oryzae* |
| DQ926702 | beta-glucosidase | EC 3.2.1.21 | *Rhizoctonia solani* |
| AY281378 | beta-glucosidase cel3D | EC 3.2.1.21 | *Hypocrea jecorina/Trichoderma reesei* |
| EU029950 | beta-glucosidase | EC 3.2.1.21 | *Penicillium occitanis* |
| EF648280 | beta-glucosidase | EC 3.2.1.21 | *Chaetomium thermophilum* |
| EF527403 | bgl1 | EC 3.2.1.21 | *Penicillium brasilianum* |
| DQ114397 | bgl1 | EC 3.2.1.21 | *Thermoascus aurantiacus* |
| XM_001398779 | bgl1 | EC 3.2.1.21 | *Aspergillus niger* |
| XM_001274044 | beta-glucosidase | EC 3.2.1.21 | *Aspergillus clavatus* |
| AF121777 | beta-glucosidase | EC 3.2.1.21 | *Aspergillus niger* |
| AJ566365 | beta-glucosidase | EC 3.2.1.21 | *Aspergillus oryzae* |
| AJ132386 | bgl1 | EC 3.2.1.21 | *Aspergillus niger* |
| AF016864 | beta-glucosidase | EC 3.2.1.21 | *Orpinomyces* sp. PC-2 |
| CS435985 | beta-glucosidase | EC 3.2.1.21 | *Hypocrea jecorina* |
| DQ011524 | bgl2 | EC 3.2.1.21 | *Thermoascus aurantiacus* |
| DQ011523 | bgl2 | EC 3.2.1.21 | *Thermoascus aurantiacus* |
| DD329362 | Bgl6 | EC 3.2.1.21 | *Hypocrea jecorina/Trichoderma reesei* |
| DD329363 | Bgl6 | EC 3.2.1.21 | *Hypocrea jecorina*/Trichoderma reesei |
| DQ888228 | bgl | EC 3.2.1.21 | *Chaetomium thermophilum* |
| DQ655704 | bgl | EC 3.2.1.21 | *Aspergillus niger* |
| DQ010948 | bgl | EC 3.2.1.21 | *Pichia anomala*/Candida beverwijkiae |
| DQ010947 | beta-glucosidase | EC 3.2.1.21 | *Hanseniaspora uvarum* |
| DD146974 | Bgl | EC 3.2.1.21 | *Hypocrea jecorina/Trichoderma reesei* |
| DD146973 | Bgl | EC 3.2.1.21 | *Hypocrea jecorina/Trichoderma reesei* |
| DD182179 | Bgl | EC 3.2.1.21 | *Hypocrea jecorina/Trichoderma reesei* |
| DD182178 | Bgl | EC 3.2.1.21 | *Hypocrea jecorina/Trichoderma reesei* |
| DD181296 | Bgl | EC 3.2.1.21 | *Hypocrea jecorina/Trichoderma reesei* |
| DD181295 | Bgl | EC 3.2.1.21 | *Hypocrea jecorina/Trichoderma reesei* |
| CS103208 | beta-glucosidase | EC 3.2.1.21 | *Aspergillus fumigatus* |
| AJ276438 | bgl1A | EC 3.2.1.21 | *Piromyces* sp. E2 |
| AY943971 | bgl1 | EC 3.2.1.21 | *Aspergillus avenaceus* |
| AY688371 | bgl1 | EC 3.2.1.21 | *Phaeosphaeria avenaria* |
| AY683619 | bgl1 | EC 3.2.1.21 | *Phaeosphaeria nodorum* |
| AB081121 | beta-glucosidase | EC 3.2.1.21 | *Phanerochaete chrysosporium* |
| AY445049 | bgla | EC 3.2.1.21 | *Candida albicans* |
| AF500792 | beta-glucosidase | EC 3.2.1.21 | *Piromyces* sp. E2 |
| AY343988 | beta-glucosidase | EC 3.2.1.21 | *Trichoderma viride* |
| AY072918 | beta-glucosidase | EC 3.2.1.21 | *Talaromyces emersonii* |
| BD185278 | beta-glucosidase | EC 3.2.1.21 | *Debaryomyces hansenii/Candida famata* |
| BD178410 | beta-glucosidase | EC 3.2.1.21 | *Debaryomyces hansenii/Candida famata* |
| BD168028 | beta-glucosidase | EC 3.2.1.21 | *Acremonium cellulolyticus* |
| AB003110 | bgl | EC 3.2.1.21 | *Hypocrea jecorina/Trichoderma reesei* |
| AB003109 | bgl4 | EC 3.2.1.21 | *Humicola grisea* var. *thermoidea* |
| AY049946 | BGL5 | EC 3.2.1.21 | *Coccidioides posadasii* |
| AF338243 | BGL3 | EC 3.2.1.21 | *Coccidioides posadasii* |
| AY081764 | beta-glucosidase | EC 3.2.1.21 | *Talaromyces emersonii* |
| AY049947 | BGL6 | EC 3.2.1.21 | *Coccidioides posadasii* |
| AY049945 | BGL4 | EC 3.2.1.21 | *Coccidioides posadasii* |
| AY049944 | BGL3 | EC 3.2.1.21 | *Coccidioides posadasii* |
| AF022893 | BGL2 | EC 3.2.1.21 | *Coccidioides posadasii* |
| AX011537 | beta-glucosidase | EC 3.2.1.21 | *Aspergillus oryzae* |
| AF268911 | beta-glucosidase | EC 3.2.1.21 | *Aspergillus niger* |
| U31091 | beta-glucosidase | EC 3.2.1.21 | *Candida wickerhamii* |
| U13672 | beta-glucosidase | EC 3.2.1.21 | *Candida wickerhamii* |
| AF036873 | beta-glucosidase | EC 3.2.1.21 | *Phanerochaete chrysosporium* |
| AF036872 | beta-glucosidase | EC 3.2.1.21 | *Phanerochaete chrysosporium* |
| X05918 | beta-glucosidase | EC 3.2.1.21 | *Kluyveromyces marxianus* |
| U16259 | beta-glucosidase (bgln) | EC 3.2.1.21 | *Pichia capsulata* |
| M22476 | BGL2 | | *Saccharomycopsis fibuligera* |
| M22475 | BGL1 | | *Saccharomycopsis fibuligera* |
| M27313 | beta-glucosidase | | *Schizophyllum commune* |

TABLE IV

| No. | Source | Gene | Accession No. |
|---|---|---|---|
| 1 | *Gibberella zeae* | triacylglycerol lipase FGL5 | EU402385 |
| 2 | *Schizosaccharomyces pombe* | 972h-triacylglycerol lipase (SPCC1450.16c) | NM_001023305 |
| 3 | *Schizosaccharomyces pombe* | 972h-esterase/lipase (SPAC8F11.08c) | NM_001019384 |
| 4 | *Schizosaccharomyces pombe* | 972h-triacylglycerol lipase (SPAC1A6.05c) | NM_001018593 |

TABLE IV-continued

| No. | Source | Gene | Accession No. |
|---|---|---|---|
| 5 | Hypocrea lixii | lip1 gene for lipase 1 | AM180877 |
| 6 | Thermomyces lanuginosus | lipase (LGY) gene | EU022703 |
| 7 | Aspergillus niger strain F044 | triacylglycerol lipase precursor | DQ647700 |
| 8 | Antrodia cinnamomea | lipase | EF088667 |
| 9 | Aspergillus oryzae | tglA gene for triacylglycerol lipase | AB039325 |
| 10 | Gibberella zeae | triacylglycerol lipase FGL4 | EU191903 |
| 11 | Gibberella zeae | triacylglycerol lipase FGL2 | EU191902 |
| 12 | Gibberella zeae | triacylglycerol lipase (fgl3) | EU139432 |
| 13 | Aspergillus tamarii isolate FS132 | lipase | EU131679 |
| 14 | Aureobasidium pullulans strain HN2.3 | extracellular lipase gene | EU117184 |
| 15 | Rhizopus microsporus var. chinensis | lipase | EF405962 |
| 16 | Fusarium oxysporum | lipase (lip1) | EF613329 |
| 17 | Aspergillus tamarii isolate FS132 | lipase | EF198417 |
| 18 | Neosartorya fischeri NRRL 181 | Secretory lipase (NFIA_072820) | XM_001259263 |
| 19 | Neosartorya fischeri NRRL 181 | Secretory lipase (NFIA_047420) | XM_001257303 |
| 20 | Nectria haematococca | NhL1 gene for extracellular lipase | AJ271094 |
| 21 | Aspergillus terreus NIH2624 | lipase precursor (ATEG_09822) | XM_001218443 |
| 22 | Galactomyces geotrichum | lipase | DQ841229 |
| 23 | Yarrowia lipolytica | lipase 2 | DQ831123 |
| 24 | Magnaporthe grisea | vacuolar triacylglycerol lipase (VTL1) | DQ787100 |
| 25 | Magnaporthe grisea | triacylglycerol lipase (TGL3-2) | DQ787099 |
| 26 | Magnaporthe grisea | triacylglycerol lipase (TGL3-1) | DQ787098 |
| 27 | Magnaporthe grisea | triacylglycerol lipase (TGL2) | DQ787097 |
| 28 | Magnaporthe grisea | triacylglycerol lipase (TGL1-2) | DQ787096 |
| 29 | Magnaporthe grisea | triacylglycerol lipase (TGL1-1) | DQ787095 |
| 30 | Magnaporthe grisea | hormone-sensitive lipase (HDL2) | DQ787092 |
| 31 | Magnaporthe grisea | hormone-sensitive lipase (HDL1) | DQ787091 |
| 32 | Penicillium expansum | triacylglycerol lipase | DQ677520 |
| 33 | Aspergillus niger | triacylglycerol lipase B (lipB) | DQ680031 |
| 34 | Aspergillus niger | triacylglycerol lipase A (lipA) | DQ680030 |
| 35 | Yarrowia lipolytica | lip2 | AJ012632 |
| 36 | Galactomyces geotrichum | triacylglycerol lipase | X81656 |
| 37 | Candida antarctica | lipase B | Z30645 |
| 38 | Candida cylindracea | LIP1 to LIP5 gene for lipase | X64703 to X64708 |
| 39 | Yarrowia lipolytica | LIPY8p (LIPY8) gene | DQ200800 |
| 40 | Yarrowia lipolytica | LIPY7p (LIPY7) gene | DQ200799 |
| 41 | Rhizopus niveus | prepro thermostable lipase | E12853 |
| 42 | Galactomyces geotrichum | lipase | E02497 |
| 43 | Rhizomucor miehei | lipase | A02536 |
| 44 | | | |
| 45 | Fusarium heterosporum | lipase | S77816 |
| 46 | Candida albicans SC5314 | triglyceride lipase (CaO19_10561) | XM_716177 |
| 47 | Candida albicans SC5314 | triglyceride lipase (CaO19_3043) | XM_716448 |
| 48 | Rhizopus stolonifer | lipase lipRs | DQ139862 |
| 49 | Candida albicans | secretory lipase 3 (LIP3) gene to lipase 10 (LIP10) | AF191316 to AF191323 |
| 50 | Candida albicans | secretory lipase 1 (LIP1) | AF188894 |
| 51 | Candida albicans | secretory lipase (LIP2) gene | AF189152 |
| 52 | Emericella nidulans | triacylglycerol lipase (lipA) gene | AF424740 |
| 53 | Gibberella zeae | extracellular lipase (FGL1) | AY292529 |
| 54 | Kurtzmanomyces sp. I-11 | lipase | AB073866 |
| 55 | Candida deformans | lip1 gene to lip 3 for triacylglycerol lipase | AJ428393 to AJ428395 |
| 56 | Botryotinia fuckeliana | lipase (lip1) | AY738714 |
| 57 | Penicillium allii | lipase (lipPA) | AY303124 |
| 58 | Aspergillus flavus | lipase | AF404489 |
| 59 | Aspergillus parasiticus | lipase | AF404488 |
| 60 | Yarrowia lipolytica | LIP4 gene for lipase | AJ549517 |
| 61 | Candida parapsilosis | lip1 gene for lipase 1 and lip2 gene for lipase 2 | AJ320260 |
| 62 | Penicillium expansum | triacylglycerol lipase precursor | AF288685 |
| 63 | Penicillium cyclopium | alkaline lipase | AF274320 |
| 64 | Pseudomonas sp. | lip35 lipase gene | EU414288 |
| 65 | Bacillus sp. NK13 | lipase gene | EU381317 |
| 66 | Uncultured bacterium | lipase/esterase gene | EF213583 to EF213587 |
| 67 | Shewanella piezotolerans | WP3 lipase gene | EU352804 |
| 68 | Bacillus sp. Tosh | lipase (lipA) gene | AY095262 |
| 69 | Bacillus subtilis strain FS321 | lipase | EF567418 |
| 70 | Pseudomonas fluorescens strain JCM5963 | lipase | EU310372 |
| 71 | Pseudomonas fluorescens | triacylglycerol lipase | D11455 |
| 72 | Burkholderia cepacia | alkaline lipase | EU280313 |
| 73 | Burkholderia sp. HY-10 | lipase (lipA) and lipase foldase (lifA) genes | EF562602 |

TABLE IV-continued

| No. | Source | Gene | Accession No. |
|---|---|---|---|
| 74 | *Pseudomonas aeruginosa* | lip9, lif9 genes for LST-03 lipase, lipase-specific foldase | AB290342 |
| 75 | *Pseudomonas fluorescens* | gene for lipase | AB009011 |
| 76 | *Streptomyces fradiae* | clone k11 lipase gene | EF429087 |
| 77 | *Geobacillus zalihae* strain T1 | thermostable lipase gene | AY260764 |
| 78 | *Pseudomonas* sp. MIS38 | gene for lipase | AB025596 |
| 79 | *Uncultured bacterium* | cold-active lipase (lipCE) gene | DQ925372 |
| 80 | *Burkholderia cepacia* | lipase (lipA) and lipase chaperone (lipB) genes | DQ078752 |
| 81 | *Psychrobacter* sp. | 2-17 lipase gene | EF599123 |
| 82 | *Bacillus subtilis* strain Fs32b | lipase gene | EF541144 |
| 83 | *Bacillus subtilis* strain FS14-3a | lipase gene | EF538417 |
| 84 | *Aeromonas hydrophila* strain J-1 | extracellular lipase gene | EF522105 |
| 85 | *Acinetobacter* sp. MBDD-4 | lipase gene | DQ906143 |
| 86 | *Photorhabdus luminescens* subsp. *akhurstii* strain 1007-2 | lipase 1 (lip1) gene | EF213027 |
| 87 | *Uncultured bacterium* clone h1Lip1 | lipase gene | DQ118648 |
| 88 | *Geobacillus thermoleovorans* | lipase precursor (lipA) gene | EF123044 |
| 89 | *Bacillus pumilus* strain F3 | lipase precursor | EF093106 |
| 90 | *Pseudomonas fluorescens* lipase (lipB68) gene | lipase (lipB68) gene | AY694785 |
| 91 | *Geobacillus stearothermophilus* strain ARM1 | thermostable lipase precursor gene | EF042975 |
| 92 | *Serratia marcescens* strain ECU1010 | extracellular lipase (lipA) gene | DQ884880 |
| 93 | *Bacillus subtilis* | lipase gene | DQ250714 |
| 94 | *Pseudomonas aeruginosa* | gene for lipase modulator protein | D50588 |
| 95 | *Pseudomonas aeruginosa* | gene for lipase | D50587 |
| 96 | *Uncultured bacterium* clone pUE5 | esterase/lipase (estE5) gene | DQ842023 |
| 97 | *Serratia marcescens* strain ES-2 | lipase (esf) gene | DQ841349 |
| 98 | *Pseudomonas fluorescens* strain 26-2 | lipase class 3 gene | DQ789596 |
| 99 | *Stenotrophomonas maltophilia* strain 0450 | lipase gene | DQ647508 |
| 100 | *Listonella anguillarum* | Plp (plp), Vah1 (vah1), LlpA (llpA), and LlpB (llpB) genes | DQ008059 |
| 101 | *Geobacillus* sp. | SF1 lipase gene | DQ009618 |
| 102 | *Uncultured Pseudomonas* sp. | lipase (lipJ03) gene | AY700013 |
| 103 | *Photobacterium* sp. M37 | lipase gene | AY527197 |
| 104 | *Pseudomonas fluorescens* | lipase (lip) gene | DQ305493 |
| 105 | *Pseudomonas aeruginosa* | lipase (lipB) gene | DQ348076 |
| 106 | *Bacillus pumilus* mutant | lipase precursor | DQ345448 |
| 107 | *Bacillus pumilus* strain YZ02 | lipase gene | DQ339137 |
| 108 | *Geobacillus thermoleovorans* YN | thermostable lipase (lipA) gene | DQ298518 |
| 109 | *Pseudomonas* sp. CL-61 | lipase (lipP) gene | DQ309423 |
| 110 | *Burkholderia* sp. 99-2-1 | lipase (lipA) gene | AY772174 |
| 111 | *Burkholderia* sp. MC16-3 | lipase (lipA) gene | AY772173 |
| 112 | *Pseudomonas fluorescens* | lipase (lipB52) gene | AY623009 |
| 113 | *Geobacillus stearothermophilus* | lipase gene | AY786185 |
| 114 | *Burkholderia multivorans* strain Uwc 10 | LifB (lifB) gene | DQ103702 |
| 115 | *Burkholderia multivorans* strain Uwc 10 | LipA (lipA) gene | DQ103701 |
| 116 | *Bacillus pumilus* | lipase precursor gene | AY494714 |
| 117 | *Bacillus* sp. TP10A.1 | triacylglycerol lipase (lip1) gene | AF141874 |
| 118 | *Staphylococcus warneri* | gehWC gene for lipase | AB189474 |
| 119 | *Staphylococcus warneri* | lipWY gene for lipase | AB189473 |
| 120 | *Bacillus* sp. L2 | thermostable lipase gene | AY855077 |
| 121 | *Bacillus megaterium* | lipase/esterase gene | AF514856 |
| 122 | *Pseudomonas aeruginosa* | lip8 gene for lipase | AB126049 |
| 123 | *Bacillus* sp. 42 | thermostable organic solvent tolerant lipase gene | AY787835 |
| 124 | *Pseudomonas fluorescens* | lipase (lipB41) gene | AY721617 |
| 125 | *Burkholderia cepacia* | triacylglycerol lipase (LipA) and lipase chaperone (LipB) genes | AY682925 |
| 126 | *Pseudomonas aeruginosa* | triacylglycerol lipase (LipA) and lipase chaperone (LipB) genes | AY682924 |
| 127 | *Vibrio vulnificus* | lipase and lipase activator protein genes | AF436892 |
| 128 | *Uncultured bacterium* plasmid pAH114 | lipase (lipA) gene | AF223645 |
| 129 | *Thermoanaerobacter tengcongensis* | lipase (lip1) gene | AY268957 |
| 130 | *Pseudomonas aeruginosa* | lip3 gene for lipase | AB125368 |
| 131 | *Staphylococcus epidermidis* | lipase precursor (gehD) gene | AF090142 |
| 132 | *Pseudomonas fluorescens* clone: pLP101-2741 | lipA gene for lipase | AB109036 |

TABLE IV-continued

| No. | Source | Gene | Accession No. |
|---|---|---|---|
| 133 | Pseudomonas fluorescens clone: pLPM101 | lipA gene for lipase | AB109035 |
| 134 | Pseudomonas fluorescens clone: pLPD101 | lipA gene for lipase | AB109034 |
| 135 | Pseudomonas fluorescens clone: pLP101 | lipA gene for lipase | AB109033 |
| 136 | Micrococcus sp. HL-2003 | lipase gene | AY268069 |
| 137 | Pseudomonas sp. JZ-2003 | lipase gene | AY342316 |
| 138 | Vibrio harveyi | vest gene | AF521299 |
| 139 | Pseudomonas fluorescens | lipase gene | AY304500 |
| 140 | Bacillus sphaericus strain 205y | lipase gene | AF453713 |
| 141 | Bacillus subtilis | lipase (lipE) gene | AY261530 |
| 142 | Synthetic construct | triacylglycerol lipase gene | AY238516 |
| 143 | Serratia marcescens | lipA gene for lipase | D13253 |
| 144 | Geobacillus thermoleovorans IHI-91 | thermophilic lipase gene | AY149997 |
| 145 | Streptomyces rimosus | GDSL-lipase gene | AF394224 |
| 146 | Pseudomonas luteola | triacylglycerol lipase precursor gene | AF050153 |
| 147 | Geobacillus thermoleovorans | thermostable lipase (lipA) | AY095260 |
| 148 | Mycoplasma hyopneumoniae | triacylglycerol lipase (lip) gene | AY090779 |
| 149 | Staphylococcus aureus | lipase gene | AY028918 |
| 150 | Bacillus sp. B26 | lipase gene | AF232707 |
| 151 | Pseudomonas aeruginosa | triacylglycerol acylhydrolase (lipA) | AF237723 |
| 156 | Bacillus stearothermophilus | lipase gene | AF429311 |
| 157 | Bacillus stearothermophilus | lipase gene | AF237623 |
| 158 | Bacillus thermoleovorans | lipase (ARA) gene | AF134840 |
| 159 | Bacillus stearothermophilus | lipase gene | U78785 |
| 160 | Pseudomonas fluorescens | lipase (lipB) gene | AF307943 |
| 161 | Pseudomonas sp. KB700A | KB-lip gene for lipase | AB063391 |
| 162 | Moritella marina | super-integron triacylglycerol acyl hydrolase (lip) gene | AF324946 |
| 163 | Staphylococcus xylosus | lipase precursor GehM (gehM) gene | AF208229 |
| 164 | Staphylococcus warneri | lipase precursor (gehA) gene | AF208033 |
| 165 | Pseudomonas sp. UB48 | lipase (lipUB48) gene | AF202538 |
| 166 | Psychrobacter sp. St1 | lipase (lip) gene | AF260707 |
| 167 | Pseudomonas fluorescens | polyurethanase lipase A (pulA) gene | AF144089 |
| 168 | Staphylococcus haemolyticus | lipase gene | AF096928 |
| 169 | Pseudomonas fluorescens | genes for ABC exporter operon | AB015053 |
| 170 | Pseudomonas aeruginosa | lipase (lipC) gene | U75975 |
| 171 | Streptomyces coelicolor | lipase (lipA), and LipR activator (lipR) genes | AF009336 |
| 172 | Petroleum-degrading bacterium HD-1 | gene for esterase HDE | AB029896 |
| 173 | Pseudomonas fragi | lipase precursor gene | M14604 |
| 174 | Acinetobacter calcoaceticus | lipase (lipA) and lipase chaperone (lipB) genes | AF047691 |
| 175 | Streptomyces albus | lipase precursor (lip) and LipR genes | U03114 |
| 176 | Staphylococcus epidermidis | lipase precursor (geh1) gene | AF053006 |
| 177 | Pseudomonas sp. B11-1 | lipase (lipP) gene | AF034088 |
| 178 | Pseudomonas fluorescens | lipase (lipA) gene | AF031226 |
| 179 | Pseudomonas aeruginosa | gene for lipase | AB008452 |
| 180 | Pseudomonas wisconsinensis | extracellular lipase (lpwA) and lipase helper protein (lpwB) genes | U88907 |
| 181 | Aeromonas hydrophila | extracellular lipase (lip) gene | U63543 |
| 182 | Streptomyces sp. | triacylglycerol acylhydrolase (lipA) and lipA transcriptional activator (lipR) genes | M86351 |
| 183 | Proteus vulgaris | alkaline lipase gene | U33845 |
| 184 | Moraxella sp. | lip3 gene for lipase 3 | X53869 |
| 185 | Serratia marcescens SM6 | extracellular lipase (lipA) | U11258 |
| 186 | Staphylococcus aureus | geh gene encoding lipase (glycerol ester hydrolase) | M12715 |
| 187 | Pseudomonas fluorescens | lipase gene | M86350 |
| 188 | Bacillus subtilis | lipase (lipA) | M74010 |
| 189 | Staphylococcus epidermidis | lipase (gehC) gene | M95577 |

TABLE V

| Nucleotide Id | Gene | Enzyme class | Species |
|---|---|---|---|
| EU367969 | alpha-amylase | 3.2.1.1 | Bacillus amyloliquefaciens |
| BD249244 | Alpha-amylase | | Bacillus amyloliquefaciens |
| DD238310 | Alpha-amylase | | Bacillus amyloliquefaciens |
| BD460864 | Alpha-amylase | | Bacillus amyloliquefaciens |
| V00092 | Alpha-amylase | | Bacillus amyloliquefaciens |
| M18424 | Alpha-amylase | | Bacillus amyloliquefaciens |

TABLE V-continued

| Nucleotide Id | Gene | Enzyme class | Species |
|---|---|---|---|
| J01542 | Alpha-amylase | | *Bacillus amyloliquefaciens* |
| EU184860 | amyE | | *Bacillus subtilis* |
| AM409180 | amy | | *Bacillus subtilis* |
| E01643 | alpha-amylase | | *Bacillus subtilis* |
| X07796 | alpha-amylase | | *Bacillus subtilis* 2633 |
| AY594351 | alpha-amylase | | *Bacillus subtilis* strain HA401 |
| AY376455 | amy | | *Bacillus subtilis* |
| V00101 | amyE | | *Bacillus subtilis* |
| AF115340 | maltogenic amylase | EC 3.2.1.133 | *Bacillus subtilis* |
| AF116581 | amy | EC 3.2.1.1 | *Bacillus subtilis* |
| K00563 | alpha-amylase | | *Bacillus subtilis* |
| M79444 | alpha-amylase | | *Bacillus subtilis* |
| DQ852663 | alpha-amylase | | *Geobacillus stearothermophilus* |
| E01181 | alpha-amylase | | *Geobacillus stearothermophilus* |
| E01180 | alpha-amylase | | *Geobacillus stearothermophilus* |
| E01157 | alpha-amylase | | *Geobacillus (Bacillus) stearothermophilus* |
| Y17557 | maltohexaose-producing alpha-amylase | 3.2.1.133 | *Bacillus stearothermophilus* |
| AF032864 | ami | EC 3.2.1.1 | *Bacillus stearothermophilus* |
| U50744 | maltogenic amylase BSMA | 3.2.1.133 | *Bacillus stearothermophilus* |
| M13255 | amyS | EC 3.2.1.1 | *B. stearothermophilus* |
| M11450 | alpha-amylase | | *B. stearothermophilus* |
| M57457 | alpha amylase | | *B. stearothermophilus* |
| X59476 | alpha-amylase | | *B. stearothermophilus* |
| X02769 | alpha-amylase | | *Bacillus stearothermophilus* |
| X67133 | BLMA | | *Bacillus licheniformis* |
| BD249243 | Alpha-amylase | | *Bacillus licheniformis* |
| DQ517496 | alpha-amylase | | *Bacillus licheniformis* strain RH 101 |
| DD238309 | alpha-amylase | | *Bacillus licheniformis* |
| E12201 | ACID-RESISTANT/THERMOSTABLE ALPHA-AMYLASE GENE | | *Bacillus licheniformis* |
| BD460878 | Alpha-amylase | | *Bacillus licheniformis* |
| DQ407266 | amyl thermotolerant | | *Bacillus licheniformis* |
| AF438149 | amy hyperthermostable | | *Bacillus licheniformis* |
| A27772 | amyl thermotolerant | EC 3.2.1.1 | *Bacillus licheniformis* |
| A17930 | Alpha amylase | | *Bacillus licheniformis* |
| M13256 | amyS | | *B. licheniformis* |
| M38570 | alpha-amylase | | *B. licheniformis* |
| AF442961 | alpha-amylase amyA | | *Halothermothrix orenii* |
| AY220756 | alpha amylase | | *Xanthomonas campestris* |
| AY165038 | alpha-amylase | | *Xanthomonas campestris* pv. *campestris* |
| AF482991 | alpha-amylase | | *Xanthomonas campestris* pv. *campestris* str. 8004 |
| M85252 | amy | | *Xanthomonas campestris* |
| AY240946 | amyB | | *Bifidobacterium adolescentis* |
| EU352611 | alpha-amylase | | *Streptomyces lividans* |
| EU414483 | amylase-like gene | | *Microbispora* sp. V2 |
| EU352611 | alpha-amylase (amyA) | | *Streptomyces lividans* |
| D13178 | alpha-amylase | | *Thermoactinomyces vulgaris* |
| EU159580 | amylase gene | | *Bacillus* sp. YX |
| D90112 | raw-starch-digesting amylase | | *Bacillus* sp. B1018 |
| AB274918 | amyI, thermostable amylase | | *Bacillus halodurans* |
| EU029997 | Alpha-amylase | | *Bacillus* sp. WHO |
| AM409179 | maltogenic amylase | 3.2.1.133 | *Bacillus* sp. US149 |
| AB178478 | Alpha-amylase | | *Bacillus* sp. KR-8104 |
| AB029554 | alpha-amylase, glucoamylase | 3.2.1.1, 3.2.1.3 | *Thermoactinomyces vulgaris* |
| DQ341118 | alpha amylase | 3.2.1.1 | *Bifidobacterium thermophilum* strain JCM7027 |
| D12818 | glucoamylase | 3.2.1.3 | *Clostridium* sp. |
| AB115912 | glucoamylase | | *Clostridium thermoamylolyticum* |
| AB047926 | glucoamylase | | *Thermoactinomyces vulgaris* R-47 |
| AF071548 | glucoamylase | | *Thermoanaerobacterium thermosaccharolyticum* |
| DQ104609 | glucoamylase (gla) | | *Chaetomium thermophilum* |
| AB083161 | glucoamylase | | *Aspergillus awamori* GA I |
| EF545003 | glucoamylase (gla) | | *Thermomyces lanuginosus* |
| XM_743288 | glucan 1,4-alpha-glucosidase | | *Aspergillus fumigatus* |
| DQ268532 | glucoamylase A | | *Rhizopus oryzae* |
| DQ219822 | glucoamylase b | | *Rhizopus oryzae* |
| D10460 | glucoamylase | | *Aspergillus shirousami* GLA |

TABLE V-continued

| Nucleotide Id | Gene | Enzyme class | Species |
|---|---|---|---|
| AJ304803 | glucoamylase | | Talaromyces emersonii |
| Z46901 | glucoamylase | | Arxula adeninivorans |
| XM_001215158 | glucoamylase | | Aspergillus terreus NIH2624 |
| AY948384 | glucoamylase | | Thermomyces lanuginosus |
| X00712 | Glucoamylase | 3.2.1.3 | A. niger |
| AB239766 | glucoamylase | | Fomitopsis palustris |
| E15692 | Glucoamylase | | Aspergillus oryzae |
| E01247 | glucoamylase | | Rhizopus oryzae |
| E01175 | glucoamylase | | Saccharomycopsis fibuligera |
| E00315 | glucoamylase | | Aspergillus awamori |
| DQ211971 | gluB | | Aspergillus oryzae |
| AJ890458 | gla66 | | Trichoderma harzianum |
| X58117 | glucoamylase | | Saccharomycopsis fibuligera |
| X67708 | 1,4-alpha-D-glucan glucohydrolase. | | Amorphotheca resinae |
| X00548 | glucoamylase G1 cDNA | | Aspergillus niger |
| AJ311587 | glucoamylase (glu 0111 gene) | | Saccharomycopsis fibuligera |
| AY652617 | gluA-A | | Aspergillus niger strain VanTieghem |
| AY642120 | gluA-G | | Aspergillus ficuum |
| AB091510 | glucoamylase | | Penicillium chrysogenum |
| AY250996 | glucoamylase | | Aspergillus niger |
| AB007825 | glucoamylase | | Aspergillus oryzae |
| BD087401 | Thermostable glucoamylase | | Talaromyces emersonii |
| BD087377 | Thermostable glucoamylase | | Aspergillus niger |
| D00427 | glucoamylase I | | Aspergillus kawachii |
| AF082188 | GCA1 | | Candida albicans |
| AF220541 | glucoamylase | | Lentinula edodes |
| D45356 | aglA | | Aspergillus niger |
| D00049 | glucoamylase | | Rhizopus oryzae |
| D49448 | glucoamylase G2 | | Corticium rolfsii |
| U59303 | glucoamylase | | Aspergillus awamori |
| X13857 | Glucan-1,4-alpha-glucosidase | | Saccharomyces cerevisiae |
| L15383 | glucoamylase | | Aspergillus terreus |
| M60207 | glucoamylase (GAM1) | | Debaryomyces occidentalis |
| M89475 | gla1 | | Humicola grisea thermoidea |
| M90490 | 1,4-alpha-D-glucanglucohydrolase | | Saccharomyces diastaticus |
| D10461 | AMY | 3.2.1.1 | Aspergillus shirousami |
| DQ663472 | alpha-amylase | | Fusicoccum sp. BCC4124 |
| EU014874 | AMY1 | | Cryptococcus flavus |
| AB083162 | amyI III | | Aspergillus awamori |
| AB083160 | amyI III | | Aspergillus awamori |
| AB083159 | amyI I | | Aspergillus awamori |
| XM_001544485 | alpha-amylase A | | Ajellomyces capsulatus |
| EF143986 | alpha-amylase | | Phanerochaete chrysosporium |
| EF682066 | alpha-amylase | | Paracoccidioides brasiliensis |
| XM_750586 | alpha-amylase | 3.2.1.1 | Aspergillus fumigatus Af293 |
| XM_744365 | alpha-amylase AmyA | | Aspergillus fumigatus Af293 |
| XM_742412 | Maltase | 3.2.1.3 | Aspergillus fumigatus Af293 |
| XM_001395712 | amyA/amyB | 3.2.1.1 | Aspergillus niger |
| XM_001394298 | acid alpha-amylase | | Aspergillus nomius strain PT4 |
| DQ467933 | amyI | | Aspergillus nomius strain KS13 |
| DQ467931 | amyI | | Aspergillus nomius strain TK32 |
| DQ467931 | amyI | | Aspergillus nomius |
| DQ467923 | amyI | | Aspergillus pseudotamarii |
| DQ467918 | alpha amylase | | Aspergillus parasiticus |
| DQ467917 | amyI | | Aspergillus sp. BN8 |
| DQ467916 | amyI | | Aspergillus flavus strain UR3 |
| DQ467908 | amyI | | Aspergillus flavus strain AF70 |
| XM_001275450 | alpha-amylase | | Aspergillus clavatus NRRL |
| XM_001275449 | alpha-glucosidase/alpha-amylase | | Aspergillus clavatus |
| XM_001265627 | alpha-amylase | | Neosartorya fischeri NRR |
| | maltase | 3.2.1.3 | Neosartorya fischeri |
| DQ526426 | amy1 | 3.2.1.1 | Ophiostoma floccosum |
| EF067865 | AMY1 | | Ajellomyces capsulatus |
| X12727 | alpha-amylase | | Aspergillus oryzae |
| AY155463 | alpha-amylase | | Lipomyces starkeyi |
| XM_567873 | Alpha-amylase | | Cryptococcus neoformans var. neoformans |
| BD312604 | Alpha-amylase | | Aspergillus oryzae |
| XM_714334 | maltase | 3.2.1.3 | Candida albicans |
| X16040 | amy1 | 3.2.1.1 | Schwanniomyces occidentalis |
| AB024615 | amyR | | Emericella nidulans |

TABLE V-continued

| Nucleotide Id | Gene | Enzyme class | Species |
|---|---|---|---|
| U30376 | alpha-amylase | | *Lipomyces kononenkoae* subsp. *spencermartinsiae* |
| AB008370 | acid-stable alpha-amylase | | *Aspergillus kawachii* |
| K02465 | glucoamylase | 3.2.1.1 | *A. awamori* |
| XM_001276751 | Maltogenic alpha-amylase | 3.2.1.133 | *Aspergillus clavatus* NRRL 1 |
| XM_001273477 | Maltogenic alpha-amylase | | *Aspergillus clavatus* NRRL 1 |
| AB044389 | Maltogenic alpha-amylase | | *Aspergillus oryzae* |
| EU368579 | Maltogenic alpha-amylase | | *Bacillus* sp. ZW2531-1 |
| M36539 | Maltogenic alpha-amylase | | *Geobacillus stearothermophilus* |
| AM409179 | Maltogenic alpha-amylase | | *Bacillus* sp. US149 |
| Z22520 | maltogenic amylase | | *B. acidopullulyticus* |
| X67133 | maltogenic amylase | | *Bacillus licheniformis* |
| AY986797 | maltogenic amylase | | *Bacillus* sp. WPD616 |
| U50744 | maltogenic amylase | | *Bacillus stearothermophilus* |
| M36539 | maltogenic amylase | | *B. stearothermophilus* |
| AF115340 | maltogenic amylase | 3.2.1.133 | *Bacillus subtilis* Bbma |
| AF060204 | maltogenic amylase | | *Thermus* sp. IM6501 |
| Z22520 | maltogenic amylase | | *Bacillus acidopullulyticus* |
| AAF23874 | maltogenic amylase | | *Bacillus subtilis* SUH4-2 |
| AY684812 | maltogenic amylase | | *Bacillus thermoalkalophilus* ET2 |
| U50744 | maltogenic amylase | | *Geobacillus stearothermophilus* ET1 |
| | LACCASE | 1.10.3.2 | |
| EU375894 | laccase | 1.10.3.2 | *Hypsizygus marmoreus* |
| AM773999 | laccase | | *Pleurotus eryngii* |
| EF175934 | laccase (lcc15) | | *Coprinopsis cinerea* strain FA2222 |
| EU031524 | laccase | | *Pleurotus eryngii* var. *ferulae* |
| EU031520 | laccase | | *Pleurotus eryngii* var. *ferulae* |
| EF050079 | laccase 2 | | *Sclerotinia minor* |
| AM176898 | lac gene | | *Crinipellis* sp. RCK-1 |
| EF624350 | laccase | | *Pholiota nameko* strain Ph-5(3) |
| AB212734 | laccase4 | | *Trametes versicolor* |
| Y18012 | laccase | | *Trametes versicolor* |
| D84235 | laccase | | *Coriolus versicolor* |
| AB200322 | laccase | | *Thermus thermophilus* |
| AY228142 | alkaline laccase (lbh1) | | *Bacillus halodurans* |

TABLE VI

EC 3.1.1.74

| No. | Source | Gene | Accession No. |
|---|---|---|---|
| 1 | *Colletotrichum gloeosporioides* | cutinase | M21443 |
| 2 | *Fusarium oxysporum* | cutinase (lip1) gene | EF613272 |
| 3 | *Neosartorya fischeri* NRRL 181 | cutinase family protein (NFIA_102190) | XM_001266631 |
| 4 | *Neosartorya fischeri* NRRL 181 | cutinase family protein (NFIA_089600) | XM_001260899 |
| 5 | *Pyrenopeziza brassicae* | cutinase gene | AJ009953 |
| 6 | *Botryotinia fuckeliana* | cutA gene | Z69264 |
| 7 | *Ascochyta rabiei* | cut gene for cutinase | X65628 |
| 8 | *Aspergillus terreus* NIH2624 | cutinase precursor (ATEG_04791) | XM_001213969 |
| 9 | *Aspergillus terreus* NIH2624 | acetylxylan esterase precursor (ATEG_04709) | XM_001213887 |
| 10 | *Aspergillus terreus* NIH2624 | acetylxylan esterase precursor (ATEG_04056) | XM_001213234 |
| 11 | *Aspergillus terreus* NIH2624 | cutinase precursor (ATEG_03640) | XM_001212818 |
| 12 | *Aspergillus terreus* NIH2624 | cutinase precursor (ATEG_02133) | XM_001211311 |
| 13 | *Emericella nidulans* | cutinase (AN7541-2) | DQ490511 |
| 14 | *Emericella nidulans* | cutinase (AN7180-2) | DQ490506 |
| 15 | *Monilinia fructicola* | cutinase (cut1) gene | DQ173196 |
| 16 | *Nectria haematococca* | cutinase 3 (cut3) gene | AF417005 |
| 17 | *Nectria haematococca* | cutinase 2 (cut2) | AF417004 |
| 18 | *Nectria ipomoeae* | cutinase (cutA) | U63335 |
| 19 | *Phytophthora infestans* clone PH026H6 | cutinase | AY961421 |
| 20 | *Phytophthora infestans* | cutinase (Cut1) | AY954247 |
| 21 | *Phytophthora brassicae* | cutinase (CutB) | AY244553 |

TABLE VI-continued

EC 3.1.1.74

| No. | Source | Gene | Accession No. |
|---|---|---|---|
| 22 | Phytophthora brassicae | cutinase (CutA) | AY244552 |
| 23 | Phytophthora capsici | cutinase | X89452 |
| 24 | Monilinia fructicola | cutinase (cut1) | AF305598 |
| 25 | Blumeria graminis | cutinase (cut1) | AF326784 |
| 26 | Glomerella cingulata | cutinase | AF444194 |
| 27 | Mycobacterium avium | serine esterase cutinase | AF139058 |
| 28 | Aspergillus oryzae | CutL gene for cutinase | D38311 |
| 29 | Fusarium solani | cutinase | M29759 |
| 30 | Fusarium solani pisi | cutinase | K02640 |
| 31 | Colletotrichum capsici | cutinase | M18033 |
| 32 | Alternaria brassicicola | cutinase (cutab1) | U03393 |

TABLE VII

| No. | Source | Gene | Accession No |
|---|---|---|---|
| 1 | Colletotrichum gloeosporioides | pectate lyase (pelA) partial | L41646 |
| 2 | Colletotrichum gloeosporioides | pectin lyase (pnlA) | L22857 |
| 3 | Bacillus subtilis | pectin lyase | D83791 |
| 4 | Aspergillus fumigatus | pectin lyase B | XM_743914 |
| 5 | Aspergillus fumigatus | pectin lyase | XM_748531 |
| 6 | Aspergillus niger | pectin lyase pelD | XM_001402486 |
| 7 | Aspergillus niger | pectin lyase pelA | XM_001401024 |
| 8 | Aspergillus niger | pectin lyase pelB | XM_001389889 |
| 9 | Aspergillus oryzae | pectin lyase 1 precursor (pel1) partial | EF452419 |
| 10 | Pseudoalteromonas haloplanktis | pectin methylesterase/pectate lyase (pelA) | AF278706 |
| 11 | Penicillium griseoroseum | pectin lyase (plg2) | AF502280 |
| 12 | Penicillium griseoroseum | pectin lyase (plg1) | AF502279 |
| 13 | Aspergillus niger | rglA gene for rhamnogalacturonan lyase A | AJ489944 |
| 14 | Aspergillus niger | pelF gene for pectine lyase F, | AJ489943 |
| 15 | Aspergillus niger | plyA gene for pectate lyase A | AJ276331 |
| 16 | Mycosphaerella pinodes | pelA | X87580 |
| 17 | | Artificial pelC gene | A12250 |
| 18 | | Artificial pelB gene | A12248 |
| 19 | Aspergillus niger | pelB gene for pectin lyase B | X65552 |
| 20 | Aspergillus niger | pelA gene for pectin lyase | X60724 |
| 21 | Emericella nidulans | pectin lyase | DQ490480 |
| 22 | Emericella nidulans | pectin lyase | DQ490478 |
| 23 | Erwinia chrysanthemi | kdgF, kduI, kduD, pelW genes | X62073 |
| 24 | Erwinia sp. BTC105 | pectate lyase | DQ486987 |
| 25 | Erwinia chrysanthemi | pelI gene | Y13340 |
| 26 | Erwinia carotovora | pel1, pel2 and pel3 genes | X81847 |
| 27 | Bacillus sp. | pelA gene | AJ237980 |
| 28 | Erwinia chrysanthemi | pelC | AJ132325 |
| 29 | Erwinia chrysanthemi | pelD | AJ132101 |
| 30 | Bacillus halodurans strain ATCC 27557 | pectate lyase | AY836613 |
| 31 | Uncultured bacterium clone BD12273 | pectate lyase gene | AY836652 |
| 32 | Uncultured bacterium clone BD9113 | Pectate lyase | AY836651 |
| 33 | Uncultured bacterium clone BD9318 | Pectate lyase | AY836650 |
| 34 | Uncultured bacterium clone BD8802 | Pectate lyase | AY836649 |
| 35 | Uncultured bacterium clone BD9207 | Pectate lyase | AY836648 |
| 36 | Uncultured bacterium clone BD9208 | Pectate lyase | AY836647 |
| 37 | Uncultured bacterium clone BD9209 | Pectate lyase | AY836646 |
| 38 | Uncultured bacterium clone BD7597 | Pectate lyase | AY836645 |
| 39 | Uncultured bacterium clone BD9561 | Pectate lyase | AY836644 |

TABLE VII-continued

| No. | Source | Gene | Accession No |
|---|---|---|---|
| 40 | Uncultured bacterium clone BD8806 | Pectate lyase | AY836643 |
| 41 | Uncultured bacterium clone BD9837 | Pectate lyase | AY836642 |
| 42 | Uncultured bacterium clone BD7566 | Pectate lyase | AY836641 |
| 43 | Uncultured bacterium clone BD7563 | Pectate lyase | AY836640 |
| 44 | Uncultured bacterium clone BD9170 | Pectate lyase | AY836639 |
| 45 | Uncultured bacterium clone BD8765 | Pectate lyase | AY836638 |
| 46 | Uncultured bacterium clone BD7651 | Pectate lyase | AY836637 |
| 47 | Uncultured bacterium clone BD7842 | Pectate lyase | AY836636 |
| 48 | Uncultured bacterium clone BD7564 | Pectate lyase | AY836635 |
| 49 | Uncultured bacterium clone BD7567 | Pectate lyase | AY836634 |
| 50 | Uncultured bacterium clone BD8804 | Pectate lyase | AY836633 |
| 51 | Uncultured bacterium clone BD8113 | Pectate lyase | AY836632 |
| 52 | Uncultured bacterium clone BD8803 | Pectate lyase | AY836631 |
| 53 | Uncultured bacterium clones | Pectate lyase | AY836611 to AY836630 |
| 54 | *Aspergillus niger* | pelA | X55784 |
| 55 | *Aspergillus niger* | pelC | AY839647 |
| 56 | *Penicillium expansum* | pectin lyase (ple1) | AY545054 |
| 57 | *Blumeria graminis* f. sp. *tritici* | pectin lyase 2-like gene, partial sequence | AY297036 |
| 58 | *Aspergillus oryzae* | pel2 gene for pecyin lyase 2 | AB029323 |
| 59 | *Aspergillus oryzae* | pel1 gene for pecyin lyase 1 | AB029322 |
| 60 | *Colletotrichum gloeosporioides* f. sp. *malvae* | pectin lyase (pnl1) | AF158256 |
| 61 | *Colletotrichum gloeosporioides* f. sp. *malvae* | pectin lyase 2 (pnl-2) | AF156984 |
| 62 | *Bacillus* sp. P-358 | pelP358 gene for pectate lyase P358 | AB062880 |
| 63 | *Aspergillus niger* | pectin lyase D (pelD) | M55657 |
| 64 | *Erwinia carotovora* | pectin lyase (pnl) | M65057 |
| 65 | *Erwinia carotovora* | pectin lyase (pnlA) | M59909 |
| 66 | *Bacillus* sp. YA-14 | pelK gene for pectate lyase | D26349 |
| 67 | *Streptomyces thermocarboxydus* | pl2 gene for pectate lyase | AB375312 |
| 68 | | | |
| 69 | *Pseudomonas viridiflava* strain RMX3.1b | pectate lyase | DQ004278 |
| 70 | *Pseudomonas viridiflava* strain RMX23.1a | pectate lyase | DQ004277 |
| 71 | *Pseudomonas viridiflava* strain PNA3.3a | pectate lyase | DQ004276 |
| 72 | *Pseudomonas viridiflava* strain LP23.1a | pectate lyase | DQ004275 |
| 73 | *Aspergillus fumigatus* Af293 | pectate lyase A | XM_744120 |
| 74 | *Aspergillus niger* CBS 513.88 | pectate lyase plyA | XM_0014402441 |
| 75 | *Emericella nidulans* | pelA | EF452421 |
| 76 | *Bacillus* sp. P-4-N | pel-4B gene for pectate lyase Pel-4B | AB042100 |
| 77 | *Bacillus* sp. P-4-N | pel4A gene for pectate lyase Pel-4A | AB041769 |
| 78 | *Fusarium solani* | pelB | U13051 |
| 79 | *Fusarium solani* | pelC | U13049 |
| 80 | *Fusarium solani* | pelD | U13050 |
| 81 | *Fusarium solani pisi* (*Nectria hematococca*) | pectate lyase (pelA) | M94692 |

SEQUENCE LISTING (2313 sequences)

SEQ ID NO: 1 - DNA, 999 bp, Aspergillus niger
atgaaattcctcaaagccaagggtagcttgctgtcgtctggcatatacctcattgcattggccccctttgtcaacgcaaaatgcgctcttccgtcgacatatagttggacttcgaccgatgctctcgccaccccaaagtccggatggactgcactcaaggacttcaccgatgtcgtctctaacggcaaacatattgtctatgcgtccactaccgacacacagggaaattacggctccatgggctttggcgccttttcggactggtcggacatggcatccgctagtcaaacggccacaagcttcagcgccgtagctccaaccttgttctacttccagccaaagagtatctgggttctggcctaccaatggggctccagcactttcacctaccgcacctctcaagatcccaccaatgtcaacggctggtcatccgagcaagctcttttcacgggcaaaatcagcggctcaagtaccggtgccattgatcagactgtgattggtgatgatacgaatatgtatcttttctttgccggcgacaatggcaagatctaccgatccagcatgtctatcaatgacttccccggaagcttcggcagccagtacgaggagatcctcagcggcgcgaccaacgatttgttcgaggcggtccaagtgtacaccgtcgacggcggcgagggtgacagcaagtacctcatgatcgtcgaggcgatcggttccaccggacatcgttatttccgctccttcacggccagcagtctcggcggagagtggacagcccaggcggcaagtgaagatcaacccttcgcgggcaaagccaacagtggcgccacctggaccgacgacatcagtcatggtgacttggttcgcaacaaccctgatcaaaccatgacggtcgatccttgcaacctccagcttctctaccagggccatgaccccaacagcaatagtgactacaacctcttgccctggaagccaggagttcttaccttgaagcagtga

SEQ ID NO: 2 - protein, 332 aa, Aspergillus niger
MKFLKAKGSLLSSGIYLIALAPFVNAKCALPSTYSWTSTDALATPKSGWTALKDFTDVVSNGKHIVYASTTDTQGNYGSMGFGAFSDWSDMASASQTATSFSAVAPTLFYFQPKSIWVLAYQWGSSTFTYRTSQDPTNVNGWSSEQALFTGKISGSSTGAIDQTVIGDDTNMYLFFAGDNGKIYRSSMSINDFPGSFGSQYEEILSGATNDLFEAVQVYTVDGGEGDSKYLMIVEAIGSTGHRYFRSFTASSLGGEWTAQAASEDQPFAGKANSGATWTDDISHGDLVRNNPDQTMTVDPCNLQLLYQGHDPNSNSDYNLLPWKPGVLTLKQ

SEQ ID NO: 3 - DNA, 984 bp, Aspergillus niger
atggttcagatcaaggtagctgcactggcgatgcttttcgctagccaggtactttctgagcccattgaaccccgtcaggcttcagtgagtattgataccaaattcaaggctcacgggaagaaatatcttggaaacattggtgatcagtacaccttgaccaagaactcgaagactccggccattatcaaggccgattttggcgcgttgactccagagaacagcatgaagtgggatgctactgaacccagccgtggacagttctctttctcaggatcggactacctggtcaactttgcccagtctaacaacaagctgatccgcggacatactctcgtgtggcactcgcagctcccctcctgggtccaatccatcacggacaagaatacactgatcgaagtcatgaagaatcacatcaccacagtgatgcaacactataagggcaagatttatgcctgggatgttgtcaatgaaatcttcaacgaagacggctccctacgcgacagcgtcttttacaaggtcatcggcgaggactacgtgcggatcgccttcgagactgctcgggctgcagatcccaatgcaaagctctacatcaatgattacaacctggattccgcctcctaccctaaattgaccggcatggttagccatgtcaagaagtggatcgcagctggcatccctatcgatggaatcggttcccaaacccacttgagcgctggtggaggtgctggaatttctggagctctcaatgctctcgcaggtgccggcaccaaggagattgctgtcaccgagcttgacatcgctggcgccagctcgaccgactacgtggaggtcgtcgaagcctgcctgaaccagcccaagtgtatcggtatcaccgtttggggagttgctgacccggattcctggcgctccagctccactcctctgctgttcgacagcaactacaacccgaagcctgcatacactgctatcgcaaatgctctctag

SEQ ID NO: 4 - protein, 327 aa, Aspergillus niger [sequence omitted]

SEQ ID NO: 5 - DNA, 745 bp, Aspergillus niger
atgctcaccaagaaccttctcctctgcttcgccgcagctaaggctgttctggccgttccccacgactctgtcgtcgagcgttcggatgccttgcacaagctctctgagcgttcgaccccgagctcgaccggcgagaacaacggcttctactactccttctggaccgacggcggtggtgatgtgacctacaccaacggtgacgctggctcgtacaccgttgagtggtctaacgttggcaactttgttggtggaaagggctggaaccctggaagtgcgcagtaagttaccctctctcaagctgtccctctagggtattcagtgaaacaaatgctcacataactccagggacattacctacagcggcaccttcacccctagcggcaacggctacctctccgtctatggctggaccactgaccccctgatcgagtactacatcgtcgagtcctacggcgactacaaccccggcagtggaggcacctacaagggcaccgtcacctccgatggatccgtctacgatatctacacggctacccgcaccaacgccgcttccatccaaggaaccgctaccttcacccagtattggtccgttcgccagaacaagagagtcggaggaactgttaccacttccaaccacttcaacgcttgggctaagctgggcatgaacctgggtactcacaactaccagatcgtggctaccgagggctaccagagcagcggatcttcctccatcactgttcagtga

SEQ ID NO: 6 - protein, 225 aa, Aspergillus niger
MLTKNLLLCFAAAKAVLAVPHDSVVERSDALHKLSERSTPSSTGENNGFYYSFWTDGGGDVTYTNGDAGSYTVEWSNVGNFVGGKGWNPGSAQDITYSGTFTPSGNGYLSVYGWTTDPLIEYYIVESYGDYNPGSGGTYKGTVTSDGSVYDIYTATRTNAASIQGTATFTQYWSVRQNKRVGGTVTTSNHFNAWAKLGMNLGTHNYQIVATEGYQSSGSSSITVQ

SEQ ID NO: 7 - DNA, 678 bp, Aspergillus niger
atgctcaccaagaaccttctcctctgcttcgccgcagctaaggctgttctggccgttccccacgactctgtcgtcgagcgttcggatgccttgcacaagctctctgagcgttcgaccccgagctcgaccggcgagaacaacggcttctactactccttctggaccgacggcggtggtgatgtgacctacaccaacggtgacgctggctcgtacaccgttgagtggtctaacgttggcaactttgttggtggaaagggctggaaccctggaagtgcgcaggacattacctacagcggcaccttcacccctagcggcaacggctacctctccgtctatggctggaccactgaccccctgatcgagtactacatcgtcgagtcctacggcgactacaaccccggcagtggaggcacctacaagggcaccgtcacctccgatggatccgtctacgatatctacacggctacccgcaccaacgccgcttccatccaaggaaccgctaccttcacccagtactggtccgttcgccagaacaagagagtcggaggaactgttaccacttccaaccacttcaacgcttgggctaagctgggcatgaacctgggtactcacaactaccagatcgtggctaccgagggctaccagagcagcggatcttcgtccatcactgttcagtaa

SEQ ID NO: 8 - protein, 225 aa, Aspergillus niger; identical to SEQ ID NO: 6

SEQ ID NO: 9 - DNA, 636 bp, Aspergillus niger
atgaaggtcactgcggcttttgcaggtcttttggtcacggcactcgccgctcctgccccggaacctgttctggtgtcgcgaagtgccggtatcaactacgtgcaaaactacaacggcaaccttggtgacttcacctacgacgagagtgccggaacattttccatgtactgggaagatggtgtcagctccgactttgtcgttggtctgggctggaccactggttcttctaaccctatcacctactctgccgactacagcgcttctggctcctcttcctacctcgctgtgtacggctgggacaactatcctcaagcggagtactacatcgtcgaggattacggtgattacaacccttgcagctcggccacaagccttggtaccgtgtactctgatggaagcacttaccaagtctgcaccgacactcgaacaaacgaaccgtccatcacaggaacaagcacgttcacgcagtacttctccgttagagagagcacgcgcacttctggaacggtgactgttgccaaccatttcaacttctgggcccagcatgggtttggcaatagcgacttcaattatcaggtcgtggcggtggaagcatggagcggtgctggcagcgccagtgtcacgatctcctcttaa

SEQ ID NO: 10 - protein, 211 aa, Aspergillus niger
MKVTAAFAGLLVTALAAPAPEPVLVSRSAGINYVQNYNGNLGDFTYDESAGTFSMYWEDGVSSDFVVGLGWTTGSSNPITYSADYSASGSSSYLAVYGWDNYPQAEYYIVEDYGDYNPCSSATSLGTVYSDGSTYQVCTDTRTNEPSITGTSTFTQYFSVRESTRTSGTVTVANHFNFWAQHGFGNSDFNYQVVAVEAWSGAGSASVTISS

SEQ ID NO: 11 - DNA, 655 bp, Aspergillus niger
atgaaggtcactgcggcttttgcaggtcttttggtcacggcattcgcgcctcctgtgccggaacctgttctggtgtcgcgaagtgctggtattaactacgtgcaaaactacaacggcaaccttggtgatttcacctatgacgagagtgccggaacattttccatgtactgggaagatggagtgagctccgactttgtcgttggtctgggctggaccactggttcttctaacgctatcacctactctgccgaatacagtgcttctggctcctcttcctacctcgctgtgtacggctgggtcaactatctcaggctgaatactacatcgtcgaggattacggtgattacaacccttgcagctcggccacaagccttggtaccgagtactctgatggaagcacctaccaagtctgcaccgacactcgaactaacgaaccgtccatcacgggaacaagcacgttcacgcagtacttctccgttcgagagagcacgcgcacatctggaacggtgactgttgccatccatttcaacttctgggcgcagcatgggttcggaaatagcgacttcaattatcaggtcatggcagtggaagcatggagcggtgctgcagcgccagtgtcacgatctcctcttaagggataagtgccttggtagtc

SEQ ID NO: 12 - protein, 169 aa, Aspergillus niger
MKVTAAFAGLLVTAFAPPVPEPVLVSRSAGINYVQNYNGNLGDFTYDESAGTFSMYWEDGVSSDFVVGLGWTTGSSNAITYSAEYSASGSSSYLAVYGWVNYLRLNTTSSRITVITTLAARPQALVPSTLMEAPTKSAPTLELTNRPSREQARSRSTSPFERARAHLER

SEQ ID NO: 13 - DNA, 636 bp, Aspergillus niger
atgaaggtcactgcggcttttgcaagtctcttgcttacggccttcgcggcccctgctccggagcctgttctggtgtcgcgaagtgccggtatcaactacgtgcagaactacaacggcaaccttggtgacttcacctacgacgagagtaccgggacattttccatgtactgggaggatggagtcagttccgacttcgtcgttggtttgggctggaccactggctcctctaaatctatcacctactctgcccaatacagcgcttctagctccagctcctacctggctgtctacggctgggtcaactctcctcaggccgaatactacatcgtcgaggattacggtgattacaacccttgcagctcggccacgagccttggtaccgtgtactctgatggaagcacctaccaagtctgcaccgacactcgacgaacgcggccatctatcacaggaacaagcacgttcacgcagtacttctccgttcgtgaaagtacacgcacatccggaacagtgactatcgccaaccatttcaatttctgggcgcagcatgggttcggcaatagcaacttcaattatcaggtcatggcggtggaggcatggaacggtgtcggcagtgccagtgtcacgatctcctcttaa

SEQ ID NO: 14 - protein, 211 aa, Aspergillus niger
MKVTAAFASLLLTAFAAPAPEPVLVSRSAGINYVQNYNGNLGDFTYDESTGTFSMYWEDGVSSDFVVGLGWTTGSSKSITYSAQYSASSSSSYLAVYGWVNSPQAEYYIVEDYGDYNPCSSATSLGTVYSDGSTYQVCTDTRRTRPSITGTSTFTQYFSVRESTRTSGTVTIANHFNFWAQHGFGNSNFNYQVMAVEAWNGVGSASVTISS

SEQ ID NO: 15 - DNA, 978 bp, Aspergillus fumigatus
atggtcgtcctcagcaagctcgtcagcagcattctctttgcctccctggtttcggcgggcgtgatcgaagaacgccaggcagccagcatcaaccaggcgtttacctcccatggcaagaggtactttggcaccgccagtgaccaagctctgctccagaagtcgcagaatgaggccattgtgcgcaaagactttggccagctgacgccggagaatagcatgaagtgggatgcgactgagccatcgcaaggaagattcaacttcgctggtgctgatttcctggtcaactatgcaaaacagaatggcaagaaggtccgcggacacaccttagtctggcactcccaactcccgtcctgggtgtcggctatcagcgacaaaaacaccctgacctcggtgctgaagaaccacatcaccaccgtcatgacccggtacaagggccagatctacgcctgggacgtcgtcaacgagatcttcaacgaggacggctccctccgcgacagcgtcttctcccgcgtgctgggcgaggactttgtgcggattgccttcgagacggcgcgctctgtggatccctcggcgaagctgtacatcaacgattacaatctcgactcggctagctatggcaaaacccaggggatggtgagatgtgtcaagaagtggctggctgcgggcattcctatcgatggaatcggcactcaaacccaccttggtgcgggtgcttcgtccagcgtcaaaggagcattgactgctcttgcgtcttccggcgtctctgaggtcgccattaccgagctggatatcgcgggtgcgagctcccaggactacgtcaatgtcgtcaaggcatgcctggatgtccccaagtgtgtgggaatcaccgtctggggggtgtcggacagggactcgtggcgctccggctcgtctccgctgctgttcgacagcaactaccagcccaaggcggcgtataatgccatcattgctgctctctga

SEQ ID NO: 16 - protein, 325 aa, Aspergillus fumigatus
MVVLSKLVSSILFASLVSAGVIEERQAASINQAFTSHGKRYFGTASDQALLQKSQNEAIVRKDFGQLTPENSMKWDATEPSQGRFNFAGADFLVNYAKQNGKKVRGHTLVWHSQLPSWVSAISDKNTLTSVLKNHITTVMTRYKGQIYAWDVVNEIFNEDGSLRDSVFSRVLGEDFVRIAFETARSVDPSAKLYINDYNLDSASYGKTQGMVRCVKKWLAAGIPIDGIGTQTHLGAGASSSVKGALTALASSGVSEVAITELDIAGASSQDYVNVVKACLDVPKCVGITVWGVSDRDSWRSGSSPLLFDSNYQPKAAYNAIIAAL

SEQ ID NO: 17 - DNA, 687 bp, Aspergillus fumigatus
atggtttctttctcctacctgctgctggcgtgctccgccattggagctctggctgcccccgtcgaacccgagaccacctcgttcaatgagactgctcttcatgagttcgctgagcgcgccggcaccccaagctccaccggctggaacaacggctactactactccttctggactgatggcggcggcgacgtgacctacaccaatggcgccggtggctcgtactccgtcaactggaggaacgtgggcaactttgtcggtggaaagggctggaaccctggaagcgctagaaccatcaactacggaggcagcttcaaccccagcggcaatggctacctggctgtctacggctggaccacaaaccccttgattgagtactacgttgttgagtcgtatggtacatacaaccccggcagcggcggtaccttcaggggcactgtcaacaccgacggtggcacttacaacatctacacggccgttcgctacaatgctccctccatcgaaggcaccaagaccttcacccagtactggtctgtgcgcacctccaagcgtaccggcggcactgtcaccatggccaaccacttcaacgcctggagcagactgggcatgaacctgggaactcacaactaccagattgtcgccactgagggttaccagagcagcggatctgcttccatcactgtctactag

SEQ ID NO: 18 - protein, 228 aa, Aspergillus fumigatus
MVSFSYLLLACSAIGALAAPVEPETTSFNETALHEFAERAGTPSSTGWNNGYYYSFWTDGGGDVTYTNGAGGSYSVNWRNVGNFVGGKGWNPGSARTINYGGSFNPSGNGYLAVYGWTTNPLIEYYVVESYGTYNPGSGGTFRGTVNTDGGTYNIYTAVRYNAPSIEGTKTFTQYWSVRTSKRTGGTVTMANHFNAWSRLGMNLGTHNYQIVATEGYQSSGSASITVY

SEQ ID NO: 19 - DNA, 642 bp, Bacillus licheniformis
atgtttaagtttaaaaagaattttttagttggattaacggcagctttaatgagtattagcttgttttcggcaaccgcctctgcagctagtacagactactggccaaattggaccgatgggggcggaacagtaaacgcggtcaatgggtctggcgggaattacagtgttaattggtctaataccggaaatttcgttgttggtaaaggttggactaaaggttcgccatctagaacaataaattataatgccggagtttgggcgccgaatggcaatggatatttggctttatatggttggacgagatcaccgctcatagaatattatgtagtggattcatggggtacttatagacctactggaacgtataagggtactgtatacagtgatgggggtacatatgacatatatacaactaaacgttataacgcaccttccattgagggccaacattctacttttacgcaatattggagtgttcgccggtctaagagaccaactggaaacaacgctaaaatcactttcagcaatcatgttaaagcatggaagagtcatggaatgaatctggggagtatttggtcttaccaagtcttagcgacagagggatatcaaagtagtggaagttctaacgtaacagtgtggtaa

SEQ ID NO: 20 - protein, 213 aa, Bacillus licheniformis
MFKFKKNFLVGLTAALMSISLFSATASAASTDYWPNWTDGGGTVNAVNGSGGNYSVNWSNTGNFVVGKGWTKGSPSRTINYNAGVWAPNGNGYLALYGWTRSPLIEYYVVDSWGTYRPTGTYKGTVYSDGGTYDIYTTKRYNAPSIEGQHSTFTQYWSVRRSKRPTGNNAKITFSNHVKAWKSHGMNLGSIWSYQVLATEGYQSSGSSNVTVW

SEQ ID NO: 21 - DNA, 756 bp, Cryptococcus flavus
atggtagcatccgctgcgccggtcgtcgaagctgaagacgggcaggccgccacgcccatcgccatcgagaagcgtaccggaagtgagtagaccgcttctgagccggactgactgtcagactactttcagaactacaatggcaatgtggccaatgtcaagtacagccagtacgatggcaccttctccgtcaactggaacggcgacaccgatttcgtctgcggtctcggatggacggtcggtaccggtcgaagcatcagatacagcggctcgtacaatcctggctacagcggctcgtatcaggcgatctacggttggactggccagggctccctcagcggtgagtaaccaaccgcacagcacagaagtggcgctgatcctaccagaatactatgtcattgacaactacggaggggtgagtctgggtggctgggtttgagtgtggctgagtgtattcagtacaacccgtgcactgggtcgggcgtcactcagctcggcaacctttacagtgatgggtcttcgtaccaagtctgcacacatacgcagtataaccagccgtccatcgttggcaccacgacattcccccagttcttctcggtccgacagaacaagcgctcttccggatcggtcaacatgcagaaccacttcaactactgggctcagcacggtttccccaaccgaaactttgactaccaggttctcgccgtccaaggcttctctggctccggcaacgccaacatgaagctcatctccggataa

SEQ ID NO: 22 - protein, 209 aa, Cryptococcus flavus
MVASAAPVVEAEDGQAATPIAIEKRTGNYFQNYNGNVANVKYSQYDGTFSVNWNGDTDFVCGLGWTVGTGRSIRYSGSYNPGYSGSYQAIYGWTGQGSLSEYYVIDNYGGYNPCTGSGVTQLGNLYSDGSSYQVCTHTQYNQPSIVGTTTFPQFFSVRQNKRSSGSVNMQNHFNYWAQHGFPNRNFDYQVLAVQGFSGSGNANMKLISG

SEQ ID NO: 23 - DNA, 690 bp, Trichoderma viride
atggttgccttttccagcctcatctgcgctctcaccagcatcgccagtactctggcgatgcccacaggcctcgagcctgagagcagtgtcaacgtcacagagcgtggcatgtacgactttgttcttggagctcacaatgatcatcgccgtcgtgctagcatcaactacgaccaaaactaccaaactggcggacaagtcagctattcgccttccaacactggcttctcagtgaactggaacactcaagatgactttgttgtgggcgttggttggacgactggatcttctgctcccatcaactttggcggctcttttagtgtcaacagcggaactggcctgctttccgtctatggctggagcaccaacccactggttgagtactacatcatggaggacaaccacaactacccagcacagggtaccgtcaagggaaccgtcaccagcgacggagccacttacaccatctgggagaatacccgtgtcaacgagccttccatccagggcacagcgaccttcaaccagtacatttccgtgcggaactcgcccaggaccagcggaactgttactgtgcagaaccacttcaatgcttgggcctcgcttggcctgcaccttgggcagatgaactaccaggttgtcgctgtcgaaggctggggtggtagtggttctgcctcacagagtgtcagcaactag

SEQ ID NO: 24 - protein, 229 aa, Trichoderma viride
MVAFSSLICALTSIASTLAMPTGLEPESSVNVTERGMYDFVLGAHNDHRRRASINYDQNYQTGGQVSYSPSNTGFSVNWNTQDDFVVGVGWTTGSSAPINFGGSFSVNSGTGLLSVYGWSTNPLVEYYIMEDNHNYPAQGTVKGTVTSDGATYTIWENTRVNEPSIQGTATFNQYISVRNSPRTSGTVTVQNHFNAWASLGLHLGQMNYQVVAVEGWGGSGSASQSVSN

SEQ ID NO: 25 - DNA, 2966 bp, Thermoascus aurantiacus
taaccttctaacattccctaagacagaccgttaagggtaatccgtcgtgacataaggacgtggataatactccgttggtcgaggttcgcttgaatcgagccaggggcgaaacatggttctccccaccacggtaagtcgcctaaatctagggttgaaaattccgggccgttaaagctacctaccctttctgtcaatgatccgacgagggggggcatctctgcagagttctccacattcaaatcggggtcagtacagtggtaaccgctgggattaatttaggctaaagcagtgatgtcaccttattatttatcattgctattatgtacataaaacaaccgaggagcgaacaaggcaaaccaccgacgagaacaatggtttggtttacttttcttcgacattgcggggcctcttggatcgcgatgtccttttgtccttttctcccgtcgaagagagggaaaacagcctgaatgtgaacaatgaattgaatttttccaccacatgtttgcattgttcgttgagtaagtccaatcaccttttagatgtttagtggtttggtattattagcccctggaagagacgctggccttgtggggtactcctagctaaaattcatgtaagacataggggctgttgtaaacgagactttaaccaaactgttacgaccggcaacaagttgcatgattgatgtgtaagatgtccctgttcgggtctcaaggggatagttagatgcaaaggtactgtatttgggtatatatatcgttcaaatgtcggttccattgcccttccttcagagatcaatcactacttaaaatctgactgcatcaactacttacttgcctccttacctactaagaagccatggttcgaccaacgatcctacttacttcactcctgctagctcccttcgcagctgcgagccctatcctcgaggaacgccaagctgcacagagtgtcgaccaactgatcaaggctcgcggcaaggtgtactttggcgtcgccacggaccaaaaccggctgacgaccggcaagaatgcggctatcatccaggctgatttcggccaggtcacgccggagaatagtatgaaatgggacgctactgaacgtgcgtgagaaagataatttgatttttttttcttctatgaccgctcggaccgttctgactaggtttataatatagcttctcaaggaaactttaactttgccggtgctgattaccttgtacgtacatacgaccacttgacgtttcttgcacgcaactgcgatcgaggagaagatactaatcttcttgaaaggtcaattgggcccagcaaaatggaaagctgatccgtggccatactcttggttagtagaacgccaacctgcttccctaacttagtgaagaaggaaaaccgaattgaccgtcccccaagtatggcactcgcagctgccctcgtgggtgagctccatcaccgacaagaatacgctgaccaacgtgatgaaaaatcacatcaccaccttgatgacccggtacaagggcaagatccgtgcatgggtcagtcatcctaccctaagctgcgtttcaatgaagagacaaataagaacacacgtatttgtccgggcgtttcagaatcagaactgacagaatcactgaataggacgtggtgaacgaggcattcaacgaggatggctccctccgccagactgtcttcctcaacgtcatcggggaggattacatcccgattgctttccagaccgcccgcgccgctgacccgaatgccaagctgtacatcaacgattacaagtaagatttaaggctcagtgatattccatttagtgtgagaagcattgcttatgagcatctgtattacagcctcgacagtgcctcgtaccccaagacgcaggccattgtcaaccgcgtcaagcaatggcgtgcagctggagtcccgattgacggcataggtatgtctcactttctgtttgtgatgtgaccgatctgaaaccagtctaacgttagctgggtctaggatcgcaaacgcacctcaggtaaataatcgggaatgcctcggagaataaaagagaaaaaaatgattgtcttatcagatcgtatcgactgactcatggcttgtccaaaatagcgctggtcagggagccagtgttctacaataagtgcccccctcccctattttgtttcctattattgcgagaacggaacaggctgacaaccccaaacggctcttccgctccttgctagtgccggaactcccgaggtcgctatcacggaactggacgtggctggtgctagctcgacggattacgtcaatgtatgtacttcgttgtccctatcccccttggatactttgtataattatcttcccggagcctgttgatcagatctgacgatcatttctcgtttttaggtcgtgaacgcttgcctcaacgtgcagtcctgcgtgggcatcaccgtctggggcgtggcagatccggtaagcgcggttcttccgtactccgtacccaactagacgttcgggctgtcacgtcatgtcttaagtcgtctgcagtcaggccaaggccaagacacaggacctgaaacgggcaggcagcagctgctaagcagcccaagaagcagccacatgatgcatgattattattattatatctccgagttctgggctaacgattggtgataataaataaataggactcgtggcgtgctagcacgacgcctctcctcttcgacggcaacttcaacccgaagccggcgtacaacgccattgtgcaggacctgcagcagtgagtatagaacggaacagagtagtaagtccggcaggactttctattattttctctccttttttttcatttcttcgatggattgttaacaagtttcttcacagaaacagcaatagcaataacaacaacgccgtcctcaaagtaagcggaaagtgcgcatgatgggtgggtaaagtactgtacctaagtactatgca

SEQ ID NO: 26 - protein, 329 aa, Thermoascus aurantiacus
MVRPTILLTSLLLAPFAAASPILEERQAAQSVDQLIKARGKVYFGVATDQNRLTTGKNAAIIQADFGQVTPENSMKWDATEPSQGNFNFAGADYLVNWAQQNGKLIRGHTLVWHSQLPSWVSSITDKNTLTNVMKNHITTLMTRYKGKIRAWDVVNEAFNEDGSLRQTVFLNVIGEDYIPIAFQTARAADPNAKLYINDYNLDSASYPKTQAIVNRVKQWRAAGVPIDGIGSQTHLSAGQGASVLQALPLLASAGTPEVAITELDVAGASSTDYVNVVNACLNVQSCVGITVWGVADPDSWRASTTPLLFDGNFNPKPAYNAIVQDLQQ

SEQ ID NO: 27 - DNA, 3203 bp, Agaricus bisporus
gatcaatagatgaactcaaagcgcgcaaggaggtgatatgactaacccacaaatcgccaaagagtgcgagaatcacccagcatattgtcgaatttggcacatgcatttgccgcgcgactgatcggttcatggcgcaagcccgcacgatgctgcaatcgagctctcaatcgaaggaaaggcacaatgagtttgatggtatattgaataacctagggtcaggagtcacttgaaattgattaaaaagattgaattactactgaccatgaaaagtttactgaggaaggcatcaaacaaaactgaatggacccaaagcaggagactactcactcgcttccaccccaagtgccaagaaagcgcaccagatggttcaaagttgctgaaggttgaaaacaaccaaagcagccaaggattgcatcgttgagacgggccacagtcaatggcttagaaggacgcgacatcgtgaaaggacaaatatcgagcagagaacgtgaaagctatttttgacccacgttaccgagccggcgtgtgatgatacttatataatcaacaatatacaacatcgatgacatttttttgcgtgtttcctcagaacaattctgtggacacaaaagttcgggcttggttgagcttttccgtctcctcgcccgcgttcccgtcccctagaacgaaccaaggtgctttgcaccggctttttcgtctcgtccgggtgctatcgctcgagtatcttgtccattctcggaggcatcgctccagctggtgctcatgatcggtatcgatagaatacgagaaaactcccggacctggtggaaatctacatacatgcctttggatggatctactactctctacgatgtccatattccaagttccttcaataagaataattcaaccaaaccacggttccttgtgaccagtattcgcattcgattgtggcaacggagaatctcctcgtccagtgtagaggtatctcggcgttattgaaataaagtttaatgcgaaattctcgcgaaatttatccctgggctggaggagtttaccttaacaaggacttttgactgcggcgactccacttgtgaaggtattctttctcattcaccatgcccaatgaccggtgacctacgaccataattcttatgacaagcaagaagcaccatgcactcggcaaatccctggcgggggtgaactattccctcactttggttacgccgctcagaattacattcccatgacatgtgttatttctggaagagtgtttatttaatagcttagctgtcaacgtctggaagcagggtacctccacctctcatttcttgttgccctataatcgctaagtcaaaatgtatctcgtcgcgtttatgcttctcgctatactgccgacaggctattgccaactcaatacgcttgccgtacgagctggaaagaaatattttggtactgcaaccgataatcctgaattgggagatgctccgtatgttgcccaactcggtaacacggcagatttcaatcaaatcaccgcggtgagtatataccgtggatcaatggagctcgctatctgataagtcatgtagggaaacagtatgaaatgggtgcgaccgtttctatggtctaaaaaacactcttgagttataacttcatctcaggacgccacggagccctcccgaggaactttcaccttttcaaatggcgacacagttgccaacatggcccgaaaccgtgggcagcttctcagaggttcttgaatagtataatctactgttgctggatcccgtcattgactgccgtctagggcacacctgtgtttggcactcgcagcttccaaactgggtcacatctggcaattttgacaattcaacccttctaaggtgcccgacacttgaacccatatcaacgttcaaaatttgattcactccacctagcattgtccaaaaccactgctcgactttagtctcccattacaggggtcaaatgtacgttcgaacctctttcagtaacgtcaaggactgacgaattatctttaataggtgttagtacaatctgtcaaactagcctcattcgctactcatcaacttgcgcctatagacagttgggatgtagtcaatggttcgactcaggtttaatatttctacttgatccgacatgactcaatttttagagccgttcaacgaggatggcagctttaggcaatcagtcttcttccagaagactgggaccgcttatatcgccacagcactccgagccgctcgtaatgcagacccgaacacgaagctctatgtaagcaccttcgtcgaatctgaacgagtttgctcaactacgcgcagatcaacgatttcaacattgaaggtaccggggccaagtccactggcatgattaatctcgtccggagccttcaacagcagaacgtccccattgacggcatcggcgtacaagctcacttgattgttggccaaattccttccagtatacagcaaaatctacagaactttgcgaacctcggagtagaagtcgcaattactgagcttgatatcagaatgacacttcctgtcacacagcaaaagcttgagcaacagcaagaagattatcggaccgtcattcgggcatgcaaggctgtttcccgctgcgtcggtgttacagtttgggattggactgatagggtgggttgttttgatttgatgtcgcaaccgcatgtatttacaccccttagtactcttgggttccaggagttttcaatggtgaaggagccgcttgcccatgggatgaagtgagctttttcgatataaacccccttttagaagcgtactgacaattgaaaagaatttggcgaagaaacccgcatatcaaggcatcgtggatggctggagtcaatgagccaatgaggatcacggtgtaactccagatagtgaaactgaatcttttgagttacctactaactgttggtctcgcttggacgagactttgttaaaaaatatggccacttcatttctccatttacgtttgtgacaccggttatcattgaccgagaatgttattctgcttatatattcagcgagcccaaaattagtgcctcgccaggattcgattctgattgtgtcatgaataaatgtcgagcgtcattgaatgagttcagtgcgagggttaggagagagaaggaaagatgcactccctccgtctggaggtactctgctagacgttgtggtcacaacgtc

SEQ ID NO: 28 - protein, 333 aa, Agaricus bisporus
MYLVAFMLLAILPTGYCQLNTLAVRAGKKYFGTATDNPELGDAPYVAQLGNTADFNQITAGNSMKWDATEPSRGTFTFSNGDTVANMARNRGQLLRGHTCVWHSQLPNWVTSGNFDNSTLLSIVQNHCSTLVSHYRGQMYSWDVVNEPFNEDGSFRQSVFFQKTGTAYIATALRAARNADPNTKLYINDFNIEGTGAKSTGMINLVRSLQQQNVPIDGIGVQAHLIVGQIPSSIQQNLQNFANLGVEVAITELDIRMTLPVTQQKLEQQQEDYRTVIRACKAVSRCVGVTVWDWTDRYSWVPGVFNGEGAACPWDENLAKKPAYQGIVDGWSQ

SEQ ID NO: 29 - DNA, 1711 bp, THERMOBIFIDA ALBA
ctcgaggtttgagtaacggctgtccgtatgggttttataaagacgatcttccactccgatacgtaacgtgttagatttgtcaccggtcgcacgtgggagcgctcccgaacgtgcggtctgaccgacaggctgagggggcacgtcggtcgcgccacaaaagaacatccgtcgcgcgaaaggaaaagtcgatgacggaaacccgtcaccgtccttcgcggcgagccagacgctcgctcagcctcctcctcacctcggcgctgactgccgccggcctgctggtcacggccgccccggcacaggccgagtcgaccctgcgggaactggctgcccagaacggcggccgccacttcggtacggctatcgcctacagcccgctcaacagtgacgcccagtaccgcaacatcgcggctacccagttcagcgccatcacccacgaaaacgagatgaagtgggagtcgctggagccgcagcggggccagtacaactggagccaggccgacaacatcatcaacttcgccaaggccaacaaccagattgtgcgcggccacaccctggtctggcacagccagctgccgtcctggctgaacaacggcggcttctccggcagccagctccggtccatcatggagaaccacatcgaggtggtggccggacgctaccggggtgacgtctacgcctgggacgtggtcaacgaagcgttcaacgaggacggtacgctccgcgactcgatctggtaccgcggcatgggtcgcgactacatcgcccacgcgttccgcaaggcgcacgaggtcgaccccgacgccaagctgtacatcaacgactacaacatcgaaggcatcaacgctaagagcaacggcctctacaacctggtggtcgacctgctccgcgacggtgtgccgatccacggtatcggtatccagtcccacctgatcgtcggccaggtgccgtccacgttccagcagaacatccagcggttcgctgacctcggcctggacgtggccatcaccgagctggacatccgcatgcagatgccggccgaccagtacaagctccagcagcaggcccgcgactacgaggccgtggtcaacgcctgcctcgcggtgacccgctgcatcggtatcaccgtctggggtatcgacgacgagcgctcctgggtgccctacaccttcccgggtgaaggtgctccgctgctctacgacggccagtacaaccgcaagcccgcctggtacgcggtctacgaggctctcggcggcgactcctccggcggcggtccgggtgagccgggcggtcctggcggtccgggtgaaccgggcggccccggtgacggcacctgcgcggtgaactacaccgtggtcaatgactggggtcacggtatgcagggggcgatcaccgtctccaacaccggatcctcgcccatcaacaactggaccctgcagttcagcttctcgggtgtgaacatctccaacggctggaacggcgagtggagccagagcggctcgcagatcaccgtccgcgctcctgcctggaactccacgctccagccgggccagagcgtggaactgggcttcgttgctgacaagaccggcaacgtctccccgccctcccagttcaccctcaacggagccacctgctcctgacccggacccacgttgaggtgaaccacaccggggccgccccaagcggcgcctctctccacagctcctgtctcgag

SEQ ID NO: 30 - protein, 482 aa, THERMOBIFIDA ALBA
MTETRHRPSRRARRSLSLLLTSALTAAGLLVTAAPAQAESTLRELAAQNGGRHFGTAIAYSPLNSDAQYRNIAATQFSAITHENEMKWESLEPQRGQYNWSQADNIINFAKANNQIVRGHTLVWHSQLPSWLNNGGFSGSQLRSIMENHIEVVAGRYRGDVYAWDVVNEAFNEDGTLRDSIWYRGMGRDYIAHAFRKAHEVDPDAKLYINDYNIEGINAKSNGLYNLVVDLLRDGVPIHGIGIQSHLIVGQVPSTFQQNIQRFADLGLDVAITELDIRMQMPADQYKLQQQARDYEAVVNACLAVTRCIGITVWGIDDERSWVPYTFPGEGAPLLYDGQYNRKPAWYAVYEALGGDSSGGGPGEPGGPGGPGEPGGPGDGTCAVNYTVVNDWGHGMQGAITVSNTGSSPINNWTLQFSFSGVNISNGWNGEWSQSGSQITVRAPAWNSTLQPGQSVELGFVADKTGNVSPPSQFTLNGATCS

SEQ ID NO: 31 - DNA, 1800 bp, Bacillus subtilis
ttcaatagttgaatgcagctttttcattattggaaataaatttaatttttcgactcgaatgaaaaatgacgtgtaaagtcccaattcagtccagttttctttgttctatatgtgtcatgtgtgtcttattcattggaggtagagcaaattgacaggcttttaaacctccccaaaacaagaaattaggttgatagacaatcatgagaaagatttttacaatgagttcgtgctcataagaagtgtagagccaaaatgatgcgaaggaggaaaagatcagatatgaaacggtcaatctctatttttattacgtgtttattgattacgttattgacaatgggcggcatgatagcttcgccggcatcagcagcagggacaaaaacgccagtagccaagaatggccagcttagcataaaaggtacacagctcgttaaccgagacggtaaagcggtacagctgaaggggatcagttcacacggattgcaatggtatggagaatatgtcaataaagacagcttaaaatggctgagagatgattggggtatcaccgttttccgtgcagcgatgtatacggcagatggcggttatattgacaacccgtccgtgaaaaataaagtaaaagaagcggttgaagcggcaaaagagcttgggatatatgtcatcattgactggcatatcttaaatgacggtaatccaaaccaaaataaagagaaggcaaaagaattcttcaaggaaatgtcaagcctttacggaaacacgccaaacgtcatttatgaaattgcaaacgaaccaaacggtgatgtgaactggaagcgtgatattaaaccatatgcggaagaagtgatttcagttatccgcaaaaatgatccagacaacatcatcattgtcggaaccggtacatggagccaggatgtgaatgatgctgccgatgaccagctaaaagatgcaaacgttatgtacgcacttcatttttatgccggcacacacggccaatttttacgggataaagcaaactatgcactcagcaaaggagcacctatttttgtgacagagtggggaacaagcgacgcgtctggcaatggcggtgtattccttgatcaatcgagggaatggctgaaatatctcgacagcaagaccattagctgggtgaactggaatctttctgataagcaggaatcatcctcagctttaaagccgggggcatctaaaacaggcggctggcggttgtcagatttatctgcttcaggaacattcgttagagaaaacattctcggcaccaaagattcgacgaaggacattcctgaaacgccatcaaaagataaacccacacaggaaaatggtatttctgtacagtacagagcaggggatgggagtatgaacagcaaccaaatccgtccgcagcttcaaataaaaaataacggcaataccacggttgatttaaaagatgtcactgcccgttactggtataaagcgaaaaacaaaggccaaaactttgactgtgactacgcgcagattggatgcggcaatgtgacacacaagtttgtgacgttgcataaaccaaagcaaggtgcagatacctatctggaacttggatttaaaaacggaacgttggcaccgggagcaagcacagggaatattcagctccgtcttcacaatgatgactggagcaattatgcacaaagcggcgattattcctttttcaaatcaaatacgtttaaaacaacgaaaaaaatcacattatatgatcaaggaaaactgatttggggaacagaaccaaattagttaagcttttttttggcggac

SEQ ID NO: 32 - protein, 499 aa, Bacillus subtilis
MKRSISIFITCLLITLLTMGGMIASPASAAGTKTPVAKNGQLSIKGTQLVNRDGKAVQLKGISSHGLQWYGEYVNKDSLKWLRDDWGITVFRAAMYTADGGYIDNPSVKNKVKEAVEAAKELGIYVIIDWHILNDGNPNQNKEKAKEFFKEMSSLYGNTPNVIYEIANEPNGDVNWKRDIKPYAEEVISVIRKNDPDNIIIVGTGTWSQDVNDAADDQLKDANVMYALHFYAGTHGQFLRDKANYALSKGAPIFVTEWGTSDASGNGGVFLDQSREWLKYLDSKTISWVNWNLSDKQESSSALKPGASKTGGWRLSDLSASGTFVRENILGTKDSTKDIPETPSKDKPTQENGISVQYRAGDGSMNSNQIRPQLQIKNNGNTTVDLKDVTARYWYKAKNKGQNFDCDYAQIGCGNVTHKFVTLHKPKQGADTYLELGFKNGTLAPGASTGNIQLRLHNDDWSNYAQSGDYSFFKSNTFKTTKKITLYDQGKLIWGTEPN

SEQ ID NO: 33 - DNA, 875 bp, CHAETOMIUM CUPREUM
ttcgaattccttggatatctctctagcctccgagtttgccaaccaaacaacatccggattcctccagattcacactttttgcaaccatggtctccttcaaggctcttcttctcggcgctgccagcgctctggccttgccctttaacgccaccgaacttggtgagcgtatggctcgcggcgaaaacgtgaccgagcttcttattgctcgcggaggcaccccaagccagacgggctggaacaacggttattacttctcgttctggaccgacaacgggggaaacgtcaacttctggaacggcaacggcggtaactacggcgtcaactggcagaactgcggcaactttgttgctggcaagggctggtaagtgctttagtacctaccttcgttaaagtagggggtaagaacctccactaaatgtgaacaggaatccaggttcggcacggaccatcaactacggcggcagcttcagcccctcgggcaatggctacctgtccatctacggctggacgaccaacccgctcgtcgagtactacattgtcgagtcgttcggcacctacgacccctcgtcgcaggctcagaagcttggcacggcctacatcgacggcagcaactacgtgctggccaagaccacacgctacaaccagccatccatcgtcggcaccgccaccttcaaccagtactggtctgttcgtcagaaccaccgctcgggtggctcggtcaacactggcgctcacttccaggcttgggcccaacacggacttaacctgggccaacacaactatcagattgttgccactgagggctaccagagcagcggttcttccagcatcactgtctaatgagaggagcaatcaacgcgctgtctgcttggtga

SEQ ID NO: 34 - protein, 229 aa, CHAETOMIUM CUPREUM
MVSFKALLLGAASALALPFNATELGERMARGENVTELLIARGGTPSQTGWNNGYYFSFWTDNGGNVNFWNGNGGNYGVNWQNCGNFVAGKGWNPGSARTINYGGSFSPSGNGYLSIYGWTTNPLVEYYIVESFGTYDPSSQAQKLGTAYIDGSNYVLAKTTRYNQPSIVGTATFNQYWSVRQNHRSGGSVNTGAHFQAWAQHGLNLGQHNYQIVATEGYQSSGSSSITV

SEQ ID NO: 35 - DNA, 4466 bp, Paenibacillus polymyxa
ctgcaggcgattgctcgcccagagcatttggcctacgtcatctatacttctggatcaaccggaaatccaaaaggagttatgctccagcatggctcggtcctcaagtttagccttaatcaaggttgtaaatcgacgctctccaacagaggagatcgcccgattttagaaataacctaactcaactttcggtgggccaagcctagattgtgatgtatttagcgggtggcttttgctcaatagccctaacagacagtctgcctttaatttgctcgcctacaatcaaactcaacccattcagggcaaatattatacttaaacggttacggaaaaacgtcagtatttcacagagcaaatcggtaggttacatcccttttggtgtgctcttttaaattagaatgatattgttatatttgatagagtatggtatgatcattccaaataaatccattattatgaatcgaattacatattagtacttaatattttatattctatactttattcaattaatactgaagttcacagcataaggacagagataagtaagtattgacttctcttgtagggcgtttccaaacaatgatttgtaagcggtttcaaattatttctatcccttaccactctttatgtcagttctccttgcgggtaaaggtctgagcatattcttaagtttgataaatttacggatagctcagctttagaccatataaaaaacggaggttatgttatgattagaaaatgtctagttttatttctttccttcgctttattgctcagcgtctttcccatgctaaatgtagatgctgccaatcgaccactggcaaagatacctggaaattccaatcctctaatggatcataaattgggagctgatccctattcattggtgtatgatggaagagtgtatattttcatgtcaagtgatacgtacgtgtataacaaggatggatcgattaaagaaaacgacttcagtgcgctggatcgtatccaggtcatatcctctacagacatggtgaactggacggatcacggaacgataccagtcgcaggtgccaacaacaaaaacagtggaagaggcattgccaaatgggcctctaactcttgggctccagcagttgcgcataaaaaaataaatggcagagacaagttctttttatattttgccaatgggggagcaggtattggtgtcctaacagcagacacgcctatcggaccttggacagatccccttggcaaagcgcttgtgacacatagtacacctgggatggctggcgtgacttggctttttgacccggctgtactggtagatgatgatggcacgggatacctgtatagcggtggcggaattcctaatgagtcggatccggcttccattgcaaatcctaaaaccgccagagtcatcaaattaggcgcagatatgaccagcgttattggaagcgccaccactatagacgctccttacctgtttgaagattccggtattcataaatataacggcaaatactactattcgtactgtatcaactttgccggaacacaccctcaacagtaccctgcaggtgaaatcggttatatggttagcgacaacccgatgggtcccttcacttataaaggtcatttcctaaaaaatccgtatacgttcttcggcgttggaggcaacaaccaccatgctgtatttaattttaagaatgaatggtatgtcgtataccatgcccaaacggtcagcaaggctcaaattggagctggaaaaggctatcgctctccgcatattaataagctggtgcacaaggaggacggaagcatctctgaggtgcaagggaatatgacaggaatcgctcagctatccaatatgaacccatataccagagttgaagcggagaccattgcctggcaagcaggcgttacgaccgaacccacacaagccagtggcggcccgattagcaatctgaatgtgaccaacatccataatggggactggatcgctgtcgggaaggctgattttggctctgctggagcgaagacattcaaagctaatgtggccactaatgtcggtggcaacattgaagtacggcttgacagtgaaacaggtcctctagtcggctccttgaaagtaccttcaactggaggtatgcagacctggagagaagtagagaccacgatcaataatgcaacgggggttcacaacatctatctggtgtttactgggtcaggcagcggcaatctgttgaatttggatgcctggcagttcactcccaacacgggagggaatacgataaccaaggttgaagccgagaatatgaagattggcggcacttatgcaggcaagatcagtgcaccgttcgacggggtcgctttgtatgccaatgctgactatgtatcatattcacagtattttgccaactctacgcataatatctcagtgcggggggcttcaagcaatgctggtactgccaaggtggacttggttattggcggagtaactgtaggttccttcaatttcacgggcaaaacgccgactgtacaaaccttgtccaatattactcacgctactggagatcaggagatcaaactcgccttgacgagtgatgacggcacttgggatgcctacgtggattttattgaattttcattatgatcgctcatataaacagtaggtgttttggagcttttgcaaaatcgagggacccgaccctgttattccaagagaacgctattagcgggtaaatgtccaggcaagctctattatttggttttcggcagatcatattacgtttgctggaaaccacattccacaactttcattcatatttgaaattgtccttggaggtgtatgatgaagaagaagtcttggtttacgctgatgatcacaggtgtgatttctctgtttttttcggtaagcgcatttgcggggaatgtgttctgggaaccattaagttattttaattcaagtacttggcaaaaggcagatgggtactccaatgggcagatgttcaattgcacttggcgtgccaacaatgttaactttacgaatgatggaaagctcaagctgagtttaacgagtccggcgaacaacaaatttgattgtggggagtaccgatcaacgaacaattacggatatggcctgtacgaggtcagcatgaagcctgctaaaaatacgggaattgtctcatcctttttcacgtatacaggaccttcccatggcacgcaatgggatgaaatagatatcgaatttttaggaaaggacacgacaaaagtacagtttaactattataccaatggagtcggtgggcacgagaaaattatcaatcttggctttgatgcttcaacgagcttccatacctatgctttcgattggcagccagggtatattaaatggtacgttgacggtgttctgaaacatacagcaaccacgaatattccaagtacgccaggcaaaattatgatgaatttatggaatggtaccggagtagatagctggttagggtcatataatggagcaaatccgctgtatgccgaatatgactgggtaaaatatacgagcaattagtatgattacagcagaagaggcagccctatagggctgcttttgcctgtccagggagagatagctgaatagaccccgctaggggattttttagttagcataatgatgttatgaaaaacttcaaaaacagagcgatagcgtattaaacgcccttggaacaggtgccaaactgaatatcgacaatcgatggcatctggcgttgctatcgtaccatcgtcaccaggttccgagcggaccaaacttcccagtttaacatgactattagccgtctattcttgtaagtgagccctgttgaaaaagacactgcattaaaatacttgactctccccattaggggagacattaaactcagtttgtaagctaatcgattaaaaggaggaagtcaaaatgcaactttagttattagagacattagaaaagaggatatagaacctattaaagcgattatcgcagatacctggaacgcaaaggattttatcgaggatgacggctataataaatgcagcagttacaatgatgttcataagtccaatattaaataaaagtacttttggaagagtagctacattagatggagaagtcattggctgtaatttttggttcaagagttggtgaaataacatcttatagattgttacaagaagattatacaagtgaattgctacaactcttaaatctaaatgacatcgaacgaaaagtatttgttgaactcacctctatgactaatgaggcatacagcaagttaattagaggaaaagaagatgagtttcaggggtgcttagaattctttgctgtttatgaaggagctagaggcccaaaggtagggaaacaattatttaatgagctcatctcttacttaaaaaatacaaaaacaaataaaatttatgtgtatacagatacaatgagtaactatggattctat

SEQ ID NO: 36 - protein, 635 aa, Paenibacillus polymyxa
MIRKCLVLFLSFALLLSVFPMLNVDAANRPLAKIPGNSNPLMDHKLGADPYSLVYDGRVYIFMSSDTYVYNKDGSIKENDFSALDRIQVISSTDMVNWTDHGTIPVAGANNKNSGRGIAKWASNSWAPAVAHKKINGRDKFFLYFANGGAGIGVLTADTPIGPWTDPLGKALVTHSTPGMAGVTWLFDPAVLVDDDGTGYLYSGGGIPNESDPASIANPKTARVIKLGADMTSVIGSATTIDAPYLFEDSGIHKYNGKYYYSYCINFAGTHPQQYPAGEIGYMVSDNPMGPFTYKGHFLKNPYTFFGVGGNNHHAVFNFKNEWYVVYHAQTVSKAQIGAGKGYRSPHINKLVHKEDGSISEVQGNMTGIAQLSNMNPYTRVEAETIAWQAGVTTEPTQASGGPISNLNVTNIHNGDWIAVGKADFGSAGAKTFKANVATNVGGNIEVRLDSETGPLVGSLKVPSTGGMQTWREVETTINNATGVHNIYLVFTGSGSGNLLNLDAWQFTPNTGGNTITKVEAENMKIGGTYAGKISAPFDGVALYANADYVSYSQYFANSTHNISVRGASSNAGTAKVDLVIGGVTVGSFNFTGKTPTVQTLSNITHATGDQEIKLALTSDDGTWDAYVDFIEFSL

SEQ ID NO: 37 - protein, 238 aa, Paenibacillus polymyxa
MMKKKSWFTLMITGVISLFFSVSAFAGNVFWEPLSYFNSSTWQKADGYSNGQMFNCTWRANNVNFTNDGKLKLSLTSPANNKFDCGEYRSTNNYGYGLYEVSMKPAKNTGIVSSFFTYTGPSHGTQWDEIDIEFLGKDTTKVQFNYYTNGVGGHEKIINLGFDASTSFHTYAFDWQPGYIKWYVDGVLKHTATTNIPSTPGKIMMNLWNGTGVDSWLGSYNGANPLYAEYDWVKYTSN

SEQ ID NO: 38 - DNA, 903 bp, Neocallimastix frontalis
atgactgttgctaaggcccaatggggtagaggtgcttccgctggtcagaagttgtccgtcggtggtggtcagaaccaacacaagggtgtctccgatggtttctcctacgaaatctggttggacaacaccggaggttctggttctatgaccctgtgttctggtgcaaccttcaaggctgagtggaatgctgctgtcaacagaggtaacttccttgccagacgtggtcttgactttggttctagaaagaaagcaaccgactactcctacatcagattggactacactgctacttacagacaaaccgcctccgctagcggtaactcccgtttgtgtgtctacggatggttccagaacagaggagttcaaggcgttcctttggttgagtactacatcattgaagattgggttgactgggttccagacgctcaaggaaagatggttaccattgacggagctcaatacaaaatcttccaaatggaccatactggcccaactatcaacggtggttccgagaccttcaagcaatacttctctgtcagacaacaaaagagaacgtctggtcacattactgtctctgatcacttcaaggagtgggctaagcaaggttggggtatcggtaacctgtacgaggttgctttgaatgccgaaggttggcaatcctctggtattgctgacgtcaccaagttggacgtttacacaacccagaagggatctaaccctaccaccgccgctcgtaccactagaactactgccagaactactgccagaactactaccagaactagaactttgccaaccaacaacaagtgttcttccaagattactgctcaaggttacgaatgctgttcctctccaaactgcgagattgtctacaccgatgacgacggtaagtggggtaaataa

SEQ ID NO: 39 - protein, 300 aa, Neocallimastix frontalis
MTVAKAQWGRGASAGQKLSVGGGQNQHKGVSDGFSYEIWLDNTGGSGSMTLCSGATFKAEWNAAVNRGNFLARRGLDFGSRKKATDYSYIRLDYTATYRQTASASGNSRLCVYGWFQNRGVQGVPLVEYYIIEDWVDWVPDAQGKMVTIDGAQYKIFQMDHTGPTINGGSETFKQYFSVRQQKRTSGHITVSDHFKEWAKQGWGIGNLYEVALNAEGWQSSGIADVTKLDVYTTQKGSNPTTAARTTRTTARTTARTTTRTRTLPTNNKCSSKITAQGYECCSSPNCEIVYTDDDGKWGK

SEQ ID NO: 40 - DNA, 2228 bp, Penicillium citrinum
ggatccgcatggaaagttgatgcgtcggaaaatttctattgggagcaaggaatgtagaatgggaggttcaacaccaagaggagtgaagagttggaagatgtttccatcatttgctgcatgagtcgtactacttgctctccgcaagaatgagaaatagatgggcgatgatactctcccaccaactaatgcagtttcttagtatctcttgcaaatactgtattcaattttggaagtttcgtctcaagagatatcagagacaacagttcagcattttgagtacaatggaccaccttcccaaataccaacaacttgaaagataactagcagacatggccacactgatgttccagaccgctacaaaggagcttaactcaacacccgtaaggactagacaaatatgaataaggtgatcgaccctgtaactactccacttgttttactgatctatctactccgtaagtgatcaggaattatgataaaacaggggcactccggtggggcacagggctgctaacaagtggagcatctcatgtcaacatgaagcaacgacaagtttcaaagctaacccaccaataaaatcaacgacaacagtaacaaagctggagccaaacagaaccgagacaatcctcctacacaatacgtttgagcaatttcttccagagcctggaaaagtgggtaaaataatctgcccatatcgagatgtccgtctccggtagtatccccattaggagaaagttcaacgataaaacacaaagttcggaagaactgacatttagagggctaagggtctagcctaattacaattattagccattattgggattggcagcgacagatctggaagaatcatgcacagatcaagccaatttacccgccggcaaaacctcgcagttttggctgaagacatggcgtcggggctttagtttattttgtcatggcgctactatccctgaagacccggcttgacagatgtggacctccttgatctagccaagacgtacagggtatacagcatgtataaaggagatgtctcgaaccaagaccgaaagctattccaacctccatccaagaactacgattttccaaaatgccgtctctgacttcgctattctcgttcttcgctctcgcttcaggcgctttcagtgctactgctgatctctcgaaaagagaatcttatacttccagctcgactggaactagcaatggctattactactccttctggacggatggccagggcgatatcacctactccaacggtgccgctggcgagtacagcgtgacctggtctggtgatggaaacttcgttgctggaaagggttggaaccctggtggtagccggtatgtttgaaagattctccgagtatactactagtatacaaagtctaatcatgactctgctttagggaggttaccttcaagggctcctacaaccccaacggtaagacacggaaaaatccccgatactgagtataatcatacttaaaatcatacaggaaacagctacctctccgtctacggctggactcaaaaccccctgatcgaattctacatcgtcgaagacttcggcacttacaacccctccagcggcgcaaccaagaagggcactgttaccagtgatggaagtgtctacgacatttacaccagtgagcgagtcaatcagccttctattgagggcactgcgactttcacccagtactggtccgttcgtcagaacaagcgttctgagggaactgttactactggaaatcactttaatgcatggaaaaacctgggcatggaccttggttcgttcaactatatgattgttgctacagagggatattatagcagtggttctgctgatattactgttagctagattaatgcttgagcgtggacacagtggtggattggattttgtcaatcgaatagtgattagattgaatctcaatttgctttgctttcttagtttgggatttgtagactgtcgagacaatatgctgcagtgtggttgtttttctcatggtcagtgatactggctgtttaaatgatgcagacttcccgtaggcttaaaagatcaaaagaaagtgtcaagtgaatatgagctctatgtgaaagcttggcttatagagaagattgaataactattttcttctgatatttccatgaggaccgcacgctttgtatggctcgattaagctatggaatgatcaatgaataggaaattgaatactgcaaagggcatt

SEQ ID NO: 41 - protein, 217 aa, Penicillium citrinum
MPSLTSLFSFFALASGAFSATADLSKRESYTSSSTGTSNGYYYSFWTDGQGDITYSNGAAGEYSVTWSGDGNFVAGKGWNPGGSREVTFKGSYNPNGNSYLSVYGWTQNPLIEFYIVEDFGTYNPSSGATKKGTVTSDGSVYDIYTSERVNQPSIEGTATFTQYWSVRQNKRSEGTVTTGNHFNAWKNLGMDLGSFNYMIVATEGYYSSGSADITVS

SEQ ID NO: 42 - DNA, 1396 bp, Agaricus bisporus
aagcaagaagcaccatgcactcggcaaatccctggcgggggtgaactattccctcactttggttacgccgctcagaattacattcccatgacatgtgttatttctggaagagtgtttatttaatagcttagctgtcaacgtctggaagcagggtacctccacctctcatttcttgttgccctataatcgctaagtcaaaatgtatctcgtcgcgtttatgcttctcgctatactgccgacaggctattgccaactcaatacgcttgccgtacgagctggaaagaaatattttggtactgcaaccgataatcctgaattgggagatgctccgtatgttgcccaactcggtaacacggcagatttcaatcaaatcaccgcgggaaacagtatgaaatgggacgccacggagccctcccgaggaactttcaccttttcaaatggcgacacagttgccaacatggcccgaaaccgtgggcagcttctcagagggcacacctgtgtttggcactcgcagcttccaaactgggtcacatctggcaattttgacaattcaacccttctaagcattgtccaaaaccactgctcgactttagtctcccattacaggggtcaaatgtacagttgggatgtagtcaatgagccgttcaacgaggatggcagctttaggcaatcagtcttcttccagaagactgggaccgcttatatcgccacagcactccgagccgctcgtaatgcagacccgaacacgaagctctatatcaacgatttcaacattgaaggtaccggggccaagtccactggcatgattaatctcgtccggagccttcaacagcagaacgtccccattgacggcatcggcgtacaagctcacttgattgttggccaaattccttccagtatacagcaaaatctacagaactttgcgaacctcggagtagaagtcgcaattactgagcttgatatcagaatgacacttcctgtcacacagcaaaagcttgagcaacagcaagaagattatcggaccgtcattcgggcatgcaaggctgtttcccgctgcgtcggtgttacagtttgggattggactgataggtactcttgggttccaggagttttcaatggtgaaggagccgcttgcccatgggatgaaaatttggcgaagaaacccgcatatcaaggcatcgtggatggctggagtcaatgagccaatgaggatcacggtgtaactccagatagtgaaactgaatcttttgagttacctactaactgttggtctcgcttggacgagactttgttaaaaaatatggccacttcatttctccatttacgtttgtgacaccggttatcattgaccgagaatgttattctgcttatataaaaaaaaaaaaaaaaaaaaaaa

SEQ ID NO: 43 - protein, 333 aa, Agaricus bisporus; identical to SEQ ID NO: 28

SEQ ID NO: 44 - DNA, 1656 bp, BACILLUS SP. (137)
atcctcgtagtggaacggagcggaagccactcgattctgcgggatttagaggaaggccactgaaaaaggtgtgtttttcacctttatcagtggtctctaagcaatgagcgaaaccgttgcaatctttttaaagcctgctatgagtgggtttctcatagcaggcacgcaacgtgtgaagccattgccgcttccttgaatctgctaaaaaggactttttcagtggccttatttagaggtagggtcgagacccgacaggcgcagtgaggaggctcgacacctccccgcggaaagcgagtggctggagcgtaatggaacgaacatttggagacgaacctataaaaacaccaagtttacgaaaacagcctttaaaaaaggaggcaaacaagcatgaatcagcaacttaacattcctaatctttatgagatttataaagacttcttttctataggtgctgcagtaaactctaagacactagaatcagaaaaagagttattaaaaaagcattacaatagcttaacagcagaaaatgaaatgaagtttgaactgttacagccagaacaaggtaactttaactttacacaagccgacaagcttgttgcatttgcaaacgaacacaatatgaagctacgagggcatacgcttgtttggcacaaccagacgacaggatggttatttcaaaattccgatggaacacaagtaaaccgtgaaacactcttacagcgaatggaagcgcacatttcaaccgttttaggtcgttataaaggccagttctatagctgggacgtcgttaacgaagccatttccgatgatgattctgaataccttcgtaagtctaaatggttagatattattggagaggattttatagcaaaggctttcgaatttgcacatcaggctgaccctaatgcctctttattttacaacgattacaacgaatctcatcccaataaacgagagagaatctatcgtctcgtaaaatctttactagataaagacgtacctattcacggagtaggattacaagctcactggaatgttcacgatccaagtttagatgatattcgagctgcaatagaacgctatgcttcactcgggatacagcttcaaataacagagatggatgtttcaatgtttagctgggataatcgacgtgcagacctcacacagcctacagaaaaaatgctaaacctacaagaagaacgttacgaccaattcttccaattatttagagaatacaaggatgtaatttctaatgtaactttctggggtgcaaatgattcttatacgtggttaaatgattttcctgttagaggaagaaaaaattggcctttcatttttgatgaaaagggtgacccgcaaagagtctttttggagaatcgctaaattttaggcttcctctcctctctttaatagtaaaacaatccggttcgctaagcgagccgggattgttttgctatctcttcgttgtatcttcttttaatcctaaaatccaagttgcaataaaagcacccaccgtagcaattaacattccaattagataatgaataatattagccgttccaaatggcgctgcgatcgcgatcattggaatccctgttaaaccataggcgtttacaataacattgataaacacaacatatgccccacctagagctc

SEQ ID NO: 45 - protein, 331 aa, BACILLUS SP. (137)
MNQQLNIPNLYEIYKDFFSIGAAVNSKTLESEKELLKKHYNSLTAENEMKFELLQPEQGNFNFTQADKLVAFANEHNMKLRGHTLVWHNQTTGWLFQNSDGTQVNRETLLQRMEAHISTVLGRYKGQFYSWDVVNEAISDDDSEYLRKSKWLDIIGEDFIAKAFEFAHQADPNASLFYNDYNESHPNKRERIYRLVKSLLDKDVPIHGVGLQAHWNVHDPSLDDIRAAIERYASLGIQLQITEMDVSMFSWDNRRADLTQPTEKMLNLQEERYDQFFQLFREYKDVISNVTFWGANDSYTWLNDFPVRGRKNWPFIFDEKGDPQRVFLENR

SEQ ID NO: 46 - DNA, 1070 bp, Bacillus pumilus
gaattcatttcatcttagagatgacagaattaaaaggatgaaaaaggagaggaatgacgaatgaatttgagaaaattaagactgttgtttgtgatgtgtattggactgacgcttatactgacggctgtaccagcccatgcgagaaccattacgaataatgaaatgggtaaccatagcgggtacgattatgaattatggaaggattatggaaacacctcgatgacactcaataacggcggggcatttagtgcaggctggaacaatatcggaaatgctttatttagaaaagggaaaaagtttgattccactagaactcaccatcagcttggcaacatctccatcaattacaacgcaagttttaacccaggcgggaattcctatctatgtgtctatggctggacacaatctccattagcagaatactacattgttgattcatggggcacatatcgtccaacaggagcgtataaaggatcattttatgctgatggaggcacatatgacatttatgaaacaacccgtgtcaatcagccttccattatcgggatcgcaaccttcaagcaatattggagtgtacgtcaaacgaaacgtacaagcggaacggtctccgtcagtgcgcattttagaaaatgggaaagcttagggatgccaatggggaaaatgtatgaaacggcatttactgtagaaggctaccaaagcagcggaagtgcaaatgtgatgaccaatcagctgtttattggcaactaaaaaagtcaaagaaaagagccgggagcaaaactcctggctttttctatcataatttttcaacttcgactctgccgggaaagaacgttccggaaaagaacgtcgcaccgccgcccatatctgccaagcgatcaggtgtgaggccattcaccaaatgttttttgccttttttggtctgcccataatcctggctgacaacaacaccagataacacattttgtccgactgacacgatcagctcgcattctcctcgatgattcagcacacgaaccatgtccccatcttcaatctgtctttcttttgcatcttgttcattcatatgaggc

SEQ ID NO: 47 - protein, 228 aa, Bacillus pumilus
MNLRKLRLLFVMCIGLTLILTAVPAHARTITNNEMGNHSGYDYELWKDYGNTSMTLNNGGAFSAGWNNIGNALFRKGKKFDSTRTHHQLGNISINYNASFNPGGNSYLCVYGWTQSPLAEYYIVDSWGTYRPTGAYKGSFYADGGTYDIYETTRVNQPSIIGIATFKQYWSVRQTKRTSGTVSVSAHFRKWESLGMPMGKMYETAFTVEGYQSSGSANVMTNQLFIGN

SEQ ID NO: 48 - DNA, 1320 bp, Aeromonas punctata
ttccaagaaatcgttctgttgcgatgagcagtgggaacaaacgtggaggtgtttttgttttgcgcacagggcccaggatcataaatagttaaatataagggggaagaagtataatttgttcattgtaagcgtattcaacaaacgatatgatgaataaaaatgggcagggaggaattgtaaatgccaaccgagattccatcactacatgctgcgtacgctaatacgttcaaaataggtgctgctgtacataccagaatgttgcagtccgaaggggaatttatcgccaaacacttcaatagcatcacggctgaaaatcagatgaaattcgaagaaattcacccggaagaggatcgttattcatttgaggcggcggatcaaattgttgattttgctgttgcccaagggattggggttcgcggacatactttggtctggcataatcaaacatcgaaatgggtctttgaggatacctcaggtgctcccgcttccagagagctgttattatctcgcttgaagcaacatattgatacggtagtaggtcggtataaggggcaaatatatgcgtgggatgttgttaatgaagctgttgaagataagaccgacctgttcatgcgggacacgaagtggttagagctagtgggggaagattatttgctgcaagcgttcagtatggctcatgaagctgatccaaatgctcttcttttctataatgactacaatgagacggatccggtcaaacgggagaagatctacaatctggttcggtctttgctggacaagggagcgcctgtacacgggattgggttgcaggggcattggaatattcatggtccttcgattgaggagatccgaatggctattgagcgttatgcttcactggatgtacagttgcatgttacggagctggatatgtccgtgtttcgtcatgaggatcgtcgaacggacctcaccgcgccaacttcggagatggctgagctacaggagcttcgatatgaggaaatcttcaatttgttccgtgagtataaatcatccattacctctgtgacgttctggggagtagcggacaattatacctggctcgaccatttcccggttcgtgggcgaaaaaattggccctttgtttttgatcagcagttgcagccaaaggtatcattttggcgtatcattaattctatgtcctgaatatcaggtaagtggagagaatcggtcacgatgtggccggttttttgttgcgctcaatatagattatacagtacggctatcccgtgcataattgaacactacgcttgtatgtgtgtaagtatatggtttttaatggaa

SEQ ID NO: 49 - protein, 333 aa, Aeromonas punctata
MPTEIPSLHAAYANTFKIGAAVHTRMLQSEGEFIAKHFNSITAENQMKFEEIHPEEDRYSFEAADQIVDFAVAQGIGVRGHTLVWHNQTSKWVFEDTSGAPASRELLLSRLKQHIDTVVGRYKGQIYAWDVVNEAVEDKTDLFMRDTKWLELVGEDYLLQAFSMAHEADPNALLFYNDYNETDPVKREKIYNLVRSLLDKGAPVHGIGLQGHWNIHGPSIEEIRMAIERYASLDVQLHVTELDMSVFRHEDRRTDLTAPTSEMAELQELRYEEIFNLFREYKSSITSVTFWGVADNYTWLDHFPVRGRKNWPFVFDQQLQPKVSFWRIINSMS

SEQ ID NO: 50 - DNA, 3395 bp, Penicillium canescens
tcaacctattcctctctcttttttctgaggttcatttctcgcagtaatgggtgctcccgaccaggttattgggtgtcctgtagatttaaggacacaagggactggatgatgatgcatgaagattttttggataataaaacacgtcgcatagcgaaaaaaaagaagctcttggactggggaaatgtggccaaaaaggtaggaaattcgttcagtcctcgtatcccgcatgcttgcatgctcgcaattccttgtactagatttgtatatgtcattgagaacgttgctcattgcattgatgtcagtagcgttcttgtacacgagcccagcttaggacagtctatacagacaagattccgctgaggcaatgtattccttgacttgttgttttacactcagatgttaagaaagcctgctagttggactatcaggttgaacagtctaggaacaaaaatccatgtcctcctaatgtggccccggcacatgtacttctatctaaatgccgaactgaaacaatcagccgccaaaaactcattttatccacagctctagctaaatgtggaactggccgttcgattcccgaaacgagactaactacatcggaagattttccggggtagacgtccgcagtcaaaacacactaagttactaaccctttcgtcaagccatcataagcagctattggacaagctaccccacacaagtgatgcagggtcctgcaatagttgtgaagaatccttttcagccggcagtgcttcgctgggagtttctgatgtcatcctgaagcccctcagaatctccttccaggactatgttgaacatgagctttagtggatcgaatctgttagtaaatcataaaaagcagaccaaaaaactcatgcttaattattatgaaatatgatcatatagtacgtggcctttttgaagctccgtcgaatgttctgcgttaggtagatcttctccgagaatctcttgatgtagatgtcaatgatttaaaaagtcctttaccacaacagtcattcactaattcgacagggattggtaatccatgttttggcgccggacgaaccccttctatgctgagaatttgcaatggactcgaaaagagctattttaccatgaaacacactagtctcgatattggtagtcattccctcagtcagggccctgagggtcctgccttgccaaaaggatcttcaaggctcgcagaaccgacgtggcgcggagggcggaggaacatcggagactcggagagtggtagttgaaaagtagtttgcggggccgacgttttctgaagaaatttggacccagattcacaaaatggctgaattagttttaggttaattgatatagtaagccccctggtgatccaccgtctccactaaccaggcacccttgtttttccattaacggtagtcttttacctcctgaccctaagccaagatatttagacccttttattgttacatctcaaggctagaacttgtaatggcccttctgaagaagcgcttggcagtatgttgggattcaggctgaagtcttcttggcaagcgcgtcggctaaaatgacgttcgagtatgttcttcaagtcggttacagttacaggggtcttggattgaatggggaacatccgtttctcatcggttgaaggcatacatggtgcgacgtccgttttgcatcggggaaggatattcgtttagttagcccctcaactatgacacgacttcccctagcatggtgtctactgtcttgtataagtatcagggtcgatccctccaaatcatagctttgcatcaacaccagctctcataatcgatctactcgaaaaccaaacacattcacaatcatggttcaactcaagactgctgctctggcgcttcttttcgccggtcaggctctttccggacctgtcgactcccgacaggcctctgtgagcattgatgccaaattcaaggctcatggcaagaagtatcttggaaccattggtgaccagtacaccttgaccaagaacacgaagaacccggcaattattaaggctgattttggtcaattgaccccggagaacagcatgaagtgggatgctactgagcgttagtttaactatctcgatgtaacgagaattaccagaaactgatttggaaaacagcaaaccgaggccagttcaccttctcaggctcggattaccttgtcaactttgcccaatccaacggcaagctgatccgtggtcacactctcggtaagttcctgaatccacacgtttctataagtcatagtatccaagctaacactgtccagtgtggcactctcagctcccgggatgggtctcttccatcacggataagaacactctcatcagtgtcctgaagaaccacatcaccaccgtgatgacccgttacaagggcaagatctacgcctgggtaagctctattcataaaatggttcagataagccccttctaacttattaaaggacgtcctgaacgagatcttcaacgaagatggctccctgcgcaacagcgtcttctacaatgtcatcggtgaggactatgtccgcattgctttcgagaccgctcggtctgtggaccccaacgccaagctgtacattaatgattacaagtgagttgaagctctgcaatcccctcaaacagtatctattctgaccatgcaaagcttggattccgctggctattccaaggtgaacggaatggtcagccacgtcaagaagtggcttgccgctggtattcccattgacggaattggtaagatccctgccatatccctttgccatatataattgctgactcgtttcaaggttcccaaacccacctgggcgctggtgccggctctgcagttgctggataagtacccccatgcttctttacctctaaacacaggagagctaacagcctcttacagctctgaatgctcttgccagtgcaggaaccaaggagattgctatcactgagcttgatattgctggcgccagctctactgactatgtcaatgtgagttttcaaaatcaattacccgtagagtgccatggctcatgactgaaacttcattttcataggttgtcaacgcttgcctgaaccaggctaagtgtgttggaatcaccgtttggggtgtcgctgacccggtaaataccactattctcttgtttgaaattggggatgattgtatactaacattgcattttctcttaggattcatggcgctccagctcttcccctctgctgtttgacggcaactacaaccccaaggctgcttataacgctatcgccaatgcgctttagagtcgtgacttgaacatctgtctggagatgaggtctacgattggataggttatactacaaattgtgggattggtatagtttggaatgcatggagcttggaatggta

SEQ ID NO: 51 - protein, 327 aa, Penicillium canescens
MVQLKTAALALLFAGQALSGPVDSRQASVSIDAKFKAHGKKYLGTIGDQYTLTKNTKNPAIIKADFGQLTPENSMKWDATEPNRGQFTFSGSDYLVNFAQSNGKLIRGHTLVWHSQLPGWVSSITDKNTLISVLKNHITTVMTRYKGKIYAWDVLNEIFNEDGSLRNSVFYNVIGEDYVRIAFETARSVDPNAKLYINDYNLDSAGYSKVNGMVSHVKKWLAAGIPIDGIGSQTHLGAGAGSAVAGALNALASAGTKEIAITELDIAGASSTDYVNVVNACLNQAKCVGITVWGVADPDSWRSSSSPLLFDGNYNPKAAYNAIANAL

SEQ ID NO: 52 - DNA, 2527 bp, Cochliobolus carbonum
ctttttgtgaaggcacctccgtagacatcagtccttagatctgacttgcgcagcaccacacaagcagcagttattccttgggctccaatctggtcacaccaccaaacaaatccaacgggctaatatcgcaaggcagtgcagtaagcggtgttggcgtgagcattgtagctcgccttgaaagttggtccggcataacaatcttccacagtaaagaacgcacactgtttctccttattggtgtgtcaattaacgtccacatccattaagcctggatattcggctagccaagtggagtcttggaaagcttgtggaagacaataagcgcaggtaccttggctgcatatgcagtttccccagacagatgcactccacaattccttctgttccggagaaatcatcctcgcaaatcctaacggctttactacccctaccaagtggtcttatgccaagtcgatcgacgagtacggaccatcgctacggaatattctccacgaatcgtccatccccgcatgccaccacgtagccaaaccaacgaagaacagaaatggacccgtagaaccagcactggtaccggacatatcccgtattgcggtgaatcattatcagagctccgtggatccagtcattgttgtgctgcactaattactcgcgcgcagagtaaagcggtctacgtaccgagctatggttttgcgtgtgcttacttgcgtactgaacacagcccctgttgatatattaatatcggaaatttattcagcacaatgatgtcgcgtttcgagaattaggtggaacaagcataggccggctgttgttgtttcgccatgaactccctactcgcatttagccgctttttccccgtgcagaaaacgccaagtacctcaagcagcacaagaaccgaccaccgaagcttggaataaattaacccgaaacgcctggtccccacttttttactctatacggtaagactacgaatcattcaggccatgaccgacatgaacgacgcattgcaggtgcgattgcaggcgatgtttgattgcgttaacgccctattttcgggggttctccacaacgtggtgggtatgcggcttctagacgacgcctgccgttgtttgaggcgaattacattgtttagacgaaatgcgtgcgccgaatagtctagggcactctggggggacgatggattggtataagtagagctgggcccatgggcatatcttcgtatccatcacattcattcatttcagcttctccattctaccaaacaatcaaaccaatccttttagcaaccatgaagttttctctcatcaccatcctttccgccagcgctttggtcgctgcctctccctttgctgagccagaggctttccttgaggagcgccaggctgcgcagagcctcgatgccgccatgaaggccaagggcaggaagtacttcggtaccgccactgacccaggccgattcaaccagggcaagaacgctgccatcatcaaggccaactttggtcaaatcacccccgagaactccatgaagtgggatgctaccgagtctacccgtggcaaattcaccttcggtactgccgaccagaccgctaagttcgccaaggacaacggcaagctcatccgtggacacaccaccatctggcactcccagcttccttcatgggtttcttccatcaaggacaaggccaccttgaccactgtcatgcagaaccacatctcctccgtcatgggccacttcaagggccagatctacgcctgggacgtcatcaacgagatgttcgaggagaacggtaacttccgtgccagcgtcttctacaacgtcctcggtgaggactttgtccgcatcgccttcgaggctgccaagaaggctgaccccactgctaagcgttacatcaacgactacaagtaagcattgatctatgattaccaagtttttcgatatactgactgcaatatagccttgacactgccaactacgcaaagacccaggccatggccaagaacgtcaagaagtggatcgccgccggtatccccatcgacggtatcggttcgcagactcaccttaccgccggccagggtgccgctaccatcgacgccatgaagctcctctgcagcgttgcttccgagtgcgccatgaccgaggtcgacatccagaacgcccagcaggctgactggaccaacgtcaccaaggcctgccttaaccagaagaactgcgttggtatcaccgtctggggtgtcagggactccgactcctggaggccccagggcaaccctctcctcttcgacaacagctacaaccccaagcaggcttacaccactgtcctcaacgctctcaagtaaactgtttgcgatgctgggcatcctgggaaccaggaagactatgtcttttcttgctcccttacctatccttcttttcgacatattattgtaaatactttgattggtggtggagatattgtaaatatttgattgaaaggaatgaagaagttgatctttcccctataattgtgtgcttcttgatctctctactagt

SEQ ID NO: 53 - protein, 331 aa, Cochliobolus carbonum
MKFSLITILSASALVAASPFAEPEAFLEERQAAQSLDAAMKAKGRKYFGTATDPGRFNQGKNAAIIKANFGQITPENSMKWDATESTRGKFTFGTADQTAKFAKDNGKLIRGHTTIWHSQLPSWVSSIKDKATLTTVMQNHISSVMGHFKGQIYAWDVINEMFEENGNFRASVFYNVLGEDFVRIAFEAAKKADPTAKRYINDYNLDTANYAKTQAMAKNVKKWIAAGIPIDGIGSQTHLTAGQGAATIDAMKLLCSVASECAMTEVDIQNAQQADWTNVTKACLNQKNCVGITVWGVRDSDSWRPQGNPLLFDNSYNPKQAYTTVLNALK

SEQ ID NO: 54 - DNA, 843 bp, ASPERGILLUS CF. NIGER
atgcttaccaagaaccttctcctctgcttcgccgcagctaaggctgttctggctgttccccacgactctgtcgtcgagcgttcggatgccttgcacaagctctctgagcgttcgaccccgagctcgaccggcgagaacaacggcttctactactccttctggaccgacggcggtggtgatgtgacctacaccaacggtgacgctggctcgtacaccgtcgagtggtccaacgttggcaactttgttggtggaaagggctggaaccctggaagtgcgcaagacatcacctacagcggcaccttcacccctagcggcaacggctacctctccgtctatggctggaccactgaccccctgatcgaatactacatcgtcgagtcctacggcgactacaaccccggcagtggaggcacatacaagggcaccgtcacctccgatggatccgtctacgatatctacacggctacccgcaccaacgccgcttctatccaaggaaccgctaccttcacccagtactggtccgttcgccagaacaagagagtcggaggaactgttaccacttccaaccacttcaacgcttgggctaagctgggcatgaacctgggtactcacaactaccagatcgtggctaccgagggctaccagagcagcggatcttcctccattactgttcagtgagctgtggatgtccaaccgtgcttgcagggattgcctggatgtgggtgtgagaattgagtgcgatggtccttggaaatattgagcaatcatatgatgtgtgaaacaattagttgctcgctatcaatgcacttgtcatctggaacaaaaaaaaaaaaaaaaaaaaaa

SEQ ID NO: 55 - protein, 225 aa, ASPERGILLUS CF. NIGER; identical to SEQ ID NO: 6

SEQ ID NO: 56 - DNA, 1020 bp, Bacillus alcalophilus
atgggaggaaatcagcgtgaactcttatcgctaagtaaggcatatgaagatttatttctaattggtgcagcagtaaatcattttacgattgattcagaattatccttattagaaaaacattttaatagtttaacagcagaaaatgaaatgaaatttgagcatatacaaccaaaggagaatcaatttcaatttgagtatgtagataagttggtttcttactctgagcgttatggtcatcagcttcgtggtcatactttagtatggcataaccaaacatcagattggatatttaaagctccagaaggaaaggaaatgaatcgagatttattattggggcggatgaaatcccatatcatgactttattaaaaaggtataaagggaaattttatagttgggatgttgttaatgaagcgatttccgatcaaaaaggtgaatttttgagacactctccttggcttgatattataggtgaagatttcattgattatgcctttcggtatgcacatgaagctgatccagaagcagcattattttataatgattataacgaatcggatcctgaaaaaagagataaaatttataccttagtcaaagatatgcttgaaaaagatgtacctattcacggaattgggctacaagctcattggaatattcatgatccctctatggatcatattcgagctgcgatagaaaaatatgcatcattaggcttgcagcttcagattacagagatggatgtctccatgtttcaattcgaagataagagaattgatttattaaaacctacaagtgaaatgctagaaaaacaagcggaaagatacgaacagttttttaaattgtttaaagaataccatcagcatattacttccgtaacattctggggtgtaagtgacaaatacacgtggttacatgattttcctgtacgaggaagaagaaattggccattcttatttgatgagaataatcaaacgaaagaggcttattggcgggtaatcgatcaagtaagcataagtaagtaa

SEQ ID NO: 57 - protein, 339 aa, Bacillus alcalophilus
MGGNQRELLSLSKAYEDLFLIGAAVNHFTIDSELSLLEKHFNSLTAENEMKFEHIQPKENQFQFEYVDKLVSYSERYGHQLRGHTLVWHNQTSDWIFKAPEGKEMNRDLLLGRMKSHIMTLLKRYKGKFYSWDVVNEAISDQKGEFLRHSPWLDIIGEDFIDYAFRYAHEADPEAALFYNDYNESDPEKRDKIYTLVKDMLEKDVPIHGIGLQAHWNIHDPSMDHIRAAIEKYASLGLQLQITEMDVSMFQFEDKRIDLLKPTSEMLEKQAERYEQFFKLFKEYHQHITSVTFWGVSDKYTWLHDFPVRGRRNWPFLFDENNQTKEAYWRVIDQVSISK

SEQ ID NO: 58 - DNA, 786 bp, Trichoderma viride
atggtctccttcacaactctcctcgccggcttcgtcgctgttaccggagttctgtccgctcccactgagaacgtggaggtcgtggacgtggagaagcgccagacgattggccccggcactggcttcaacaacggctactactactcgtactggaacgatggccattccggcgtgacatacaccaacggtgctggcggctcattcagcgtcaactgggcaaactcgggcaactttgtcggaggcaagggatggaaccccggcagcagctccaggtaagtgactcaagtgaggaacacaactcagatactccaagacactggccaccagtactcccctgtgccatattcacgtgcagagagctaataccactcgctctgttaatcaagggtcatcaacttctctggcagctacaaccccaacggcaatagctacctctcagtctatggctggtcaaagaaccctctcatcgagtactacatcgttgagaactttggaacctacaacccatcgaccggcaccaccaagctgggcgaggtgacctctgacggcagcgtctacgacatctaccgcacgcagcgagtcaaccagccttccatcatcggaaccgccaccttttaccagtactggtctgtccgccgcaaccaccgctccagcggctcggtcacggttgcgaaccacttcaacgcgtggcgcaacctgggcttgaccctgggaaccttggactaccagatcattgccgtggagggctactttagctctggtaacgccaacattaacgttagctaa

SEQ ID NO: 59 - protein, 223 aa, Trichoderma viride
MVSFTTLLAGFVAVTGVLSAPTENVEVVDVEKRQTIGPGTGFNNGYYYSYWNDGHSGVTYTNGAGGSFSVNWANSGNFVGGKGWNPGSSSRVINFSGSYNPNGNSYLSVYGWSKNPLIEYYIVENFGTYNPSTGTTKLGEVTSDGSVYDIYRTQRVNQPSIIGTATFYQYWSVRRNHRSSGSVTVANHFNAWRNLGLTLGTLDYQIIAVEGYFSSGNANINVS

SEQ ID NO: 60 - DNA, 1044 bp, Thermotoga maritima
atgaaaatattaccttctgtgttgatccttttgttgggatgtgttccagttttcagctctcagaatgtatctctgagagaactcgcagaaaagctgaacatctatattggttttgccgcaatcaacaacttttggtctctttccgacgcagaaaagtacatggaagttgcaagaagagaattcaacatcctgacccctgagaaccagatgaagtgggatacgattcatccagaaagagacagatacaatttcactcccgctgaaaaacacgttgagtttgcagaagaaaacgacatgatcgtgcatggacacactcttgtctggcacaaccagcttcctggatggatcactggtagagaatggacaaaggaagaacttttgaacgttcttgaagaccacataaaaacggtggtgtctcatttcaaaggtagagtgaagatctgggatgtggtgaacgaagcggtgagcgattctggaacctacagggaaagcgtgtggtacaagacgatcggtcctgaatacattgaaaaagcgttcagatgggcaaaagaagccgatccagatgcgattctcatccacaacgactacagcatagaagaaatcaacgcaaaatcgaacttcgtctacaacatgataaaagagctgaaagaaaagggagtacctgttgatggaataggatttcagatgcacatagactacagagggctcaattatgacagtttcagaaggaatttggagagatttgcgaaactcggtcttcaaatatacatcacagagatggatgtgagaattcctctcagtggttcggaggagtattatttgaaaaaacaggctgaagtttgtgcgaagatcttcgatatatgcttggacaaccctgcagttaaagcgatccagttttggggattcacagacaaatactcctgggttcccggctttttcaaagggtacgggaaagcgttgctcttcgatgagaattacaaccccaagccttgttattacgcgataaaagaggtgctggagaaaaagatagaagaaagaaaatga

SEQ ID NO: 61 - protein, 347 aa, Thermotoga maritima
MKILPSVLILLLGCVPVFSSQNVSLRELAEKLNIYIGFAAINNFWSLSDAEKYMEVARREFNILTPENQMKWDTIHPERDRYNFTPAEKHVEFAEENDMIVHGHTLVWHNQLPGWITGREWTKEELLNVLEDHIKTVVSHFKGRVKIWDVVNEAVSDSGTYRESVWYKTIGPEYIEKAFRWAKEADPDAILIHNDYSIEEINAKSNFVYNMIKELKEKGVPVDGIGFQMHIDYRGLNYDSFRRNLERFAKLGLQIYITEMDVRIPLSGSEEYYLKKQAEVCAKIFDICLDNPAVKAIQFWGFTDKYSWVPGFFKGYGKALLFDENYNPKPCYYAIKEVLEKKIEERK

SEQ ID NO: 62 - DNA, 672 bp, Trichoderma viride
atggtctccttcacaactctcctcgccggcttcgtcgctgttaccggagttctgtccgctcccactgagaacgtggaggtcgtggacgtggagaagcgccagacgattggccccggcactggcttcaacaacggctactactactcgtactggaacgatggccattccggcgtgacatacaccaacggtgctggcggctcattcagcgtcaactgggcaaactcgggcaactttgtcggaggcaagggatggaaccccggcagcagctccagggtcatcaacttctctggcagctacaaccccaacggcaatagctacctctcagtctatggctggtcaaagaaccctctcatcgagtactacatcgttgagaactttggaacctacaacccatcgaccggcaccaccaagctgggcgaggtgacctctgacggcagcgtctacgacatctaccgcacgcagcgagtcaaccagccttccatcatcggaaccgccaccttttaccagtactggtctgtccgccgcaaccaccgctccagcggctcggtcacggttgcgaaccacttcaacgcgtggcgcaacctgggcttgaccctgggaaccttggactaccagatcattgccgtggagggctactttagctctggtaacgccaacattaacgttagctaa

SEQ ID NO: 63 - protein, 223 aa, Trichoderma viride; identical to SEQ ID NO: 59

SEQ ID NO: 64 - DNA, 3826 bp, Gibberella zeae
gaattcaagtccttcgtcaacttcgtctccaccaccggcaagagcagcagccactcttggtggttgcaaatggacatcaccggcggcacatactccgccgtctccaagcccaagcccagcgacaccgcctacgtccaccgtgacaccctcctcctcttccaattctacgacagcgttgccgccactgcccagtacccctctgatggcttcaacctcatcaagggcttgaggcagagcatctccaactctctcaaggcgggaacttggggtatgtacgccaactaccctgactcgcagatcaagaatgatcgcgctaccgagatgtactggggaagcaacgttgccaagttggaggctgtcaaggccaagtacgatcccaagaacttgttccgcaaccctcagtctattaagcctaaggcttagagtgggcaaggatcttcctggcattttggcattttcttttcaaaatagagtgttatagacttgatatttagcggctttaatattaatcaactggtggtgcaaaccatccttgtaatcaatatctttctccctgttgtgaacagtgttccttgtcctcatctcaatctgcagactacgtacttgttctctattgcagtgactttttaggttccatcagccgcttgaatagtcccatatattacaccggttaattaataaatcgatttgacgaagctgagattcggaccttgatatgcgtcagctgtttggtaattaaccggtagtgaccatgtcaacatacataagcagttgacatctaaattggctgcagatttgtatcacaggcgaataatatggaggccttgatagaatatccatcttagctcaaatcaagtcacacatggttgattccaaaagagtcactcggttatctgattcaagtcgagcctagccccaactcataccaagttttattctatgagtccatcagatcatctggcaatagtgttttctctctgacaaccgcagtcgctgtaattccgaatatcctgaattgaagttgaattagtcgtcgaataagttccacaggaacaacaacaaggataaaaaactgcccgaggctaaaatgaaaatcttggccatgctgtaatttaggcaaaatacaatctgcaaggatcaagcatcgtaatccggggcatcatgttccatctatctgaatcgggctagatgtgtgtcggtacccggccggatgtatccaacccgaccgaatctctaaatcccagatcttacctttatttacgactctgtcttatgtcttgttacattcccaaatatcacatagtaagcttaaatctggtgatcgacataatgagattctgttaagcgagtcagtaaaggtactttgttgtgggactacgactggcggtcatgatgtttgtgccaagattactattcctggcatgatatttccttaatagtcttgcagatatagttccaagacatgggatcctcggtagtggacatcggcatgagatgaaaatccgggaagacattgcagtagcggtcatcacatcgctcgtcccaccttttctttttcgtcttggaaatgacctgtttgtagctttatcccgagtcggtggaccaataacgatacccagtccgtatcctgtaattcccctcctgattgaagtgaactgttaaaatgccaagatgtagtcttcagaaacggatgaaaggaactgacgtttgcttttagccggaatataaagaaggtgtgctgaatcagtgcctgcaggagtatggctagcctacgatatgtgcatgtcactgattttgcggctgacgaatcgcatcaaaggatcacatctgtggatatacttgtgtcccctcatgggtgatcgtgagagacattaccgtcttggctttcttatgggataaattattaccatgtggatttcaagatggaggtggaggggcagacaacaccatgatgattgtagaaatgcttttgagtattaacctagaagggagttagtctccgagatggagaagcagccaagatattgaggttgcttctttgactatcagtattagccactaaccctcttggcattatcaatgtttcaatgcaaaaataagtatatatatgacctcttcaatatcgattaatgaagaatttctcaccaggtcagacctctctgaacagtcaaccacttgtttctcaatacttccttgagaactactctcgcgcccttcaccatcatggtctcgttcaaatcccttctcgtcgccgtctcggcactcactggggcacttgctcgtccctttgacttcctcgatgagcgtgacgatggcaacgccacctcggtcctcgaggctcgccaagtcactggcaacagtgaaggttaccacaacggttacttctactcttggtggtctgatggtggtggttatgctcagtaccgtatgggtgagggcagccactaccaggttgattggcgcaacactggtaactttgtcggtggaaagggatggaaccctggtactggccggcaagttctctcagacatattatcttacaaatcatttgacttacactatgcagaaccatcaactacggaggttccttcaaccctcagggtaacggatacctttgcgtttacggatggacccgcggtcccctcgtcgagtactacgtaagtgactctagcctcaaacttcctatacctcggtactaacaattatccaggtcatcgagagttacggttcttacaaccccggcagccaggctcagcaccgaggtaccgtctacaccgacggtgacacctacgatctctatatgtccacccgttaccaacagccttcgatcgacggtgttcagaccttcaaccagtactggtccatccgccgcaacaagcgtaccagcggctccgtcaacatgcagaaccacttcaatgcttggagatctgctggcatgaacctcggaaaccactactaccagattctggccactgagggttaccagagcagtggctcatcttctatctatgtccagactagttaagggatgtcagctgtggtcggttacagatgatttgagagatcatgtgtggaaattgaagagggaaaggttcttggctgactgaaggatggtcactgttactgtctgatgtatatttttttgcgactttggcaagtctctggcgcgaaagatcatcattgcaatacgggtcttcaataaaactgacattttggacaaaagtaatgtcttgcttgctgtaaagttcactattaattctgagaacccatgagaccgtatgtagtacaacataatgattgacttgtcacatcaaatttcatgcttgcattacgaaatccctagccttgcttgatccttgtcgccaaataaatcgaggctgtgttaacagaaatgtcggccactacctaatatggatgcttactttctacgccaagatcttgacaaggctagattgtatagcagcagaggaccaaggaccacgcttcgcccaattaacaatcaatacaattgcaaattccaataacgacaggatttgaggcctccactcattttggtttattatacaaacgagtaattttctattcatgtcgagaccaagtcaaacctcgcttgtctttactaaaataccagctacgataacaaaaccatatcagctataacagcaaccaacatgtcttccaccaaagctatcgtcattatagccctaagcgctttacaagcagcggctcaaaccccaaccccaaccttgacctcaaccgaaaccccagctacgcttcctacgcgtcctaccttgtcaatgccaccatgctgggagcttgcgaattc

SEQ ID NO: 65 - protein, 231 aa, Gibberella zeae
MVSFKSLLVAVSALTGALARPFDFLDERDDGNATSVLEARQVTGNSEGYHNGYFYSWWSDGGGYAQYRMGEGSHYQVDWRNTGNFVGGKGWNPGTGRTINYGGSFNPQGNGYLCVYGWTRGPLVEYYVIESYGSYNPGSQAQHRGTVYTDGDTYDLYMSTRYQQPSIDGVQTFNQYWSIRRNKRTSGSVNMQNHFNAWRSAGMNLGNHYYQILATEGYQSSGSSSIYVQTS

SEQ ID NO: 66 - DNA, 1139 bp, Aeromonas caviae
ggatccttaaaccatttcgatggatcggtgtttcgccgcagcccctaacaccagagagccggagttacttgttcctgatatttcgaaagcgccttcattactctcgctgttatggatctcttgcggtgagcaggacaatcttatagagattagtctgggggttcaccgatatttggcggaacaaggagtacctcacatttggcatgaggaaagtggaggacatgattggcctgtgtggaagaacgatctgtatctgttttcgcaacgtcttttcaagtgaatgtgctgaagaacattcatatcggattctagcatcaaccaaatctattaaaatatcaggaggtattattctatgttcaaattcggcaaaaaattaatgactgttgttcttgcagcttccatgagttttggtgtctttgcagcaacatccagcgctgcaacagattattggcagaattggacagatggtggaggaacagtcaacgccgttaatggatcaggagggaattacagcgtgagttggcaaaataccgggaactttgttgtcgggaaagggtggacatatggcacacctaatcgggtagtcaattacaatgccggtgtgttcgctccttcaggtaacggctatctcaccttctatggttggactcgaaacgctttaattgaatattacgtggtggatagctggggaacgtatcgtccgaccggaacgtataagggcacggtgaatagtgatggtggcacatatgatatctatacaacgatgagatacaatgcaccttccattgatggtacgcagactttccctcagtattggagtgttagacagtccaagagaccgactggtgtcaattctaccattacgttcagcaatcatgtgaatgcatggccgagcaaagggatgtaccttggaaatagttggtcctatcaggtgatggcaacagagggttatcaaagcagcggtaacgcaaatgtgacggtttggtaaaaatgatgtaatgccgttcaacatctgcacctgcatttgaattgaattgtccggaacgttgaggaacgttaatcacagactaacggacctcgacgttgccggattcatgcttagcaaaggagaataattgaatgaggaagctgatatggtt

SEQ ID NO: 67 - protein, 211 aa, Aeromonas caviae
MFKFGKKLMTVVLAASMSFGVFAATSSAATDYWQNWTDGGGTVNAVNGSGGNYSVSWQNTGNFVVGKGWTYGTPNRVVNYNAGVFAPSGNGYLTFYGWTRNALIEYYVVDSWGTYRPTGTYKGTVNSDGGTYDIYTTMRYNAPSIDGTQTFPQYWSVRQSKRPTGVNSTITFSNHVNAWPSKGMYLGNSWSYQVMATEGYQSSGNANVTVW

SEQ ID NO: 68 - DNA, 2187 bp, Bacillus pumilus
aagctttgatattctttgctgcagccacaaagcaggaaacaggtgattatacagcgcttggtgcaagagcgaaagatgcagctgcgcagctcctagaggttgcatggaattacaatgatggcgtcggcatagtgacagaggaagatagagaagactatgaccgtttctttagaaaagaagtgtatttcccaaatggatggaacgggacatttggtcaaggaaatcaaattcctggagccagcaccattccttctgacccgcagcgaggagggaatggggtctatacgagttttgctgatcttcgtccgaagattaaacaagatccagcatggtcttcactcgaaagtaaatatcagtcttcatttaatgaagctacaggcaaatgggagaatggcgcaccagttttcacttatcaccgcttctggtctcaagtggatatggccactgcctatgctgaataccatcgtctgatcaactaagaggttaaaagcaagctgccggcttctggccggcagtttgaataggtaatatgaatccaatgaagataagggtgatttcacatggacaaagaaagaagctttcttcatcattcattcaatagaggcgaaaatgggcaggaaaatctgatgtggaaaaaagaggcggatgatcgaatctcagagcatagacaaagagatcttgtgatcaacgtgacaaacggcgaaaaaaagccaatagcaggaatagaggttgaaataaagcaaatcagacatgaattcgcctttggttcagcgatgaatgatcaagtgttatttaatcaacaatatgctgattttttcgtgaagcattttaattgggctgtttttgaaaatgaagcaaaatggtatgcgaatgagccagaaagagggaaaatcacctacgaaaaagcagatgcgatgctgaattttgcagatcgacatcagcttccagtgagggggcacgctttattttgggaggtagaggatgcgaatccaagctggctgaggtcactgccgaatcacgaagtatatgaagccatgaaaaaacggcttgagcatgcgggcaatcactttaagggaaggttccggcattgggatgtaaacaatgaaatgatgcatggttcattttttaaagatcgctttgggaaaaatatttggaagtggatgtatgaagaaacgaaaaaaattgaccctcaagcactattgtttgtgaatgattataatgtgatctcttatggtgaacaccatgcctataaagcccatatcaatgaactgcgtcagttaggcgcacctattgaggcgattggggttcaaggccattttgaagaacgggtcgatccagtcattgtcaaagagaggctcgatgtgctggctgagcttggtcttccaatatgggtcacagagtacgattctgttcaccctgaccctaatagaagagcggataacctggaagctttatatcgcgtcgcatttagtcatccagccgtaaaaggagtgctgatgtggggattttgggcaggtgcccattggagaggtgaacatgcagccatcgtgaattatgattggtctttaaatgaagcaggacgacgttatgaaaagcttctaaacgagtggacgacgcaaagagttgaaaaaacagatgctaatggccatgtgaaatgtccagcatttcacggaacatatgagattcgaatcggtaaagaaaataaaatgctcaaacagcagacgattgaacttgattcaaatgaacaaacaccgtttcaactagacgtaatcctgcctcaagaaggatagagatagattgtgaggagaatgtaaatgaaaaagtgggctcaaagagtgtcttgcttcatacttctagccgctatatggtctggctggttttcgcttacgatgaaggctgccgcttatgtgcagacgtctggtacacaatttacactgaacaatcaaccattttacttcgccggcacaaataattactatttccattacaaatctaaaaaaatggtagatgctgtgttcgatgatatgaaagcaatgaatttaaaggtcatacggatttggggctttcacgacggggctcctcaagaaaactcagtcttacaatctagtccaggcgtctatgaagaatctggttttcatttttctagattatgcgatttataaagcaggacaggaaggaataaagctt

SEQ ID NO: 69 - protein, 409 aa, Bacillus pumilus
MDKERSFLHHSFNRGENGQENLMWKKEADDRISEHRQRDLVINVTNGEKKPIAGIEVEIKQIRHEFAFGSAMNDQVLFNQQYADFFVKHFNWAVFENEAKWYANEPERGKITYEKADAMLNFADRHQLPVRGHALFWEVEDANPSWLRSLPNHEVYEAMKKRLEHAGNHFKGRFRHWDVNNEMMHGSFFKDRFGKNIWKWMYEETKKIDPQALLFVNDYNVISYGEHHAYKAHINELRQLGAPIEAIGVQGHFEERVDPVIVKERLDVLAELGLPIWVTEYDSVHPDPNRRADNLEALYRVAFSHPAVKGVLMWGFWAGAHWRGEHAAIVNYDWSLNEAGRRYEKLLNEWTTQRVEKTDANGHVKCPAFHGTYEIRIGKENKMLKQQTIELDSNEQTPFQLDVILPQEG

SEQ ID NO: 70 - DNA, 1763 bp, Fusarium oxysporum
caacaccaagtcattctgcttctcttactcgttcgtcgaagaaagcttggcacgcatgtttatccttcggcatagcagcctaatatgatatgtctgccacgtgcactcctccttccccatgatccctgcctccccgcaataaggtgctggcatcccgagtcacgatctcaagccacggaccagaggaattggggaatgccattttagccggaagtcaattatggatgccaccgatcgaaattgcggaggaaacatcacgccagttcttatgaatgcgtcctgccaatcgcatcacagactgactcttggggataaggggttgttcacctatcattggccaggagagttcctaccgtcttggctccagtgcttaccgtcttggccttcatgcgagtggggaagaagaggctgagatttccaagatgaatgcaaagagttgcttttgctagtaacggagagccaggttccgaggtagggcaccaagctagagggttggaagagcctgatgatcttggtattaaggactaagatacttggcagtcgacttatgacaggcgatatgaagccttatacgagtatatatagagaacatcccgctcaccaactaattgattctgcagctcatcagggttcttcgatttacatcccaactatccagccaatctcaaaagagacatcatggtctccttcaagtctctcctcctcgccgcttcggcactcactggagctctcgctcacccctttgacttcctcgacgagcaagacgacggcaactccacctccgtcctcgaggcccgtcaagtcactggcaactccgagggttaccacaacggatacttctactcttggtggtctgatggcggtggttatgccaactaccgcatgggtgagggtagtcactaccaggttgattggcgcaacactggtaactttgttggtggaaagggttggaaccctggtactggccggtaagttgaagatgcttttaagagttgagatagtctgctgatgatggactagaaccatcaactatggcggttctttcagccctcaaggtaacggctacctttgcgtttacggctggactcgcagccctctcgtcgagtactacgtacgtaccccatctcaccctcaactctccattaacaatatctaggtcatcgagagctacggcacttacaaccctggctctgctggccagcacaagggcaccgtctacaacgacggcgacacctacgatctctaccaaaccacccgcgtgcagcagccctccatcgacggcacccagaccttcaaccagtactgggccatccgccgcaacaagcgcaccagcggcgccgtcaacatgcagactatctttaatgcttggaattcggctggcatgagacttggaaaccactactatcagattctggctactgaaggttaccagagcagtggatcttcttccatctatgtccagactaagtaagacctgcctgtgaaggttcgttggccttgaaacaatgaggctgaatctctctatggcattgcttgggaattatgataaagatggtggatgtgaaaactatgaagaaggcttgacctggtgtcaattgatggggctttacttttcagcgcgggacatttctcctttggagttatgtcttgtcattctctagtacataactttgatctgatcaatattacatatcgcgaaataccttccacgctcagtgaaccatcagtgatgctccatacctattattcgtgcctctatttgc

SEQ ID NO: 71 - protein, 231 aa, Fusarium oxysporum
MVSFKSLLLAASALTGALAHPFDFLDEQDDGNSTSVLEARQVTGNSEGYHNGYFYSWWSDGGGYANYRMGEGSHYQVDWRNTGNFVGGKGWNPGTGRTINYGGSFSPQGNGYLCVYGWTRSPLVEYYVIESYGTYNPGSAGQHKGTVYNDGDTYDLYQTTRVQQPSIDGTQTFNQYWAIRRNKRTSGAVNMQTIFNAWNSAGMRLGNHYYQILATEGYQSSGSSSIYVQTK

SEQ ID NO: 72 - DNA, 2202 bp, Fusarium oxysporum
ggtatgccaagtttcaggttgaggatgctgccgtttgccgatgctggttacaaaatacggctgttacctcgtttcaactgaaattaattgtggaacgtgaggttaaaagagcggatttgagccggaatagttgccgtggatttattgatagagacgatattctactgaccttggttgacgatatcaagtgcagcgacttctctatgccaagattcaatatatcttagtcaaaacttatctcatgtaccatcaataatgttcgattcttggtaaaaataccatttgtagatctgaaacttggaacatgacgaggctgagcggaaagcatgaatattcgcttggcatctagatctaatcgacccaccatcagctcaacgcattaaaatcaccatctcccggaaacatcaaaacaatcgtccaatggacggaaaaaatcgagcttcgtccctccttcattaaacgtcaaatcattgtccgatcgggaaaacgggccggccccacaagttgtttcagaccaagcaacaccacatgtttattcgaaacaatagtacgaagcgatataacaagggtcttcttttctatatctataccaacaacttcgcagcaatggcagagagaatcatccttcaactcaacactcgttttctattctaacacactcttttttctcttcaaatcattcatcatggttcacttcacttccgtcttcgctgggctgtcgctcgtagctggttctcttgccgcgccctccaaagaaggtctcttctccaagattaccaagcgggctggtactcccaacagttccggtactaacaacggattctactactcttgggtgtgtacagccaacataattctcgggccatagctgactttatatagtggagtgatggcggtgccgatgccacttacaccaacggtgagggaggttcttactccatggagtggaaggatggcggcaacgtcgtcggtggtaagggttggtctcctggaaaggcccggttagtacacaataagcttaccatggccctctgctaatacctggtagaaccatctcgtacgagggagagtacaagcccaacggcaacagctacctctctgtctacggttggacccgaaaccctctcgtcgaatactacatcgtcgagtccttcggtacttacaacccctccagcggtgctaccaagaagggcaccgttgaggccgatggcagcacctacgacatcttcgagaccactcgcaccaacgccccttcaatcgacggtactcagaccttccagcagtactggtctgttcgccagcagcaccgctctactggcagcgtcgacactggtcttcatttcgatgcctgggagaaggccggcatgaagctcggtactcacgactaccagatcctcgctactgagggttacttcagcagcggatcgtcccacatgaccgtctctgagggtgcttcttctggtggtggtgccggtggctctactggcggtgatgcttcccagggcggtgattctcagcaaggaggcgatgttcaacagggtggcgacgcttctcagggcggaaacggtcagcaaggtggcaatggaaactctttccagcagcctggcagtgagaaccaaccccagcagcaagagattgacactggcgctaacgagccctgccaataagtctaagcacaaaccttccaagcaagagcctggtgccaatgtaagcattctccccttcacaacctagctgactcttggatactgacttcagcagtgcgcttctatttacggacgatgtggtggccagagctggactgaagctacctgatgtcatcggagctgcaagcgtgccagtggtacttccagagcttcaacgacaggatcacgggtgatttggagttagagttgaggagatcgtattctttcatacccattgcttctcgccctttagtagagaagtggtggcgtgtatatacttgatgtataaatttcttgcttgaatatctccacagggtatccagtgacagtcgatctgtgacggttaatcgtgttcagagagcagttagaaccatgtggtcgttttgctcagcgccactgcggtgccgctatcagcctaagagtctactaagactatcctaaagtatcctaatatattctaaatctacctaaacacttttattacttaggatcaaaatctgaaggtttttaccatccc

SEQ ID NO: 73 - protein, 295 aa, Fusarium oxysporum
MVHFTSVFAGLSLVAGSLAAPSKEGLFSKITKRAGTPNSSGTNNGFYYSWWSDGGADATYTNGEGGSYSMEWKDGGNVVGGKGWSPGKARTISYEGEYKPNGNSYLSVYGWTRNPLVEYYIVESFGTYNPSSGATKKGTVEADGSTYDIFETTRTNAPSIDGTQTFQQYWSVRQQHRSTGSVDTGLHFDAWEKAGMKLGTHDYQILATEGYFSSGSSHMTVSEGASSGGGAGGSTGGDASQGGDSQQGGDVQQGGDASQGGNGQQGGNGNSFQQPGSENQPQQQEIDTGANEPCQ

SEQ ID NO: 74 - DNA, 3621 bp, Penicillium purporogenum
agttgaacatcagtctattggatttgaatgttttcgaaagccatgaaaagctgggcagaatatcacgcccaataactatgagtatcattataatacgtggccttttgaaggttcgttgaatgctcggcgttgtcctaatcttcgacgagagcctcgtgatgtggatgtacatgattatgacagtcatccactaattcgacagggaatggtaaaactcatgatggcggtgctggacgaacctcttccaagctgagtatttgtaagaagagagctatttcaccatgaaacacactagatagttctgacattagtaatttggtagttatttccttagtcaacaacgtgccttgccgggaggttcttcagggttcacacaaccgatgtggcgcggaggtacctcggagacagactcggagggccgaagttgaaaagtagtttgcggggccgacgttttgtgaagaaatttggacccggattaacgatggctgaattagttttaagttaattgaccagcaagccccctggtgatccacctgcccgccgggcgtctccactcgccaggcaccctgttgtttccattaaccgttgcctctacctcctgaccataagccaagatatttaggtccttttcttgttacatctcaaggctagaacctgtgatcgcccttttgaagaagcgcttgacagtattcggggttcaggctgaagtcttcttggcaagcgcgtcggctaaaataacgtttaagtatcttcacgtcagatacaggggtcttggattgaatggggaacatccgtttctcatcggttgaaggaatacatggtgcgacgtccgttttgtaacggggaaggatattcgtttagttagcccctctactatgacattacttctcctgggatggtgactacgatcttgtataagtatcagggttgatccctccaaatgatagctttcttcaacatcgactctcataatcgatatacttgaaaacccaacacatcactcaaaatggttcaactcaagactgctgcgctggcgctccttttcgccggtcaggcgatttccagccctgtcgacatcgactccagacaggcctctgtgagcattgatgccaaattcaaggcccacggcaagaagtatcttggtaccattggtgaccagtacaccttgaccaagaactcgaagaaccctgccatcatcaaggctgacttcggtcaattgaccccggagaacagcatgaagtgggatgctactgagcgttagtttaactttccggatggaacgagattcaccagaaactgatttggaaaacagcaaaccggggccagttctccttctcaggctcggactaccttgtatgtatcccgcgatatatgcttgtttgttttgttctcacaaattctaggtcaactttgcccagtccaacggcaagctgatccgcggccacactctcggtaagtttctgaaaccgcacgtttctatagtcatagttccaaagctaacaccgtcaagtctggcactctcagctcccgggatgggtctcttccatcacggataagaacactctcatcagtgtcctgaagaaccacatcaccaccgtgatgacccgttacaagggcaagatctacgcttgggtaagttctttccacataatgagttcaaaaaatccccccttctaacatatccaaggacgtcctgaacgagatcttcaacgaagacggctccctgcgcaacagcgtcttctacaatgtcatcggtgaagactacgtccgcattgctttcgagaccgctcggtccgtggaccccaacgccaagttgtacatcaacgattacaagtgagttatagctctctcaccccctcgagatgtatctcttctaacattataaagcctggattccgccggttactccaaggtgaacggcatggtcagccacgtcaagaagtggcttgctgccggtattcccattgacggaattggctcccaaacccacctgggcgctggtgccggtgctaatgttgctggataagtgccccccgtcttccatgaattaaaccgaggaaagctaacagcctcttacagctctgaatgctcttgccggtgctggaaccacggagattgccatcactgagcttgatattgctggcgctagctctactgactacgtcaacgtgagtttcgagtccaatcaataacccgtataattggttcattacttaaacattcatttcaataggttgtcaaggcttgcctgaaccagtccaagtgtgttggaatcactgtctggggtgtcgctgacccggtaaatacccattcccctttcgtgaaagtggaaatgattggtatactaacattgcatgttctcttaggattcgtggcgctctagctcctcccctctgctgttcgacagcaactataaccccaaggctgcctacaatgctattgccaatgcgctctaggagcgtggcttcaacatctgttcgaagatgaggtctactactgagttgggttgattgtactacagattgttcgattgtatagttttgaatgtatggagcttaaaatggtgctcatttagctaatttcccttggctaagtcacttagcttcaataaaaccatcattggcttcgcaaatctatgatttcttacacgtttctattgtaatgccatttcatgtgatccaagaagatacgcaccgtcgactttagcttagtgactcgcacaaaggctacagtagacttacgtcaacacatgaaaagatgctctcttgtattcacaaaaataaaagtaaatctatgaacaatggaaatctccaaaccaccttccgcccacacaaaatgtatcatcagaagtgaaaaataggccatgagaatgaagtgaatatgttctgtagaaaatggcaagttgcaagttttgctgttttctaatgtacttacgtagatggtaagcaataagttcagggccagaatgagctatgccaggtatttctacctgcgggctggcccttgtgtggttacgccggactcgaggagccgtgctccctttcattaacagcaaccacggtttcgtgagtaaccaagttgacagggcgctcgggctcatcaatggatcccacaccaagttgtctgttaggcgaagcggggcaaatcacggaacgaccaacacggaacaacggcggatgaggtgattcacgctgagcgccacgcttgcgagagcggtgactcggcccggtaagatctccacggggtgtcgcggtactgtgcgtgtggcgaatgtttgaaataggcaccggctcaggctcatcaacagtactagtgctgatggcgctggagatggtgcgtggaaggttgtagccagccttcccgacggggactgataggccgtggacgacctgggatagggttagaatgggtactctttagtgtagaagggatgttggaaactcacaatactgcagaccaccaagaaccacaccacgatattgacggtatccatgacttgctgggcatcttctcggaccttgccatcaactgtgatttcccggaggaattcccggctaatggaaaggtagaagatggcgccaacgccgatgggtccgaaaaatccaacgaatgctgcgtggg

SEQ ID NO: 75 - protein, 329 aa, Penicillium purporogenum
MVQLKTAALALLFAGQAISSPVDIDSRQASVSIDAKFKAHGKKYLGTIGDQYTLTKNSKNPAIIKADFGQLTPENSMKWDATEPNRGQFSFSGSDYLVNFAQSNGKLIRGHTLVWHSQLPGWVSSITDKNTLISVLKNHITTVMTRYKGKIYAWDVLNEIFNEDGSLRNSVFYNVIGEDYVRIAFETARSVDPNAKLYINDYNLDSAGYSKVNGMVSHVKKWLAAGIPIDGIGSQTHLGAGAGANVAGALNALAGAGTTEIAITELDIAGASSTDYVNVVKACLNQSKCVGITVWGVADPDSWRSSSSPLLFDSNYNPKAAYNAIANAL

SEQ ID NO: 76 - DNA, 1767 bp, Streptomyces sp. S38
gcatgccgtagcccggtctcggcggttgcggccggagcgaagatccgaaagagcatcgaaactttcgaggattcaagggggcgaattctctccggaaattcggtcatccatccagccaacttcgcgcggtgtggcgcaggttgccgtagacctgcggatattgccgatctgggtatctgctgcaggatcgagagtttcgcaatccatgcggaaactgttgactgttgacgggtgcagctcaacactgtcggcatcgccagggccgtagggcccacgtgctccctggctgcccgcacgccgtcacaaggaggaagcgtgaccaaggacaacacccccatccggcccgtgagccgcagaggcttcatcggccgggccggcgccctggcgctggcgacgtccggactgatgctgcctggcacggcccgcgccgacacggtcatcaccacgaaccagacgggcaccaacaacggctactactactcgttctggaccgacggcggcggctcggtctccatgaacctggcgtccggcggcagttacggcacctcatggaccaactgcggcaacttcgtcgcaggcaagggctgggccaacggcgcccgccggacggtgaactactccggcagtttcaacccctcaggcaacgcgtacctgaccctctacgggtggaccgccaacccgctcgtggagtactacatcgtcgacaactggggcacctaccggcccaccgggacgtacaagggcacggtcaccagcgacggcggtacgtacgacgtctaccagacgacgcgggtcaacgccccgtccgtcgaaggcaccaagacgttcaaccagtactggagcgtccgtcagtcgaagcggacgggcgggagcatcaccgccggcaaccacttcgacgcctgggcccgctacgggatgccgctgggcagcttcaactactacatgatcatggcgacggagggctaccagagcagcgggagctccagcatctcggtgagctgacgtccccgtgaaccggcccggccggggtgaggggcctctcggccgccgtaccccggccggttgtcgttccggacgccgtctcagacgaggaacgggcgcaccaggcgcaggagcgctccgggcggtgcagcggaatgatgtggccgcagtcctcgacgaggtggccggtgaggtcgtcggtgacgggacgcaactgttgttcgagcgcgttccccaccggctgggcgccgacggccatcgtgggcaccgacagccgtccggcgtccacagcctcccggatctgccgggcgcccgtgggcatggcgcggtagtaggagaaggcgcagcgcagggcctcggagccggagtacgcgtcgacgaaggcgtcccggaacgcgcctccgacgccctgccccagggtgcccgcgtcgaggaaccagtcgatgtaggccgcttcgtccccccgcagcacggtctccgccagaccgggaaccgagtggaagccgaaccaccagggcggccctccggccaggaaccgctccgcgccgggcagagtgcccaccagcgattccatgagcaccagacggcggacgcgcccgggactccgcatggccatcaggaaggcgggcgggacaccggcgtcgatggccatcacggacgccggtccctcgccgagcgcgtccagcagcccgacgcagtcctcggcgagggtccccgggtcgtagccgtccgcggcacgcgtgctcgcgccgagcccccggaggtcgggcgcgatcacccggtacc

SEQ ID NO: 77 - protein, 228 aa, Streptomyces sp. S38
MTKDNTPIRPVSRRGFIGRAGALALATSGLMLPGTARADTVITTNQTGTNNGYYYSFWTDGGGSVSMNLASGGSYGTSWTNCGNFVAGKGWANGARRTVNYSGSFNPSGNAYLTLYGWTANPLVEYYIVDNWGTYRPTGTYKGTVTSDGGTYDVYQTTRVNAPSVEGTKTFNQYWSVRQSKRTGGSITAGNHFDAWARYGMPLGSFNYYMIMATEGYQSSGSSSISVS

SEQ ID NO: 78 - DNA, 834 bp, BACILLUS SP. NBL420
gatcaaaaactttggcattagtaattaataatgttttaaatctatacgagtgctacctcatgtcaaagtcagaataattattataggaggtaacatatgtttaagtttaaaaggaatttcttagttggattaacggcagctttaatgagtattagcttgttttcggcaaccgcctctgcagctagtccagactactggcaaaattggactgatggcggcggaacagtaaacgctgttaatgggcctggcgggaattacagcgttaattggtctaataccggaaatttcgttgttggtaaaggttggactacaggttcgccatctaggacaataaactataatgccggagtttgggcgccgaatggcaatggatatttggctttatatggttggacgagagcacctctcatagaatattatgtagtggattcatggggtacttatagacctactggaacgtataaaggtactgtaaaaagtgatgggggcacatatgacatatatacaactacacgttataatgcaccttccattgatggcgaaaaaactactttcacgcagtactggagtgttcgccagacgaagagaccaactggaagcaacgctaaaatcactttcagcaatcatgttagagcatggaagagtcatggaatgaatctgggtagtatttggtcttatcaagtcttagcgacagagggatatcaaagtagtggaagttctaacgtaacagtgtggtaacagatcatctttaatcaggggtagcggctgttgatccatgtcctgcagcacgatatcaaaacggacgtcaccgatttttccgacaatgcgcggatc

SEQ ID NO: 79 - protein, 213 aa, BACILLUS SP. NBL420
MFKFKRNFLVGLTAALMSISLFSATASAASPDYWQNWTDGGGTVNAVNGPGGNYSVNWSNTGNFVVGKGWTTGSPSRTINYNAGVWAPNGNGYLALYGWTRAPLIEYYVVDSWGTYRPTGTYKGTVKSDGGTYDIYTTTRYNAPSIDGEKTTFTQYWSVRQTKRPTGSNAKITFSNHVRAWKSHGMNLGSIWSYQVLATEGYQSSGSSNVTVW

SEQ ID NO: 80 - DNA, 2380 bp, Bacillus stearothermophilus
aagcttgaccacggcaagaagcagggagcaagaatcattttgggtagtcaaatctatttctgaggaggaacatttgatgaagttaaagaagaagatgcttactctactcctgacggcttcgatgagtttcggtttatttggggcaacctcaagtgcagcaacggattattggcaatattggacggatggcggcgggatggtgaatgcggttaatgggcccggaggcaattacagtgttacctggcaaaataccgggaacttcgtggtcggcaaaggctggacggttggatcgccgaatcgggtgatcaactacaatgcgggcatctgggaaccttcggggaacgggtacttaaccctttacggatggacgaggaacgcgctgatcgagtattacgttgtggacagctgggggacgtaccggcctaccggcaattacaagggaacggtgaacagcgacggaggaacttacgatatttatacgaccatgcgttataatgcaccttccattgatggcacgcagacgttccaacagttctggagtgtgcggcaatcgaaacgacctaccggcagcaacgtatccatcaccttcagcaatcacgtgaatgcctggagaagcaagggcatgaacctgggcagcagctgggcttatcaggttctggcgacggaaggctatcagagcagcggaagatccaacgttacggtttggtaacaattcatcgctaatattggttccagggccgttcggcttgccgccggcggccttcacggaccttcaatcaaaggggagctgaccttgaggaagcgatacatgagcatgatcttgcccatcgccatcatggtgctggtcaccgcctgctcgcaggctgcgatgggaagactggaacggcagaacgattcgttcgtgctggttcaaggcgggagcgtgaagaacactcgatctaatttttatggctcgggtgaggttttggctgatttttatattggaaaatatgaagtgacccagagagaatgggtggaagtgatgggcagcaatccgtctcagttccagggcgacgatttgccggtggagatggtgagctggtacgacgtcattgagtattgcaatcagcggagcataaaagagggcttgaaacctttttacaatatagataagcaaaaaatagacccaaacaatcaaagcgaatttgatccggtgaaatggacggttacgatcaatcccgatgcgaacggatatcggttgccgacggaggccgagtgggaatatgcggctggcggcgggcagctcagccagagctataaatacagcggaagttcgcgtgtggacgatgtggcctggtattggcggaatgccgggaaggagtatttgagtggggactggaactggccgatcattgagagtaatcagagtcgcactcggcctgttggcggcaaggagccgaatgagctggggctgtacgatatgtccggcaatgtgagggaatggtgctgggattggtatggggacgaggtaaaccagaactatgacggcggcttgtttcgtgtggtgaaaggcggcggctggatcggcgatgtcagcagcagcgaggtggcgtttcgcggcaagtttgaagcaagcggctttggtccggatcaagggttccggttggcgcgtaacaagtagtttggggagtttgggtcgtttgagtcgcgtggggcgtttggtagattgggttgagttaagttgagcttggctgtgttagcttgagttaggatggtttgacctagttagtaggatagttgggctgggttgcgagtttgagtagttaggctagttggactggttcggctagtctggcgagggagcttggagggagcttggctacattttggaattgaatccgtcccttctcgtagtaagctaaggggaaaagaaccatgcgggaggaagggagctggctccattcaatgaagctggaaacggtgatgcaggagctggaggcactaggtaaggagcgcctgcaagcaaaatgtacatgtccaacggggccgggagccgctgtttggtgtcgcaacgggcagcaaatgaagccgctgttccggcaaatcaagcatcaatcatcccttggccgaggagctttacgcgacagggaattacgatgcgatgtactttgcggggatgattgccgatccgaagcgatgacgcaggcggattttgagcgctggatcgaaggtgcttatttctatatgctgtcggacttcgtggttgccgtcaccgtggcggaggcggatatgctcaggaagttgccgacaagtggatcgccagcgggacgagctgaagatgtggcgggctggagctgttattgctggctatagcggccgactcagtttgatgcagctaagc

SEQ ID NO: 81 - protein, 210 aa, Bacillus stearothermophilus
MKLKKKMLTLLLTASMSFGLFGATSSAATDYWQYWTDGGGMVNAVNGPGGNYSVTWQNTGNFVVGKGWTVGSPNRVINYNAGIWEPSGNGYLTLYGWTRNALIEYYVVDSWGTYRPTGNYKGTVNSDGGTYDIYTTMRYNAPSIDGTQTFQQFWSVRQSKRPTGSNVSITFSNHVNAWRSKGMNLGSSWAYQVLATEGYQSSGRSNVTVW

SEQ ID NO: 82 - protein, 283 aa, Bacillus stearothermophilus
MSMILPIAIMVLVTACSQAAMGRLERQNDSFVLVQGGSVKNTRSNFYGSGEVLADFYIGKYEVTQREWVEVMGSNPSQFQGDDLPVEMVSWYDVIEYCNQRSIKEGLKPFYNIDKQKIDPNNQSEFDPVKWTVTINPDANGYRLPTEAEWEYAAGGGQLSQSYKYSGSSRVDDVAWYWRNAGKEYLSGDWNWPIIESNQSRTRPVGGKEPNELGLYDMSGNVREWCWDWYGDEVNQNYDGGLFRVVKGGGWIGDVSSSEVAFRGKFEASGFGPDQGFRLARNK

SEQ ID NO: 83 - DNA, 1800 bp, Phanerochaete chrysosporium
cgaagcacgcaaagcaccgtgctcgcgcatgacactcgcgacagggcacgctcacgtgttccgcatctacctgccgagcatttcagcgactttactcccggacgccctggtcgtccggcacgcgcgcacgcagagtcgatgtgcgggcgagtacaaaatgcgcgacgatgagggctcggggtgtgtgcctcccagcgattgtcgtctgctatatcgcccggcgtgtcgaccccagcaatgatgaagctctctgcctccttcgcggccctcgcggtcctcctgccgttcgtgcaggcccagtcgcctgtttggggccaatgtgagtgcggtagcgtgggcggagagacgggttgctgacggctgcacgcacaggcggtggtattggctggaccggccccacgacctgcacggctggcaacgtctgccaggagtacagcgcgtattattcgcagtgcatccccgctgtgcgtcgtttcttgttatgttctgctgtcgtggtgctgacgttggggcgcagagccaggcaacgtccgtcacgtccgtctccaccgcgccgaacccgccgccgacgtcgcacacgagcacgtcgtctgccccatccggtgcatcgacctcgaccgcgaagctgaacacgctcgcgaaggccaagggcaagctctacttcggcacggcgaccgacaacggagagctctcggacaccgcgtacaccgcgatcctcgacgacaacacgatgttcggccagatcacgcctgcgaacagcatgaaatgggtgcgtctctcgtatcttggctaaatgtgtggttaatcactgagccttgttaccctaggatgccaccgagccgcagcagggccagttcaccttcagcggaggtgaccagattgccaaccttgccaaatcaaatggcatgctcctgcgtggtatgtacagtgctactccggtagagaaatgcacttgactcacttcattgtaataggtcacaattgcgtgtggtacaaccagctcccaagctgggtgtccaacggcaagttcaccgcagcccagcttacctccatcatccaaaaccactgctcgaccctcgtcacccactacaagggccaggtctacgcctgggacgtcgtcaacgagcccttcaacgacgacggctcgtggcgcacggacgtcttctacaacacgctcggcacgtcgtacgtgcagattgcgctcgaggccgcccgcgcggcggacccggacgcgaagctgtacatcaacgagtacaacatcgagtacgcgggcgcgaaggcgacgtcgctgctcaacctcgtgaagacgctcaaggctgcatccgtaccgctcgacggcattggcttccagagccacttcatcgtcggccaggttccgacgggcctgcagtcgcagctcacgacgttcgccgcgcagggcgtcgaggtcgcgatcaccgagctcgacatccgcatgacgctcccgtcgacgcccgcgctcctcgcgcagcagaagacggactactcgaacgtcatcaaggcgtgcgcgtccgtcgaggcgtgtgtcggcgtcaccgtgtgggactggacggacaagtactcgtgggtgccgaacacgttctctggccagggtgcggcctgcccgtgggaccaggtcagtgatacattgtctaacttctgcagccctgtctgacactcccgcgcagaacttcgtcaggaagcccgcctacgatggtatcgctattggcttcggcaattagacggcgcgttcctatgcaccgcccaaaatgtgtatcactactgtaaccctgcataatcaca

SEQ ID NO: 84 - protein, 408 aa, Phanerochaete chrysosporium
MKLSASFAALAVLLPFVQAQSPVWGQCGGIGWTGPTTCTAGNVCQEYSAYYSQCIPASQATSVTSVSTAPNPPPTSHTSTSSAPSGASTSTAKLNTLAKAKGKLYFGTATDNGELSDTAYTAILDDNTMFGQITPANSMKWDATEPQQGQFTFSGGDQIANLAKSNGMLLRGHNCVWYNQLPSWVSNGKFTAAQLTSIIQNHCSTLVTHYKGQVYAWDVVNEPFNDDGSWRTDVFYNTLGTSYVQIALEAARAADPDAKLYINEYNIEYAGAKATSLLNLVKTLKAASVPLDGIGFQSHFIVGQVPTGLQSQLTTFAAQGVEVAITELDIRMTLPSTPALLAQQKTDYSNVIKACASVEACVGVTVWDWTDKYSWVPNTFSGQGAACPWDQNFVRKPAYDGIAIGFGN

SEQ ID NO: 85 - DNA, 1799 bp, Phanerochaete chrysosporium
cgaagcacgcaaagcaccgtgctcgcgcatgacactcgcgacagggcacgctcacgtgttccgcatctacctgccgagcatttcagcgactttactcccggacgccctggtcgtccggcacgcgcgcacgcagagtcgatgtgcgggcgagtacaaaatgcgcgacgatgagggctcggggtgcgtgtccccagcaattgtcgtctgctatatcgcccggcgtgtcgaccccagcaatgatgaagctctctgcctccttcgcggccctcgctctcctcctgccgttcgtgcaggcccagtcgcctgtttggggccaatgtgagtgcggtagcgtgggcggagagacgtggtgctgacggctgcacgcacaggcggtggtattggctggaccggccccacgacctgtacggctggcaacgtctgccaggagtacagcgcgtactactcgcagtgcatccccgctgtgcgttgtttcttgttatgttctgttgtcgccgtgctgacgttggggtgcagagccaggcaacgtccgtcacgtccgtctccaccgcgccgaacccgcctccgacgtcgcacacgagcacgtcgtctgccccgtctggtgcctcgacctcgaccgcgaagctgaacacgctcgcgaaggccaagggcaagctctacttcggcacggcgacggacaacggcgagctctcggacaccgcgtacaccgcgatcctcgatgacaacacgatgttcggccagatcacgcctgcgaacagcatgaaatgggtgcatttctcgtgccttggataaatgcgtggttaattactgagcattgttcccctaggatgccaccgagccgcagcagggccagttcaccttcagcggaggtgaccagattgccaaccttgccaaatcaaatggcatgctcctgcgtggtatgtacagtgctactctggtagaggaatgcacttgactcacttcattgcaataggtcacaattgcgtgtggtacaaccagctcccaagctgggtgtccaacggcaagttcaccgcagcccagcttacctccatcatccaaaaccactgctcgaccctcgtcacccactacaagggccaggtctacgcctgggacgtcgtcaacgagcccttcaacgacgacggctcgtggcgcacggacgtcttctacaacacgctcggcacgtcgtacgtgcagattgcgcttgaggccgcccgcgcggcggacccggacgcgaagctgtacatcaacgagtacaacatcgagtacgcgggcgcgaaggcgacgtcgctgctcaacctcgtaaagacgctcaaggctgcatccgtaccgctcgacggcattggcttccagagccacttcatcgtcggccaggtcccgactggcctgcagtcgcagctcacgacgttcgccgcgcagggcgtcgaggtcgcgatcaccgagctcgacatccgcatgacgctcccgtcgacgcccgcgctcctcgcgcagcagaagacggactactcgaacgtcatcaaggcgtgcgcgtccgtcgaggcgtgtgtcggcgtcaccgtgtgggactggacggacaagtactcgtgggtgccgaacacgttctctggccagggtgcggcctgcccgtgggaccaggtcagtgatacattgtctatcttctgcagccctttctgacagtcccgcgcagaacttcgtcaggaagcccgcctacgatggtatcgctattggcttcggcaattagacggcgcgttcctatgcaccgcccaaaatgtgtatcactactgtaaccctgcataatcaca

SEQ ID NO: 86 - protein, 408 aa, Phanerochaete chrysosporium
MKLSASFAALALLLPFVQAQSPVWGQCGGIGWTGPTTCTAGNVCQEYSAYYSQCIPASQATSVTSVSTAPNPPPTSHTSTSSAPSGASTSTAKLNTLAKAKGKLYFGTATDNGELSDTAYTAILDDNTMFGQITPANSMKWDATEPQQGQFTFSGGDQIANLAKSNGMLLRGHNCVWYNQLPSWVSNGKFTAAQLTSIIQNHCSTLVTHYKGQVYAWDVVNEPFNDDGSWRTDVFYNTLGTSYVQIALEAARAADPDAKLYINEYNIEYAGAKATSLLNLVKTLKAASVPLDGIGFQSHFIVGQVPTGLQSQLTTFAAQGVEVAITELDIRMTLPSTPALLAQQKTDYSNVIKACASVEACVGVTVWDWTDKYSWVPNTFSGQGAACPWDQNFVRKPAYDGIAIGFGN

SEQ ID NO: 87 - DNA, 1204 bp, Phanerochaete chrysosporium
aaaaataagaactgcgtgtttttgtttctttcctgagatgcgtgaaatattcatacacgacacggaacggccgctcaacagcatccgccacttttagtgagccctcccctctcgcatcgcccaccggtcacgatggtcagcttcaactccctcctcgttgcagtctcggctgccacctgcgccctcgccttccccttcgagttccacaacggcacgcacgtcttcccgcgccagagcacgcccgccggcaccggcacgaacaacggctacttctactccttctggaccgacggtggcggatccgtcacctacaacaacggtcccgcgggcgagtacagcgtgacgtggtccaacgcggacaacttcgtcgccggcaagggctggaacccgggctctgcccagtgagtctctaccgcgcatacgcgcgtgtcacatgacggcgatgctgaccccacgggcgcagggcgatctcgttcacggcgaactaccagccgaacggaaactcgtacctgtccgtgtatggctggtcgacgaacccgctcgtggagtactacatcctcgaggacttcgggacgtacaaccccgcggtgtcgctcacgcacaagggcacgctcacgtcggacggcgcgacatacgacgtgtacgagggcacgcgcgtgaacgagccgtcgatccagggcaccgcgacgttcaaccagtactggtcgatccgctcctcgaagcgctcctcgggcaccgtcacgaccgcgaaccacttcgcggcctggaagcagctcggcctcccgctcggcacgttcaactaccagatcgtcgccaccgagggctaccagtcctccggctcgtccaccgtcaccgtgaaccccgccggcggcgtcacctcgcccaccgcccccaccgggccctcgtccgtctccaccaccccgagcggcccctcgagcagcccaagccccgtcggcagttgcgcggctctctacggccagtgcggtggccagggctggacgggcccgacctgctgctcgtcgggcacctgcaagttctcgaacgactggtactcccagtgcctctaagtggcgtgcaggatggagggtagagggcggttggacaggggagggctcactaaaagtggcggatgctgttgagcggccgttccgtgtcgtgtatgaatatttcacgcatctcaggaaagaaacaaaaacacgcagtt

SEQ ID NO: 88 - protein, 290 aa, Phanerochaete chrysosporium
MVSFNSLLVAVSAATCALAFPFEFHNGTHVFPRQSTPAGTGTNNGYFYSFWTDGGGSVTYNNGPAGEYSVTWSNADNFVAGKGWNPGSAQAISFTANYQPNGNSYLSVYGWSTNPLVEYYILEDFGTYNPAVSLTHKGTLTSDGATYDVYEGTRVNEPSIQGTATFNQYWSIRSSKRSSGTVTTANHFAAWKQLGLPLGTFNYQIVATEGYQSSGSSTVTVNPAGGVTSPTAPTGPSSVSTTPSGPSSSPSPVGSCAALYGQCGGQGWTGPTCCSSGTCKFSNDWYSQCL

SEQ ID NO: 89 - DNA, 1204 bp, Phanerochaete chrysosporium
aaaaataagaactgcgtgtttttgtttctttcctgagatgcgtgaaatattcatacacgacacggaacggccgctcaacagcatccgccacttttagtgagccctcccctctcgcatcgcccacccgtcacgatggtcagcttcaactccctcctcgtcgcagtctcggctgccacctgcgccctcgcctttcccttcgagttccacaacggcacgcacgtcttcccgcgccagagcacgcccgccggcaccggcacgaacaacggctacttctactccttctggaccgacggtggcggatccgtcacctacaacaacggtcccgcgggcgagtacagcgtgacgtggtccaacgcggacaacttcgtcgccggcaagggctggaacccgggctctgcccagtgagtctctaccgcgcatacgcgcgtgtcacatgacggcgatgctgaccccacgggcgcagggcgatctcgttcacggcgaactaccagccgaacggaaactcgtacctgtccgtgtacggctggtcgacgaacccgctcgtggagtactacatcctcgaggacttcgggacgtacaaccccgcggtgtcgctcacgcacaagggcacgctcacgtcggacggcgcgacatacgacgtgtacgagggcacgcgcgtgaacgagccgtcgatccagggcaccgcgacgttcaaccagtactggtcgatccgctcctcgaagcgctcctcgggcaccgtcacgaccgcgaaccacttcgcggcctggaagcagctcggcctcccgctcggcacgttcaactaccagatcgtcgccaccgagggctaccagtcctccggctcgtccaccgtcaccgtgaaccccgccggcggcgtcacctcgcccaccgcccccaccgggccctcgtccgtctccaccaccccgagcggcccctcgagcagcccgagccccgtcggcagttgcgcggctctctacggccagtgcggtggccagggctggacgggcccgacctgctgctcgtcgggcacctgcaagttctcgaacaactggtactcccagtgcctctaagtggcgtgcaggatggagggtagagggcggttggacaggggagggctcactaaaagtggcggatgctgttgagcggccgttccgtgtcgtgtatgaatatttcacgcatctcaggaaagaaacaaaaacacgcagtt

SEQ ID NO: 90 - protein, 290 aa, Phanerochaete chrysosporium
MVSFNSLLVAVSAATCALAFPFEFHNGTHVFPRQSTPAGTGTNNGYFYSFWTDGGGSVTYNNGPAGEYSVTWSNADNFVAGKGWNPGSAQAISFTANYQPNGNSYLSVYGWSTNPLVEYYILEDFGTYNPAVSLTHKGTLTSDGATYDVYEGTRVNEPSIQGTATFNQYWSIRSSKRSSGTVTTANHFAAWKQLGLPLGTFNYQIVATEGYQSSGSSTVTVNPAGGVTSPTAPTGPSSVSTTPSGPSSSPSPVGSCAALYGQCGGQGWTGPTCCSSGTCKFSNNWYSQCL

SEQ ID NO: 91 - DNA, 2966 bp, Thermoascus aurantiacus; identical to SEQ ID NO: 25

SEQ ID NO: 92 - protein, 329 aa, Thermoascus aurantiacus; identical to SEQ ID NO: 26

SEQ ID NO: 93 - DNA, 2056 bp, Neocallimastix patriciarum
attataataattgttcaaaaaaagtaataataaaaaaaaaatttttttttttttttttgggaaaattgagtataaatagtttttggtttaccttttttggtttttcctttattctttataaagttaattgtttaataattattggtggaaatatttaaaagttgtatatatattttaatatttattggaattatttactttcactggtggaaacaaatattaatagtgtataatatattattagaaaaagaaaaaaaaaaattattacaattaattactataaataaaatagttaaaaatgaaatttttacaaattattcctgtattattatctttaacttcaactactcttgctcaaagtttctgtagttcagcttctcactctggacaaagtgtaaaggaaaccggcaacaaggttggaactattggtggtgttggttacgaattatgggctgatagtggtaataacagtgctactttctattctgatggttccttctcatgtactttccaaaatgctggggattacttatgtcgtagtggtctttctttcgatagtactaagaccccatctcaaattggtcgtatgaaggctgatttcaaacttgtcaaacaaaatatttccaatgttggttattcctatgttggtgtttacggttggactagaagtccacttgtcgaatactacattgtcgataattggcttagtccatccccaccaggtgattgggttggtaacaagaagcatggttctttcactattgatggtgctcaatacactgtttatgaaaacactcgtactggtccatctattgatggtaataccaccttcaaacaatactttagtattcgtcaacaagctcgtgattgtggtaccattgatatttctgctcactttgatcaatgggaaaagcttggtatgactatgggtaaattacatgaagccaaggttttaggtgaagccggtaacggtaacggtggtgtcagtggtactgctgatttcccatacgcaaaggtttacattggtgatggaaatggtggtggtgcttctccagctccagctggtggcgctccagcaggcggcgctccagccggtaacgaccaaccacaaggaccacaaggtcaacaaccaccacaaggtcaacaaccaccacaaggtcaacaacctccacaagggcaacaaccaccacaagggcaacaaccaccacaaggtaacgatcaacaaggacaacaaccaccacaaggccaacaaccaccacaaggtaacgatcagcaccaaggacaacacccaccacaaccacaaggaccacaaggaggtaacccaggtggttctgattttaacaactggagccaaggtggtagtccatggggtggtaatcaaggtggtagtccatggggaggtaaccaaggcggtaatccatggggaggaaaccaaggtggtagcccatggggtggtaaccaaggtggcagtccatggggtcaaggtaaccaaggcggtaatccatggggaggaaaccaaggtggtagcccatggggtggtaaccaaggtggtaatccatggggtggtaatcaatggggtgctccacaaaatgctgctgctccacaaagcgctgctgctccacaaaacgcttctgatggtggtaactgtgcttctctttggggtcaatgcggtggacaaggttataatggtccatcttgctgttccgaaggttcctgtaagccaattaacgaatacttccaccaatgtcaaaaataaattgattagaaatcattatcaacccatatttattttgtagattaaaataataaagaaaaaaaaaaaaattttttttatttttttttttttttctcctcaattaataaatcattaaaatagatcattaatataattatttattttcattttttttttttttaattaatacgtaaatgtaaatgtaaatttaaacaatttatttaatatttaatattttataaaagatactattttaataaaattataaaaaaaaaatatataaaaaaaaaatataaaaaaaaaaaaaatattaatgaaagt

SEQ ID NO: 94 - protein, 485 aa, Neocallimastix patriciarum
MKFLQIIPVLLSLTSTTLAQSFCSSASHSGQSVKETGNKVGTIGGVGYELWADSGNNSATFYSDGSFSCTFQNAGDYLCRSGLSFDSTKTPSQIGRMKADFKLVKQNISNVGYSYVGVYGWTRSPLVEYYIVDNWLSPSPPGDWVGNKKHGSFTIDGAQYTVYENTRTGPSIDGNTTFKQYFSIRQQARDCGTIDISAHFDQWEKLGMTMGKLHEAKVLGEAGNGNGGVSGTADFPYAKVYIGDGNGGGASPAPAGGAPAGGAPAGNDQPQGPQGQQPPQGQQPPQGQQPPQGQQPPQGQQPPQGNDQQGQQPPQGQQPPQGNDQHQGQHPPQPQGPQGGNPGGSDFNNWSQGGSPWGGNQGGSPWGGNQGGNPWGGNQGGSPWGGNQGGSPWGQGNQGGNPWGGNQGGSPWGGNQGGNPWGGNQWGAPQNAAAPQSAAAPQNASDGGNCASLWGQCGGQGYNGPSCCSEGSCKPINEYFHQCQK

SEQ ID NO: 95 - DNA, 3942 bp, Streptomyces avermitilis
ggatcccgtgagtcccgcgtacccggcgagttctcgaagtcgcgcacgccacgtgcgtgacgacgccgcaccagagccgcggtgcggtgcacggtgagtccctctcccctgccttggaggcacagtcatgggctttcacgccctccccagatcggccggccggccgaagctccgcgccctgctgcccgcgctgctcgtcggcgccctcggcttcgccggcgcggtggccgcaccgccgccccaggcccaggccgccgaaagcaccctcggcgccgccgcggcgcagagcggccgctacttcggtgtcgccatcgccgcgaaccgcctcagcgactcgacgtacgcgtcgatcgcgaaccgcgagttcaactcggtgacggccgagaacgagatgaagatcgacgcgaccgagccgcagcgggggcagttcaacttccagaacgccgaccgcatctacaactgggccgtgcagaacggcaagcaggtgcgcggtcacaccctcgcctggcactcccagcagcccggctggatgcagagcctcagcggcagcgccctgcgccaggcgatgatcgaccacatcaacggcgtgatggcccactacaagggcaagatcgcgcagtgggacgtggtgaacgaggccttcgccgacggcagttcgggcgcccggcgcgactccaacctggaacgcaccggcagcgactggatcgaggtggccttccgcaccgcgcgcgccgccgacccctccgccaagctctgctacaacgactacaacgtcgagaactggacctgggcgaagacccaggccatgtaccgcatggtgaaggacttcaagcagcgcggcgtgccgatcgactgcgtcggcttccagtcgcacttcaacagcggaagcccgtacaactccaacttccgcacgacgctgcagacgttcgccgccctcggtgtcgacgtggcgatcaccgagctggacatccagggcgcctcgccgaacacctacgccgccgtggtcaacgactgcctcgccgtctcccgctgcctcggcgtgaccgtctggggcgtgcgcgacatggactcctggcgttcgagcgacacccctctgctgttcaacaacgacggcagcaagaagcaggcgtacaacgccgtgctgaacgccctcaacgccggcgacggcggcggtggcgaccccgacccggagcccggtgacggcaccgcgatcaagggcgtcggctcgggccgctgcctggacgtgccgaacgcgagcaccacggacggcacgcaggtccagctgtacgactgcaacggccgcaccaaccagcagtgggagctcacctcctccggtgagctgcgggtctacggcaacaagtgcctggacgcggccggcaccggcaacggcgccaaggtccagatctacagctgctggggtggcgacaacagaagtggcgtctgaactccgacggcaccatcgtcggcgtgcagtccggccgctgcctcgacgcggtcggcgcgggcacggccaacgggacgcagatccagctgtacagctgcgggggcggaagcaaccagcgctggtcccgcgtgtgatccacccgtcctcatgaccgtgagggtcaccgcctcgtacgggcggtggccctcacgaccgtcctccgttcgccgccggagcggtcagcggcggtacgacagaccgtgcccggccgggaacagcacccgcgccgggtcgtcggcgcgctggaccgggacgggcagcgtgccgcgcggatcgacccggccgctgatcacgcgcgcggcggcgcgcagttcgacctcggtccagcagtaggaggcgagggaggcccggacgccgtcgaggtgggcgatgtcgtacgggttgcgcacggcgagatggacgacggggacgccggccgcgagcagccgggacacgagggtgcgctgggcgctcgccggcccgacgttgtcggtggtgacgaccaccgcgtcccgcccccgtgcggcggccacggccgcgtcgatcgcggcggcgtcgggcgtacggccggtgacgaggtgggtggtccggaaacccaaggcctcgaactcggcggccagttcgggcaccgtgctccgggtgtcgtccgtggggaaggccggactggcgccgaccacgagcagcttccgctgtccgcgccgcagcgggagcgtgcggtcctcgtggaccagcagagtggtggtcctctccgcgatccggtcggcggcgatccggtgcgagcgggcgccgacgacccggtccacctcccgcggcgaggtgaaagggctgccgtccagcagacccaccttgtccttcacccggaggatgcgcaggaccgactcgtcgagccgctcctcggtgatctccccgtcgcggacggcggcgaggacggcgtggtaggcgacgtcgatgtccggagggaacagcaactggtcggccccggccttcagcgcgagcacgggcacgcggtcgtcgccgtacttggtgcgcacgccggccatgttgagcgcgtcggtgacgatcaccccgtcgaagccgagctcaccgcgcagcactccctgcaggatcgtgggcgacagggtggccgggtcgttgctggggtcgagcgcgggaacctggagatgcgcggtcatgatcgagtcgacgccggcggcgatggcggcccggaagggcggggcgtcgacacggtcccactcctcgcgcgtgtgggtgatcacgggcagctcggtgtgactgtcctgccccgtgtccccgtgccccgggaagtgcttggcgcaggcgacgacgccggcccgctggtagccggtcacctgggccgccaccatgcggcccacctcgccggggtcggcgccgaaggagcggatgttgatgatggggttggccggattgacgttgacgtcggcgaccggcgcgaagttctggtggatgccgagggcggcgagttccgtgccggagatgcgtcccgcggtccgggcgtcggacagcgagccgcccgccccgagcgccatcgcgcccggcagctgggtggcgccgctgccgatgcggacgttggccccgtgctcctggtcgatggagatgaggcaggggacgggggtgggcagtgcgagtgaggccctctgcacaccgttcgtcagctcggcgacctgacgggggtcgtggatgttgttcgtccagcccgagaagaggatgaccccgccgaggtggtacttggcgacgagctcggcgacggtgcggacgcccagttcccgcaggttgcgctcctggtcggcctcgctgggggaggtcgccgacgcaccgtagaagtagggcacgaagagctggccgaccttggcctcgaggctcatgctcccgacgatcttccgcaggcgcttgtcgcggccgtgcgcggcggcgggggcgcccgctgcgaggccggtcacccctgcggcgaccacggtcgcggaggcgaggacggaccgcctggacagactccggctctgcatgcgggcatgctccttccggccgttgaggcacgggagttgaagggggcgcgtggggctcggatcagcgggcaacgtagcccgcgggggaggggcgggacaagaggtctagacaaaaacggctctggccggttgtcacctctggagatcgctccctcgtcggccagacttgttgcctcacgccccatgcgcaccgctgccgcggtggcccgtgcccgggaggccctgatgacgtcagacacgaggccggacgaagacggggtggtggccccgacgggaaggcgacggtctcccggtgaacgcgtcgcgctgcgcggcgatctgcgggccgccctgcccgacgccacggcggcggtggtggtcaccgcgctcgtgttcgccctcctgtgggcgcgtatggagtcggggcttcggacaccgtcccggtcaagccgttcatggacattcccgcacctactggat

SEQ ID NO: 96 - protein, 438 aa, Streptomyces avermitilis
MGFHALPRSAGRPKLRALLPALLVGALGFAGAVAAPPPQAQAAESTLGAAAAQSGRYFGVAIAANRLSDSTYASIANREFNSVTAENEMKIDATEPQRGQFNFQNADRIYNWAVQNGKQVRGHTLAWHSQQPGWMQSLSGSALRQAMIDHINGVMAHYKGKIAQWDVVNEAFADGSSGARRDSNLERTGSDWIEVAFRTARAADPSAKLCYNDYNVENWTWAKTQAMYRMVKDFKQRGVPIDCVGFQSHFNSGSPYNSNFRTTLQTFAALGVDVAITELDIQGASPNTYAAVVNDCLAVSRCLGVTVWGVRDMDSWRSSDTPLLFNNDGSKKQAYNAVLNALNAGDGGGGDPDPEPGDGTAIKGVGSGRCLDVPNASTTDGTQVQLYDCNGRTNQQWELTSSGELRVYGNKCLDAAGTGNGAKVQIYSCWGGDNRSGV

SEQ ID NO: 97 - protein, 606 aa, Streptomyces avermitilis
MQSRSLSRRSVLASATVVAAGVTGLAAGAPAAAHGRDKRLRKIVGSMSLEAKVGQLFVPYFYGASATSPSEADQERNLRELGVRTVAELVAKYHLGGVILFSGWTNNIHDPRQVAELTNGVQRASLALPTPVPCLISIDQEHGANVRIGSGATQLPGAMALGAGGSLSDARTAGRISGTELAALGIHQNFAPVADVNVNPANPIINIRSFGADPGEVGRMVAAQVTGYQRAGVVACAKHFPGHGDTGQDSHTELPVITHTREEWDRVDAPPFRAAIAAGVDSIMTAHLQVPALDPSNDPATLSPTILQGVLRGELGFDGVIVTDALNMAGVRTKYGDDRVPVLALKAGADQLLFPPDIDVAYHAVLAAVRDGEITEERLDESVLRILRVKDKVGLLDGSPFTSPREVDRVVGARSHRIAADRIAERTTTLLVHEDRTLPLRRGQRKLLVVGASPAFPTDDTRSTVPELAAEFEALGFRTTHLVTGRTPDAAAIDAAVAAARGRDAVVVTTDNVGPASAQRTLVSRLLAAGVPVVHLAVRNPYDIAHLDGVRASLASYCWTEVELRAAARVISGRVDPRGTLPVPVQRADDPARVLFPAGHGLSYRR

SEQ ID NO: 98 - DNA, 1929 bp, Cochliobolus carbonum
ctgcatgactggaccactcagcgcgcggcttccccacaaaagtctatatgaagtatccaccgccgtgatggagcttgattaactgtcgggatggcgacttggcacgcgccttgaaatgcaggatagcatcacgcctaggggcagggccgattgcgctcattggatacgaatacatcaagacactagtgtagaacgattcagacgattcatccatgggcaacgaggggcgagaggtggccccatgacacagggaggaagacagcgggtgaaacaaccgcaatatgtttcctgtggtgtgcacccacgctctttaaccgtctctaagtatataggtcaagacttccaagaccgaataagctcaccaccaagcctttcatcttcaacactcaagcagtctttacttcactcaccctcttttcaattcactcctagcgagaaccagcttcttttcacacaaacacaaacaaatcttcaatctatcaaaatggttgccttcacctccgtcctcctcggcctctccgccattggctctgccttcgccgcccccgttgccgatgtccctgacttcgagttctccggccccaagcacttggctgcccgccaggactacaaccagaactacaagactggtggtaacatccagtacaaccccaccagcaacggttactccgtcaccttctctggcgcccaggacttcgtccttggcaagggctggaagcaaggtactaccaggtaagccacacacagtgttctagacccaaatatcaatcaatactaactcctttccttcaggaccgtcaagtacactggttccacccaggcccaggccggtactgtcctcgtcgctctctacggctggaccaggggcagcaagctcgtcgagtactacatccaggacttcacctctggcggctctggctccgcccagggccagaagatgggccaagtcacctgcgacggctccgtctacgacatctggcagcacacccaggtgaaccagccttccatcgtcggcacgaccaccttcgtccagtacatcagcaaccgcgtcagcaagcgctccaccggcggtaccatcaccaccaagtgccacttcgacgcctgggccaagctcggcatgaaccttggtaaccagtgggactaccagaccatctccactgagggttggggcaacgctgctggaaagtcccagtacaccgtctccgctgcttaaattgtgggcgcggtccgttctttggctcaaggggaatgaaccaggggttcgagagatttgtgaaacattggcttgcgcaatcatcaattcctctccagaggagaggaaatatgatagcttcaagggctttgtaggggtgttgatttaggggatgctgccgctgctgttgcttgattcattggtgtttatctttctttcttcttgatttgttcagggccttgacacaccctggcttgtacatactttttttactcgtttcttgtagaaacgggtaaatcctgaatatacacgttgccttgtttctccctcgtttggatgacaatagcaattgcccggttatgaaccgaaaaaaaaactcctcatcttcttctgtgtttcttatcattgtgacaagtgacttttttttcttttcttacttaaatttatttttctaggttttcacaaaagtatatatattcttagccatgctggctgccccatcttacttagtaaacaggtgaaacttccaattatcgctgccaaacgcaggctcggatgtcggcggcggcgcgtggatggagatacataacattgtgttgcttaaaacaaggctaggttggctgggctggggctgaacagccggtggtaggatgatttatcgggcaaatatcaagacacacacacatcttcttaaaacgcccttttggtggcgaaggttcttaaccaagtgggtaccc

SEQ ID NO: 99 - protein, 222 aa, Cochliobolus carbonum
MVAFTSVLLGLSAIGSAFAAPVADVPDFEFSGPKHLAARQDYNQNYKTGGNIQYNPTSNGYSVTFSGAQDFVLGKGWKQGTTRTVKYTGSTQAQAGTVLVALYGWTRGSKLVEYYIQDFTSGGSGSAQGQKMGQVTCDGSVYDIWQHTQVNQPSIVGTTTFVQYISNRVSKRSTGGTITTKCHFDAWAKLGMNLGNQWDYQTISTEGWGNAAGKSQYTVSAA

SEQ ID NO: 100 - DNA, 786 bp, TRICHODERMA REESEI
gaattcgccaaacctgaacaaccccagcacctgaacagtcatacaacccctccaagcccaaaagacacaacaactcctactagccgaagcaagaagacatcaacatggtctccttcacctccctcctcgccggcgtcgccgccatctcgggcgtcttggccgctcccgccgccgaggtcgaacccgtggctgtggagaagcgccagacgattcagcccggcacgggctacaacaacggctacttccactcgtactggaacgatggccacggcggcgtgacgtacaccaatggtcccggcgggcagttctccgtcaactggtccaactcgggcaactttgtcggcggcaagggatggcagcccggcaccaagaacaaggtcatcaacttctcgggcagctacaaccccaacggcaacagctacctctccgtgtacggctggtcccgcaaccccctgatcgagtactacatcgtcgggaactttggcacctacaacccgtccacgggcgccaccaagctgggcgaggtcacctccgacggcagcgtctacgacatttaccgcacgcagcgcgtcaaccagccgtccatcatcggcaccgccaccttttaccagtactggtccgtccgccgcaaccaccgctcgagcggctccgtcaacacggcgaaccacttcaacgcgtgggctcagcaaggcctgacgctcgggacgatggattaccagattgttgccgtggagggttactttagctctggctctgcttccatcaccgtcagctaaagggagatct

SEQ ID NO: 101 - protein, 223 aa, TRICHODERMA REESEI
MVSFTSLLAGVAAISGVLAAPAAEVEPVAVEKRQTIQPGTGYNNGYFHSYWNDGHGGVTYTNGPGGQFSVNWSNSGNFVGGKGWQPGTKNKVINFSGSYNPNGNSYLSVYGWSRNPLIEYYIVGNFGTYNPSTGATKLGEVTSDGSVYDIYRTQRVNQPSIIGTATFYQYWSVRRNHRSSGSVNTANHFNAWAQQGLTLGTMDYQIVAVEGYFSSGSASITVS

SEQ ID NO: 102 - DNA, 2054 bp, Aspergillus tubingensis
aacgtctgcagtcccgtactgtttaccaaaatgccaggccactggtggatatacaactttgtaatacgttgccggagtcagcccctactccctgatgggttcccactccctagttacttcctactgggtagtaggctcctagagtggggtaaagtttgccaagggtttagccccagtcttgtttatgcttggctaggcaggacctgggtaagttgatggctcctgcattcctacctgagtatttccagctataagcgagatttgccatactcttcagcgagtccggatggtccgcgccgaggttgaccctgccttcatcacctacacaaagaactcctcggccaactcccggtggccttcgagctccaaagtaccttcgcgacctttggccagtgtttctcgcagcgtttactgagcctaaggcttgctacaataaataaagagacataaccttgcagtacatacgtcttgtatgagcgaggaactgtgttcagtagtagatcagtgggtacataatcatgaacatgacttctgagccagaaaaccttctgcagggaaccggtgaagaaaccccacttccccgcctccactaactgcagcccctttatccgcctgccgtccatttagccaaatgtagtccatttagccaagtgcggtccatttagccaagtccagtgcttaggttggtggctacacaggaaacggccatgaatgtagacacaactatagaactgtccctagaaataggctcgaggttgttagagcgtttaaggtgatgcggcaaaatgcatatgactgagttgcttcaacgtgcaggggaaagggataaatagtctttttcgcagaatataaatagaggtagagcgggctcgcagcaatattgaccaggacagggcttcttttccagttgcatacatccattcacagcattcagctttcttcaatcatcatgaaggtcactgcggcttttgcaggtcttttggtcacggcattcgccgctcctgccccagaacctgatctggtgtcgcgaagtgccggtatcaactacgtgcaaaactacaacggcaaccttggtgatttcacctacgacgagagtgccggaacattttccatgtactgggaagatggagtgagctccgactttgtcgttggtctgggctggaccactggttcttctaagtgagtgactgtattctttaaccaaggtctaggatctaacgtctttcagcgctatcacctactctgccgaatacagcgcttctggctccgcttcctacctcgctgtgtacggctgggtcaactatcctcaagctgagtactacatcgtcgaggattacggtgattataacccttgcagttcggccacaagccttggtaccgtgtactctgatggaagcacctaccaagtctgcaccgacactcgaacaaacgaaccgtccatcacgggaacaagcacgttcacgcagtacttctccgttcgagagagcacgcgcacatctggaacggtgactgttgccaaccatttcaacttctgggcgcaccatgggttcggcaatagcgacttcaattatcaggtcgtggcggtggaagcatggagcggtgctggcagcgctagtgtcacaatctcttcttgagagattagtgccctagtagtcggaagatatcaacgcggcagtttgctctcaggtggtgtgatgatcggatccggtctctggggttacattgaggctgtataagttgttgtggggccgagctgtcagcggctgcgttttcagcttgcacagataatcaactctcgttttctatctcttgcgtttcctcgctgcttatcctatccatagataattattttgcccactaccacaacttgttcggtcgcagtagtcactccgagcaaggcattgggaaatgggggatgcggggtgctgcgtaccctctaacctagggcattttaaaggatatttaccctccagatattctatagatacagacttcttaggactgcgggtaatatagagagcgaaatttctacagttcgatgcagttcaatgcga

SEQ ID NO: 103 - protein, 211 aa, Aspergillus tubingensis
MKVTAAFAGLLVTAFAAPAPEPDLVSRSAGINYVQNYNGNLGDFTYDESAGTFSMYWEDGVSSDFVVGLGWTTGSSNAITYSAEYSASGSASYLAVYGWVNYPQAEYYIVEDYGDYNPCSSATSLGTVYSDGSTYQVCTDTRTNEPSITGTSTFTQYFSVRESTRTSGTVTVANHFNFWAHHGFGNSDFNYQVVAVEAWSGAGSASVTISS

SEQ ID NO: 104 - DNA, 2196 bp, Thermomonospora fusca
gtcgacgactcgacgtgtggctcacctagccgcgtcatccccgacgccgaggagcggcgaccactgaccccggtcatcgccccccaccaggtcgcaggatgctccctggtcccctccagcccgtacaaggaggaaacacccacaatgaaccatgcccccgccagtctgaagagccggagacgcttccggcccagactgctcatcggcaaggcgttcgccgcggcactcgtcgcggtcgtcacgatgatccccagtactgccgcccacgcggccgtgacctccaacgagaccgggtaccacgacgggtacttctactcgttctggaccgacgcgcctggaacggtctccatggagctgggccctggcggaaactacagcacctcctggcggaacaccgggaacttcgtcgccggtaagggatgggccaccggtggccgccggaccgtgacctactccgccagcttcaacccgtcgggtaacgcctacctgaccctctacgggtggacgcggaacccgctcgtggagtactacatcgtcgaaagctggggcacctaccggcccaccggtacctacatgggcacggtgaccaccgacggtggtacctacgacatctacaagaccacgcggtacaacgcgccctccatcgaaggcacccggaccttcgaccagtactggagcgtccgccagtccaagcggaccagcggtaccatcaccgcggggaaccacttcgacgcgtgggcccgccacggtatgcacctcggaacccacgactacatgatcatggcgaccgagggctaccagagcagcggatcctccaacgtgacgttgggcaccagcggcggtggaaaccccggtgggggcaacccccccggtggcggcaacccccccggtggcggtggctgcacggcgacgctgtccgcgggccagcagtggaacgaccgctacaacctcaacgtcaacgtcagcggctccaacaactggaccgtgaccgtgaacgttccgtggccggcgaggatcatcgccacctggaacatccacgccagctacccggactcccagaccttggttgcccggcctaacggcaacggcaacaactggggcatgacgatcatgcacaacggcaactggacgtggcccacggtgtcctgcagcgccaactagtcctgccggataaccccagctgtggcgcggcggttcagggggccgccgcgccacacccgcgagcagagcactccgctcgcggcgattggtccgggaatgcggtgtgcgctggccctccccccacgaaagggccggcgcacggtcatcccgccggcaagcggcggcgttccctcacccgtggcaccggtacccagggtcttccaggggatgaacagcgaacacagacccccgaggggataggggaaacgcacggggcccgctgctgtgccgcagcgggccccgttgcatggattctgacggtcggaagccaccgcatccaccccctggtcttgcgcgccgggcaatggtggcgaccgcggtatgcgcgcgctgcccacgagcggattaccgctcggtaatggcgatccgccgcggcttgagcgccttgctcttggggatccgcacggtcaaaaccccctgggacaaggtcgcgtccaccccgtcagggtcgatgtcccgcggcagggtgaccgcgtagtggaaccggccgacgctgcgggtgcggtggcggaaccagccctcgcgctcccgctccttgcgttctcccgtgatcaccagttccgtcccggacaggtcgatgctgatgtcctcgcgggagacacccgggacttccacctcgaccaggtaggcgtcctcggtctcggacaggtcagccagcggcgaccagctcaacgggtccgcggtgaggccggaagtccgctccagcaccgaatccatccaccgatgcagctgcgtgtggagttcgttcagctcccgaaacgggtcccatccggttgtcggctgagaagaacggacgacgggcagtgccatgtctgtacctcctcgaactcgttggtgaccgccgggaggcggtgggttcaggtgcggaggccttgcggccttgcgccggtgatcatccccaaatttgagtcccataaactcaactttgttgagtgtgttgcgtgtcactggtgggggaggggcgggtctccccaccaagcccagctggagtcggct

SEQ ID NO: 105 - protein, 338 aa, Thermomonospora fusca
MNHAPASLKSRRRFRPRLLIGKAFAAALVAVVTMIPSTAAHAAVTSNETGYHDGYFYSFWTDAPGTVSMELGPGGNYSTSWRNTGNFVAGKGWATGGRRTVTYSASFNPSGNAYLTLYGWTRNPLVEYYIVESWGTYRPTGTYMGTVTTDGGTYDIYKTTRYNAPSIEGTRTFDQYWSVRQSKRTSGTITAGNHFDAWARHGMHLGTHDYMIMATEGYQSSGSSNVTLGTSGGGNPGGGNPPGGGNPPGGGGCTATLSAGQQWNDRYNLNVNVSGSNNWTVTVNVPWPARIIATWNIHASYPDSQTLVARPNGNGNNWGMTIMHNGNWTWPTVSCSAN

SEQ ID NO: 106 - DNA, 1677 bp, Aspergillus fumigatus
atggcagctccaagtttatcctaccccacaggtatccaatcgtataccaatcctctcttccctggttggcactccgatcccagctgtgcctacgtagcggagcaagacacctttttctgcgtgacgtccactttcattgccttccccggtcttcctctttatgcaagccgagatctgcagaactggaaactggcaagcaatattttcaatcggcccagccagatccctgatcttcgcgtcacggatggacagcagtcgggtatctatgcgcccactctgcgctatcatgagggccagttctacttgatcgtttcgtacctgggcccgcagactaagggcttgctgttcacctcgtctgatccgtacgacgatgccgcgtggagcgatccgctcgaattcgcggtacatggcatcgacccggatatcttctgggatcacgacgggacggtctatgtcacgtccgccgaggaccagatgattaagcagtacacactcgatctgaagacgggggcgattggcccggttgactacctctggaacggcaccggaggagtctggcccgagggcccgcacatttacaagagagacggatactactacctcatgatcgcagagggaggtaccgagctcggccactcggagaccatggcgcgatctagaacccggacaggtccctgggagccatacccgcacaatccgctcttgtcgaacaagggcacctcggagtacttccagactgtgggccatgcggacttgttccaggatgggaacggcaactggtgggccgtggcgttgagcacccgatcagggcctgcatggaagaactatcccatgggtcgggagacggtgctcgcccccgccgcttgggagaagggtgagtggcctgtcattcagcctgtgagaggccaaatgcaggggccgtttccaccaccaaataagcgagttcctcgcggcgagggcggatggatcaagcaacccgacaaagtggatttcaggcccggatcgaagataccggcgcacttccagtactggcgatatcccaagacagaggattttaccgtctcccctcggggccacccgaatactcttcggctcacaccctccttttacaacctcaccggaactgcggacttcaagccggatgatggcctgtcgcttgttatgcgcaaacagaccgacaccttgttcacgtacactgtggacgtgtcttttgaccccaaggttgccgatgaagaggcgggtgtgactgttttccttacccagcagcagcacatcgatcttggtattgtccttctccagacaaccgaggggctgtcgttgtccttccggttccgcgtggaaggccgcggtaactacgaaggtcctcttccagaagccaccgtgcctgttcccaaggaatggtgtggacagaccatccggcttgagattcaggccgtgagtgacaccgagtatgtctttgcggctgccccggctcggcaccctgcacagaggcaaatcatcagccgcgccaactcgttgattgtcagtggtgatacgggacggtttactggctcgcttgttggcgtgtatgccacgtcgaacgggggtgccggatccacgcccgcatatatcagcagatggagatacgaaggacggggccagatgattgattttggtcgagtggtcccgagctactga

SEQ ID NO: 107 - protein, 558 aa, Aspergillus fumigatus
MAAPSLSYPTGIQSYTNPLFPGWHSDPSCAYVAEQDTFFCVTSTFIAFPGLPLYASRDLQNWKLASNIFNRPSQIPDLRVTDGQQSGIYAPTLRYHEGQFYLIVSYLGPQTKGLLFTSSDPYDDAAWSDPLEFAVHGIDPDIFWDHDGTVYVTSAEDQMIKQYTLDLKTGAIGPVDYLWNGTGGVWPEGPHIYKRDGYYYLMIAEGGTELGHSETMARSRTRTGPWEPYPHNPLLSNKGTSEYFQTVGHADLFQDGNGNWWAVALSTRSGPAWKNYPMGRETVLAPAAWEKGEWPVIQPVRGQMQGPFPPPNKRVPRGEGGWIKQPDKVDFRPGSKIPAHFQYWRYPKTEDFTVSPRGHPNTLRLTPSFYNLTGTADFKPDDGLSLVMRKQTDTLFTYTVDVSFDPKVADEEAGVTVFLTQQQHIDLGIVLLQTTEGLSLSFRFRVEGRGNYEGPLPEATVPVPKEWCGQTIRLEIQAVSDTEYVFAAAPARHPAQRQIISRANSLIVSGDTGRFTGSLVGVYATSNGGAGSTPAYISRWRYEGRGQMIDFGRVVPSY

SEQ ID NO: 108 - DNA, 2379 bp, Aspergillus fumigatus
atgtcggttgccaaatctattgctgccgtgctggtagcactgttgcctggtgcgcttgctcaggcgaatacaagctatgttgattacaatgtggaggcgaatccggatctcacccctcagtcggtcgctacgattgacctgtcctttcccgactgcgagaatggaccgctcagcaagactctcgtttgcgacacgtcggctcggccgcatgaccgagctgctgccctggtttccatgttcaccttcgaggagctggtgaacaacacaggcaacactagccctggtgttccaagacttggtctccctccgtaccaagtatggagcgaggctctccatggacttgaccgcgccaacttcacagacgagggagagtacagctgggccacctcgttccccatgcctatcctgacaatgtcggccttgaaccgaaccctgatcaaccagatcgcgaccatcatcgcaactcaaggacgagctttcaataacgttgggcggtatgggctggacgtgtacgccccgaatataaatgcattcagatcggctatgtggggaagaggtcaagagacccccggagaagacgcttactgcctggcatcggcgtatgcgtacgagtatatcactggcatccagggtggtgttgatccggaacacctcaagttggtggccactgccaaacactatgcgggctacgatcttgagaactgggacggtcactcccgtttgggcaacgatatgaacattacacagcaggaactttccgaatactacacccctcagttccttgttgcagccagagacgccaaagtgcacagtgtcatgtgctcctacaacgcggtaaatggggtgcccagctgcgcaaactcgttcttcctccagaccctcctccgtgacacatttggcttcgtcgaggatggttatgtatccagcgactgcgactcggcgtacaatgtctggaacccgcacgagtttgcggccaacatcacgggggccgctgcagactctatccgggcggggacggacattgattgcggcactacttatcaatactatttcggcgaagcctttgacgagcaagaggtcacccgtgcagaaatcgaaagaggtgtgatccgcctgtacagcaacttggtgcgtctcggctatttcgatggcaatggaagcgtgtatcgggacctgacgtggaatgatgtcgtgaccacggatgcctggaatatctcatacgaagccgctgtagaaggcattgtcctactgaagaacgatggaaccttgcctctcgccaagtcggtccgcagtgttgcattgattgggccctggatgaatgtgacgactcagcttcagggcaactactttggaccggcgccttatctgattagtccgttgaatgccttccagaattctgacttcgacgtgaactacgctttcggcacgaacatttcatcccactccacagatgggttttccgaggcgttgtctgctgcgaagaaatccgacgtcatcatattcgcgggcgggattgacaacactttggaagcagaagccatggatcgcatgaatatcacatggcccggcaatcagctacagctcatcgaccagttgagccaactcggcaaaccgctgatcgtcctccagatgggcggcggccaagtcgactcctcctcgctcaagtccaacaagaatgtcaactccctgatctggggtggataccccggacaatccggcgggcaggctctcctagacatcatcaccggcaagcgcgcccccgccggccgactcgtggtcacgcagtacccggccgaatacgcaacccagttccccgccaccgacatgagcctgcggcctcacggcaataatcccggccagacctacatgtggtacaccggcacccccgtctacgagtttggccacgggctcttctacacgaccttccacgcctccctccctggcaccggcaaggacaagacctccttcaacatccaagacctcctcacgcagccgcatccgggcttcgcaaacgtcgagcaaatgcctttgctcaacttcaccgtgacgatcaccaataccggcaaggtcgcttccgactacactgctatgctcttcgcgaacaccaccgcgggacctgctccatacccgaacaagtggctcgtcggcttcgaccggctggcgagcctggaaccgcacaggtcgcagactatgaccatccccgtgactatcgacagcgtggctcgtacggatgaggccggcaatcgggttctctacccgggaaagtacgagttggccctgaacaatgagcggtcggttgtccttcagtttgtgctgacaggccgagaggctgtggttttcaagtggcctgtagagcagcagcagatttcgtctgcgtga

SEQ ID NO: 109 - protein, 792 aa, Aspergillus fumigatus
MSVAKSIAAVLVALLPGALAQANTSYVDYNVEANPDLTPQSVATIDLSFPDCENGPLSKTLVCDTSARPHDRAAALVSMFTFEELVNNTGNTSPGVPRLGLPPYQVWSEALHGLDRANFTDEGEYSWATSFPMPILTMSALNRTLINQIATIIATQGRAFNNVGRYGLDVYAPNINAFRSAMWGRGQETPGEDAYCLASAYAYEYITGIQGGVDPEHLKLVATAKHYAGYDLENWDGHSRLGNDMNITQQELSEYYTPQFLVAARDAKVHSVMCSYNAVNGVPSCANSFFLQTLLRDTFGFVEDGYVSSDCDSAYNVWNPHEFAANITGAAADSIRAGTDIDCGTTYQYYFGEAFDEQEVTRAEIERGVIRLYSNLVRLGYFDGNGSVYRDLTWNDVVTTDAWNISYEAAVEGIVLLKNDGTLPLAKSVRSVALIGPWMNVTTQLQGNYFGPAPYLISPLNAFQNSDFDVNYAFGTNISSHSTDGFSEALSAAKKSDVIIFAGGIDNTLEAEAMDRMNITWPGNQLQLIDQLSQLGKPLIVLQMGGGQVDSSSLKSNKNVNSLIWGGYPGQSGGQALLDIITGKRAPAGRLVVTQYPAEYATQFPATDMSLRPHGNNPGQTYMWYTGTPVYEFGHGLFYTTFHASLPGTGKDKTSFNIQDLLTQPHPGFANVEQMPLLNFTVTITNTGKVASDYTAMLFANTTAGPAPYPNKWLVGFDRLASLEPHRSQTMTIPVTIDSVARTDEAGNRVLYPGKYELALNNERSVVLQFVLTGREAVVFKWPVEQQQISSA

SEQ ID NO: 110 - DNA, 1596 bp, Aspergillus fumigatus
atgagacggttcactttgttcctgctggccatccagagctgggtgctcaccaccctagcaatccggaatcccattatcaccggatggaaccctgatccttcgattctccgtgtgggaggcgagtatttcctcgcaacctcgtcattcgagtactggcctagcacaccgatctacaagtccaaagacctggccaactgggagctcttctcccatgcattcaccagaccggagcagcttcagctatacggaactccgacaggtgcaggtggaccggcaggtgcttgggctccaacgctctcctacatcaatggaaaatactacctcgctgcaatgacgcgatggacatacgacccagtcgcccgagtgtggccacgagtgatgtgggtgtcgtcccgcgacctcaggacctggtcggaccccatctggggtgacccatggggcattgatccctcattattccaggatcctgtctcgcagaaagtgtacttgaacctgatggcccccaacaacaacaaggaccgcatttggggaatttaccagtgtgaagtagatatcgacagtggtcgctgtggcacagacgaccttcaccgtgccagtatcgcacgctccctggctccagaaggtccctgggagcccgcgccgcacaatccgattcttttcaatggagcgtacggctatgataacctcaccgtacaatccactggccatgcgaccatcttcgaggcggcaaatggcgacagttacgtggtttacctcgcgcggcgcaagatcaatggctcgtcgcctctgggccgggaaaccttcatgtcaccagtcacctggaaagatggatggccgatgatcaatggcgggaatccagtccttctcagtgaatccttcggtgcttcgcacgaccagaaaccaccaccaccacgtttcatcgacacatttgaccagaagacgcttgatccctcctggtacacattgcggactccgtacgcgcccatctacgacctgaaggacggtggccgaaagaagtctcatggaattgtcttccgaccgaacgttttcggtctaagcgaccgagacaccccagcagcaattctacgaaaacaaaagtcgctgaatatgacctttagcgcgcagttgctacccacgacgtccgggctgggttacggcgagactgtcgggatcagtgcctatttgagtgagctgcaacatcaggacattggagtgtcgggctgtgtgaatagtactggcatgtgcatcttcactcagttgatgatgaatgggacaactgagtataagcaggtcaagctgaactcgacgtcgattccatcggatctgacactccatatccgcgcaacgcccctctcctacaaacttggatacagctttggatcagatgagaccatcacctggctggcgtcgctgtcatcgtcttggttggcattcgctccatcgggttggtttgtgttcgagggagcgagttttgctttgtttgcgaccggcactggacagccgtggccgccacatgcgccagaagtagggttttcgcaagtcacggagacatactatgacgaggatattcctaattatgaccagtggtctgtataa

SEQ ID NO: 111 - protein, 531 aa, Aspergillus fumigatus
MRRFTLFLLAIQSWVLTTLAIRNPIITGWNPDPSILRVGGEYFLATSSFEYWPSTPIYKSKDLANWELFSHAFTRPEQLQLYGTPTGAGGPAGAWAPTLSYINGKYYLAAMTRWTYDPVARVWPRVMWVSSRDLRTWSDPIWGDPWGIDPSLFQDPVSQKVYLNLMAPNNNKDRIWGIYQCEVDIDSGRCGTDDLHRASIARSLAPEGPWEPAPHNPILFNGAYGYDNLTVQSTGHATIFEAANGDSYVVYLARRKINGSSPLGRETFMSPVTWKDGWPMINGGNPVLLSESFGASHDQKPPPPRFIDTFDQKTLDPSWYTLRTPYAPIYDLKDGGRKKSHGIVFRPNVFGLSDRDTPAAILRKQKSLNMTFSAQLLPTTSGLGYGETVGISAYLSELQHQDIGVSGCVNSTGMCIFTQLMMNGTTEYKQVKLNSTSIPSDLTLHIRATPLSYKLGYSFGSDETITWLASLSSSWLAFAPSGWFVFEGASFALFATGTGQPWPPHAPEVGFSQVTETYYDEDIPNYDQWSV

SEQ ID NO: 112 - DNA, 2379 bp, Aspergillus fumigatus
atggcggttgccaaatctattgctgccgtgctggtagcactgttgcctggtgcgcttgctcaggcgaatacaagctatgttgattacaatgtggaggcgaatccggatctcacccctcagtcggtcgctacgattgacctgtcctttcccgactgcgagaatggaccgctcagcaagactctcgtttgcgacacgtcggctcggccgcatgaccgagctgctgccctggtttccatgttcaccttcgaggagctggtgaacaacacaggcaacactagccctggtgttccaagacttggtctccctccgtaccaagtatggagcgaggctctccatggacttgaccgcgccaacttcacagacgagggagagtacagctgggccacctcgttccccatgcctatcctgacaatgtcggccttgaaccgaaccctgatcaaccagatcgcgaccatcatcgcaactcaaggacgagctttcaataacgttgggcggtatgggctggacgtgtacgccccgaatataaatgcattcagatcggctatgtggggaagaggtcaagagacccccggagaagacgcttactgcctggcatcggcgtatgcgtacgagtatatcactggcatccagggtggtgttgatccggaacacctcaagttggtggccactgccaaacactatgcgggctacgatcttgagaactgggacggtcactcccgtttgggcaacgatatgaacattacacagcaggaactttccgaatactacacccctcagttccttgttgcagccagagacgccaaagtgcacagtgtcatgtgctcctacaacgcggtaaatggggtgcccagctgcgcaaactcgttcttcctccagaccctcctccgtgacacatttggcttcgtcgaggatggttatgtatccagcgactgcgactcggcgtacaatgtctggaacccgcacgagtttgcggccaacatcacgggggccgctgcagactctatccgggcggggacggacattgattgcggcactacttatcaatactatttcggcgaagcctttgacgagcaagaggtcacccgtgcagaaatcgaaagaggtgtgatccgcctgtacagcaacttggtgcgtctcggctatttcgatggcaatggaagcgtgtatcgggacctgacgtggaatgatgtcgtgaccacggatgcctggaatatctcatacgaagccgctgtagaaggcattgtcctactgaagaacgatggaaccttgcctctcgccaagtcggtccgcagtgttgcattgattgggccctggatgaatgtgacgactcagcttcagggcaactactttggaccggcgccttatctgattagtccgttgaatgccttccagaattctgacttcgacgtgaactacgctttcggcacgaacatttcatcccactccacagatgggttttccgaggcgttgtctgctgcgaagaaatccgacgtcatcatattcgcgggcgggattgacaacactttggaagcagaagccatggatcgcatgaatatcacatggcccggcaatcagctacagctcatcgaccagttgagccaactcggcaaaccgctgatcgtcctccagatgggcggcggccaagtcgactcctcctcgctcaagtccaacaagaatgtcaactccctgatctggggtggataccccggacaatccggcgggcaggctctcctagacatcatcaccggcaagcgcgcccccgccggccgactcgtggtcacgcagtacccggccgaatacgcaacccagttccccgccaccgacatgagcctgcggcctcacggcaataatcccggccagacctacatgtggtacaccggcacccccgtctacgagtttggccacgggctcttctacacgaccttccacgcctccctccctggcaccggcaaggacaagacctccttcaacatccaagacctcctcacgcagccgcatccgggcttcgcaaacgtcgagcaaatgcctttgctcaacttcaccgtgacgatcaccaataccggcaaggtcgcttccgactacactgctatgctcttcgcgaacaccaccgcgggacctgctccatacccgaacaagtggctcgtcggcttcgaccggctggcgagcctggaaccgcacaggtcgcagactatgaccatccccgtgactatcgacagcgtggctcgtacggatgaggccggcaatcgggttctctacccgggaaagtacgagttggccctgaacaatgagcggtcggttgtccttcagtttgtgctgacaggccgagaggctgtggttttcaagtggcctgtagagcagcagcagatttcgtctgcgtga

SEQ ID NO: 113 - protein, 792 aa, Aspergillus fumigatus
MAVAKSIAAVLVALLPGALAQANTSYVDYNVEANPDLTPQSVATIDLSFPDCENGPLSKTLVCDTSARPHDRAAALVSMFTFEELVNNTGNTSPGVPRLGLPPYQVWSEALHGLDRANFTDEGEYSWATSFPMPILTMSALNRTLINQIATIIATQGRAFNNVGRYGLDVYAPNINAFRSAMWGRGQETPGEDAYCLASAYAYEYITGIQGGVDPEHLKLVATAKHYAGYDLENWDGHSRLGNDMNITQQELSEYYTPQFLVAARDAKVHSVMCSYNAVNGVPSCANSFFLQTLLRDTFGFVEDGYVSSDCDSAYNVWNPHEFAANITGAAADSIRAGTDIDCGTTYQYYFGEAFDEQEVTRAEIERGVIRLYSNLVRLGYFDGNGSVYRDLTWNDVVTTDAWNISYEAAVEGIVLLKNDGTLPLAKSVRSVALIGPWMNVTTQLQGNYFGPAPYLISPLNAFQNSDFDVNYAFGTNISSHSTDGFSEALSAAKKSDVIIFAGGIDNTLEAEAMDRMNITWPGNQLQLIDQLSQLGKPLIVLQMGGGQVDSSSLKSNKNVNSLIWGGYPGQSGGQALLDIITGKRAPAGRLVVTQYPAEYATQFPATDMSLRPHGNNPGQTYMWYTGTPVYEFGHGLFYTTFHASLPGTGKDKTSFNIQDLLTQPHPGFANVEQMPLLNFTVTITNTGKVASDYTAMLFANTTAGPAPYPNKWLVGFDRLASLEPHRSQTMTIPVTIDSVARTDEAGNRVLYPGKYELALNNERSVVLQFVLTGREAVVFKWPVEQQQISSA

SEQ ID NO: 114 - DNA, 1608 bp, Vibrio sp. XY-214
atgacaactacgattcagaaccctattttaaaaggctttaatccagatccttcgattgttcgtgtcggcgacgattactacattgcaacctcaaccttcgagtggtttccggggattcaacttcatcattcacgcgatctgattaactggcgccttgttggtcacgccttaactagaacctcacaactgaacatgatgggcatggataattccgaaggcgtttacgcccctgccctaacttattctgacggcacattctggctgtgcttctcgaatgtccactcatgtcgcggtggtaactggatggcgacgcctagttatgttgtgacagctgacagcattgaaggtccatggagtgagcctgttccgattggtaattacggctttgatccttctctgttccatgatgacgatggcaagaaatacatgctcaacatgatttggggtggccgtgcaaagactaacttctttggcggtatcatcatgcaagagtttgatgccgatgaaggtaagcttgttggcgcacccaagaccgtcttcgaagggaccgagctcggttgtactgaaggcccacaactgcttaaaaaggatgactattattacctgataacagcggaaggtggtacagagcgcaatcacgcggtaacggtttgtcgttccaagcacatctggggaccttatgaagttcacccagaaaatcctatcctgaccagtcgtttccaagaacacgcagagctttcacgtgcaggtcacggctttctagttgagactcaaaccggtgaatggtatatgagccacctgtgtggccgccgtattccaaacccggaaggctatcaatttatgcctaaatacgacaatggcttctcaatcttaggccgagaaagtgcgctacaaaaagcacactggcaagacgattggccatacatcgcaacaggtaaaacacctgttgttgaagtggaagcaccaaaccttcctttacacccttggcctgaatctccggctcgagacgaatttatcgacccaacgttgagcctgatatcaaccttacgagagccagtatctgaaaaatggctgtcgttaagcgagcgaccaggattcttacgtctgaaaggacgccactatttatattcccgttacgaacaaagcatggttgctcgccgattccaagcgcacaatgcaacagtagaaaccaagcttgagttcaagccgaacacaccttatgaaatggcagggttatgtgcttattacgcacgtaatgggcactactttctaaaaatgactgccaatgatctaggcgaacgtgttttacaagttgtcggtaacatcaatgatgtttacggtgaatactctaacgatgtcgttatcggtgatgcagatacggtctacatgagattagagctcaaaactcaatggtatcaatatagttactcactggatggcgtcgactggtatgagattggcccagccttaaacagcacaccgctgtcagatgaaggcggtcctgatattttccgtttcacaggaagcttcgcagcactatttgttgctgatatcacagggcagaaacgccatgctgattttgactactttgagtacctagagcattaa

SEQ ID NO: 115 - protein, 535 aa, Vibrio sp. XY-214 [sequence omitted]

SEQ ID NO: 116 - DNA, 4560 bp, Aspergillus niger
acgccctgggcggaacgcacatgctcaccattggatggcattgcggtgccatcttcggtcctgctgcctccgcagcagccgtctccaagctcctgaatcttcccgccgcgcagatcgaagatgcactgggcatggcgtgcacgcaggcctgcgggctcatgtcggcgcagtttgagagcatggtgaagcgcatgcagcatgggtttgcatcgcggagcggagtactcgccacctatttggcgaagcaggggtttacggggatcaaggagatctttgatcgcgagtatggtgggttcttgaagatgttttcgtacggggcggagacggagcgcaagtattacccggaggaggtctgcaagggattaggggaagtgtggcagaccaagaagatcaagcagaagttgcatgcgctgtgcgcggtgtcgcattgtacggtggattgtattaaggacctgcaggccatgtatcctgcgaagatgggtgagtggaagaaaatcgtcaagattgaggcggagatggcgagggccgcgatgaagaagggtggctgggcaccggagaagccagccaccgccacggcggcgcagatgagtataccgtatgcggtggcgttgcaggttctggatggggagattgtgccggggcagtttgcgccgggcatgttgaatcgggaggagttatgggatgtgattaggctggtggaatgtcgggaggccaaggagctggataatacgtgggcgcagagggtcaagatcacgtttgaggatggggaggtggtggagaagttgttgaaggctccgaagggagtccatcctggggtgacgaatgaggaggtgttgcagaagtggcgggctgtgacgaagggggtaatttcggaagagaggcagaagaagatcgaggagattgtgttgaatttggaagaggtggaggatgtggctggtgttttgggcgagttgttgagggaagagacggtgaatgtgctgcagtagacggttaccccatttggacggggatggcttcatatttcccaagcgatgtcacgccatagaaagggcacatttacccggtgcctgagcgaaactctacttcgaagacaatgccaatgtttaactatcttgttttaattgctaaatgcaaacattccaggttcttcctaatgccggctaaatcattcaggctaaacccccgcgatgaagtcaatcggtcattctccggcgcatctccgcatctccgcaaaccgctataaaatctaccccagattcagtccccggccacctttctatccccccccccacagactggctcaaccatggcgcactcaatgtctcgtcccgtggctgccactgccgctgctctgctggctctggctcttcctcaagctcttgcccaggccaacaccagctacgtcgactacaacatcgaagccaacccggacttgtatcctttgtgcatagaaaccatcccactgagcttccccgactgccagaatggtcccctgcgcagccatctcatctgtgatgaaacagccaccccctatgaccgagcagcatcgctcatctcgctcttcaccctggacgagctgatcgccaacaccggcaacaccggcctcggtgtctcccgactgggcctccctgcataccaagtatggagtgaagctcttcacggcctcgaccgtgccaatttcagcgactcaggagcctacaattgggccacctcattcccccagcccatcctgaccaccgcggccctcaaccgcaccctcatccaccaaatcgcctccatcatctctacccaaggccgcgccttcaacaacgccggccgctacggcctcgacgtctacgcccccaacatcaacaccttccgccaccccgtctggggtcgcggacaagaaaccccaggagaggacgtctctctcgccgccgtctacgcctacgaatacatcaccggcatccagggtcccgacccagaatcaaacctcaaactcgccgccacggccaagcactacgccggctatgacatcgagaactggcacaaccactcccgcctgggcaacgacatgaacatcacccagcaagacctctccgaatactacacgccccaattccacgtcgccgcccgcgacgccaaagtccagagtgtcatgtgcgcctacaacgccgtcaacggcgtccctgcctgcgccgactcctacttcctccagaccctcctccgcgacaccttcggatttgtcgaccacggatacgtctccagcgactgcgatgccgcctataacatctacaacccccacggctatgcctcctcccaggctgccgctgccgctgaggccatcctcgccggcaccgacatcgactgcggtaccacctaccaatggcacctgaacgagtccatcgctgcgggagatctctctcgcgatgatattgagcagggtgtgattcgtctctacacgaccctcgtgcaggccggatacttcgactccaacaccacaaaggcgaacaacccctaccgcgacctctcctggtccgacgtccttgagacggacgcatggaacatctcctaccaagccgcgacgcagggcattgtccttctcaagaactccaacaacgtcctccccctcaccgagaaagcttacccaccatccaacaccaccgtcgccctcatcggtccctgggccaacgccaccacccaactcctgggcaactactacggcaacgctccctacatgatcagcccccgcgccgccttcgaagaagccggatacaaagtcaacttcgccgagggcaccggtatctcctccacaagcacctcgggcttcgctgccgccttatccgccgcacaatccgccgacgtgataatctacgccggtggtatcgacaatacccttgaagcggaggcactggatcgagagagtatcgcgtggccgggtaaccaactggacttgatccagaagctcgcctcggcggccggaaagaagccgctcatcgtcctccaaatgggcggcggacaggtcgattcctcttcgctcaagaacaacaccaatgtttctgcacttctctggggcggataccccggccaatctggcggcttcgctttgcgggatatcatcacggggaagaagaaccccgcgggtagactagtcacgacgcagtaccctgccagctacgcggaggagttcccggcgacagatatgaaccttcgtcctgagggtgataaccctggtcagacgtataaatggtacaccggcgaagccgtgtacgagttcggccacgggttattctacacgaccttcgcggaatcctccagcaataccactacaaaggaagttaagctcaacatccaggacattctttcccagacacacgaagacctggcgtcgattacccagctccctgtgctgaacttcaccgccaatatcaggaacactggaaagctggaatcggattacaccgctatggtattcgccaatacctctgatgccgggccggcgccgtatcccaagaagtggctggtcgggtgggatcggcttggggaggtgaaggtcggggagacgagggagttgagggtccccgttgaggtggggagctttgcgagggtgaatgaggatggcgattgggtggtgtttccgggaacgtttgagttggcgttgaatttggagaggaaggttcgggtgaaggttgttcttgagggtgaggaggaagtcgtgctgaagtggccggggaaggagtagaaaatactattctgttgatggctctaggggatgagagtcagcctattactggatatgcatagtggtgatacgatgtatatagctctatgaagtaattagttcaagtgggaatacccctttcacacatatagtatgctgttattccgaaatagggatcatttctgattaatagtagcggtagcgatggtcacacacgacttaatgttccccattgtaccggaagtaacaattccagtgacctcttagaagaaagacagcaagaaaaagtaagaaagggaaattgatcaaaaaataaggccatctacagcctattcacatttagccggatctgcaatacagctacagaaataaagtttgttaggctgcttgctagcatagctcctactatactaaaccaacacaatgggacaataccccaattaaccagccctcactcaacacaagtgaatcctaccgacaacatgcataaaccactgcttccccacccagcacccttcttcacgatcagatcacggagaattaccaactactcttcgcataaaacgtaaacaacggcctcgggccaggatccgtccgactcaaaagcaacaaatccctcgttcgcatactagccacatgaacctgttgctccgagacctcctcaactgggtcttcaaatgcccagaagacgctttcttctcgatatccatcggatactcgctggccgcttagacatatgaacgatgagtctcgtctgccaaaggaaacaaccgtgttcccgaatccagtgtcaaagtcgtaggtctggaatttgaaaagtgttcgggcgtttccttggagggtcgggagtgcgactgcag

SEQ ID NO: 117 - protein, 804 aa, Aspergillus niger
MAHSMSRPVAATAAALLALALPQALAQANTSYVDYNIEANPDLYPLCIETIPLSFPDCQNGPLRSHLICDETATPYDRAASLISLFTLDELIANTGNTGLGVSRLGLPAYQVWSEALHGLDRANFSDSGAYNWATSFPQPILTTAALNRTLIHQIASIISTQGRAFNNAGRYGLDVYAPNINTFRHPVWGRGQETPGEDVSLAAVYAYEYITGIQGPDPESNLKLAATAKHYAGYDIENWHNHSRLGNDMNITQQDLSEYYTPQFHVAARDAKVQSVMCAYNAVNGVPACADSYFLQTLLRDTFGFVDHGYVSSDCDAAYNIYNPHGYASSQAAAAAEAILAGTDIDCGTTYQWHLNESIAAGDLSRDDIEQGVIRLYTTLVQAGYFDSNTTKANNPYRDLSWSDVLETDAWNISYQAATQGIVLLKNSNNVLPLTEKAYPPSNTTVALIGPWANATTQLLGNYYGNAPYMISPRAAFEEAGYKVNFAEGTGISSTSTSGFAAALSAAQSADVIIYAGGIDNTLEAEALDRESIAWPGNQLDLIQKLASAAGKKPLIVLQMGGGQVDSSSLKNNTNVSALLWGGYPGQSGGFALRDIITGKKNPAGRLVTTQYPASYAEEFPATDMNLRPEGDNPGQTYKWYTGEAVYEFGHGLFYTTFAESSSNTTTKEVKLNIQDILSQTHEDLASITQLPVLNFTANIRNTGKLESDYTAMVFANTSDAGPAPYPKKWLVGWDRLGEVKVGETRELRVPVEVGSFARVNEDGDWVVFPGTFELALNLERKVRVKVVLEGEEEVVLKWPGKE

SEQ ID NO: 118 - DNA, 3878 bp, Bacteroides ovatus
gaattccgctgactggttttgctattctttgtttttggaacggcttttcgggttcactgttctatgcctatttcacttacgttggattatccatgtgttatacattgattaatgtgccttatggagcactgaatgcgtcacttacccgcgatacgaatgaaatcacggtgttgacgtcagtgcgtatgtttcttgccaatttgggtggtttggctgtggcatacggtattccgatactggtgaaggtgttgtctcccgatggtaaaatcaatactactgcatctgctaacgcatggtttattacgatgactatttatgctgttatcggattggcgttattgatgttctgctttaaccagacgaaggagcgtgtggttatggatcaggaggagacatctaaagtaaaagtgtccgacttgtgggtagaattttgtagaaataaacctttgcgtattttggcgttctttttcattactgcttttgcaatgatggcgattggtaattctgccggttcatattatatgatttataatgtacgtgcaccggagatgttaccttatttcatggccttgggctcgatacccgcattcattttcatgccgatggtacctgccattaaacgtgccattggaaaaaagcaaatgttttatgtattcctttcagtcgctatattgggtatggcattgctgtatattatttctgtggttccggtactcaaaacgcagatatggttggtctttgtggcgcagttcataaaatcgacgggagtcattattgcgacagggtatatgtgggctttggttcccgaagtaatttcgtatggcgaatatactcatggtaaacgtatttcgggtatagtcaatgctttgactggtattttctataaagcgggaatggctcttggaggagttgtaccgggacttgttatggcttttgtcggattcgaccagacaaatgaagtgtcacaatcgccttttgccgaacagggaatactgtggctcgtagccgttattccggcgttgttgcttttggtcgctatgttcattatttctaaatatgaattggaagataatgtgattgacaatataaatgaggagatagaatcgcgctgtaaaaaaggcgaatagataagatagtagaatgtttattactcaaaaatataacgtatgaaactcaaacgaataattctgttgttattgacagtgatgttttctttttcttatggagaagtttttgcgaaagatggaagttcgctgaaaaaggctttgaaaaacaagtttttgattggcgtgtcagtgaacacacatcaaagttccggtaaggatgtcgcagctgttgaaattgtaaagaagaattttaattccatcgtggcggaaaactgcatgaagtcttctgtcattcatccgaaagaaaataagtataattttgcgcaggcagatgaatttgtcagttttggtgagagcaatcaaatggctatcattggtcactgcctgatttggcattcacaattggctccttggttttgcgtagataaggacgggaataatgtttctccggaagtcctgaagaaacggatgaaagaccatatcactaccatcgtgaaacgctataaaggccgtatcaaaggctgggatgtagtaaatgaagcgattgaagataatggagcatatcgcaagacaaagttttatgagattctgggggaagaatatatcccattggctttccagtatgcacacgaggctgatccggatgccgaactttactacaatgactactcaatggcccaaccgggcagaagagaagccgtcgtgaaaatggtgaacgatttgaaaaaacgtggaatccgtattgatgccataggtatgcaaggacacatcggcatggactacccgaaaatcagtgaatttgagaagagtatgctggcctttgccggaacaggagtgaagataatgataacagaactggatttgacggtgataccatcaccgaatcccaatgtaggtgcagaagtttccgcttcctttgaatataagaaagagatgaatccttatccggatggattaccggaagaggtatcgaaagcatggactgaaagaatgaatgactttttccgtctgttcctgaaacatcataaccttatcaccagggttactctttggggagtagccgatcagaactcttggcgtaatgactggccgatgagaggccgcacggattatccgttactttttgatcgcaattatcagccgaagccggtagtcggcctgattatcaaagaggctgaaaaaacaaaataagtttctaacagaaaaaccgaaaaagcatgaaaacagaaaaaagatatttagttcccggtgattatatggctgaccctgccgtacatgtatttgatggcaaactgtatatttatccctcgcacgattgggaaagtggtattgctgaaaatgataatggcgatcatttcaatatgaaagattatcacgtgtattctatggatgatgtgatgaacggtgaaataaaagatcatggagtggtgctttccacagaggatattccttgggcgggccgtcaactatgggattgtgatgtggtttgtaaagatggtaagtactatatgtattttccattgaaagatcagaatgatatatttcgtatcggggtagctgtgagtgataaaccttatggtccttttataccggaagctaatccgatgaaaggaagttacagcatcgatccggctgtatgggatgacggagatggtaactattatatatatttcggtggattgtggggtggacaacttcaacgttaccgtaataataaagccttggaatctgccattttgccggaaggagaggaggaggcaatcccgtcgcgtgttgctcgtttgagtgaagacatgatggagtttgccgaagaaccccgtgcagtggtaattctggatgaagacggtaagccattgacagcaggggatacggaacgccgtttcttcgaagcttcgtggatgcataaatataatggtaaatactatttttcctattctacgggagacactcatttgctctgctatgcaacaggtgataacccttatggtccgtttacttatcagggagtcattctgactccggtggtaggatggactactcaccatgctattgtagagtttaaaggtaagtggtatctgtttcatcacgattgtgtaccatcagagggaaagacttggctccgtagcttgaaagtctgtgaacttcagtatgatgcagacgggcgaatcattactatcgagggaaaagatgaataataggatacattaaaacaaccgcctctatttgaaaaacatacctacttttaccagaatattaggtaatagggatttttcaggtagaggcggttattattaactatgaatgcttaatttacttatgctatcatactgtaaattaattgtgataacatactttgtactatgagaaatatatttgcattgacattcactttgtttttttgcttttcttctatttgggcagaagatggaagtgccttgtggcttcgttatgcatcgggagcgaaagcggaaattaccagcaagaaacaatcacctacattacgtattgcggtttccgaattacagaacttctggcagggaggaatcccggttactttggaggtccggaacaataaagaacttcgtgcacttggaaatgagggatatacgattcagacctccaaaggtggcaatcaaataacgatagcttcttccggtgaacaaggagtactttatggaacgtatcatttactccgtctgcaagctaccggacaactaccggaatcagctttgcaatccctcaatttctccgaacgacctgattatcgaattc

SEQ ID NO: 119 - protein, 374 aa, Bacteroides ovatus
IPLTGFAILCFWNGFSGSLFYAYFTYVGLSMCYTLINVPYGALNASLTRDTNEITVLTSVRMFLANLGGLAVAYGIPILVKVLSPDGKINTTASANAWFITMTIYAVIGLALLMFCFNQTKERVVMDQEETSKVKVSDLWVEFCRNKPLRILAFFFITAFAMMAIGNSAGSYYMIYNVRAPEMLPYFMALGSIPAFIFMPMVPAIKRAIGKKQMFYVFLSVAILGMALLYIISVVPVLKTQIWLVFVAQFIKSTGVIIATGYMWALVPEVISYGEYTHGKRISGIVNALTGIFYKAGMALGGVVPGLVMAFVGFDQTNEVSQSPFAEQGILWLVAVIPALLLLVAMFIISKYELEDNVIDNINEEIESRCKKGE

SEQ ID NO: 120 - protein, 376 aa, Bacteroides ovatus
MKLKRIILLLLTVMFSFSYGEVFAKDGSSLKKALKNKFLIGVSVNTHQSSGKDVAAVEIVKKNFNSIVAENCMKSSVIHPKENKYNFAQADEFVSFGESNQMAIIGHCLIWHSQLAPWFCVDKDGNNVSPEVLKKRMKDHITTIVKRYKGRIKGWDVVNEAIEDNGAYRKTKFYEILGEEYIPLAFQYAHEADPDAELYYNDYSMAQPGRREAVVKMVNDLKKRGIRIDAIGMQGHIGMDYPKISEFEKSMLAFAGTGVKIMITELDLTVIPSPNPNVGAEVSASFEYKKEMNPYPDGLPEEVSKAWTERMNDFFRLFLKHHNLITRVTLWGVADQNSWRNDWPMRGRTDYPLLFDRNYQPKPVVGLIIKEAEKTK

SEQ ID NO: 121 - protein, 325 aa, Bacteroides ovatus
MKTEKRYLVPGDYMADPAVHVFDGKLYIYPSHDWESGIAENDNGDHFNMKDYHVYSMDDVMNGEIKDHGVVLSTEDIPWAGRQLWDCDVVCKDGKYYMYFPLKDQNDIFRIGVAVSDKPYGPFIPEANPMKGSYSIDPAVWDDGDGNYYIYFGGLWGGQLQRYRNNKALESAILPEGEEEAIPSRVARLSEDMMEFAEEPRAVVILDEDGKPLTAGDTERRFFEASWMHKYNGKYYFSYSTGDTHLLCYATGDNPYGPFTYQGVILTPVVGWTTHHAIVEFKGKWYLFHHDCVPSEGKTWLRSLKVCELQYDADGRIITIEGKDE

SEQ ID NO: 122 - DNA, 1461 bp, Aspergillus clavatus
atggcatcacttggcttctcccatcccactcccccccaaccatataccaatcccctctttcctagctggcactcggatctcacctgtgtctacgttccggagcaggatactttcttctgcgccacgtccaccctcgtcgcctttccaggcctgccagtctatgcaggcaaagacctgcagaactggaaactcgccagcaacgtcttcaatcgacccagtcagattcccgacctgcgcatcaccgacggccagcagtcgggtatctacgcccccacgcaccgctaccacgacggcatattctacttgatcgtctcctacctgggcccgcagaccaagagtctcctgttcacgttgtccgatccgttcagcggtgccgcgtggtgcgagccgctcgtcttctccgtccgcggcatcgacccggaactcttctgggacgacgatggaacggtgtacgtgacgtcggcggatgaccagcagatccagcagtgctcgcttgacctgcggaccggcgagacagggctaatggtcggccatgcggacttgttctacgatgatggcgatggacactggtgggctgtggcgctgagtacacgctcgggcccggagtggaagaactaccccatgggtcgcgagatggtcctggccgctgcgaccggggatgaaggggaatggccggtcgtccagcctgtccacggacagatgcagagccctcttccgcggccgaacaggggtatccgtcgcggcgacgccgcgtggatcaacgaacccgacgagattgactttctgacgggttcgtcgattccgccgcacttggtgtactggcggcatctgaagccggaggatttcaccgtctcgccagcgggccatcctcgtacgctccggctgacgcccccgttctataatcccaccggaacggaggactttcagccggatgatgggttgacgctcatcatacgccatcagactgatacgttgtgcgcatacagtgtgatcgtatctttcaaccccagggtggccgacaaagaagcgggcgtgacggtttttctgacccagcagcatattgatctgggtgttgtcctgcttcagtcctccaaaggactatcgctggccttctggtttcgcgtagagggccgcggtaactatcgagacgcgaccccagagaacacggtacctgtgcctgaggattggcaaggcggacccatccgtctggagatccagaccgtgaacgattccgagtatgtctttgcagctgctccagctcggcacccgaaacaacgaatggtcatcggatgcgccgatgcgctgattgtcagtggtgatacgggacggtttactggatcgctcgttggtgcatatgcgacgaagaatggcggctcggactccacgccggcatatataagcagatggagatatgagggacgcgggcggagagttgactccgatcgagtcattcccagttga

SEQ ID NO: 123 - protein, 486 aa, Aspergillus clavatus
MASLGFSHPTPPQPYTNPLFPSWHSDLTCVYVPEQDTFFCATSTLVAFPGLPVYAGKDLQNWKLASNVFNRPSQIPDLRITDGQQSGIYAPTHRYHDGIFYLIVSYLGPQTKSLLFTLSDPFSGAAWCEPLVFSVRGIDPELFWDDDGTVYVTSADDQQIQQCSLDLRTGETGLMVGHADLFYDDGDGHWWAVALSTRSGPEWKNYPMGREMVLAAATGDEGEWPVVQPVHGQMQSPLPRPNRGIRRGDAAWINEPDEIDFLTGSSIPPHLVYWRHLKPEDFTVSPAGHPRTLRLTPPFYNPTGTEDFQPDDGLTLIIRHQTDTLCAYSVIVSFNPRVADKEAGVTVFLTQQHIDLGVVLLQSSKGLSLAFWFRVEGRGNYRDATPENTVPVPEDWQGGPIRLEIQTVNDSEYVFAAAPARHPKQRMVIGCADALIVSGDTGRFTGSLVGAYATKNGGSDSTPAYISRWRYEGRGRRVDSDRVIPS

SEQ ID NO: 124 - DNA, 1566 bp, Aspergillus clavatus
atgccatcccagtacaccaaccccatcctccccgggttctaccccgatccagcctgcatcctggtgggagacaccttctacctgatcaactccagcttccaattctttccgggactaccaatccacaaatccaaggatctgattaactgggagctcatcggaaatgccatctgccgaccagagcaaatccaactacattcgtccacgaccaaagtcaacaatgcggcggaaaagcagatcttcaccggaggtctgtatgccccaaccatccgctaccacaacggccgcttctacatcgtctgcacgatgctcagcggcccggtggacatgccagccgccgcggactttgaaccgcagaacttcatcatcacagcatccgatctcgaggatccgtcctccttcagcgatcccatctactttgacttctacgggatcgaccccagtttgttctttgacgatgacggccgcgtgtatgtgcagggtagctggatccacgggtatcgcaagaatcccgccacggtcatccgccaagcggagattgatctcagcacggggaagctcgccgcgccagcggtggatatctggtccggacataccgggcgggttccggagggcccgcatctgtacaagaaggacgggtattactatctcctgattgccgagggcggcacgttcggcgagcacaagatcaccatggcccgcgctagaagcgtctggggtccgtatgagtcgttcagtggcaatcctgttctcaccgcggaaggctctaacgggtgtatacaatgtgtcggacatgctgagctgttccaggatccgctgggccagtggtgggcggttatgctggcaggacgggagtacggagcaagctatccgcttggtcgagagacattcctgacgccggttgagtggccggagaaccaattcccgtcttttgcaccggtggaattatccccgaaatgcagtcgccagatgccgggaagagtcgcttctcataccctcccagcggtttccctcgactcaccattgacactgtatctccgcacccctgacctccagaactatgcgcaaaatggaaaggagataacattgaccccggtggaagccgatctggggtctatgtctgggaccatgactttcgtgggccaacgccaaacatcgctcgagtcggtcgcacgtgttctgctgcggctcggtgatctcccagcaggaaaggtctcgtgcgggttggctgtatataaagaccctttccgatatgcctccgttacatacagcactgcggacggttgtttcagcttgacgattcaggagcccgggaaacctctgacaacactcggttcgattccggtacaacacgcgaccgcagcccagctatcgattacttcatcgacggaaaactacgtgtttgagtgttcccttgcacacaccgatggggatacggaaactaccaagctcggagaagtgccgtgctctgcgctgagtggtgatgattttactggcacgatatatgctatattcgcttcaggggaaggggatgtcaagtttcatgactttaagatacagaactag

SEQ ID NO: 125 - protein, 521 aa, Aspergillus clavatus
MPSQYTNPILPGFYPDPACILVGDTFYLINSSFQFFPGLPIHKSKDLINWELIGNAICRPEQIQLHSSTTKVNNAAEKQIFTGGLYAPTIRYHNGRFYIVCTMLSGPVDMPAAADFEPQNFIITASDLEDPSSFSDPIYFDFYGIDPSLFFDDDGRVYVQGSWIHGYRKNPATVIRQAEIDLSTGKLAAPAVDIWSGHTGRVPEGPHLYKKDGYYYLLIAEGGTFGEHKITMARARSVWGPYESFSGNPVLTAEGSNGCIQCVGHAELFQDPLGQWWAVMLAGREYGASYPLGRETFLTPVEWPENQFPSFAPVELSPKCSRQMPGRVASHTLPAVSLDSPLTLYLRTPDLQNYAQNGKEITLTPVEADLGSMSGTMTFVGQRQTSLESVARVLLRLGDLPAGKVSCGLAVYKDPFRYASVTYSTADGCFSLTIQEPGKPLTTLGSIPVQHATAAQLSITSSTENYVFECSLAHTDGDTETTKLGEVPCSALSGDDFTGTIYAIFASGEGDVKFHDFKIQN

SEQ ID NO: 126 - DNA, 1572 bp, Neosartorya fischeri
atgtacaacaatcccatcatccccgggttcaacccggacccctccatcatccgcgtcaatcatgaccacttcctcgtcacctcgtccttcgagtacttccccggcgccccaatctaccacagcacagatctaatccgctggtcattgatcggtcatgccttgactaaacccagccagctgcagatccacactcccgagccaggaggcggcatctgggcaacaaccctgcgctaccacaaggggaccttttacatcatcgccgccagtttcgagcggtaccgtccgcaggaggacgaccgtgtctggccgcggggattctacgtcaagacagagaatatctgggactcggactcgtggtctgatcccgtgtattttgatcaggtcgggttcgaccaggatctcttctgggacgacgacggaacggtgtacctatcatcaacataccgcaagctcgtccgcacccccggcgccaccctcaaagatttcgccatccatatcgcaacagttgacctcgagacgggcaactccacctccgagccgagactgatccgcgaatcggcctccggtgtggcggagggctcgcatatcttcaagcggggaaagtactactatctcttcacggcggagggtggcaccgagagcgggcactgcgagtgggtttgtcggagcgaggtcagcccgtttgggccgtgggaggttgggccgtgtaatcccctctggagaaatggggtggacgacgaggtgcagaataccgggcatgcggatctggtcgaggacgcggagggcaactggtgggcagtgtttctgggggtgaggccggtgtggaaggatggagagtgggaggagtcggtttttggtcgggagacattcctcgttcctgtggagtggaaggatgattggccgaccattaatggcgggcagaaggttactctcaagtctgggccggggctttacgagtatgagccgccggtggcgtggagggatgacttttccagtcccaagctacaactgggctggtatagaaagaacacaccggtgaagatcgactattcccttacggagcggcctaaccatctgcgtctacacggcggcccatacaatctctcctcaccggcatgcccaactctcttcctaaggaagcaatcatctcgtcactgcacctgggagacacgactatctttccaaccctcgtccgtccacgtagaagccggcacggtagtctactggaactacttcaccaacagctcgatcggcgtccgactatccaccgaaggaaagcgtatcgtacgctttcgaccggcagaaggcaaggtccttgaccgggaggtgggccccacctccgatatcatcttcctgatcgaatgcggagacaggtacaggttcggcttcaaagaggtcagcgagggagtcgaaactttggcgcagtggattggggcggttgcgaatagcatcatgactagagcacctccagtcggggcgcctttcacaggcatgatgctgggattgtacagttatggcgagttgcaaaagtgtctcgctcccgctgatttccattacgctgagtttcggtga

SEQ ID NO: 127 - protein, 523 aa, Neosartorya fischeri
MYNNPIIPGFNPDPSIIRVNHDHFLVTSSFEYFPGAPIYHSTDLIRWSLIGHALTKPSQLQIHTPEPGGGIWATTLRYHKGTFYIIAASFERYRPQEDDRVWPRGFYVKTENIWDSDSWSDPVYFDQVGFDQDLFWDDDGTVYLSSTYRKLVRTPGATLKDFAIHIATVDLETGNSTSEPRLIRESASGVAEGSHIFKRGKYYYLFTAEGGTESGHCEWVCRSEVSPFGPWEVGPCNPLWRNGVDDEVQNTGHADLVEDAEGNWWAVFLGVRPVWKDGEWEESVFGRETFLVPVEWKDDWPTINGGQKVTLKSGPGLYEYEPPVAWRDDFSSPKLQLGWYRKNTPVKIDYSLTERPNHLRLHGGPYNLSSPACPTLFLRKQSSRHCTWETRLSFQPSSVHVEAGTVVYWNYFTNSSIGVRLSTEGKRIVRFRPAEGKVLDREVGPTSDIIFLIECGDRYRFGFKEVSEGVETLAQWIGAVANSIMTRAPPVGAPFTGMMLGLYSYGELQKCLAPADFHYAEFR

SEQ ID NO: 128 - DNA, 2415 bp, Aspergillus niger
atggcgcactcaatgtctcgtcccgtggctgccactgccgctgctctgctggctctggctcttcctcaagctcttgcccaggccaacaccagctacgtcgactacaacatcgaagccaacccggacttgtatcctttgtgcatagaaaccatcccactgagcttccccgactgccagaatggtcccctgcgcagccatctcatctgtgatgaaacagccaccccctatgaccgagcagcatcgctcatctcgctcttcaccctggacgagctgatcgccaacaccggcaacaccggcctcggtgtctcccgactgggcctccctgcataccaagtatggagtgaagctcttcacggcctcgaccgtgccaatttcagcgactcaggagcctacaattgggccacctcattcccccagcccatcctgaccaccgcggccctcaaccgcaccctcatccaccaaatcgcctccatcatctctacccaaggccgcgccttcaacaacgccggccgctacggcctcgacgtctacgcccccaacatcaacaccttccgccaccccgtctggggtcgcggacaagaaaccccaggagaggacgtctctctcgccgccgtctacgcctacgaatacatcaccggcatccagggtcccgacccagaatcaaacctcaaactcgccgccacggccaagcactacgccggctatgacatcgagaactggcacaaccactcccgcctgggcaacgacatgaacatcacccagcaagacctctccgaatactacacgccccaattccacgtcgccgcccgcgacgccaaagtccagagtgtcatgtgcgcctacaacgccgtcaacggcgtccctgcctgcgccgactcctacttcctccagaccctcctccgcgacaccttcggatttgtcgaccacggatacgtctccagcgactgcgatgccgcctataacatctacaacccccacggctatgcctcctcccaggctgccgctgccgctgaggccatcctcgccggcaccgacatcgactgcggtaccacctaccaatggcacctgaacgagtccatcgctgcgggagatctctctcgcgatgatattgagcagggtgtgattcgtctctacacgaccctcgtgcaggccggatacttcgactccaacaccacaaaggcgaacaacccctaccgcgacctctcctggtccgacgtccttgagacggacgcatggaacatctcctaccaagccgcgacgcagggcattgtccttctcaagaactccaacaacgtcctccccctcaccgagaaagcttacccaccatccaacaccaccgtcgccctcatcggtccctgggccaacgccaccacccaactcctgggcaactactacggcaacgctccctacatgatcagcccccgcgccgccttcgaagaagccggatacaaagtcaacttcgccgagggcaccggtatctcctccacaagcacctcgggcttcgctgccgccttatccgccgcacaatccgccgacgtgataatctacgccggtggtatcgacaatacccttgaagcggaggcactggatcgagagagtatcgcgtggccgggtaaccaactggacttgatccagaagctcgcctcggcggccggaaagaagccgctcatcgtcctccaaatgggcggcggacaggtcgattcctcttcgctcaagaacaacaccaatgtttctgcacttctctggggcggataccccggccaatctggcggcttcgctttgcgggatatcatcacggggaagaagaaccccgcgggtagactagtcacgacgcagtaccctgccagctacgcggaggagttcccggcgacagatatgaaccttcgtcctgagggtgataaccctggtcagacgtataaatggtacaccggcgaagccgtgtacgagttcggccacgggttattctacacgaccttcgcggaatcctccagcaataccactacaaaggaagttaagctcaacatccaggacattctttcccagacacacgaagacctggcgtcgattacccagctccctgtgctgaactttaccgccaatatcaggaacactggaaagctggaatcggattacaccgctatggtattcgccaatacctctgatgccgggccggcgccgtatcccaagaagtggctggtcgggtgggatcggcttggggaggtgaaggtcggggagacgagggagttgagggtccccgttgaggtggggagctttgcgagggtgaatgaggatggcgattgggtggtgtttccgggaacgtttgagttggcgttgaatttggagaggaaggttcgggtgaaggttgttcttgagggtgaggaggaagtcgtgctgaagtggccggggaaggagtag

SEQ ID NO: 129 - protein, 804 aa, Aspergillus niger; identical to SEQ ID NO: 117

SEQ ID NO: 130 - DNA, 4323 bp, Aspergillus oryzae
gatccgatccacctcgtaaatgtgttagaatgaccagcctttatatccgaaggtccttcatgtaatagctaagaatgcttcaacattgagaggctcgggtttcgggggaaattgcgccgacggtttgagcgcaacagcatccgcaacgaatagcaacatctccctgatgagccagaggagaggtgtccgtgcggtcttatacgaagaggttatttacagccaaaagcttagcagcgacgtccatatatttctgacggacctatcgtggggtactaaccaacgttagcgatcaatcttcccatttacaagttacgctgttaattgcgcgtggtgtggagagattacgtgcaagtagtggcaatgaatctagattccatgcaaggggatataagcctttagtattttttattaaaaagtgttttacgagaggcttgcttacaaagcgtttcttgaatagttaccgacgctgggcttaaatccggcaaatggaatgacttattacccgaggctgaagtgattaggaaacaaacgctgtccacacaaggcgtactattactctatgaatctgctatgaagcttgcctgtgtatctttcaggctaaagacagactaagcattgccaattgatcagcgtcacccgaagaatatcctgccttggatgtctctctaaaactccgcctagaagggaccatgatctcggcatggcccggattctatggcccgactcgggcccatcctgcagaaccctgcaattcagcctgaatggattgggtggttcagcatatatcggaaaatccccgcgtcggaggaggtgatcggctgcgggactttctcgattcgggacttcatctgtgggggtgaagtcaaaatgttggagatgctgcggcaatgccgactttttatccagagatagatgacgtacacagctcaaggaacgcagctaactcccttgccatgcagaatgcaattgcccattgctataaatccgagcccactgccagggtaccagacgaaaagacagctccagcactggaccaccgacaattgccattatgcctggtgcagcgtccatcgtcgccgtcctggcggccttgttgccgaccgctcttggtcaagcaaaccaaagctacgtcgactacaacatcgaagcgaacccagacctcttctctgaatgtctggagaccggtggtacctcattcccagactgcgaaagcggtcccttgagcaagactctggtctgcgatacttcggcaaaaccccatgatcgagctgctgccctcgtctccctcctgaccttcgaggagctggtgaacaacaccgccaacaccggccatggtgcccctagaatcggcctgcccgcgtatcaggtgtggaatgaagctctccacggtgtcgcccatgccgatttcagcgatgccggtgacttcagctggtccacgtccttcccgcagccgatctcgacaatggctgccctcaaccgcaccctaattcaccagatcgccaccatcatctccacgcaaggccgtgccttcatgaacgctggccgctacggactcgacgtctactctcccaacatcaataccttccgccacccagtttggggccgcggccaggaaaccccaggcgaagacgcctactgcctcgcctccacctacgcatacgaatacatcaccggcatccagggcggcgtcgacgccaaccctctcaaactcatcgcaacagcgaagcactacgccggctacgatatcgagaactgggacaaccactcccggctcggtaacgacatgcaaatcacccaacaagacctggccgaatactacaccccccaattcctcgtcgcctcgcgagacgccaaagtccacagcgtgatgtgctcctacaacgccgtcaacggcgtccccagctgctccaactccttcttcctgcaaaccctcctccgcgacaccttcgacttcgtcgaagacggctacgtctccggcgactgcggcgcagtctacaacgtcttcaacccgcacggctacgccaccaacgaatcatccgccgccgcagactccatccgcgcaggaaccgacatcgactgcggcgtctcctacccacgccacttccaagaatccttccacgaccaggaagtctcccgacaagacctcgaacgcggcgtcatccgtctctacgccagcctcatccgcgcaggctacttcgacggcaaaaccagtccataccgcaacataacctggtccgacgtggtgtccaccaacgcccaaaacctctcctacgaagccgccgcccaaagcatcgtcctgctcaaaaacgacggcatcctcccccttacctccaccagttcctccacaaaaaccatcgccctaatcggcccctgggcaaacgcaaccacccaaatgctaggcaactactacggcccagccccctacctaatcagcccgctgcaagccttccaagactcagaatacaaaatcacctacaccatcggcacaaacacaaccaccgacccggactccacctcccaatccaccgccctcaccaccgccaaagaagcagacctaatcatcttcgccggcggcatcgacaacaccctcgaaaccgaagcccaagaccgcagcaacataacctggccctccaaccaactctccctaataaccaagctcgcggacctaggcaaacccctcatcgtcctccaaatgggcggcgggcaggtcgactcctccgccctgaagaacaacaagaacgtcaacgccttgatttggggcggatacccgggtcagtcgggtggacaggccctggccgatatcatcacggggaaacgggcccccgcggctcggctagttacgacgcagtatccggctgagtacgccgaggtgttcccggctattgatatgaatctgagaccgaatgggtcgaatccaggacaaacttatatgtggtataccgggacgccggtttatgagtttggacatgggctgttttatactaatttcactgcttctgcttctgcgggtagtgggactaagaatcggacgtcgtttaatatcgatgaggttctgggacgcccgcatcctgggtataagctggtggagcagatgccgttgttgaattttacggtcgacgtgaagaatactggagacagggtgtcggattatactgccatggcgtttgtgaatacgactgctgggccggcgccgcatcctaataagtggctggttgggtttgatcggttgagtgctgtcgagcctgggtcggcgaagactatggttattccggtgacggtggatagtctggctcggactgatgaggaggggaatcgggtgttgtatcctggacggtatgaagtggcgttgaataatgagagggaggtggttttgggatttacgctcacgggggagaaggctgtgcttttcaagtggcctaaggaggagcagttgattgcgccgcagtagattgggatagttctattttgatgtaatgatgtggtttgctagaaagatatgaagagagagtactgcttatgatagattcattctatatgcaatttcatggtgattcaaacgtgactgtgtaggaatggtgtaaaccaagacatgctagttcctccgtcaacgatctcatcagcatcgttgttctattttacggtaactgtgcttcacgaagtagaaggctttgtctcaatcatctgaacaagctcatcatactcgcccgtattgcgcaacatatcccagaagatgccttctttcttgacaaggttggcgggcgtatcgttcctattgtgtccgttagtatcagcacaatactacaaatcactcagtttgattaatagatcgaggaaggaacatactcaataatctccccatcggccataacaagcacccgatcatagtccataatggtcctcagccgatgcgcgatagcgataatagtgcaatcagggaacatctccctcaggacacgctgcatatgcatatccgtctcatggtcaacggatgccgtcgcctcgtccagcagcacgacctttgaccgtcgacacatggcccgggcgagactgagcacctgacgctggccctggctgaagttctcgccgttagccgccacaggcgtatccagggcgagaggacgggccgttttggcgggatgggcgtggtctgcctggtcgctgccgtcagggacatggatggaggtgcaggctgccagggcggaggcaagttctgtttcgctggactcgccgaatgggtcgaggttcgagtggacgtcccccgaaaaaaggactggttcttgcgggatcaaggttacgctggtgcgaagtcggttgaggaggatc

SEQ ID NO: 131 - protein, 798 aa, Aspergillus oryzae
MPGAASIVAVLAALLPTALGQANQSYVDYNIEANPDLFSECLETGGTSFPDCESGPLSKTLVCDTSAKPHDRAAALVSLLTFEELVNNTANTGHGAPRIGLPAYQVWNEALHGVAHADFSDAGDFSWSTSFPQPISTMAALNRTLIHQIATIISTQGRAFMNAGRYGLDVYSPNINTFRHPVWGRGQETPGEDAYCLASTYAYEYITGIQGGVDANPLKLIATAKHYAGYDIENWDNHSRLGNDMQITQQDLAEYYTPQFLVASRDAKVHSVMCSYNAVNGVPSCSNSFFLQTLLRDTFDFVEDGYVSGDCGAVYNVFNPHGYATNESSAAADSIRAGTDIDCGVSYPRHFQESFHDQEVSRQDLERGVIRLYASLIRAGYFDGKTSPYRNITWSDVVSTNAQNLSYEAAAQSIVLLKNDGILPLTSTSSSTKTIALIGPWANATTQMLGNYYGPAPYLISPLQAFQDSEYKITYTIGTNTTTDPDSTSQSTALTTAKEADLIIFAGGIDNTLETEAQDRSNITWPSNQLSLITKLADLGKPLIVLQMGGGQVDSSALKNNKNVNALIWGGYPGQSGGQALADIITGKRAPAARLVTTQYPAEYAEVFPAIDMNLRPNGSNPGQTYMWYTGTPVYEFGHGLFYTNFTASASAGSGTKNRTSFNIDEVLGRPHPGYKLVEQMPLLNFTVDVKNTGDRVSDYTAMAFVNTTAGPAPHPNKWLVGFDRLSAVEPGSAKTMVIPVTVDSLARTDEEGNRVLYPGRYEVALNNEREVVLGFTLTGEKAVLFKWPKEEQLIAPQ

SEQ ID NO: 132 - DNA, 5021 bp, Aspergillus oryzae
ctgcagaacctgcaattcagcctgaatggattgggtggttcagcatatatcggaaatccccgcgtcggaggaggtgatcggctgcgggactttctcgattcgggacttcatctgtgggggtgaagtcaaaatgttggagatgctgcggcaatgccgactttttatccagagatagatgacgtacacagctcaaggaacgcagctaactcccttgccatgcagaatgcaattgcccattgctataaatccgagcccactgccagggtaccagacgaaaagacagctccagcactggaccaccgacaattgccattatgcctggtgcagcgtccatcgtcgccgtcctggcggccttgttgccgaccgctcttggtcaagcaaaccaaagctacgtcgactacaacagcgaagcgaacccagacctcttctctgaatgtctggagaccggtggtacctcattcccagactgcgaaagcggtcccttgagcaagactctggtctgcgatacttcggcaaaaccccatgatcgagctgctgccctcgtctccctcctgaccttcgaggagctggtgaacaacaccgccaacaccggccatggtgcccctagaatcggcctgcccgcgtatcaggtgtggaatgaagctctccacggtgtcgcccatgccgatttcagcgatgccggtgacttcagctggtccacgtccttcccgcagccgatctcgacaatggctgccctcaaccgcaccctaattcaccagatcgccaccatcatctccacgcaaggccgtgccttcatgaacgctggccgctacggactcgacgtctactctcccaacatcaataccttccgccacccagtttggggccgcggccaggaaaccccaggcgaagacgcctactgcctcgcctccacctacgcatacgaatacatcaccggcatccagggcggcgtcgacgccaaccctctcaaactcatcgcaacagcgaagcactacgccggctacgatatcgagaactgggacaaccactcccggctcggtaacgacatgcaaatcacccaacaagacctggccgaatactacaccccccaattcctcgtcgcctcgcgagacgccaaagtccacagcgtgatgtgctcctacaacgccgtcaacggcgtccccagctgctccaactccttcttcctgcaaaccctcctccgcgacaccttcgacttcgtcgaagacggctacgtctccggcgactgcggcgcagtctacaacgtcttcaacccgcacggctacgccaccaacgaatcatccgccgccgcagactccatccgcgcaggaaccgacatcgactgcggcgtctcctacccacgccacttccaagaatccttccacgaccaggaagtctcccgacaagacctcgaacgcggcgtcatccgtctctacgccagcctcatccgcgcaggctacttcgacggcaaaaccagtccataccgcaacataacctggtccgacgtggtgtccaccaacgcccaaaacctctcctacgaagccgccgcccaaagcatcgtcctgctcaaaaacgacggcatcctcccccttacctccaccagttcctccacaaaaaccatcgccctaatcggcccctgggcaaacgcaaccacccaaatgctaggcaactactacggcccagccccctacctaatcagcccgctgcaagccttccaagactcagaatacaaaatcacctacaccatcggcacaaacacaaccaccgacccggactccacctcccaatccaccgccctcaccaccgccaaagaagcagacctaatcatcttcgccggcggcatcgacaacaccctcgaaaccgaagcccaagaccgcagcaacataacctggccctccaaccaactctccctaataaccaagctcgcggacctaggcaaacccctcatcgtcctccaaatgggcggcgggcaggtcgactcctccgccctgaagaacaacaagaacgtcaacgccttgatttggggcggatacccgggtcagtcgggtggacaggccctggccgatatcatcacggggaaacgggcccccgcggctcggctagttacgacgcagtatccggctgagtacgccgaggtgttcccggctattgatatgaatctgagaccgaatgggtcgaatccaggacaaacttatatgtggtataccgggacgccggtttatgagtttggacatgggctgttttatactaatttcactgcttctgcttctgcgggtagtgggactaagaatcggacgtcgtttaatatcgatgaggttctgggacgcccgcatcctgggtataagctggtggagcagatgccgttgttgaattttacggtcgacgtgaagaatactggagacagggtgtcggattatactgccatggcgtttgtgaatacgactgctgggccggcgccgcatcctaataagtggctggttgggtttgatcggttgagtgctgtcgagcctgggtcggcgaagactatggttattccggtgacggtggatagtctggctcggactgatgaggaggggaatcgggtgttgtatcctggacggtatgaagtggcgttgaataatgagagggaggtggttttgggatttacgctcacgggggagaaggctgtgcttttcaagtggcctaaggaggagcagttgattgcgccgcagtagattgggatagttctattttgatgtaatgatgtggtttgctagaaagatatgaagagagagtactgcttatgatagattcattctatatgcaatttcatggtgattcaaacgtgactgtgtaggaatggtgtaaaccaagacatgctagttcctccgtcaacgatctcatcagcatcgttgttctattttacggtaactgtgcttcacgaagtagaaggctttgtctcaatcatctgaacaagctcatcatactcgcccgtattgcgcaacatatcccagaagatgccttctttcttgacaaggttggcgggcgtatcgttcctattgtgtccgttagtatcagcacaatactacaaatcactcagtttgattaatagatcgaggaaggaacatactcaataatctccccatcggccataacaagcacccgatcatagtccataatggtcctcagccgatgcgcgatagcgataatagtgcaatcagggaacatctccctcaggacacgctgcatatgcatatccgtctcatggtcaacggatgccgtcgcctcgtccagcagcacgacctttgaccgtcgacacatggcccgggcgagactgagcacctgacgctggccctggctgaagttctcgccgttagccgccacaggcgtatccagggcgagaggacgggccgttttggcgggatgggcgtggtctgcctggtcgctgccgtcaggacatggatggaggtgcaggctgccagggcggaggcaagttctgtttcgctggactcgccgaatgggtcgaggttcgagtggacgtcccccgaaaaaaggactggttcttgcgggatcaaggttacgctggtgcgaagtcggttgaggaggatcttggtgatgtcgactccatcgatggttatctgaccagaggcgatgttcacaaatcgtaataacgatagtccaagggtgcttttgccacttcctgttcgaccgacgaggccaatgcgctcccctggattcgcgacgaaagacacattgcgtaggacgtcggggccgtcttcctggtatcgcgcggtgacgttatgaaactcgacacggccggatgtaggccagctggctgggacgactgaggattttgcgtggtcttcactcaggtgttcctcaggttcgatatctgcgtattcacgcacccgttggaaacagttcagctcgacttccagctcgttcattgtccgcacaaggttcaggatattctggctgagaccgatggcattggtcaatgagaaaccaaccagcccggctggtccagaccaaaagtaggccacgcagccggccgcggctgcaacagatgcggcacagagatccgatcggacggatatccaacggttgcagttatactgtgtttccgcggagcgagcatgaacagctagtttctcggcgaggagcctctggaacacgagatccatatccttgcgggcacgaatcacgcacaggccagacagagaatcggtaaaatgtgaaaacactggagagtagttgatggatgtcagccgcttgatggagacctgagtgcgagtgtacatctctccgatgatgaacccaaccgtgcatataacagctgccggaagagcaaatataggcataatagaggcaacactggcaatgcgaagcaagaaccgcaacccgttctcaatggacatccgcagccagtctatcagaactgtgtctagcgaccgtgtgtcatttccaaaccggttaatcaatcgtccgattggattctggtcgaaccaggaaatgggggcagatagaaccgctgtcaccaatcgcctgtgcatcttttttgcagctgaccagctcccgtactgatagaggagattaccacttagctgtagcaacaggaagaggatgattgatgcggcgtagacccctaaatagtaaagggaatttgcattctcgtactcctcgtaggcacgcatccaaatagaaagccagtaggtgatcgcaaagtaagcaagttgcactgcgatagtcacagccattgctagaagcgcgtagcaaggcccgccgaataagaggatgtattgtaaggcttgagaaaatggttaggcgtgctttgagaagtttacggggtgtaacatacctaaagtgcgcggcacacggccagtagctgatgtttcctttgctatgcgcgatacctgtggactttgttgctcatgtgcaggggcaatggtggttgtaggctctgaaggaacatcaaggggttcttctactatcagggggttacactaaggataacgaatccgtgtctgttgcagggtgtactgcga

SEQ ID NO: 133 - protein, 798 aa, Aspergillus oryzae
MPGAASIVAVLAALLPTALGQANQSYVDYNSEANPDLFSECLETGGTSFPDCESGPLSKTLVCDTSAKPHDRAAALVSLLTFEELVNNTANTGHGAPRIGLPAYQVWNEALHGVAHADFSDAGDFSWSTSFPQPISTMAALNRTLIHQIATIISTQGRAFMNAGRYGLDVYSPNINTFRHPVWGRGQETPGEDAYCLASTYAYEYITGIQGGVDANPLKLIATAKHYAGYDIENWDNHSRLGNDMQITQQDLAEYYTPQFLVASRDAKVHSVMCSYNAVNGVPSCSNSFFLQTLLRDTFDFVEDGYVSGDCGAVYNVFNPHGYATNESSAAADSIRAGTDIDCGVSYPRHFQESFHDQEVSRQDLERGVIRLYASLIRAGYFDGKTSPYRNITWSDVVSTNAQNLSYEAAAQSIVLLKNDGILPLTSTSSSTKTIALIGPWANATTQMLGNYYGPAPYLISPLQAFQDSEYKITYTIGTNTTTDPDSTSQSTALTTAKEADLIIFAGGIDNTLETEAQDRSNITWPSNQLSLITKLADLGKPLIVLQMGGGQVDSSALKNNKNVNALIWGGYPGQSGGQALADIITGKRAPAARLVTTQYPAEYAEVFPAIDMNLRPNGSNPGQTYMWYTGTPVYEFGHGLFYTNFTASASAGSGTKNRTSFNIDEVLGRPHPGYKLVEQMPLLNFTVDVKNTGDRVSDYTAMAFVNTTAGPAPHPNKWLVGFDRLSAVEPGSAKTMVIPVTVDSLARTDEEGNRVLYPGRYEVALNNEREVVLGFTLTGEKAVLFKWPKEEQLIAPQ

SEQ ID NO: 134 - DNA, 1608 bp, Vibrio sp. XY-214; identical to SEQ ID NO: 114

SEQ ID NO: 135 - protein, 535 aa, Vibrio sp. XY-214 [sequence omitted]

SEQ ID NO: 136 - DNA, 1917 bp, Thermoanaerobacterium sp. 'JW/SL YS 485'
atggaataccatgtggctaaaactggctcagatgaagggaaaggaacgcttaaagatccgtttctgactataaataaggctgcgtctgttgcaatggctggcgacacaattatagtccatgaaggagtatacagggaatgggttaaaccaaagtataaagggttaagcgacaaaagaaggattacgtacaaggcggcagaaggcgaaaaagtagtgataaaagggtcagagaggattcaaagttggcagcgcgttgaaggaaacgtgtggagatgtcaactgcccaattcattttttggagaattcaatccgtacaaagaggaagtttttggagactggcttcttacagtcaatgaaaagaagcaccttggagatgtgtacttaaatggcatgtcattttatgaagtcacaaattatgaagatctttttaatccgcagcttaggacagaggtcctggatcattggacacaaaagattgtgcctattaaaaacgcagaacagacgaagtacgtttggtatgccgaagtagacagggagaagacgacgatttacgctaattttcaaggtgctgatccaaacgaagaatttgtggaaataaatgtcaggagatcgtgcttttatcctgttgaaaccggaatagactatattacagtcaaaggttttgagatggcgcatgcggctacaccatgggcacctccaacagcagaccagcctgggcttataggtcctaactggagcaaaggttggataatagaggacaatatcatacacgacgccaaatgcagcgctataagcatcgggaaagaggctacaacaggcaacaattatcgctctatacggaaagacaagcctggataccagtatcaattggaagcggtatttaatgcaaagaggaatggttggtctaaagaaaagataggttcacatataatacgaaacaatacgatctacgattgtggacaaaatgccatcgtcggacatttgggaggcgtctttagcgaaatttacaataaccatatttacaacatcgcactgaaaagagaattctacggccatgagatagcagggattaagttacacgcggctatagatgtgcagattcatcataatcgcattcacgattgctcattggggttatggctggattgggaagcgcaaggcacaagggtcagcaaaaatctgttctacaataataacagggatgtgtttgttgaagtaagccatgggccgtatcttgttgatcacaatatattatcttctgaatacgccatagacaacatgtcacaaggcggagcgtatataaacaatctaatcgcaggcaagatgaatcagagaaaagtgctaaaccgctctactcaatatcatctcccacacagcactgaagttgcaggatttgcatttgtatacgggggagacgatcgattttacaacaatatcttcataggaaaagaaggattagagaatgttgggacttcccattacaataattgcacgacgtctttagaggagtacattgaaaaggtaaatgaagtacctggtgatttaggagaatttgaacgcgtagaacaaccggtctacatcaataaaaatgcatacttcaatggtgcagagccatttgagaaagaaaaagacaatcttgttaaaaaggacttcgacccgaaacttgccataattgatgaaggagatgaagtttacctttcactgcaattgccagatgaattcgaaaatattgtaggtgatatccattcaacaaagacattggaaagagtgcggattgtggatgcggagtatgaaagtccagatggcaaagagctggttttggatactgactatttagatgcaaaaaagccggagaatagttcaataggccctatagcgcttttgaaaaaaggaaataattacataaaagtttggtaa

SEQ ID NO: 137 - protein, 638 aa, Thermoanaerobacterium sp. 'JW/SL YS 485'
MEYHVAKTGSDEGKGTLKDPFLTINKAASVAMAGDTIIVHEGVYREWVKPKYKGLSDKRRITYKAAEGEKVVIKGSERIQSWQRVEGNVWRCQLPNSFFGEFNPYKEEVFGDWLLTVNEKKHLGDVYLNGMSFYEVTNYEDLFNPQLRTEVLDHWTQKIVPIKNAEQTKYVWYAEVDREKTTIYANFQGADPNEEFVEINVRRSCFYPVETGIDYITVKGFEMAHAATPWAPPTADQPGLIGPNWSKGWIIEDNIIHDAKCSAISIGKEATTGNNYRSIRKDKPGYQYQLEAVFNAKRNGWSKEKIGSHIIRNNTIYDCGQNAIVGHLGGVFSEIYNNHIYNIALKREFYGHEIAGIKLHAAIDVQIHHNRIHDCSLGLWLDWEAQGTRVSKNLFYNNNRDVFVEVSHGPYLVDHNILSSEYAIDNMSQGGAYINNLIAGKMNQRKVLNRSTQYHLPHSTEVAGFAFVYGGDDRFYNNIFIGKEGLENVGTSHYNNCTTSLEEYIEKVNEVPGDLGEFERVEQPVYINKNAYFNGAEPFEKEKDNLVKKDFDPKLAIIDEGDEVYLSLQLPDEFENIVGDIHSTKTLERVRIVDAEYESPDGKELVLDTDYLDAKKPENSSIGPIALLKKGNNYIKVW

SEQ ID NO: 138 - DNA, 1234 bp, Penicillium herquei
ccggcagcgttacccttcaactgccgcagattcattccaaatcacgctcttataccatctgcagattgacactacatccccggacaggcccataaagagacgtcaacatggatcccaaacccctcatcacgcatctctacacagcagacccttccgcacacgtgttcaacggcaaactatacatctacccctcccacgaccgggagacagatattgccttcaacgacaatggcgaccaatacgacatgaccgactaccacgtcttctcgatggactccatcgacggcccagtagaggattccggcgtcgttctctccgccaaggacgtcccctgggtctccaagcagatgtgggcaccagacgcagccaccaagaacggaaaatactatctcgttttcccagcccgagatcaggagggtatcttccgcattggcgtcgccatttctgactcgcccacgggtcccttcgctcccgagaagaactatatcccgggcagttacagtatcgacccggctgtttttgttgatgaggatgagaagccttacttgtacttcggcggcatttggggtggacagctgcagtgctgggagaagtcgggctctgaggtcaaggagggcgatgagatgaacggactcgtcttcaatgcttccaagtccggtccgcaagagccttctggggatggtgttccggcgttgtgtccgcgtgtgggccagctgagcgatgatatgctcacattcgtctcgcctccgcaagagctacagattctggctccggagactggcgagcccattgcggctgatgatcatgagagacgcttctttgaggctgcgtggatgcatcgctacaacggtcaatattacttctcgtactctacgggtgactcgcattatcttgtctacgcgaccggatcatcgcccttggggccgttcacctaccagggtcgtatcctggagccagtgcttggatggaccacgcatcactccattgtggagttccagggcaagtggtacttgttctttcatgattgcgagctttcgggaggtgtgaatcatctgagatctgtcaaggtgcgggagattgtgtacgatgcggaggggaagattcacttggcttaattgttacttttgtaaacttataccttggaaggaattaaagggaccaaatgggagttttgcagaaatctgacagacaaaagaattaccaaaactcaacagatggaagaaaaaaaaaaaaa

SEQ ID NO: 139 - protein, 335 aa, Penicillium herquei
MDPKPLITHLYTADPSAHVFNGKLYIYPSHDRETDIAFNDNGDQYDMTDYHVFSMDSIDGPVEDSGVVLSAKDVPWVSKQMWAPDAATKNGKYYLVFPARDQEGIFRIGVAISDSPTGPFAPEKNYIPGSYSIDPAVFVDEDEKPYLYFGGIWGGQLQCWEKSGSEVKEGDEMNGLVFNASKSGPQEPSGDGVPALCPRVGQLSDDMLTFVSPPQELQILAPETGEPIAADDHERRFFEAAWMHRYNGQYYFSYSTGDSHYLVYATGSSPLGPFTYQGRILEPVLGWTTHHSIVEFQGKWYLFFHDCELSGGVNHLRSVKVREIVYDAEGKIHLA

SEQ ID NO: 140 - DNA, 2249 bp, Bifidobacterium adolescentis
gcatgctcatggcctaccagatgatcaacgtctaccagctgtacatcatccagaactacatcggccagtccgtcaaggaatccgccgtcaccgtgtccgtcgtgtccatgatcatgatggtcatgtccctggttggctccttcatctccggcccggtctccgatctcatcggccgccgcaaggtcccggtcgtcgtcgcttccgtgctcttcgccgtcggcatcgccatgccgtggatcttcaagtccaccatgggcatgtacctgttcgccggcatcgcaggcctcggctacgccgtctactccgccgtcgaccaggcgctgctggtggacgtgctgccgaacaaggaagaggccggcaaggatctgggcatcctgaacatggccaccaccctcggccagatgtgcggcccggtcgtcatgtccgccatcgtggtcaacctcggctacaacttcgcgttcccgacgtccatcgtattggccatcatcggctgcttcttcatcatggccatcaagaaggtcaagtaaggcagctgctgtaaaccgggggagacggtcgtgccataggccgtctcccctccgcgggaccgaatcgccccgcctcccatccatgccaaccatcaacgaatatccgaattatcaacgacgataccaaggaacatcatgaccacctggattgcaacgacgcaagacgacaagcttgccgaccgaacctccgacatcgaatccaccaacgccaccaccgcggccgacctgcagctcgacggcaacgaataccaggccctgcgcggcttcggcggctgcttcaacgaactcggctggctgccgctgcagaacgtcagcgaagccgaacgcgaccagatcatcaaggagctgttcagccccgacgagatgaacttcaccttcaaccgcgcccccgtcggcgccaatgacttcgccgaccactggtacagctacgacgaggtcgacggcgactacgggatggagcatttctccgtcgaacacgacgagcagaccctgatcccgtacatccaccgcgcacaggaatggcagccgaacatgcagctgttctccagtccgtggagcccgccgacgtggatgaagcgcccgaaggcctacaattacggccgtctcgtgcagaccccggagaacctgaaggcctacgccaagtacttcgtcaagtacatccaggcctatgccgagcacggcatcaccgtgaaccagctgcacgtgcagaacgaggtgttcgccgaccagaagttcccgagcgccctgtgggattccgaagcgctcaaggtgttcatccgcgactacctcggaccggcgttcgacgaggccggactcgacaccgacatctggctgggcaccctcaacggcccggaggacatggcttggaccggcggcggctatggcatgacgctcaacaactacaaccgcttcgtcgacaacatcctcttcgacgacggcgcacgcaagtacatcaagggcatcgcctatcagtgggccggccagaactgcatcgcccgcacgcacgaatcatggccggagatcgagctgatccagtcggagtccgaatgcggcaccggcgacaacagctgggagtacgcggagtacatcttccacctgatcaaccactacttccgcaacggcgccaccgcatacacctactggaacatgatcctcgacgaccaggattccacatggggctggtggcagaactccctgttcaccatcaccgccgacaagcacgaggtgcgccgcaatccggaatactacgtgatgcgccacttctcgcattacgtcaggcccggcgcgaaggtactcggcaccaccggccacttcaactcgatggccatcgccttccgcaacccggacggcacggtggtggttgtggcacagaacgccctcgacgaggagcgtccgttcgcattcgccgatcccgatgccgccgaacacggcttcaaggtaacgcttgctccgcgatcgttcaacaccttcgtgctggactgagccggagtgatacggcgtcggttcgcgcgtaatgccggtttttccctttttcccggcgatatgccgatcaccggcgccctgccatgagatgcgcttcctgccctgtcagcagcgtctcattgtgtaggattggctcatccgcattacggggtgggtggagcctgttgctctcccgcgcgatagtctcagggaaatatgagcaaagaagagcggataccgaaaacgtgttcgcaaggtacc

SEQ ID NO: 141 - protein, 448 aa, Bifidobacterium adolescentis
MTTWIATTQDDKLADRTSDIESTNATTAADLQLDGNEYQALRGFGGCFNELGWLPLQNVSEAERDQIIKELFSPDEMNFTFNRAPVGANDFADHWYSYDEVDGDYGMEHFSVEHDEQTLIPYIHRAQEWQPNMQLFSSPWSPPTWMKRPKAYNYGRLVQTPENLKAYAKYFVKYIQAYAEHGITVNQLHVQNEVFADQKFPSALWDSEALKVFIRDYLGPAFDEAGLDTDIWLGTLNGPEDMAWTGGGYGMTLNNYNRFVDNILFDDGARKYIKGIAYQWAGQNCIARTHESWPEIELIQSESECGTGDNSWEYAEYIFHLINHYFRNGATAYTYWNMILDDQDSTWGWWQNSLFTITADKHEVRRNPEYYVMRHFSHYVRPGAKVLGTTGHFNSMAIAFRNPDGTVVVVAQNALDEERPFAFADPDAAEHGFKVTLAPRSFNTFVLD

SEQ ID NO: 142 - DNA, 3460 bp, Aspergillus awamorii
agctggataatacgtgggcgcagagggtcaagatcacgtttgaggatggggaggtggtggagaagttgttgaaggcgccgaagggagtccatcctggggtgacgaatgaggaggtgttgcagaagtggcgggctgtgacgaagggggtaatttcggaagagaggcagaagaagatcgaggaggtggtgttgaatttggaagaggtggaggatgtggctggtgttttgggcgagttgttgaggggcgagacggtgaatgtgctgcagtagacgattaccccatttggacggggatggcttcatatttcccaagcgatggcacgccatagaaagggcacatttacccggtgcctgagcgaaactctacttcgaagaacaatgccaatgtttaactatcttgttttaattgctaaatgcaagcattccaagttcttcctaatgccggctaaatcattcaggctaaacccccgcgatgaagtcaatcggtcattctccggcgcatctccgcatctccgcaaaccgctatcccctctaccccagattcagtccccggccacctttctatcccccccacagactggctcaaccatggcgcactcaatgtctcgtcccgtggctgccactgccgctgctctgctggctctggctcttcctcaagctcttgcccaggccaacaccagctacgtcgactacaacatcgaagccaacccggacttgtatcctttgtgcatagaaaccatcccactgagcttccccgactgccagaatggtcccctgcgcagccatctcatctgtgatgaaacagccaccccctatgaccgagcagcatcgctcatctcgctcttcacgctggacgagctgatcgccaacaccggcaacaccggcctcggtgtctcccgactgggcctccccgcataccaagtatggagtgaagcgcttcatggcctcgaccgtgccaatttcagcgactcaggagcctacaattgggccacctcattcccccagcccatcctgaccaccgcggccctcaaccgcaccctcatccaccaaatcgcctccatcatctccacccaaggccgtgccttcaacaacgccggccgctacggcctcgacgtctacgcccccaacatcaacaccttccgccaccccgtctggggtcgcggacaagaaaccccaggagaggacgtctctctcgccgccgtctacgcctacgaatacatcaccggcatccagggtcccgacccagagtcaaacctcaaactcgccgccacggccaagcactacgccggctatgacatcgagaattggcacaaccactcccgcctgggcaacgacatgaacatcacccagcaagacctctccgaatactacacgccccaattccacgtcgccgcccgcgacgccaaagtccagagtgtcatgtgcgcctacaacgccgtcaacggcgtccctgcctgcgccgactcctacttcctccagaccctcctccgcgacaccttcggattcgtcgaccacggatacgtctccagcgactgcgatgccgcctataacatctacaacccccacggctatgcttcctcccaggctgccgctgccgctgaggccatcctcgccggcaccgacatcgactgcggtaccacctaccaatggcacctgaacgagtccatcactgcgggagatctctctcgcgatgatattgagcagggtgtgattcgtctctacacgaccctcgtgcaggccggatacttcgactccaacaccacaaaggcgaacaacccctaccgcgacctctcctggtccgacgtccttgagacggacgcatggaacatctcctaccaagccgcgacgcagggcattgtccttctcaagaactccaacaacgtcctccccctcaccgagaaagcttacccaccatccaacaccaccgtcgccctcatcggtccttgggccaacgccaccacccaactcctgggcaactactacggcaacgctccctacatgatcagcccccgcgccgccttcgaagaagccggatacaaagtcaacttcgccgagggcaccggtatctcctccacaagcacttcgggcttcgctgccgccttatccgccgcacaatccgccgacgtgatcatttacgccggtggtatcgacaatacccttgaagcggaggcactggatcgagagagtatcgcgtggccgggtaaccaactggatttgatccagaagctcgcctcggcggccggaaagaagccgctcatcgtcctccaaatgggcggcggacaggtcgattcctcttcgctcaagaacaacaccaaggtttctgcacttctctggggcggataccccggccaatctggcggcttcgctttgcgggatatcatcacggggaagaagaaccccgcgggtagactagtcacgacgcagtaccctgccagctacgcggaggagttcccggcgacagatatgaaccttcgtcccgagggtgataaccctggtcagacgtataaatggtacaccggcgaagccgtgtacgagttcggccacgggttattctacacgaccttcgcggaatcctccagcaacaccactacgaaggaagttaagctcaacatccaggacattctttcccggacacacgaagagctagcctcaattacccagctccctgtgctgaacttcaccgccaatatcaggaacactggaaagctggaatctgattacaccgctatggtattcgccaatacctctgatgccggtccggcgccgtatcccaagaagtggctggtcgggtgggatcgccttggggaggtgaaggttggggagacgagggagttgagggtccccgttgaggtggggagctttgcgagggtgaacgaagatggtgattgggtgttgtttccggggacgtttgagttggcgttgaatttggagaggaaggttagggtgaaggttgttcttgagggtgaggaggaagtcgtgctgaagtggccggggaaggagtagaaagtactattctgttaatggctctaggggatgagagccagtctattactgaatatgcatagaaagtactattctgttaatggctctaggggatgagagccagtctattactgaatatgcatagtggtgatacgatgtatatagctctatgaagtaattagtccatgtgagaatacccttcagtccacaattagtatgctgttattcgtaaatggtgattatttctgatttatagtaacggtagcgatggtcacacacacaacttaatgttccctggtgtacaggaggtagtaattctaatgaccacttggaagaaagacagcaagaaagagtaagaaagggaaatcgatcaaaaaataaggccatctacagcctattcacatttagccggatctgctatacagctacagaaataaagtttgttaggctgcttgctagcatagctcctactattctaa

SEQ ID NO: 143 - protein, 804 aa, Aspergillus awamorii
MAHSMSRPVAATAAALLALALPQALAQANTSYVDYNIEANPDLYPLCIETIPLSFPDCQNGPLRSHLICDETATPYDRAASLISLFTLDELIANTGNTGLGVSRLGLPAYQVWSEALHGLDRANFSDSGAYNWATSFPQPILTTAALNRTLIHQIASIISTQGRAFNNAGRYGLDVYAPNINTFRHPVWGRGQETPGEDVSLAAVYAYEYITGIQGPDPESNLKLAATAKHYAGYDIENWHNHSRLGNDMNITQQDLSEYYTPQFHVAARDAKVQSVMCAYNAVNGVPACADSYFLQTLLRDTFGFVDHGYVSSDCDAAYNIYNPHGYASSQAAAAAEAILAGTDIDCGTTYQWHLNESITAGDLSRDDIEQGVIRLYTTLVQAGYFDSNTTKANNPYRDLSWSDVLETDAWNISYQAATQGIVLLKNSNNVLPLTEKAYPPSNTTVALIGPWANATTQLLGNYYGNAPYMISPRAAFEEAGYKVNFAEGTGISSTSTSGFAAALSAAQSADVIIYAGGIDNTLEAEALDRESIAWPGNQLDLIQKLASAAGKKPLIVLQMGGGQVDSSSLKNNTKVSALLWGGYPGQSGGFALRDIITGKKNPAGRLVTTQYPASYAEEFPATDMNLRPEGDNPGQTYKWYTGEAVYEFGHGLFYTTFAESSSNTTTKEVKLNIQDILSRTHEELASITQLPVLNFTANIRNTGKLESDYTAMVFANTSDAGPAPYPKKWLVGWDRLGEVKVGETRELRVPVEVGSFARVNEDGDWVLFPGTFELALNLERKVRVKVVLEGEEEVVLKWPGKE

SEQ ID NO: 144 - DNA, 2201 bp, Bacillus pumilus
ctgcagggagtattacagcaggtgcttacatgtgggcactcattcctgaaaccgttgaatatggcgaatataaaacagggaaaagaatgggtggactgatttacgcagtgattggcttcttctttaaatttgggatggccttaggcggcatcgttccagggcttgtccttgaccgatttggttatattgcaaatcaagtgcaaacaccagaagctttactgggcattttaatcacgacaacggtgattcctgtatgcttactcattttagcgatggttgatattaatttttataacctagatgaagaaaaacataaaaaagtcatacgagagcttgagaatagagacaaggtgtatatcgatcatatggacgattttaaaatgtagttctctgaaagaggaggaagttcaattgaagattactaatccagtgctcaaaggatttaaccctgacccaagtatttgccgtgcgggagaggactattacatggcggtttctacatttgaatggttcccgggggtgcaaatttatcactcgaaggatctcatccattggcggctcgccgcgcgtcccttgcaaaaaacttctcaactcgatatgaaaggaaatcctgattccggcggggtatgggcaccgtgtttaagttatgcggatggtcagttttggctcatctattcagatattaaagtagtagatggtccgtttaaggatggtcataattatttggtcacagctgatgcagtagatggtgagtggagcgatccggttcggctcaatagttctgggtttgatccttccttgttccatgatccaagcggaaagaaatacgtgttgaatatgctgtgggaccatcgagaaaaacatcactcctttgcaggtatagccttgcaggaatatagtgtatctgaaaaaaaactggtcggtgagcggaaggtcatttttaaaggcacgccaatcaaactcacagaagccccgcatctttattacatcaatgatgtctattatttattaacagctgaagggggaacacgttacgaacatgcagccacaatcgcccgttcctcgcgtattgatgggccgtacgaggttcatcctgacaacccaattttaacggcttttcacgcgcctagccatccactacaaaaatgcgggcatgcttccattgtacaaacgcatacaaatgaatggtatttggctcatctgactggccgcccaattcattcaagtaaggaatccatttttcagcaaagaggctggtgccctttaggaagagagacagccatacaaaagcttgaatggaaagatggctggccgtatgtggtaggcggaaaagaggggctcctagaggttgaagcgcctgcgatgagcgtaaaagagttctctccaacctatcacatagtcgatgaatttaaagattcatcgttaaatagacatttccaaacattaagaatcccatttacggatcagattggttcagtgacggaaaatcctcatcatttaaggctgtatgggcaggaatctttaacgtctaaatttacccaagcgtttgttgcgaggcgctggcaaagcttttattttgaagcagagacagcggtttccttctttccgaaaaactttcagcaagcggcaggtcttgtgaattattataatacggaaaattggactgcacttcaggtgacttatgacgatgcgcttggccgtatccttgagttatctgtgtgtgaaaacctggccttttctcagccgctaattaaaaaaatcatcatcccagacgagattccgtatgtgtatttaaaagtgaccgttcagagagagacgtacacgtattcttattcttttgatcaacaagagtgggaaaaaatagatgtaccgcttgaatcgacccatttgtcagatgattttattcgaggaggggggttctttacaggggcttttgttggaatgcagtgccaagacacaagcggtgaacgtctgcctgccgattttaagtattttcgatacgaagaaacaactgaataaaaaaagacaacactctaaaggctgtctctctttaacatgtattccatcatggtgaaggcgtgacatcacgcaaaaaagcttcagtgacaagagatgtcatccctaaggctggtgcgttttgtcctaatgatgaaggaagcagctccacccgtgagctgaattgtgcatccattctagaattc

SEQ ID NO: 145 - protein, 535 aa, Bacillus pumilus
MKITNPVLKGFNPDPSICRAGEDYYMAVSTFEWFPGVQIYHSKDLIHWRLAARPLQKTSQLDMKGNPDSGGVWAPCLSYADGQFWLIYSDIKVVDGPFKDGHNYLVTADAVDGEWSDPVRLNSSGFDPSLFHDPSGKKYVLNMLWDHREKHHSFAGIALQEYSVSEKKLVGERKVIFKGTPIKLTEAPHLYYINDVYYLLTAEGGTRYEHAATIARSSRIDGPYEVHPDNPILTAFHAPSHPLQKCGHASIVQTHTNEWYLAHLTGRPIHSSKESIFQQRGWCPLGRETAIQKLEWKDGWPYVVGGKEGLLEVEAPAMSVKEFSPTYHIVDEFKDSSLNRHFQTLRIPFTDQIGSVTENPHHLRLYGQESLTSKFTQAFVARRWQSFYFEAETAVSFFPKNFQQAAGLVNYYNTENWTALQVTYDDALGRILELSVCENLAFSQPLIKKIIIPDEIPYVYLKVTVQRETYTYSYSFDQQEWEKIDVPLESTHLSDDFIRGGGFFTGAFVGMQCQDTSGERLPADFKYFRYEETTE

SEQ ID NO: 146 - DNA, 2575 bp, Pyrus pyrifolia
gggagaaaaatacacaatattccagttttttaaaatatggcatacaatattgccaaactctcacttctttctcttctgttcttattttcttccctctgcagcatggcagttgtgcatgctcgtccacccttcgcctgcgaccctcgaaacccgataaccagaacgttgaagttctgcagggtgagggtgccaatccacgttagggttcaggacttgatcggacggctgacattgcaggagaagatcgggctgttggtgaacaatgccattgctgtgcctaggcttggcattcaggggtacgagtggtggtctgaggcgcttcatggtgtgtccaacgtggggcctggaaccaagttcggtacctttcttggggctactagcttccctcaagtcatcaccacagctgcttccttcaatgagtcgctctgggaggaaatcggacgggttgtgtctgatgaagcaagggcaatgtacaacgggggcgcggctggactaacattttggagcccaaatgtgaacatatttcgtgacccgaggtggggaagggggcaagagactcctggggaagaccctgtcttggctgccaagtatggtgctaggtatgtcaagggcctccaaggtgatggtgctgggaatcgccttaaggttgctgcatgctgcaaacattacactgcctatgatctcgataactggaacggtgtcgatcgcttccacttcaacgctagggttagcaagcaggacttggaagacacatataacgtgcccttcaaagcctgtgtggtggatgggaatgttgctagtgttatgtgctcctacaaccaggtcaacggaaagcctacttgtgctgaccctgatctcctcaaaggcacaatccgtggtcaatggaaactcaatgggtatatcgtctcggattgtgattcagttggtgtttattatgataaccaacattacaccaaaacaccagaagcagcagctgcatacgcaattaaagcaggtttggatttggattgtgggccattccttggcatccacacagaggcggccataaggactggccaggtaaacgagattgacattaactatgcgttggctaacacaatcacggtccagatgagattgggaatgtttgatggtgaaccgtcaactcaacgatatggaaacctgggcctagcagatgtgtgcaaaccatccagcaatgagctagcccttgaagctgccagacaaggcattgttctgcttgaaaaccgtgggaattcgctacccctctcaaccatacgccaccgtactgtggcagtaatcgggcccaattctgatgttacagaaacaatgattggaaattatgctggtattgcatgtggttacactacaccactacaaggaatagcgaggtacacaaggaccatacaccaagctgggtgcacagatgttcattgcaatggaaatcaactaattggtgctgctgaggttgcagctagacaagctgatgcaaccgttttagtaataggccttgaccaatcaattgaagcagagttcagagaccggactggccttctcttgcctggacaccaacaagagctggtgtctagggtggccagggcttctagggggccaaccattctggtcataatgtcaggcggccctattgatgtgacgttcgcaaagaatgacccttgcattggagcgattatttgggttgggtatccaggccaggctggaggaaccgccattgctgatgttctattcggcactacaaacccaagtggaaagctccctatgacatggtaccctcaaaattatgtggccaacctgccaatgacagacatggctatgagagcagacccagcaagagggtatcctggtaggacctatagattttacaagggcccagttgtgttcccatttgggatgggcctaagctacaccagattctcccactccttagcccaggggcctacactggtctcggtcccactgaccagcctcgtcgctgccaaaaacacaaccatgctaagcaaccacggcgtccgagtcagccacacaaactgcgactcactctcactcgatttccacattgacatcaaaaacactggaaccatggatgggacccacactcttctagtgttcgcgacccagccggcaggaaaatgggcccccaacaagcagctggttggatttcacaaggtccatatcgtggccggatcggagagacgggttagggttggcgtccacgtgtgcaagcacctcagcattgttgacaaattggggatccggagaatcccattgggccaacacaaactggaaattggtgacctgaagcattatgtttctattgaagcaaatttaggagagattaagttttaattaggagctatcaaaaaattgatagtcacacccaaaaaatattatatgggattcgtaatcaattagtaattagtcctattccttttcgaagtcaaagaatgggaaagaaaaacgaaagttctactgtaaaactaaaaggaaagacgatccaaagataatatatgggtaaattacaaaaaaaaaaaaaaaaaaaaaaaaaaaaaaaaaaaaaaaa

SEQ ID NO: 147 - protein, 774 aa, Pyrus pyrifolia
MAYNIAKLSLLSLLFLFSSLCSMAVVHARPPFACDPRNPITRTLKFCRVRVPIHVRVQDLIGRLTLQEKIGLLVNNAIAVPRLGIQGYEWWSEALHGVSNVGPGTKFGTFLGATSFPQVITTAASFNESLWEEIGRVVSDEARAMYNGGAAGLTFWSPNVNIFRDPRWGRGQETPGEDPVLAAKYGARYVKGLQGDGAGNRLKVAACCKHYTAYDLDNWNGVDRFHFNARVSKQDLEDTYNVPFKACVVDGNVASVMCSYNQVNGKPTCADPDLLKGTIRGQWKLNGYIVSDCDSVGVYYDNQHYTKTPEAAAAYAIKAGLDLDCGPFLGIHTEAAIRTGQVNEIDINYALANTITVQMRLGMFDGEPSTQRYGNLGLADVCKPSSNELALEAARQGIVLLENRGNSLPLSTIRHRTVAVIGPNSDVTETMIGNYAGIACGYTTPLQGIARYTRTIHQAGCTDVHCNGNQLIGAAEVAARQADATVLVIGLDQSIEAEFRDRTGLLLPGHQQELVSRVARASRGPTILVIMSGGPIDVTFAKNDPCIGAIIWVGYPGQAGGTAIADVLFGTTNPSGKLPMTWYPQNYVANLPMTDMAMRADPARGYPGRTYRFYKGPVVFPFGMGLSYTRFSHSLAQGPTLVSVPLTSLVAAKNTTMLSNHGVRVSHTNCDSLSLDFHIDIKNTGTMDGTHTLLVFATQPAGKWAPNKQLVGFHKVHIVAGSERRVRVGVHVCKHLSIVDKLGIRRIPLGQHKLEIGDLKHYVSIEANLGEIKF

SEQ ID NO: 148 - DNA, 3420 bp, Clostridium stercorarium
ttcatccataaaggaatatccgatagaggcagcggctgagactgcatcgagaaactggggagggaaaacggttattatacattgcgacagctgcggtgcggaaactgttatggatgcaaaccggttaacggcagaatgcgctttctgcggttcaatacatatcagaacccagtccaatgaggacgttattaagcctgaatcccttgttccgttcaaaattgacaagcaaactgcaataaataagttcaggacatggcttaaaaaacgctatctgtcaccgggcaacctaaaaattttggcacgggaagagaaaatacatggagtgtatattccgttctggacgttcgatgccgacacaaactctttttacactgccgaaaagggaatatactactatgacaccgagcgtgtttatgtgaaggacggaaaaggcggaggacggtatgagcagagaagagtcagaaaaacccgctggtaccctacatcaggcgtatacagacattactttaacgacgttttggtatgtgcttcaaatcaggaaggaaggaacctgataaaaagaattgaacctttttatacaacggagctggttccgtacagaagtgaatatttgccgggcttttgcgccgaaaaatacagtattggccttgaggagggattcattgaagcaagagcgagaatggattccgagctgagaaaacttatcaccaggcacattgctgccgatgaggtaaggaatttaagagtacgaacgtcttattcaaacgtaaaattcaaacatatccttttgcccgtgtggatagctgcatacagatacggggacaggatatacaaatttgttgtaaacggccagaccgggctggtaaagggtgaagcgccagtcagtatcgtaaaggcgcgcaatagctgttgtggtattgctcttattgtgctgtattatttaccgcacaaacggttagcatgcttacttatgttgtccggattggcagaaaaccacagaagtagtataatattgaccggtatttccacagttttcttttaggctgtggcagtaaatgacggcgataggcggaatacaatgcggaggaggatatttctatggcaagggaaatcacaataccggctgccggtaagccttttaaaaacaacgccaccttctgcgtgggaagcggaagattaggactggcactgcagaaggaatacatagaccatttgaaaattgtccaggaacgcatccattttaaatatatccgcgggcacgggctgttctgcgatgatgtgggaatataccgcgaaaccgaagaggacgggaagcacgtcgcctactataattttacataccttgaccgcattatagattcttttcttgaacacgatataagaccgtttcttgaattgggatttatgcctgaaaagctgaaatccggggaacagacaatattctactggaaaggaaataccacgccccctgtttcgtatgaaaaatgggccgaacttgtggaaactacgttagcccatcttatcgacaggtatggagcggaagaggttataacatggccggttgaagtctggaatgaacccaatatagctttttgggcgggaacaatggaagagtatttcaaactgtatgagtattccgcaaagcgtgaaagggttgatccgaataaagtcggcgggccggtgatatgtggtatagaaaccgaaaaatggctgcgtgccttttttgagcattgcatagaaaataatttgcctctggatttcgtaagccggcattgttatactgtgggaaagccggtgcgcaaggggcagtttatttatcatgaaatattcagtccaacgtatatgatagaggaattaaaggaaacaagaaaaataatggccgattatccgcagattgctaatctgccgctgcatataaccgaatttaacagttcttacgttcctgtatgcccggtgcatgacacaactttccaggctgcatatattgcgaggattctcagtgaggccggtgaatatgccgattcctattcttactggacattcagtgatgtttttgaggaatatgacgttccaagatcggcgtttcacggaggttttggccttgtggcgctgaattcaattaaaaaaccggtatttcatacttttgaattttttgccaatgcgggcaaggaactgctttaccgcgatgagaatctgattgttacaagggatgacaaaagatatgttataataggctggaactaccatgacacaagaaagggtgagccgggcccggataaagagtatgtactctcaattccctccatcgggcagcaggcaatactgattaaaaagcaggtgggagggaattatgccaatccgctgcagacatggagcaatctgggaaagccacggacgctgaataaggaacaaagaaaaatactgatggcggcgtctgaaccgcttcagacagatgtgaaactgtttgacgaaaagggtttttataaagtgaaactgaccattcagtgcaatcatctgtatatgctggaaattctgcctgttaaggattttaccgatacatatgacggttttgaaccggatgaattttttggacttgaataaaaataaaaaatcagtctctggtatacacgaccgagaggggacttgttctggcaaaggacgcgttccctttttttctgtaattacttggtgaaggttttgcaatatttattgaaagctctgttgaactgggaaaaacttgaaaaaccgcattgagtggcaatgtcggttatttttttgtctgtgaacagaagaagctgttgggcgtttcttatccttgtcatctgaatgtaatcggtcagggaaaaacctgtaacttccttgaataaatgggacaaataatacttgctgaggaaaaacttgtttgcaagtacgctgagggataaatcctcattatagtgattgtgaatatatgcggtgattgaataaatttttgaagcaggagtattaagggtttcaggcatataaatgttttcattccggtgattgtatattgtgcataaaagatctatgaacctgcagtgaatggataaatcccgaaccggggttttcggatttggatattataaaaatgtcgttcagagtatctataattttatccttgttattctgctcaaaacggtaaatgggcaaaggcgcttcaaaaatactcagcagttcgtttaaattatcctgcaatatccctgtctgcgcaggtatgttgaactggattatcagcctttttttcggcggacctttcggatactcggatttgtgaaggctataaggtttcaggcatacaaaatccaaaaattcaattctgtaaaggttaccttcgattatgtggttggcatgatcatcgagtaaaacgtgtatttcgtaaaaattatgaaaatgctggaa

SEQ ID NO: 149 - protein, 500 aa, Clostridium stercorarium
MAREITIPAAGKPFKNNATFCVGSGRLGLALQKEYIDHLKIVQERIHFKYIRGHGLFCDDVGIYRETEEDGKHVAYYNFTYLDRIIDSFLEHDIRPFLELGFMPEKLKSGEQTIFYWKGNTTPPVSYEKWAELVETTLAHLIDRYGAEEVITWPVEVWNEPNIAFWAGTMEEYFKLYEYSAKRERVDPNKVGGPVICGIETEKWLRAFFEHCIENNLPLDFVSRHCYTVGKPVRKGQFIYHEIFSPTYMIEELKETRKIMADYPQIANLPLHITEFNSSYVPVCPVHDTTFQAAYIARILSEAGEYADSYSYWTFSDVFEEYDVPRSAFHGGFGLVALNSIKKPVFHTFEFFANAGKELLYRDENLIVTRDDKRYVIIGWNYHDTRKGEPGPDKEYVLSIPSIGQQAILIKKQVGGNYANPLQTWSNLGKPRTLNKEQRKILMAASEPLQTDVKLFDEKGFYKVKLTIQCNHLYMLEILPVKDFTDTYDGFEPDEFFGLE

SEQ ID NO: 150 - DNA, 3025 bp, Clostridium stercorarium
tcaatatcacaggatttgcggtatatcaattaagaacagacggcacgtacaagagagtaggaacggacaaaatcaccgctgaaaataccaagtcggtctccctgtatctggacaaacccttgtcatacggcgggaaagtggtaatggtgattataaagtaaacctgcatcggatatttaggaaggctttgcgggaggaatgacattccggctctttctggacaagatatgagcagtttatgacaaatgatgattagtattcgcacatggcattcgggtagaatggagatgataaaaaagacggttttaaatcgtgcacagggagggtaagtgatggaaaacaaacctgtttatctggatccgagttattcgtttgaagaacgcgcaaaagatcttgtgtcaaggatgaccattgaggaaaaggtatctcagatgctttacaattcacctgcaatcgaaaggctcggaattcctgcatataactggtggaacgaagcacttcacggtgtggcgcgggccggaacggcgaccatgttcccgcaggctatcggaatggcggctacgtttgacgaagagcttatttataaagtggcggatgttatttcaacagagggcagggcaaaataccatgcaagcagtaaaaaaggcgatcgcgggatatataagggtttaacattctggtcccctaatatcaacatattcagggatccaagatggggacgcggccaggaaacctacggggaggatccttacctcacggcaaggctcggtgttgcctttgtaaaaggcctgcagggaaaccatccgaaataccttaaggctggcggcatgtgcaaaaacattttgccgttcacagtggtccccgaatccttaaggcatgaatttaatgccgtagtgtccaaaaaggatctgtatgagacctatctgccggcttttaaggctttggttcaggaagcaaaagttgaatcggtgatgggagcgtataaccgtacaaacggtgaaccctgctgcggcagtaagacccttctttccgatattctcagaggggaatggggatttaagggacatgtggtatccgactgctgggcaatacgcgatttccatatgcaccatcatgttacggcaacagctcccgaatcagccgcccttgcagtacgcaatggctgcgatctgaactgcggaaacatgttcggaaacctgttaatagcccttaaggaaggcttgatcactgaagaggagatagacagagccgtaacaaggcttatgattacaagaatgaaactgggaatgttcgatcctgaagatcaggtgccttatgcatcgatttcgtccttcgtcgattgcaaggaacacagagagctcgcgctggacgtggcgaaaaaatccattgtcctgctaaagaatgacggcctgttgccgcttgacaggaagaaaatcaggtccatcgccgttataggcccgaatgccgacagccgccaggctctgattggaaactacgaaggaacggcgtcggaatatgtaaccgttcttgacggaatcagggaaatggcaggggacgatgtaaggatttactattcagtcggctgtcatttatacaaggacagagttgagaacctcggcgaacccggggacagaatcgcggaggcagttacctgtgccgaacacgccgacgtggttatcatgtgccttggccttgattcaaccattgaaggcgaagaaatgcatgaaagtaatatatacggttcgggcgacaagcctgatcttaaccttccggggcagcagcaggaactgctggaggctgtttacgccaccggtaagccgattgttcttgtactgcttacaggaagtgctctggcagtaacgtgggccgatgagcatatcccggcaatactgaacgcatggtatccgggggcgctgggaggaagggcaattgcctcggtactgttcggtgaaaccaacccgtcagggaagctgccggttacattctatcgtaccaccgaagaacttcccgactttacagattactcaatggaaaacagaacctacaggtttatgaagaatgaagcgctgtacccgtttggatttggtttgagctatacgacgtttgactacagcgatctgaagctgtcgaaggatacaatcagggcaggggaaggctttaacgtttcggtaaaggtaacgaataccgggaaaatggccggtgaagaagtggtccaggtttacatcaaggatttggaagcaagctggagagttcccaactggcagctttcgggaatgaagagagtaaggcttgaaagcggtgaaactgctgaaattacttttgaaatacggcctgaacagctggctgttgttaccgatgagggaaaaagcgttatcgagccgggtgagtttgaaatttatgtcggcggctcgcagccggatgcaagaagcgtcaggcttatgggaaaagcgccgctgaaagccgtgctgcgcgtgcagtaattgccatgcaacatcttgtcccctctctctttttaatttagaatgagagagggatatttatgcatatagaaaatcttgtggaaatggatatgtttcctgagccgtttccggtaagggttatatataacagggacaaaaagttcacatacccgtcccactggcataatgccattgaaatcgccgttgcggcgaaaaagagctcgggtattgttattaataaccgtctgatacgttagaggaaggcgatatagtttatatttcaggccgggatattcacggctatcccctgtcccccggcagtgagcggatatttattattttcgaccttaaccagctgaataacggcaacatatttcatgaagaatatccctatatataaaaaccattctgataaaaaaggacgtcaacaccgaacttcactcacaggtatacaggctgatagaggaaatgcttaaagaggcgtcaaatattgttttaggttcaaggttctcaatactttccaaaaatatacgaaattttagccgttaatagtgaaaggcctcgaa

SEQ ID NO: 151 - protein, 715 aa, Clostridium stercorarium
MENKPVYLDPSYSFEERAKDLVSRMTIEEKVSQMLYNSPAIERLGIPAYNWWNEALHGVARAGTATMFPQAIGMAATFDEELIYKVADVISTEGRAKYHASSKKGDRGIYKGLTFWSPNINIFRDPRWGRGQETYGEDPYLTARLGVAFVKGLQGNHPKYLKAGGMCKNILPFTVVPESLRHEFNAVVSKKDLYETYLPAFKALVQEAKVESVMGAYNRTNGEPCCGSKTLLSDILRGEWGFKGHVVSDCWAIRDFHMHHHVTATAPESAALAVRNGCDLNCGNMFGNLLIALKEGLITEEEIDRAVTRLMITRMKLGMFDPEDQVPYASISSFVDCKEHRELALDVAKKSIVLLKNDGLLPLDRKKIRSIAVIGPNADSRQALIGNYEGTASEYVTVLDGIREMAGDDVRIYYSVGCHLYKDRVENLGEPGDRIAEAVTCAEHADVVIMCLGLDSTIEGEEMHESNIYGSGDKPDLNLPGQQQELLEAVYATGKPIVLVLLTGSALAVTWADEHIPAILNAWYPGALGGRAIASVLFGETNPSGKLPVTFYRTTEELPDFTDYSMENRTYRFMKNEALYPFGFGLSYTTFDYSDLKLSKDTIRAGEGFNVSVKVTNTGKMAGEEVVQVYIKDLEASWRVPNWQLSGMKRVRLESGETAEITFEIRPEQLAVVTDEGKSVIEPGEFEIYVGGSQPDARSVRLMGKAPLKAVLRVQ

SEQ ID NO: 152 - DNA, 5448 bp, Aeromonas punctata
gtttgatacgtgccagtaacgataggaacaactgatcatcaatgtcaaaatgcatacaaaaataggtaaaacccttgccgttatggctctggctggaatgaatacttccgggaggaatcaggagcagttcgccagccttttgaatatatagggtgccgttcaccatcatgcgttgctcgccttccgtgacataattcaattcatattgagggtgctcatgcgccggataatcccagtccgtacctacacttcgtaaatgaatggcgaacagattaaccgttgtttgcacatctggaaaaaaaatttcatggacactttctcccaaagtaggaggcaaatacgttgaagacatggaagatcccccttttatatagaggttgttcaaaaaatgcgatttcgaactcgaatttatatcgaatggaatggttttgtgtaaccgctttaatccattatagtctatcagcttgatttgggtaaatatccgattgatttgatcatggtctgaggtggaaccgcgtgttaggatggggctaatgaaaacgtatgcaaactattctgagaggggttataattcgtgagcacattcaaatccatcttttataatgcacatcacgctccgattggtgcttttgcgagttttacactgggatataaaggagccaaaggcgggttgggtcttgaactcggcaagccggcggaccaaaatgtatatattggattacaatctcgcgatggagagaattatcaggcgcttcctttttatgaagcttcccaggatgagagcagccgctatgatgtagagaagttggataacggggacacagcgtcgataacggcgtcccaagttccacaacctcttattacggcttttcgcgatgaagatattacccgtgaattcacctcaggtacggatacatggactgctggagatctgacgttccgtatctactcgcctgttcgtccagtacctgatccaacgaatggggatcgtgaagaattaatggatgcactcgtacctgccgtattggttgagatgacaatagacaatacggaaggtcaacaaccccgcaaagcctactttggctatcagggcaatgatccgtactctgcgatgcgtctgattggggggcctgaaggtggctccatcacaggtgtgggacaaggtcgactcacagcgattatgtcggcagatgacggactgtggcccgcacgcggatttacgctggagaaactcttgcaagagaaacatcgggagaatctggcatttggacttggctcaaccgctgcactactgatggaagtgccggctggagagaaacgtacgtatcaatttgcagtatgtttctatcgcgggggcattgtgacgaccggaatggacacaacgtattggtatacgcgctatttctccgatattcaggcagcaggagagtatgcactacaacgcttcagtgaattgaccgcttcctgtggagagattgaacagcgccttggaacggctgctttgaccgaagatcaatcattcatgctggctcattccattcacagctattatgccagtactcaactgctggatgccgatggcgagccactctgggtggtgaacgaaggggagtatcggatgatgaacacacttgatctgacagctgatcagttgtacttcgagcttgccttgaatccatggacggtgcgtaatgagctggagtggtttgtaaaacgatacagttatacggatgaggttcgttttccaggggaagaaaagttatatccgggcggcattacctttacccatgatattggtgtagcgaatgtgttctcacgccctggacactcggcatatgaactggttggcattgacgactgtttctcacagatgagccacgaggaactggtgaactggctctgctgcgcgacagtatacattgaacagacacaggatcaagcttttgtgaaaaacatgttgcctattatccaggattgcttcgaaagtatgcttaatcgtgaccatcccgatgctgagcatcgtaacggtctaatgggtctggatagcagccgtacccaaggtggagcggaaattacaacctatgacagcctggatgtgtcacttggtcagtctcgcaataatatctatctggcgggtaaatgttgggcgatctatgttgcattggaaaagctgtttgcaacggagaagttggccaatctgtcccatcaagcagggcttcaagcggatcgctgcgctgccagcattgctgcacagttgactgatggcggttacattccagctgttattgcagaaaataatgattctcgaattattccggcgattgaaggtctggtgttcccgtactttactggctgtgaagcagcactggatgtgaagggtcgttttggaccttatctgaaagctcttcaaactcatctgaagacggttcttgtaccgggaacatgcctgttcgaagatggaggctggaaactgtcctcaacaagcaataactcgtggttaagcaaaatctatttgtcccagtttatcgctagagagctgctagatgtggaatgggatgagacaggcaaggcagcagacgcggcgcatgtcaactggctgctgcatccggaggaatcctactggtgctggagcgatcagatcctgtcaggtgtggcggttggcagcaagtactatccgcgtggtgtaacgtcgattctatggctactcgaaggaaaagggaatcgtcttacgcagatctatgctagcaaggaggcggtacaatgaaccaatccgtcgttcaaaatgccttgtcaggtccacagtatgatgcgtggctggggtaccacttcgaattgccaagagcgaatggacttgcccaaaagacggctcctgcgtggagcaagctgatactcgcggaagagaaccatggagtaatcacaacagctctaaccgaactttcacgaggactggagaagttgtatggcgtgaaaccgtcggtcagtcatctgtctgatactcagcaaagtgagcgggacaataacgcttccgctcccgcgatacgaatcggtacttggacagggagcaattcggtggctggttcgttcagtgagaaagagcgttcaactgttcaaggagaagggtacatcattcgtgagaccgagggtgtactggtcattggatcagagaccccccaaggtgtgctgtatggtgcattccatctgcttcgggaactgacaatggatcaaggaagtgcaactaaggcggatgacgctgtgagcaagtggagcttcattacagagcagcctaccaatgcactgcgaatgattaatcagtgggataacgtggacggaagcattgaacggggttacgctggagactcgattttctacgataacggggaattcacactggacttggaacgcatcagagattatgcacgcttgcttgcttcgacgggtatcaatgccatatcgatcaacaacgtcaatgtacaccggcgtgagagtctgtttctgacagaacgttatcttggtgatgtagcgaaggtggccgctgaattcagagcgtatggcattcgattgttcctgagcgccaactacgcaagtccaatcgagattggtggattgcagacggcagatccgctggatgcgaaggtacgggaatggtggaacattcaaacggcgaaggtgtatgcagccattccggattttgggggttacctgatcaaggcagattccgagaatcgaccgggtccgttcacgtataatcgggatcatgccgatggtgcaaacatgctggctgaagctcttcggccattcggtggattggtgatctggcgttgcttcgtctataactgcaagcaagattggcgggatcgttccacagaccgtgcacgggcagcctatgaccactttacgccgctggatgggcgttttgccgacaatgtcattttgcagatcaagaacgggccgatggactttcaggtgagggaagcggtatccccgctgttcggcgccatggaaaatacaaatcaggtgattgaatttcagattacgcaggagtataccgggcaacaacgtcatctctgttatcttgttccccagtggaaagaagtattggactttgacacatacgccaagggtaaaggttcagagatcaagcgaatcgcggacggttctctgtataaaagacctcacagtggcttcgccgcagtatccaatatcggtgcagatgcctgttggacaggacatcccctcgcgcaggcgaatctgtatggatacggaagacttgcgtggaatccggagctgtctgccgaagagattgccgatgagtgggtgagactcacatttggccatgaagacgaagttgtgcggaaggttacgggcatgcttttgacttcattagatatctatgagaattacacggcgcctctcggtgtgggttggatggtgaatccggaacatcattacgggccgaatgtagatggatatgagtattccaaatggggcacgtatcactttgccgattgtcatggcattggtgtagatcgaaccgtgaacagcggtacaggatacacttcacagtatcaccctgagaatgctgatcgctatgaatccgtagatacctgtccagatgagctgatcttatttttccatcatgtgccgtacacccatgttctgcattccggtaaaacggtcattcagcatatttatgatacacactttgaaggtgttgcgcaggcggaggcgttagccgagacatggagacagctggagggcaaaatcgacccagtcattttcatagatcgaaccgtaacagcggtacaggatacacttcacagtatcaccctgagaatgctgatcgctatgaatccgtagatacctgtccagatgagctgatcttatttttccatcatgtgccgtacacccatgttctgcattccggtaaaacggtcattcagcatatttatgatacacactttgaaggtgttgcgcaggcggaggcgttagccgagacatggagacagctggagggcaaaatcgacccagtcattttcagcaaagttgcttcattacaggacaaccaggccgaacatgcgaaggaatggcgggacatgatcaatacgtacttctatcgaaagagcggcattgcggatgaacaaggtagaacgatctattgattggtgatgtgaagagagaagataccttgttttctttgatgtaaactagacagcatggatatacatgaggaggagaaccgtatgggacaatatcaactacccgagaccatgaaggccgctgtcatgacagagccaggacacattattattgaggaacaacctgtcccgcaaccggcagcggatgaggtgttaatccaagtgatggctgttggggtgtgtggctcggatgtgcattattttgaacatggacgcattggcagatttgtcgtggaaaaaccgatccgaattc

SEQ ID NO: 153 - protein, 729 aa, Aeromonas punctata
MSTFKSIFYNAHHAPIGAFASFTLGYKGAKGGLGLELGKPADQNVYIGLQSRDGENYQALPFYEASQDESSRYDVEKLDNGDTASITASQVPQPLITAFRDEDITREFTSGTDTWTAGDLTFRIYSPVRPVPDPTNGDREELMDALVPAVLVEMTIDNTEGQQPRKAYFGYQGNDPYSAMRLIGGPEGGSITGVGQGRLTAIMSADDGLWPARGFTLEKLLQEKHRENLAFGLGSTAALLMEVPAGEKRTYQFAVCFYRGGIVTTGMDTTYWYTRYFSDIQAAGEYALQRFSELTASCGEIEQRLGTAALTEDQSFMLAHSIHSYYASTQLLDADGEPLWVVNEGEYRMMNTLDLTADQLYFELALNPWTVRNELEWFVKRYSYTDEVRFPGEEKLYPGGITFTHDIGVANVFSRPGHSAYELVGIDDCFSQMSHEELVNWLCCATVYIEQTQDQAFVKNMLPIIQDCFESMLNRDHPDAEHRNGLMGLDSSRTQGGAEITTYDSLDVSLGQSRNNIYLAGKCWAIYVALEKLFATEKLANLSHQAGLQADRCAASIAAQLTDGGYIPAVIAENNDSRIIPAIEGLVFPYFTGCEAALDVKGRFGPYLKALQTHLKTVLVPGTCLFEDGGWKLSSTSNNSWLSKIYLSQFIARELLDVEWDETGKAADAAHVNWLLHPEESYWCWSDQILSGVAVGSKYYPRGVTSILWLLEGKGNRLTQIYASKEAVQ

SEQ ID NO: 154 - protein, 698 aa, Aeromonas punctata
MNQSVVQNALSGPQYDAWLGYHFELPRANGLAQKTAPAWSKLILAEENHGVITTALTELSRGLEKLYGVKPSVSHLSDTQQSERDNNASAPAIRIGTWTGSNSVAGSFSEKERSTVQGEGYIIRETEGVLVIGSETPQGVLYGAFHLLRELTMDQGSATKADDAVSKWSFITEQPTNALRMINQWDNVDGSIERGYAGDSIFYDNGEFTLDLERIRDYARLLASTGINAISINNVNVHRRESLFLTERYLGDVAKVAAEFRAYGIRLFLSANYASPIEIGGLQTADPLDAKVREWWNIQTAKVYAAIPDFGGYLIKADSENRPGPFTYNRDHADGANMLAEALRPFGGLVIWRCFVYNCKQDWRDRSTDRARAAYDHFTPLDGRFADNVILQIKNGPMDFQVREAVSPLFGAMENTNQVIEFQITQEYTGQQRHLCYLVPQWKEVLDFDTYAKGKGSEIKRIADGSLYKRPHSGFAAVSNIGADACWTGHPLAQANLYGYGRLAWNPELSAEEIADEWVRLTFGHEDEVVRKVTGMLLTSLDIYENYTAPLGVGWMVNPEHHYGPNVDGYEYSKWGTYHFADCHGIGVDRTVNSGTGYTSQYHPENADRYESVDTCPDELILFFHHVPYTHVLHSGKTVIQHIYDTHFEGVAQAEALAETWRQLEGKIDPVIFIDRTVTAVQDTLHSITLRMLIAMNP

SEQ ID NO: 155 - DNA, 3493 bp, Clostridium stercorarium
gatatctactagtttaagctatgatacagatggtgggtgtttagctgattgaagtgattaattaacaactgcaacaaaatggtttgacagtcttcacggtgacgaaatgatataggacggggtacgtgaaatcaatcttgatgcatttccggacgtaaccttccgttggcacgccgagaagctcgaagcagtaactgacaaagaaatagttccgctttacacaggtatgccgatctggaacgtctatttctaacattccgaattagctgagcataaaactctttcgttccttcatattcttgagtgatgcctccaatgtgtttcgctattgcacctaatgcctttttcgccgccaaaaacaggtcatttgctgttaagtattcactacactttcgataaccaaaatgacattacctacatagcttggtgaagtcagaaattctcgctttgattttaacagaggataatatttcttcagaacattaaacttcagcaattcatagcaatccattgctccgaaatgaatgtttaagggtaaatctttaagcttaatttgtttggtataccttgctttatgttcaatcacgttctcgtcattaaacaacccatataagctgctccctgaccggaaagttgaacattgattcttgcattccgaatctgctcccaataaaacatttctgaatttcgagacggcaaaaaatgatgccgcttccatttcaacagtaacacagccttctgcaatccttttcgtcagcttcctttaaattttaagttttaagtttgtcctattgacaaaactaaaaactgtaattactataaaaatataactaataaataacatttttaacatcattatggggtactggtaaagacgtgatagttattaataaatttaacaaataataacacactgctatcttcgaccgtaaatttactatgtctctaatgtaatatgacataaataatataagtaaaggaggtaaaagtttatgaagcgtaaggttaagaagatggcagctatggcaacgagtataattatggctatcatgatcatcctacatagtataccagtactcgccgggcgaataatttacgacaatgagacaggcacacatggaggctacgactatgagctctggaaagactacggaaatacgattatggaacttaacgacggtggtacttttagttgtcaatggagtaatatcggtaatgcactatttagaaaagggagaaaatttaattccgacaaaacctatcaagaattaggagatatagtagttgaatatggctgtgattacaatccaaacggaaattcctatttgtgtgtttacggttggacaagaaatccactggttgaatattacattgtagaaagctggggcagctggcgtccacctggagcaacacccaaaggaaccatcacagtggatggcggtacttatgaaatatatgaaactacccgggtaaatcagccttccatcgatggaactgcgacattccaacaatattggagtgttcgtacatccaagagaacaagcggaacaatatctgtcactgaacattttaaacagtgggaaagaatgggcatgcgaatgggtaagatgtatgaagttgctcttaccgttgaaggttatcagagcagtgggtacgctaatgtatacaagaatgaaatcagaataggtgcaaatccaactcctgccccatctcaaagcccaattagaagagatgcattttcaataatcgaagcggaagaatataacagcacaaattcctccactttacaagtgattggaacgccaaataatggcagaggaattggttatattgaaaatggtaataccgtaacttacagcaatatagattttggtagtggtgcaacagggttctctgcaactgttgcaacggaggttaatacctcaattcaaatccgttctgacagtcctaccggaactctacttggtaccttatatgtaagttctaccggcagctggaatacatatcaaaccgtatctacaaacatcagcaaaattaccggcgttcatgatattgtattggtattctcaggtccagtcaatgtggacaacttcatatttagcagaagttcaccagtgcctgcacctggtgataacacaagagacgcatattctatcattcaggccgaggattatgacagcagttatggccccaaccttcaaatctttagcttaccaggcggtggcagcgccattggctatattgaaaatggttattccactacctataataacgttaatttcgccaacggcttaagttctataacagcaagagttgccactcagatctcaacttccattcaggtgagagcaggaggagcaaccggtactttacttggtacaatatatgttccttcgacaaatagttgggattcttatcagaatgtaactgccaaccttagcaatattacaggtgtgcatgatattacccttgtcttttcaggaccagtgaatgtggactacttcgtatttacaccagcaaatgtaaattcagggcctacctcccctgtcggaggtacaagaagtgcattttccaatattcaagccgaagattatgacagcagttatggtcccaaccttcaaatctttagcttaccaggtggtggcagcgccattggctatattgaaaatggttattccactacctataaaaatattgattttggtgacggcgcaacgtccgtaacagcaagagtagctacccagaatgctactaccattcaggtaagattgggaagtccatcgggtacattacttggaacaatttacgtggggtccacaggaagctttgatacttatagggatgtatccgctaccattagtaatactgcgggtgtaaaagatattgttcttgtattctcaggtcctgttaatgttgactggtttgtattctcaaaattcaggaacttaagggtatagaccctaatgtggagtacaaaatctggatggcatatataaaaaaagacttggaattgtaccagtgcgacatataatggctttgtaaaatattctgattaaaacggaatgattaaggataggaaaagaacgtattcttttcctgtcttttttatgtaaccttaaaaattacagccaattattcaataaaataatttctgtaaatcagttattcttgaaccaatattaaaagaatttaacccaaggtctttaatgtctggccggattacattatcttctcctgtcattttaaaaaacagttaaatcaagcttttgtcgcaatagaatgaattattatttgggattccaaaccaaagacatatcattaagcagttgtaaaataattggaaacaatcgcgacaataactaaggccacaaaagcccaaggcacatgaactaacggctaaaaaaaggcgagtgttgataatagtgttggccaaagaattatccccgtaatcggtgattttttgttgcaccctctcccttctttattattcaac

SEQ ID NO: 156 - protein, 654 aa, Clostridium stercorarium
MKRKVKKMAAMATSIIMAIMIILHSIPVLAGRIIYDNETGTHGGYDYELWKDYGNTIMELNDGGTFSCQWSNIGNALFRKGRKFNSDKTYQELGDIVVEYGCDYNPNGNSYLCVYGWTRNPLVEYYIVESWGSWRPPGATPKGTITVDGGTYEIYETTRVNQPSIDGTATFQQYWSVRTSKRTSGTISVTEHFKQWERMGMRMGKMYEVALTVEGYQSSGYANVYKNEIRIGANPTPAPSQSPIRRDAFSIIEAEEYNSTNSSTLQVIGTPNNGRGIGYIENGNTVTYSNIDFGSGATGFSATVATEVNTSIQIRSDSPTGTLLGTLYVSSTGSWNTYQTVSTNISKITGVHDIVLVFSGPVNVDNFIFSRSSPVPAPGDNTRDAYSIIQAEDYDSSYGPNLQIFSLPGGGSAIGYIENGYSTTYNNVNFANGLSSITARVATQISTSIQVRAGGATGTLLGTIYVPSTNSWDSYQNVTANLSNITGVHDITLVFSGPVNVDYFVFTPANVNSGPTSPVGGTRSAFSNIQAEDYDSSYGPNLQIFSLPGGGSAIGYIENGYSTTYKNIDFGDGATSVTARVATQNATTIQVRLGSPSGTLLGTIYVGSTGSFDTYRDVSATISNTAGVKDIVLVFSGPVNVDWFVFSKFRNLRV

SEQ ID NO: 157 - DNA, 2640 bp, Clostridium stercorarium
gatcaacgtgctcgcagtatcattcagttccagcactgccgctgcaacgggcagtgttaaactttggccggtggattttaccctggcgtcgtacaaatatgccctcagcaaacgtgagtttctgcagtcgttcctggtttctcttaaaagggttacgctgggttatattgtaaacatggttatgacaatatcggttgcgtatccgctgtcgaaggacaggtcggatttcagggcgagaaatgtttatgcgtggtttttcatcataactatgatgttcagcggcgggctgatacccacgtttgtaaccgttcgtaaacttggccttctggacacggtatgggctttggttcttcccggggcggtgcctgtgttcaatgtcattcttcttatgaactttttcagggaactcccgaaagaaatagaagaagcggcatatatagacggtgcaagccactggaccacgctgttcaggatatatctgccgctgtcgctgccttcgctggcgactatttcgctgtttgtacttgtcggtcactggaacggatggtttgacgggatgatatatatgaacaggcccaaaaactggccgctgcagacatatttgcgtacaattcttattaatccggacataagccagtatcagacttcttcagaggaactggcaaacctgaaagaagtgtcggagcgtactttcaaatcagctcaggtgttcctgggtgcggcaccgatactcgcggtttaccccttcctgcagaaatatttcatgaaggggcttgttatgggaagtgttaagggatgattacacaaacaccccgcggtttattcatattccgtggggttttaatttaggtgaaagtgtggatacaggtgtactgttgtattttgtcctgttatattataatcagaaatatatgaggcaggaggagtaattatgcagcctgacaacaaacattataaatcagccgtacgcaaatggggggatctgggaaacggtttttatagaaatccggttttgaattccgactattcagatcccgatgttatccgtgtgggcggcgatttttacatggtgtgctcggaatttcactatatgggcatgccggttttgcattcaaaggatctggtcaactggaccattataggcagggtttatgattcgttaaagcatgatccgaaatacgacaatatggaaggctatgcaaagggcagctgggcgccggcaataagatatcacaacggcaggttttacgtgtatttctgcacgcctgatgaaggactgtttatgagtactgcgaccgaccctgcggggccatggagtcctttgcatgaggtggtgcgtgttgccggctgggaagacccgtgcccgttctgggatgacgacgggaatgcttatctcggacacagtaccgtaggtgcgggaccgataattatccataaaatgagtcctgacgggacaaagctcctcgatgacggagttatagtttatgtcgggaaaatcgccgaagggacaaagatatataaaagaaacggatattattatttaattattcccgaaggaggagtaaaaacgggatggcagaccgtgctgcggtcaaaaagcatctatgggccgtatgagagaaaagtggtactgcaaactggaaatacgaatataaacggaccccaccagggagcccttgttgagctggaaaacggtgaatcatggtttatgcattttcaggacacgggaatacttgggcgtgtttgccatcttcagccggtaacatgggtggataactggcctctgatgggttgtgacggagaaccggttactgtttaccgaaaaccccgcgcaggaaaggaatacgaaaggacatttcctcagacgtcggatgagttcgacggccctgagctcggccttcagtggcagtggaaccacaacccggttaatgaacggtggtccctttcaaaacgtccgggatatctgacgctggaagcgatgtatgcggaaagtctgctgaaggcaaggaataccctgactcagaaacttatcggtgaaaagggaacggccacgaccgaacttaatacagaaaatcttaaaaacgggcagagggcaggcctggcgtttctcggcggaacacaggaaaattggattggtattgtgagggagggtgaatcttcgtatatcaaagccgttaccgcgggaataagataccacggccctgaaattgaaactccaaatgtatggtttagggccgaaattgatttgaacggaataactcaattttatttcagcacggacaatgaaaactttatacagcttggtgggccgtgcaggctggaggcgggattctggaaaggtgccagaatcgcacttttcagctataacactgtgatggacggcggaagagccgatttcaactggttcagatatgaatttgaataaaaagatttatggagggcgcttatggctgtcgacaggtataacgtggttaccagacataatccggtgataacccggatagatcccttttcaccgctatcggtgggaaacggggaatttgcctttacggccgatatcaccggacttcagactttccccgagttttatgaaaatggcataccgctgtgcacccagtcccagtggggttggcatacaga

SEQ ID NO: 158 - protein, 497 aa, Clostridium stercorarium
MQPDNKHYKSAVRKWGDLGNGFYRNPVLNSDYSDPDVIRVGGDFYMVCSEFHYMGMPVLHSKDLVNWTIIGRVYDSLKHDPKYDNMEGYAKGSWAPAIRYHNGRFYVYFCTPDEGLFMSTATDPAGPWSPLHEVVRVAGWEDPCPFWDDDGNAYLGHSTVGAGPIIIHKMSPDGTKLLDDGVIVYVGKIAEGTKIYKRNGYYYLIIPEGGVKTGWQTVLRSKSIYGPYERKVVLQTGNTNINGPHQGALVELENGESWFMHFQDTGILGRVCHLQPVTWVDNWPLMGCDGEPVTVYRKPRAGKEYERTFPQTSDEFDGPELGLQWQWNHNPVNERWSLSKRPGYLTLEAMYAESLLKARNTLTQKLIGEKGTATTELNTENLKNGQRAGLAFLGGTQENWIGIVREGESSYIKAVTAGIRYHGPEIETPNVWFRAEIDLNGITQFYFSTDNENFIQLGGPCRLEAGFWKGARIALFSYNTVMDGGRADFNWFRYEFE

SEQ ID NO: 159 - DNA, 2760 bp, Thermoanaerobacterium sp. 'JW/SL YS 485'
aagctttcgtcaaccagcaagaacacatggaatagtaaaattttcttatgccaatatgtgataaaagatgtgcttaatatagactttggagacaaagagattgagtgggacaaagtacacgcaatgtggcaacaggtgtcttgcagtgaagattgcgctacagatcaggtaaacagcgatacaggtacgccaagaggaagccgcttgtatccgagacttgtgacaagtgtattgtggatgaaatagactttgggggtcttaacatgattaaagtgatagtgccagatttttccgataagaagttttctgataggtggagatattgtgttggaacaggcagacttggccttgcgctacaaaaggaatacatcgatacattaaaatatgtgaaagaaaacatagactttaagtatataagaggacatggccttttgtgtgacgatgtaggaatatacagagaagatgtggtaggcgatgaaataaagcctttttacaattttacctatatagataggatttttgactcatttttagaaatcggaataaggccatttgtggaaatcggatttatgcctaaaagattagcatctggtacacaggcggtattttattgggaggggaatgtcactcctcccaaggattataaaaagtgggagaacctcataaaagctgtcgtttcgcatttcatatcaaggtacggaatagatgaagtggcaaaatggccatttgaaatttggaatgagccgaacttaaaagagttttggaaagatgctgacgagaaggagtattttaagctgtacaagataactgcaaaggctataaaggaagtaaatgagaatataaaagtaggaggacctgctatatgtggtggtgctgactattggatagaagattttttgaatttctgctatgaggaaaatgttcctgtagattttgtgtcgcgacatgcgtatacgtctaagcaaggcgaatatacgccgcacttaatataccaagagatcatgccgtcggaatacatgctaaacgaatttaaaacggtgagagatatcattaaaaactcgcattttccaaaccttccgtttcacataactgaatacaatacatcttacagtcctcaaaatcctgtacatgatacgccatttaatgctgcctatattgccaggattttaagcgaaggcggagattatgttgattcattttcttactggacgtttagcgacgttttcgaagaaagagatgtgccgcgatcgcaatttcatggaggatttggacttgtggctctaaatatggtaccaaagcctaccttttacacatttaaattttttaatgctatgggagaggaaatgctttatagagatgagcatatgattgtgacgagaagggatgatggctctgttgcgctcatagcgtggaatgaagtcatggataagactgaaaatccagataaagagtatgaagtccagataccagttggattcaaagatgtgtttattaaaagacaattaattgatgaagaacatggcaatccatggggaacgtggatacacatgggtaggccgaggtatcccagcaaaaaagagataaatacgcttagagaaattgcaaagccggagattatgacaagccatgctgttaccaatgatggatacttaaatctaaagtttaaattagccaaaaatgcggttgtgctttatgaattgacagaaaggattgacgaatcgagcacatatataggacttgatgatagcaagataaacggatattgatatgcatttggagggattgatatgggacttttcgacatgccattacaaaaacttagagaatacactggtacaaatccatgccctgaagatttcgatgagtattggaatagggctttagatgagatgaggtcagttgatcctaaaattgaattgaaagaaagtagctttcaagtatcctttgcagaatgctatgacttgtactttacaggtgttcgtggtgccagaattcatgcaaagtatataaaacctaagacagaagggaaacatccagcgttgataagatttcatggatattcgtcaaattcaggcgactggaacgacaaattaaattacgtggcggcaggcttcaccgttgtggctatggatgtaagaggtcaaggagggcagtctcaagatgttggcggtgtaactgggaatactttaaatgggcatattataagagggctagacgatgatgctgataatatgcttttcaggcatattttcttagacactgcccaattggctggaatagttatgaacatgccagaagttgatgaagatagagtgggagtcatgggaccttctcaaggcggagggctgtcgttggcgtgtgctgcattggagccaagggtacgcaaagtagtatctgaatatccttttttatctgactacaagagagtttgggacttagaccttgcaaaaaacgcctatcaagagattacggactatttcaggctttttgacccaaggcatgaaagggagaatgaggtatttacaaagcttggatatatagacgttaaaaaccttgcgaaaaggataaaaggcgatgtcttaatgtgcgttgggcttatggaccaagtatgtccgccatcaactgtttttgcagcctacaacaacatacagtcaaaaaaagatataaaagtgtatcctgattatggacatgaacctatgagaggatttggagatttagcgatgcagtttatgttggaactatattcataaggagatgcat

SEQ ID NO: 160 - protein, 500 aa, Thermoanaerobacterium sp. 'JW/SL YS 485'
MIKVIVPDFSDKKFSDRWRYCVGTGRLGLALQKEYIDTLKYVKENIDFKYIRGHGLLCDDVGIYREDVVGDEIKPFYNFTYIDRIFDSFLEIGIRPFVEIGFMPKRLASGTQAVFYWEGNVTPPKDYKKWENLIKAVVSHFISRYGIDEVAKWPFEIWNEPNLKEFWKDADEKEYFKLYKITAKAIKEVNENIKVGGPAICGGADYWIEDFLNFCYEENVPVDFVSRHAYTSKQGEYTPHLIYQEIMPSEYMLNEFKTVRDIIKNSHFPNLPFHITEYNTSYSPQNPVHDTPFNAAYIARILSEGGDYVDSFSYWTFSDVFEERDVPRSQFHGGFGLVALNMVPKPTFYTFKFFNAMGEEMLYRDEHMIVTRRDDGSVALIAWNEVMDKTENPDKEYEVQIPVGFKDVFIKRQLIDEEHGNPWGTWIHMGRPRYPSKKEINTLREIAKPEIMTSHAVTNDGYLNLKFKLAKNAVVLYELTERIDESSTYIGLDDSKINGY

SEQ ID NO: 161 - protein, 320 aa, Thermoanaerobacterium sp. 'JW/SL YS 485'
MGLFDMPLQKLREYTGTNPCPEDFDEYWNRALDEMRSVDPKIELKESSFQVSFAECYDLYFTGVRGARIHAKYIKPKTEGKHPALIRFHGYSSNSGDWNDKLNYVAAGFTVVAMDVRGQGGQSQDVGGVTGNTLNGHIIRGLDDDADNMLFRHIFLDTAQLAGIVMNMPEVDEDRVGVMGPSQGGGLSLACAALEPRVRKVVSEYPFLSDYKRVWDLDLAKNAYQEITDYFRLFDPRHERENEVFTKLGYIDVKNLAKRIKGDVLMCVGLMDQVCPPSTVFAAYNNIQSKKDIKVYPDYGHEPMRGFGDLAMQFMLELYS

SEQ ID NO: 162 - DNA, 9678 bp, Streptomyces thermoviolaceus
agatctcgcgctcctgctcctcgtaggggcggccccgcaggtaacggtggtgcagcgtgtggttgttgagggtgactccggagtcctgcacggcccggaagtagtcgtagtcgtcccggacgaggtagtcgctgaggaacgtcgagtacgggatcttcaggtccttcatcatccgcaggaaggcggggtccttctcggcgccgtcgtcgatggtgaggaagacgaccttgtcccgggtgggcaccgtggtgaagaccggcggcaggtcccagtcctcgtggtgctgcacctcgaagccggggcgggtgcggatgcggggcttgtcggcgggcggggccggaggcggcagcgggacccgttgcagcccccagcggtgggcggcggccgcccgggccgtggtggcggcgcgcagccggtccgcgtagtcctgcagggcctgggccgggggtgcgaggtagagctgcggaccctgtgccggcccgggcacggcgtcgggacgggagcagcccgcggcgagcacggcggcgaccagggcgagcacgaggacccgggggccggacccccacttcgcaccctttttatcgttttgtacgactgtgatcatggcgccggatcctcgcagcccggcgccccgcacccgtgccgacaccaccgcacaccgccggccgtcccaccgactggccgacaccggcgggcggtggccgacaatgagccggtgaacgacccacaggcaccgccggacgccctcgactccttcgccgccctgctcaccgacgagggccgcgccctcctggaggaggtgcacggcaccgcacccgccgacgaactcgccgtcgccacccgcctgcgccgcacgcacccgcccgcgctggtgtcggcggcgctcgcgcaggcccggctgcggcaacgggcggaggcgaagttcggtgccgaggacgcgcggcggatgttcttcaccccccacggcgtggagcagtcgacccgcgcgagcgtggccgcctaccgggcggcgcggatgaaggagctgggcgtgacctgcctggccgacctgtggggatcgggcggcgacgcgatcgccctggcccggcagggcatccgcgtcctggccgtggaccgggacccggtgacggccgccgcggcccgggccaacgcccgggcgctggggctcgacgagctgatcgaggtgcgtgaggcggacgtcaaggacgtggacgtctccgcgtacgacgcggtgttcgccgacccggcccggcgggggcgcggcggccggatcttcgaccccgaggcctactcgccgccgctgtcctgggccgtggcgaccgcgcggacggtgccgcacgcggccgtgaagatcgcgccgggcatcccgcacgaggccgtcccggcgcaggccgaggccgagtggatctccgacggcggggacgtgaaggaggcggtgctgtggttcggcaccgagcccgcgacggtgcgcgcgaccctgctgcccggcccgcgcaccctgcgcggccgcggcctgcccgacccggcggtccggctggtcggccggtacctgtacgagccggacggtgccgtcgtccgcgcccatctggtcgccgaggtcgccgaggagctggacggcgggctgatcgaccccaccatcgcctatgtcaccgcggacgagctgcggcccaccccgtacgccaccgcctacgagatcaccgaccacctccccttccacgtcaagcggctcaaggccctgctgcgcgagcgcgaggtcggcacgctgaccgtgaagaagcgcggctcggccgtcgagccggaggagctgcggcgcaaggtgctgccccggccgcacggccgcgcggcggtcacggtcttcctcacccgggtcgcgggcgccccggcgatgctgctcggccacccggtgccctgaccggcctgctcaccggcgcaccggaggccgacgcacgcggcgcgcgccgctcacccggacggtcgagcgcactccggccgggtccggccgctctcccccgagcggtggcgctccgcgtgcgacacgcccgcggcgccgccgagagtggggcgagaagcggacgggcacgtgccgccggagagccggtgtgcccggtgagccggtgagcaggcgcgtgcggaggcgaggagatcgaggtgcggggcttcaagaacttcctgatgcgcggcgacgtggtcgtcgtggccgtcggcctgatcgtggccctggcgttcagcaccctgatcaaggcgttcaccgattccgtgatcaacccgctcgtggcccgcgcccagggcggcaagtcgccggggctgggctggcagctgggcgatccggggaacaaggcgacctatctggacatcggggcgttcatctcggcgctgatctacttcctcatcttcatggcggtcgtgtacttcctgatcgtcctgccctacaagcacttccaggcgcggcgcggggtggcggccttcaaggacccggtgccgacgaagacctgcccggagtgcctgtcggacgacctgcccgagcccgcgtccaagtgccgctactgcggctccgcgcagccggcccgcggctgacccgcctccgcgtcgacggcgacgcggtgacctgacgccccggccgccgtgacgcgcgtccgcgccgcccgccggacgaggggcgacgaacgttccggctgaggctgcggagccgggctcaggcgcgtgccggggcggccgtgctgctgcgcaccaccaggctggtggccagttccacgcgggtggccgcggtggtctcgtcgtcgcggccgaggtcgagcaccaagcgggcggccgcctcggccatctcggtcagcggctggcgcaccgtggtcagcggcggccccacccagcgggccaccggcagatcgtcgaagccgacgacgctcaggtcctccgggatgcgcagccccagctcgcgtgccgcctcgaacacgccgagcgcctgcaggtcgttgccggcgaacacggcggtcggccggtcctcgcggcgcagcagctcgaggccgaggcggtacccggcctcgtggtggaagtcgccggtgacgatcagcgaggggtcgaccggcaggcccgcggcctccagggccgaccggtagccgtcgacacgggcgcgggcgcacatcatgcgggacggcccgctgatcgcgccgatccgggtgtgccccagttcgagcaggtgccgggtggcggcgagcccgccctgccagttggtcgcgccgatcgagggcacgtcggcgccggggtcgcccgccgggtccatcaccacgaacgggatcgaacggctggtcagcagggcccgctgggactcgtcgagctcggacagcaccagcaccacgccgtgcgggcggcgggcggcgacctggtcggcccaggtccgccccggggtgagccggccggcgctctcggagagcaccacgctcaggcccgcgtcccgggcgacgttctccaccccgcggatgacctccatcgcccaggcgctctccagttcgtggaagacgacgtcgatcagcggggaccgggtcgcctcggcccgccggcgccggtagccgtgggcgcgcagcaggtgctcgacccggctgcgggtcgccggggcgacgtcggcacggccgttgaggaccttcgaaacagtcggagccgacacaccggcctctcgggcgatctcggcaagtgtggcggtgcgggtttctgcggtcttcgtcggcttcatggtccggatcgtatctctgcacgaccccttgacgaagaccccgaggcgccttacgttcccggaacattcgacatcacatgcgaaacattcgggtcgacgctcgaggtgtcccggcgtgctcgccgcacggttcgagcaaggcccgaccgacttgtgagaggtgccgtcacgatgcagtcctacagcaggcgctggttcctcggcgccggcgccaccaccttgatctcggccgccggtctgaccgcctgcgggtccggcagcggctcgggcggctcgggcggcacgatcacggcgatggtgtacggcgacgacgcggtgaaggtccaggacaaggccgcgtcccggttcaacgcctcggcggaggcgaagaaggccaacgccaaggtcaagatggagcggatcccggcctccgactacccggcgaagctgcgcaccgccatgggctcgcccaacgccccggacatcttcttcaactggggcggcggctcgatcaaggcctacaaggaggccggccagctggtcgacctgaccgacgtcatcaagtccgacgaggtgctcagcaccggcttcctgccgtccgtggtcgccgccggatccctggacgggcacgagtacggcatccccatgcgcggcatgcagccggtgctgctcttctacaacaagtcggtgttcgccgagcacaagctgaccccgcccaccacctgggaccagctgctcgacaacgtcgccaagctgaagaaggcgggcgtgacgcccttcgcgctgggcggtgtggagatctggccggagctgatgtggctggagtacctggtggaccgcatcggcggcccgcaggtcttcgacaagatcaggaacggtgacgcctcgggctggggcgacccggccgtgctgaaggccgcccagaccgtcaagcagctcgtcgacgagggcgccttcggcaagggcttcagctcggtgtcgtacaacaacggcggcgcgcccgccctgctcgccaagggcaaggccggcatgcacctgatgggctcctgggagtactccacgcagctggggaagttcccggacttcgccaagaaggatctgggctggtgtgcgttcccgtcgttcgagggcggcgccggcgacatccgcaacgtggtcggcaacccctgcaactactggtccgtcaacgcccgtaccggcaacaaggacggtgcgatcgccttcctgcgcgactgcgcgtccgaggcgtacaccaaggacctgatcgacaacggtgacgtgccgaccaccacgatcgccgagaacatgctggactcctcccccaacccggagttcgccaagttccagtaccagctggtgcagaaggcccccaacttcacgctcagctgggaccaggcggtggaccccgactggcagcagccgatgctgacggagatcaacaagctgttcgtcgggaagtcctcgccggagcagttcgtctccgcgctcaaggggctgaagtgaccaagagcaccaccgcggtgcgcaagggcaggaccggtgagagtgcgcggacgggccgtccgcacaccgcctgggtcctgcccggcgtgctgttcttcgccttcttcgccgtcgcgccgatggcgctggccttctatctgtcgttcaccaagtggaacggcctgggcgaccccgaaccggtgggtctggccaactgggagaagctgctccaggacccgcggctgacccagtccctgacggtcacggtgctgctgacggtggtcagctgggccttccagaccgtcgtctcgctgctgctgggggtgtgggcggcgggacgccagcgcaaccgcgcgttcctgtccgcggtcttcttcgtgccgttcctgctgtcctcgacggccatctcgctgctgttctacgcgctgctcgaccccaacttcggcatcatccgccgcgacacgctcggcaccacctccggtgcgttcctcgccatcgtcttcgtcggcggctggcagttcatccccttccacaccctgatctaccagggcggggcccggcagatccccgaggtgctctaccaggcggccgcgatggacggcgccgggcgctaccggcagttcttctccatcacgctgccgcagctgcgcaacaccatgaccacgtccagcgtgctgatgatcgtcggctcgctgacgtacttcgagacggtgctgatcctcacccagggcggccccggcacggacaccgcgatcctgccgtacctgatgtacgaggcggggttcaagagctacgacttcggctacgcgagcgccctcgcctccttcctcgtggtggccgccaccgcgctgtcgctgctgctggtgcggctgtccgggttcggcgccatgcgcagcaccagggaagggatgtgacggcatggcacacgacaccctgccgcgtccgcacgacgtgaagcgcgccgagccgcccgcctccccgggccccgcgcggcgccgccgccactggagcaagcgccccaacccgctcgccggcctgggctcggtgctgtggctggcggtcgtgatcatcccgatctacgcgatgatctcggcctcgctgacccgccaggacgaggcgctcggccacaacgcgctcaagccgccctccgaacccaccctggagaactacaacaccgtcctgcacaacggcttcggtcatctgctgctcaacacggtgatcgtggccgcggccgtggtggtgatcgtgctggtgctgtgcgtgccgctggcctatgtggccgtgcgctcgcgcaccttctgggccggctcggccttccggctgttcctgctgggcgtggccatccccgcgcaggcggtggtggtcccgctgtacctgctgatctccaagctgaacctgtacgacagcctgatcgcgatcatcctgccgacggcggccttcgccatgccggtgtcggtgctgatcctcaccggcaccatgcgggacatctccgaggagatgtacgaggccatggccctggacggcgcctccaccacccggatgctgttccagctggtcatcccgatgaccaagggcggcatcagcacggtcgtcatctactcggcgctgcaggcctggaacggcttcctcttcccgctgatcttcacccagtccgacggcccgcgcgtgctgacgctgggcctgttcaactacgtcagccagttcggggtgaacatccccgccctgctcgcctcggtcgtcctctccggcatcccgatcttcgccgtgtacctggtggcccgccgggccctggtcaacggcctgatgggcgtgggcggcaagtgaacgacgcgacggcccccttccccgaccccactgacaggagctacatgaccaccgccccctggcaggatcccgccctgcccgccaccgcccgggtcgacgatctgctggcccgcatgaccctcgaggagaagacggcccagctctacggcgtgtgggtgggtgcctccacggacggcgacggtgtcgccccgcaccaggagcagatgaacaccgactacgactgggacgagctgatcacccgcggtctgggccagctcacccggtccttcggcaccgcccccgtggacccggccgtcggcgcgcgggccctggcgaacgcccagcggcggatcgccgaggccggccgcttcggcatccccgccgtcgcccacgaggagtgcctggccggtttcaccgcctggggcgccaccgcctacccggtgccgctggcctggggggcgaccttcgacccacagctggtcgaggcgatggccgcgcgcatcggccgggacatgcggtcggtgggcgtgcaccagggcctggcgccggtcatggacgtggtccgcgacctgcgctggggccgggtggaggagaccatcggcgaggacccctacctggtcggcaccatcggcagcgcctatgtgcggggcctggagtcggccgggatcgtcgccacgctgaagcacttcgccggctacgcctcctccgcgggcgcccggaacctggccccggtgcgggccggcgtccgggagttcgcggacatcaccctgccgccgttcgagatggccctgcgcgagggcggcgcccgctcggtgatggccgcctacaccgagaccgacggcgtgcccgcctcggccgacccgcggctgctgaccgagctgctgcgcgagcagtggggcttcaccggcacggtggtcgccgactacttcgccatcgacttcctgcagaccctgcaccgggtggcccggagcaccgccgaggcgggccgcctggcgctggccgccgggatcgacgtggagctgcccacggtgaaggcgtacggcgacgagctggtggccgccgtccgctccggcgaggtccccgaggaactggtggaccgcgcggccaggcgggtgctgctgcagaagtgcgagctgggtctgctggacgccgactggacgcccgaggtgccggagggccccgtcgacctggactcggcggagaaccgggcggtggcccggcgcctggccgaggagtcggtggtgctgctcgccaacccggacggtgtgctgccgctgccggccgacggccggatcgcggtggtcgggccgcgcgccgcggacgccctggccatgctgggctgctactccttcccctcgcacgtgggcgtgcagcacccggacgtcccgatgggcatcgagatccccacggtgctggacgcgctgcgcgccgaactgccggacgccaaggtgacgttcaccgagggctgcggggtgtcggacgaggacacctccggcttcgcggaggccgtcgcccgcgcccgggaggcggacgtgtgcgtggccgtgctcggcgaccgctccggcttgttcggccgcggcacctccggcgagggctgcgacgtggccgacctgaacctgcccggggtgcagggcgcgctgctggacgcactggtggactccggcaccccggtggtgctggtgctgctcaccggccggccctacgcgctgggccggtgggcggaccggctggccgcggtggtgcaggcgttcttccccggcgaggagggcggcccggcggtggcgggtgtgctctccggccgggtcaacccctcgggccggctcccggtgagcgtgccgcgactgcccggcggccagccgtggacgtatctgcagccgccgctgggcctggccggcgaggtgagcagcctggacccgacgccgctgtacccgttcgggcacggccggtcgtacacgtcgttccgctgggaggacttcgagggctcgggcgacgggcggatcggcaccgacggctcctacgagctgtcgctgacggtgcgcaacaccggtgaccgggcgggcgcggacgtggtgcagctgtatctgcacgacccggtggcctcggtgacccggcccgacgtgcggctgatcggctatcagcgggtggagctggagcccggcgaggcccgtcgggtgacgttccggttccacacggacctgtcggcgttcaccgacctgtccggccgccgggtggtcgagccgggcgagctggagctgcggctggccgcctccgccgcggacgtgcgccacaccgcgcggctcaccctgacgggcgaggtgcggcaggtgggacacgaccgccggctgcgctgcgagacggaactgtccaccgcggactgagcggttgtcgcgggcccgtccccggccgggggcgggcccgccgcccgactccgctcgacggcggacgcccgcaacgcgaagaccccgctccgggcgaccggaacggggtcttctcatcgagcgccgggcaggccttgcacctgcatctccccgcaggaagcggggcgtcttgccttagaccaccaacgcattcgctcgccgggctgtcctgcccgcttgcgtgtgatgatcatagcgcacccggcgggcggtgtgccacacgcgatcagtcctcgcccgcggactcgaaccgccagcggtgcaccgcccggg

SEQ ID NO: 163 - protein, 343 aa, Streptomyces thermoviolaceus
MKPTKTAETRTATLAEIAREAGVSAPTVSKVLNGRADVAPATRSRVEHLLRAHGYRRRRAEATRSPLIDVVFHELESAWAMEVIRGVENVARDAGLSVVLSESAGRLTPGRTWADQVAARRPHGVVLVLSELDESQRALLTSRSIPFVVMDPAGDPGADVPSIGATNWQGGLAATRHLLELGHTRIGAISGPSRMMCARARVDGYRSALEAAGLPVDPSLIVTGDFHHEAGYRLGLELLRREDRPTAVFAGNDLQALGVFEAARELGLRIPEDLSVVGFDDLPVARWVGPPLTTVRQPLTEMAEAAARLVLDLGRDDETTAATRVELATSLVVRSSTAAPARA

SEQ ID NO: 164 - protein, 436 aa, Streptomyces thermoviolaceus
MQSYSRRWFLGAGATTLISAAGLTACGSGSGSGGSGGTITAMVYGDDAVKVQDKAASRFNASAEAKKANAKVKMERIPASDYPAKLRTAMGSPNAPDIFFNWGGGSIKAYKEAGQLVDLTDVIKSDEVLSTGFLPSVVAAGSLDGHEYGIPMRGMQPVLLFYNKSVFAEHKLTPPTTWDQLLDNVAKLKKAGVTPFALGGVEIWPELMWLEYLVDRIGGPQVFDKIRNGDASGWGDPAVLKAAQTVKQLVDEGAFGKGFSSVSYNNGGAPALLAKGKAGMHLMGSWEYSTQLGKFPDFAKKDLGWCAFPSFEGGAGDIRNVVGNPCNYWSVNARTGNKDGAIAFLRDCASEAYTKDLIDNGDVPTTTIAENMLDSSPNPEFAKFQYQLVQKAPNFTLSWDQAVDPDWQQPMLTEINKLFVGKSSPEQFVSALKGLK

SEQ ID NO: 165 - protein, 291 aa, Streptomyces thermoviolaceus
MRKGRTGESARTGRPHTAWVLPGVLFFAFFAVAPMALAFYLSFTKWNGLGDPEPVGLANWEKLLQDPRLTQSLTVTVLLTVVSWAFQTVVSLLLGVWAAGRQRNRAFLSAVFFVPFLLSSTAISLLFYALLDPNFGIIRRDTLGTTSGAFLAIVFVGGWQFIPFHTLIYQGGARQIPEVLYQAAAMDGAGRYRQFFSITLPQLRNTMTTSSVLMIVGSLTYFETVLILTQGGPGTDTAILPYLMYEAGFKSYDFGYASALASFLVVAATALSLLLVRLSGFGAMRSTREGM

SEQ ID NO: 166 - protein, 301 aa, Streptomyces thermoviolaceus
MAHDTLPRPHDVKRAEPPASPGPARRRRHWSKRPNPLAGLGSVLWLAVVIIPIYAMISASLTRQDEALGHNALKPPSEPTLENYNTVLHNGFGHLLLNTVIVAAAVVVIVLVLCVPLAYVAVRSRTFWAGSAFRLFLLGVAIPAQAVVVPLYLLISKLNLYDSLIAIILPTAAFAMPVSVLILTGTMRDISEEMYEAMALDGASTTRMLFQLVIPMTKGGISTVVIYSALQAWNGFLFPLIFTQSDGPRVLTLGLFNYVSQFGVNIPALLASVVLSGIPIFAVYLVARRALVNGLMGVGGK

SEQ ID NO: 167 - protein, 770 aa, Streptomyces thermoviolaceus
MTTAPWQDPALPATARVDDLLARMTLEEKTAQLYGVWVGASTDGDGVAPHQEQMNTDYDWDELITRGLGQLTRSFGTAPVDPAVGARALANAQRRIAEAGRFGIPAVAHEECLAGFTAWGATAYPVPLAWGATFDPQLVEAMAARIGRDMRSVGVHQGLAPVMDVVRDLRWGRVEETIGEDPYLVGTIGSAYVRGLESAGIVATLKHFAGYASSAGARNLAPVRAGVREFADITLPPFEMALREGGARSVMAAYTETDGVPASADPRLLTELLREQWGFTGTVVADYFAIDFLQTLHRVARSTAEAGRLALAAGIDVELPTVKAYGDELVAAVRSGEVPEELVDRAARRVLLQKCELGLLDADWTPEVPEGPVDLDSAENRAVARRLAEESVVLLANPDGVLPLPADGRIAVVGPRAADALAMLGCYSFPSHVGVQHPDVPMGIEIPTVLDALRAELPDAKVTFTEGCGVSDEDTSGFAEAVARAREADVCVAVLGDRSGLFGRGTSGEGCDVADLNLPGVQGALLDALVDSGTPVVLVLLTGRPYALGRWADRLAAVVQAFFPGEEGGPAVAGVLSGRVNPSGRLPVSVPRLPGGQPWTYLQPPLGLAGEVSSLDPTPLYPFGHGRSYTSFRWEDFEGSGDGRIGTDGSYELSLTVRNTGDRAGADVVQLYLHDPVASVTRPDVRLIGYQRVELEPGEARRVTFRFHTDLSAFTDLSGRRVVEPGELELRLAASAADVRHTARLTLTGEVRQVGHDRRLRCETELSTAD

SEQ ID NO: 168 - DNA, 2601 bp, Selenomonas ruminantium
gatcattaccgaactggaacaacgtcaccagcaggaaaagcattacacagatgacagtcagctggctgccagcaccttgtaaaaacgtgtttaaattggagacttcaagatgaacattcaaaatcccgtattaaaaggctttaaccccgaccccagcattgtccgggcaggcgatgactactatattgccacctccaccttcgagtggttccccggtgtgcagattcatcattccaaagatttagtacattggcacctcgttgcccatcccctttccaccacggaatttctggatatgaaaggcaatccggattccggcggcatctgggcacctgacctttcctatgccgatggcaagttctggctcatttacaccgatgtaaaggtcgtagacggcatgtggaaggattgtcataactacctgaccaccgccgaagacataaaaggcccctggtcaaaaccgatactcctgaacggtgctggctttgatgcctccctgttccatgaccccagcggcaaaaaatatctggtcaatatgtactgggatcagcgcgtctaccatcataatttctacggcattgccctgcaggaatattccgtagccgaagaaaaactcatcggcaagccggaaatcatctataagggtaccgatattgcctataccgaaggtccccacctttactatatcaacgatatgtattacctcatgacagctgaaggcggcacgacgtatcagcattctgagaccatcgcccgcagcaagactatccacgggccctatgaaatacagccggactatcccctgctgtcggcatggaaggaagtccataaccccctgcagaaatgcggccatgcatcattagtcgaaacgcaaaacggccagtggtacttagcccatctgactggcagacccctgcctgcccccgccggcttccccagccgcgaacgcgaacagcatgccttctgtccgctgggcagagaaaccgccatccaaaaaatcgaatggcaggacggctggcccgtagtcgttggcggtcagcagggttccttagaagtcgaagcacctgacctgccccagcaggaatgggcaccgacttacgaagaacgcgatgacttcgataaggacaccttaaacatcaacttccagaccctgcgtatccccttcagtgagcatttgggcagtctcaccgcccgtcccggcttcctgcgcctgtacggccgcgaatccctgcagtccaaatttacccaggcccatattgcccgccgctggcagtccttcaatttcgatgctggaaccagcgtggaattttctccgaactccttccagcagatggccggtcttacctgctactacaatacggaaaactggtccagcatccatgtgacctggaacgaagaaaaaggccgtatcatcgatttggtcaccgccgacaacggcaccttctccatgccgcttgccggagcagaaatccccattcccgatgaagtaaagaccgtccacttcaaggtatccgtgcgcggcagaatctaccaatacgcttattccttcgatggcgaaaccttccacaccctgcccatagaactgcccagctggaaactctccgatgactatgtgcgcggcggcggattcttcactggtgctttcgtcggcataaacgccattgatattaccggcacagcgcttcccgctgactttgattatttcacttacaaggaactggactgaattcacgttacttgttaaaataatagataaaagagctaactggaggtacaggcatggttacgatgaaaagtattgcggaaatatgcggtgtttcccgaggcacagtagaccgcgcattaaatggccgcggccgggtaaactcagaaaccgctgacaaaatccgtcaaatcgccaaggaattaggctatacccccaaccctgccggcaaagcactttcagcccgaaaaaaaagaccagtcatcggcattgtaatcccctctgagaacaaccccttctttgacgatgtactaaagggcatggaagaagcagctgcccaatatcaaatctatggtgtccaaataaaataccatacgatgaaaggttatgacccggccaaacagttagcaaccctgcaaaaaatcgaagaccaggtacaggcgctcatcatcaaccccattgatgacccagctattgtcagccaaatcaatcgcatgattgacaaaggcgtcttcgtggtaaccgtcaacaacgatattgaaggtacaaagcgccattgctatgtgggcagtgactactacaacggcggcataacatcctgtgcactgatggaagcgctcgtgggcaaaacagccaatctggccattatcctcggcagcctgaaactgcgcggtcatcgcctccgtctggaaggtttcaaatcccgcatgcagcgattgccggattttcagctggcaaccgtgctggaaaacaatgatgatgacatttacgcctacgaaaaaaccaaggagcttttaaccgctcatccggaaatcaatgccatcagcattttggccgccggtgtctacggcacctgccgtgccgtcatgcagttgccggaagaaaaacggcccttgatc

SEQ ID NO: 169 - protein, 538 aa, Selenomonas ruminantium
MNIQNPVLKGFNPDPSIVRAGDDYYIATSTFEWFPGVQIHHSKDLVHWHLVAHPLSTTEFLDMKGNPDSGGIWAPDLSYADGKFWLIYTDVKVVDGMWKDCHNYLTTAEDIKGPWSKPILLNGAGFDASLFHDPSGKKYLVNMYWDQRVYHHNFYGIALQEYSVAEEKLIGKPEIIYKGTDIAYTEGPHLYYINDMYYLMTAEGGTTYQHSETIARSKTIHGPYEIQPDYPLLSAWKEVHNPLQKCGHASLVETQNGQWYLAHLTGRPLPAPAGFPSREREQHAFCPLGRETAIQKIEWQDGWPVVVGGQQGSLEVEAPDLPQQEWAPTYEERDDFDKDTLNINFQTLRIPFSEHLGSLTARPGFLRLYGRESLQSKFTQAHIARRWQSFNFDAGTSVEFSPNSFQQMAGLTCYYNTENWSSIHVTWNEEKGRIIDLVTADNGTFSMPLAGAEIPIPDEVKTVHFKVSVRGRIYQYAYSFDGETFHTLPIELPSWKLSDDYVRGGGFFTGAFVGINAIDITGTALPADFDYFTYKELD

SEQ ID NO: 170 - DNA, 1843 bp, Bacillus pumilus
aagctttactgggcattttaatcacgacaacggtgattcctgtatgcttactgattttagcgatggtggatattaatttttataacctagatgaagaaaaacataaaaaagtcgtacgggaacttgagaatagagacaaagtgtatctcgatcatatggacgattttaaaatgtaggtctctgaaagaggaggaaattcaatgaagattatcaatccagtgctcaaagggtttaacccggatccaagtatttgccgtgttggagaagattattatatggccgtctctacatttgaatggttcccaggggtacaaatttatcattcgaaggatctcgtccattggcgccttgccgcgcgtcctttgcaaaaaacgtcgcagctggatatgaagggaaatcctgattctggcggagtatgggcgccgtgcttaagctatgcggatgggcagttttggcttatttattcagatatcaaagtagtggatggtccatttaaagacggtcataattatttggtcacggcaagcgaagtggacggcgattggagtgaaccgatccggctcaacagctccggctttgatccatctttattccatgatcaaagcgggaagaaatacgtcttaaatatgctgtgggatcatagggaaaagcatcattcctttgcaggtattgccttgcaggaatatagtgtggctgaaaagaagctcatcggtcgaaggaaggtcatttttaaaggcacaccgattaaactgacagaagcgccgcatctgtatcatatcggtgacaactactatttattaacggcagaaggaggtaccaggtatgagcatgcagcaacgatcgcccgttcctcacatattgaagggccttatgaggttcatcctgataacccgatcttaagtgccttccacgcgcctgaacatccgcttcaaaaatgcgggcatgcttcaatcgttcaaacgcatacaaatgaatggtatctcgctcatctcactggcgtcccgattcaatcaaacaaggaatctatttttcaacagagaggttggtgtcctttaggaagagaaacagcgatacaaaagcttgaatggaaggatggctggccttatgttgtaggcggaaaggaggggacgcttgaggttgaagcgccaaagatcgaagaaaaggattttgcaccaacctatcatacagtcgatgaatttaaagaatcaacactaaatagacacttccaaacattaagaattccgtttaccgatcagattggttcgttaacggagaaacctcggcatttaaggttattcggccgcgaatctttaacgtctaagtttacccaagcgtttgttgcaagacgctggcaaagcttttattttgaagcagagacagctgtttcgttcttcccagaaaactttcagcaatcagctggtcttgtgaattattataatacggaaaactggacagcactccaggtgacatatgatgaggaacttggccgcacgcttgaactatctgtctgtcaaaaccttgccttttctcagccattggcacataaaatcatcattcctgacgaggtcacttatgtctatttaaaagtgaccgttcggaaagagacatataaatattcttattcatttgatcagaaagagtggaaggaaattgatgtaccgcttgaatccatccatttatccgatgattttattcgaggcggggggttttttacaggggcatttgtcggtatgcagtgccaagatacgagcggcgagcgtcttcctgctgattttcactattttcgctatgaggaaacagacgaataagaaaagacaactcgctacgagctgtctctttttga

SEQ ID NO: 171 - protein, 535 aa, Bacillus pumilus
MKIINPVLKGFNPDPSICRVGEDYYMAVSTFEWFPGVQIYHSKDLVHWRLAARPLQKTSQLDMKGNPDSGGVWAPCLSYADGQFWLIYSDIKVVDGPFKDGHNYLVTASEVDGDWSEPIRLNSSGFDPSLFHDQSGKKYVLNMLWDHREKHHSFAGIALQEYSVAEKKLIGRRKVIFKGTPIKLTEAPHLYHIGDNYYLLTAEGGTRYEHAATIARSSHIEGPYEVHPDNPILSAFHAPEHPLQKCGHASIVQTHTNEWYLAHLTGVPIQSNKESIFQQRGWCPLGRETAIQKLEWKDGWPYVVGGKEGTLEVEAPKIEEKDFAPTYHTVDEFKESTLNRHFQTLRIPFTDQIGSLTEKPRHLRLFGRESLTSKFTQAFVARRWQSFYFEAETAVSFFPENFQQSAGLVNYYNTENWTALQVTYDEELGRTLELSVCQNLAFSQPLAHKIIIPDEVTYVYLKVTVRKETYKYSYSFDQKEWKEIDVPLESIHLSDDFIRGGGFFTGAFVGMQCQDTSGERLPADFHYFRYEETDE

SEQ ID NO: 172 - DNA, 4200 bp, Bacillus stearothermophilus
ggatccttttttatgcaatactgatcgccttagctctttttcaagtgttgcctcttgtctggttgctctttttctcattgaaaaataaccaggaagtattcaatacaccgttgctttcgcctccatcaccaccgcggtggaaaattatgtaaaagtttgggtggaaggcaacattgggcagtactttttcaacagtgtctggattacgaccgtctctgtcattttgactgtattgcttgctagtttcgcgacctttgccattacacgcatgaattggaagtggaaacatgttgtgcttggactttttatggtcggtttaatgattccgattcattcgacgttaatcccattgttcagcttttttatgaaagtgaagctcatcgatcatccgttatcgattgtcttaaccaatattggatttaacttaccgattacatcatgatcttgctcggtttttaccagtcgcttccgcgtgagttggaagaatcagcggtgatggatgggtgttccgttcatcgtatgtttttccggatcattttgccgatgacggcaccggtgatcgttacgacgacgattatcaacatgatttacaactggaacgagttcgtttttgtgaacacatttattagctcagatgagtttaaaacgttaactgtcggtattcaaaactttatcggccagtatacgaccgattggggagcgattggtgccactttaatgatcagcgttctgcctattttgatcgtcttcttcttcttaagcgataaaatcatggaaggtattactgcaggagcgattaaaggataaatgtagaaaaaggggagagaagtaaccatgccaaccaatctatttttcaacgcccaccactcaccggttggagcgtttgccagctttacattaggatttccaggaaaaagcgggggattggatcttgaactcgcccgtcccccgcggcaaaacgtattgattggtgtcgaatcgttacatgaatcgggcttatatcatgtccttccgtttttggaaacagccgaagaagatgaaagcaaacggtatgacatcgaaaatcctgacccgaatccgcaaaaaccgaacatcttaatcccatttgccaaagaggagattcaacgtgaatttcatgtggccacagatacgtggaaggctggagatttaacgtttacgatttattctcctgtaaaagcggtgccaaatccggaaaccgcggacgaggaagaactcaagctggcgttggttccagctgtcatcgtggagatgacgattgataatacaaatggaacaagggcccggcgggcgtttttcgggttcgaaggcaccgatccgtatacttcaatgcggcggatcgatgacacatgcccgcaactgcgcggggtcggtcaagggcggattttgagcattgtatccaaggacgagggtgttcgctcagcgctgcattttagcatggaggatatcttaacggcacagctggaagaaaactggacgtttgggcttggcaaagtgggcgccttaattgtcgatgtgccggcaggcgaaaagaaaacttatcaatttgcggtttgtttttaccgaggcgggtacgtgacggcggggatggatgcttcctatttttatacccgtttctttcaaaatattgaggaagtcggcctttatgccctggagcaggcggaagtattgaaggagcaatcgttccgttccaataagctgattgaaaaagaatggctgtctgatgatcaaacatttatgatggcgcacgccattcgcagctactacggcaatacgcagctgttagagcacgaggggaaaccgatttgggtggtcaacgaaggcgagtaccggatgatgaatacgtttgatttgaccgttgaccaactcttttttgaactgaaactgaatccatggacggtcaaaaatgttctcgatttgtacgtcgagcgctacagttacgaggatcgcgttcgttttccgggagaagagacagaatatccgagcggcatcagttttactcacgacatgggagtagccaatacgttctcgcgcccgcactactcgtcatacgagctgtatggcattagcggctgcttctcgcacatgacgcacgaacagcttgtcaactgggtgctttgcgcggcggtgtacattgaacaaacgaaagactgggcatggcgcgacaagcggcttgctattttggagcaatgcctagaaagcatggttcgccgcgatcatcccgatccggaacaacgaaatggcgtaatgggactcgacagcacccgcacgatgggcggggcggaaattacgacatatgacagtttggacgtttccctcggccaagcccgcaacaatttatatttagcaggtaaatgttgggcggcctatgtagcgcttgaaaaattgttccgtgatgtcggcaaggaagaattggccgcgctggcgggagagcaggcggaaaaatgcgccgcgacgatcgtcagccatgtaaccgatgacgggtatattccggcgatcatgggagaaggaaacgactcaaaaatcattccggctattgaggggcttgtgttcccttatttcaccaattgccatgaagcgttggacgaaaacggacgctttggagcatatattcaagcgttgcgcaaccatttgcaatacgtgttgcgggaaggaatttgcctgttcccggatggaggctggaaaatttcctcaacgagcaacaactcatggctaagtaaaatttacctatgtcagttcattgcccgtcatattttaggctgggaatgggatgaacaaggcaaacgggccgatgccgcccatgtcgcttggctcacccatccgacattatccatttggagctggagtgatcaaatcatcgcgggtgaaattaccggcagcaaatattacccgcgcggcgtgacaagtattttgtggcttgaggagggagaataacgatgtgctcatccatcccgtcccttcgcgaagtgtttgccaatgattttcgcatcggggcagcagtcaatccagtgacgctagaagcccaacaatcgctgttgatccgccatgtaaacagccttaccgccgaaaaccatatgaagtttgaacatcttcagccagaggaggggcggtttacgtttgacatcgcgatcaaatcatcgacttcgccgttctcatcacatggcgttcgcggacatacgctcgtgtggcataaccaaaccccgagctgggtgtttcaagacagccaagggcatttcgtcggcagagatgtgttgctggaacggatgaaatctcatatctccacggttgtacagcgatacaaagggaaagtctattgttgggatgtcatcaacgaagcggtcgccgatgaggggagcgaatggctgcgctcctcaacgtggcgacaaatcatcggcgatgattttattcagcaggcgtttctttatgcccatgaagcggacccagaggcgttgctgttttacaacgactataatgaatgttttccggaaaaacgcgagaaaatttacacactagtaaaatctttgcgtgacaaaggaattcccattcacggcatcggcatgcaggcgcactggagcctgaaccgcccgacgcttgatgaaattcgcgcggcgattgagcgatatgcgtctctcggagtcattctccatattaccgaacttgatatatcgatgtttgaatttgacgatcatcgaaaggacttggctgctcctacaaacgaaatggtcgaacggcaggcagagcggtacgaacaaattttctctctattcaaggaatatcgtgatgtcattcaaaatgtcacgttttggggaattgccgatgaccacacgtggcttgaccacttccctgtgcaaggaagaaaaaattggccccttttgttcgatgaacaacacaaccccaaaccggctttttggcgggtggtgaatatctaaatttctagttgctttgaaatcatactatatagtgaagaggggaaaaaatagagtttagttctcccctcttccataataatagaaaactttcagaaaagtattgaatatggggaggtttttcgttataataaaaacaaaactagtatactagtgttactagtaatcaagtatcgcgtaagattgtacgtttgcctttttgaactagaagatattattttcaaactagtatactagaatgttaattttgtgatcc

SEQ ID NO: 173 - protein, 705 aa, Bacillus stearothermophilus
MPTNLFFNAHHSPVGAFASFTLGFPGKSGGLDLELARPPRQNVLIGVESLHESGLYHVLPFLETAEEDESKRYDIENPDPNPQKPNILIPFAKEEIQREFHVATDTWKAGDLTFTIYSPVKAVPNPETADEEELKLALVPAVIVEMTIDNTNGTRARRAFFGFEGTDPYTSMRRIDDTCPQLRGVGQGRILSIVSKDEGVRSALHFSMEDILTAQLEENWTFGLGKVGALIVDVPAGEKKTYQFAVCFYRGGYVTAGMDASYFYTRFFQNIEEVGLYALEQAEVLKEQSFRSNKLIEKEWLSDDQTFMMAHAIRSYYGNTQLLEHEGKPIWVVNEGEYRMMNTFDLTVDQLFFELKLNPWTVKNVLDLYVERYSYEDRVRFPGEETEYPSGISFTHDMGVANTFSRPHYSSYELYGISGCFSHMTHEQLVNWVLCAAVYIEQTKDWAWRDKRLAILEQCLESMVRRDHPDPEQRNGVMGLDSTRTMGGAEITTYDSLDVSLGQARNNLYLAGKCWAAYVALEKLFRDVGKEELAALAGEQAEKCAATIVSHVTDDGYIPAIMGEGNDSKIIPAIEGLVFPYFTNCHEALDENGRFGAYIQALRNHLQYVLREGICLFPDGGWKISSTSNNSWLSKIYLCQFIARHILGWEWDEQGKRADAAHVAWLTHPTLSIWSWSDQIIAGEITGSKYYPRGVTSILWLEEGE

SEQ ID NO: 174 - protein, 330 aa, Bacillus stearothermophilus
MCSSIPSLREVFANDFRIGAAVNPVTLEAQQSLLIRHVNSLTAENHMKFEHLQPEEGRFTFDIAIKSSTSPFSSHGVRGHTLVWHNQTPSWVFQDSQGHFVGRDVLLERMKSHISTVVQRYKGKVYCWDVINEAVADEGSEWLRSSTWRQIIGDDFIQQAFLYAHEADPEALLFYNDYNECFPEKREKIYTLVKSLRDKGIPIHGIGMQAHWSLNRPTLDEIRAAIERYASLGVILHITELDISMFEFDDHRKDLAAPTNEMVERQAERYEQIFSLFKEYRDVIQNVTFWGIADDHTWLDHFPVQGRKNWPLLFDEQHNPKPAFWRVVNI

SEQ ID NO: 175 - DNA, 1857 bp, Azospirillum irakense
atctgggcgtgctgatcttctcgctgctgattggtgggctggtggccagcgtgggctatgatcctttctttctggcgctggggtgctggatcttgtggcgccgccctgctctggaccctggtgcgtgaaccgtccggccccaccgctcccgcccatcatcccgctgtcacggtgcagacgccatgatccgcaatcccatcctgcccggtttcaacccggacccgtccatcgtgcgcgtgggggcagattattatatcgccacctccacctttgaatggtttcccggcgtccagatccaccattcgcgcgatctggtgcattggcgactgctgacgcggccgctgagacgggaaagccagttgaacatgctgggggcgcccgattcctgcggcgtctgggcgccgtgcttgacccatgccgacgggctgttccatctgatctataccgatgtgaaacgctatggccgcaccagtgtcggcggcgcgtcgggcgcctcgctgcgcgacttccataattatctggtgacctgtgaccggatcgacggcgaatggtccgatccggtcttcctcaacagcagcgggttcgacccctccctgttccatgatgaggatgggcggaaatatctgctcaacatgctgtgggaccatcgccccggccataaccgctttgccggtattgtcctgcaggaatattccccacaagcccgcgctttggtgggggagcggcgggtgatcttccccggcacggccctgggcctgacagaagccccccatctctataagcgcgacggctggtactatctgctgacggcggaaggcggtacgggctggaaccatgcggtgaccatggcccggtcccggtcgattgacggcccttacgaactgcatcctgacacccatatcctcacatccttcaaccggcccgatgcgccgctgcaacgcgccggccatgccgatctggtggaaacggcagagggggaaacctatgccgtctatctgtgtggccgccccttgcccaaccggggccgctgtgtgctggggcgggaaacggcaatccagcgcatggtctggggtgatgatggctggctgcggaccatggacgggcagggcctgccaagcctgaccacgccctcgcctggcctgccggcacatcctttcccgacggctcccgcccggtcggactttgatgatccaagcctgccgctggatttccaatggctgccatctccccatccggaagagctgttcagcctgttcgcccggccaggctggttgcggctttatgggcgggagacgatcggcagccagttccgtcaggcgctggtcgcaaggcggcaacaggctttctgtgtgtccgtagcgacctttatggatttccatccccgccacttccagcagatggccgggcttgtctgctattatggcggcagcaaattccattatctttatgtcagccacgacgaggcgcggggccgccatatccgtgtcatgtcggccctgccggattcaacccaggccgatgcttttaccgagatgatcccgatcccggaggggccgatcatctgcgggcagagctcgactatgaacggctgcttcgccttccggcttccggacggggattgggtctggctgccccggatctttgatgccagcatcctgtcggatgaggcgacaagccccggcgcgccgaacttcaccggcgccttcattggcatggcctgccaggatatggccggcagcggtgtaagcgctgatttcgactggtttgattatcaggagcgggattatcgcgcggatccaacctgcagataatggggtaatccgcctgtccttttaaccgggagctggtcagcctctt

SEQ ID NO: 176 - protein, 542 aa, Azospirillum irakense
MIRNPILPGFNPDPSIVRVGADYYIATSTFEWFPGVQIHHSRDLVHWRLLTRPLRRESQLNMLGAPDSCGVWAPCLTHADGLFHLIYTDVKRYGRTSVGGASGASLRDFHNYLVTCDRIDGEWSDPVFLNSSGFDPSLFHDEDGRKYLLNMLWDHRPGHNRFAGIVLQEYSPQARALVGERRVIFPGTALGLTEAPHLYKRDGWYYLLTAEGGTGWNHAVTMARSRSIDGPYELHPDTHILTSFNRPDAPLQRAGHADLVETAEGETYAVYLCGRPLPNRGRCVLGRETAIQRMVWGDDGWLRTMDGQGLPSLTTPSPGLPAHPFPTAPARSDFDDPSLPLDFQWLPSPHPEELFSLFARPGWLRLYGRETIGSQFRQALVARRQQAFCVSVATFMDFHPRHFQQMAGLVCYYGGSKFHYLYVSHDEARGRHIRVMSALPDSTQADAFTEMIPIPEGPIICGQSSTMNGCFAFRLPDGDWVWLPRIFDASILSDEATSPGAPNFTGAFIGMACQDMAGSGVSADFDWFDYQERDYRADPTCR

SEQ ID NO: 177 - DNA, 2088 bp, Cochliobolus carbonum
ttagtaattcgcttactgacacaagattaacgagatctcgccttctcattggtaccatctccattgcaataacgcgtgcatcctcactttgcgactgctgaaatgttttgaaacacactcgcgtcatcttccaatctgctgttgtatgagacggctgctgtggcccaccttccgcggggacgatgtaatcgggccgtggaggtcgaatctcggtgcttattccaggacatcaccgcataattgcacaagctcccccaatcccatatcttctgcaccattgaagatggcccattctaaacttctcagattgcttattcccctaagattaggctaaaaatcgggtggggaccgcccgatgtcagacactaaaatgacttactcaagctgcgctatgagggccttaaaaggttgcctgtccacgccctcttgacagcacccaggctttcattgcacaacagtgaaccaagcttgccaaacactcttttcgtgtccgactcgtcgttttcaacatgtctgttcaagcctacgaccccccgcttatcagcaccttccaccagtgcgaccctgcagcccacgtctggaagcatgatcccaacactgtatacatctatggatcccacgactggaactcgaccaggcagcccccggtggtcagtattcaaggatttctattatgcgaatgcaggttgacaaagaacagcaatacgacatgaaggattactatgtgcttacccagaccgattacaccaagcctgccacagtcggaccaaaggtataccaattctttagctagagattggaatttgtaactgacagaaaactagcttttggaccttgtggacatcccatgggcgacacagcaactctgggctcctgatgcgactgagaaggatggacaatactacctgttcttcccagccaaggacaaggatgatgtcttccgcatcggagtggccaaatctgacaagccggacggaaaattcaagcccgagcccaacccgattgccggcacctacagcattgaccccacaatcttggaagacaatggcaactactacatggtatggggcggactgtggggtggccagcttcaagcatggaccaacaacgtcttggtaagcctccgcctttccgcacaaccccagctgttggtaagcgtgaccaagctaatactaacgcgattttcagaacacatccctattcggtaacaatgctcctacttccggcccagccatcggaccccgtttcgccaagctctcggctaacctcacctctctcgccaccacaccaaaggaactcgtcatctacgaccaggacggcaaggtcatgcaggcaggcagcacgcgccgcttcttcgagggcccatctctgaacaaggtcggcaacctctatgtcctccagtactctaccggcacctcgcacactgttgaaatcgctaccgctaccaagcctgacggtccttactactggaagagcacgcttctgcagcctgtcaagggatggactacccacgagtcgattgtcaagttcaagaatgactggcttctttactacgctgatgcctcgctttctggccgtgatgatctccgcaacaccaaggtcaggaagatcttgtttgagaatggcaccttcaagcttgctcagcctcagcctgtcattcctagctcttaaagctataaattgtttatattcactcctacatattttgctacggcttaagctgtaatgtacacagttcgctagttactgaaagcgttgttttctacacataggattgccaagcaattagattggacaatatatttgccaagatgtgaaccgagttcctgggatactactgctttacatgacgtatgttaaaccattcccttggtatagggcagactaagctggtacaacaatgtctctgtccaaaatcaaatcaagtaggcaacgactaatcatacttggtaagacaccatgaagctgcctatgaaatcaaatagctatagctgtgaagtcgctccacgtagtaaattcaagcatgcttgtatcattcatcctaccgatagcatggtagcggttgctctgaatctgttgaagacccta

SEQ ID NO: 178 - protein, 328 aa, Cochliobolus carbonum
MSVQAYDPPLISTFHQCDPAAHVWKHDPNTVYIYGSHDWNSTRQPPVQYDMKDYYVLTQTDYTKPATVGPKLLDLVDIPWATQQLWAPDATEKDGQYYLFFPAKDKDDVFRIGVAKSDKPDGKFKPEPNPIAGTYSIDPTILEDNGNYYMVWGGLWGGQLQAWTNNVLNTSLFGNNAPTSGPAIGPRFAKLSANLTSLATTPKELVIYDQDGKVMQAGSTRRFFEGPSLNKVGNLYVLQYSTGTSHTVEIATATKPDGPYYWKSTLLQPVKGWTTHESIVKFKNDWLLYYADASLSGRDDLRNTKVRKILFENGTFKLAQPQPVIPSS

SEQ ID NO: 179 - DNA, 8616 bp, Streptomyces lividans
ggtaccggttgctccgcatcgaagcggacgagccgcagaccgtcgcggaggccggacggagcatggtctggcgccacgacggcgctgaccccggcgtcggggtcctcggccggacaggcggcggcccggtacacgggcgcatgcggccttcgccccgggactggccgagatcacggccctgccggcaggcatgaggcccggtcggccctgtgtcagtcggccaggtcggcggcgcgccgtcgcagggcgttgaccagtgccgcggccggagccgtgagccggccgggcagcgacaccaggtcgatgcgccgtacttcctccgcgacgcccgtgacgtcgacgaagcggacgccgcgcgggatcacgggcagcagcgccggggaggccgtggtgacgcccgccccggccgcgaccaggtggagtttggtcagccagtcgcgggcggtgtgcgcgacgcggggccggccgggcagccccggccagacgccgagcagcggctcgtccgtgctgccgggacccgcgatccagggctgcgcggcgatgttcctcgacgtccgcggtgccgtgttcggcgaagcggctgccggccgcaacggccagggccagacgcgtttccagcagggttcgacgtgcaggggagggtcgtccgtgtcgggcgagcggtgcgggggccgggaggtcaaaagcgccaggtcgagggtgccgctgcgcagcgcgcgcaccagcgcgggagtgctcccctcccgcgtcgtcacccgcgggcgggagccttcccggcgcagtgccgacagggcgtcggccacgagcaccgcgccggcggcgggaaagtaccccagccgtacccggccggtggcgtcccgcactccgcgcagttcccggtcggccgcctccagggcgtccagcgcggcgacggcgtggcgcagcagggcgcggcccgcgccggtcggccgtacaccgccggggaagcggtcgaacaggcgggcccccgtcgcctgttccagcgcggccatctgacgggagaccgccgactgcgtgtagccgaggctgtgcgcggccgcggtgaaggtgccgcgctcggccacctcacgcagcacccgcagcccggccagcgtcacatctcccatgcccatgagcacacagcatatccggcatgccaaacattcgctgtcggaatgccccccggactcctagcgtcggcgtcatgcctctgatcaccgtttccctgcggcagggaaccacgccccagtaccgtcgcctcgtctccgaggccctgcacaagtccatggtcgacgtgctgaaaattccgcagacgaccagttccacgtcttccacgaggtcacggacgacaacttcgtcatgcagccggtcgtgttcggcctgcggcgcacctcgcgcaccctgttcatccagttgtcgttcaaaccggcgcggcgcggagcagaaggcacgactgttccgggcgatcgtcgccaacctcaggctgtacgcggacgtccccgaggaggacgtcatgctggtggccttcgagacggccagggagaactggtgggccgccggccgcgtcgtcgaccccgccaccggctacgacgagcgcatgaccgacgtgcccgccctgcccgatgtgtccgaggagcccggccggtaggagccgtcccggcccctctccaggcgcccgcgcggcccctcgccaggcgtccgtgcggctccccgtcataggtccgtgcggcccctcgtcacgggtccgcgcggaccctcgtcaggcgtccgcgccgccgggcgccgccgcggacccgcccggcggcgccgtgctctgccgtacgacgagatgggtcgccagctcgatgcgccggccggcccggccgggctcgtccggccggaagagcatgcgggtggcctcctcggccatgtgccgcagcggctggtggacggtggtcagcggcgggctcgaccactgggccagtggcacgtcgtcgtagccgacgaccgagaggtcctgagggaccctcaggcccctgacgcgggccgcctccagtaccccgagcgcctggaggtcgctgcccgcgaagaccgccgtcggccggccgggacccgcgagcaggtccatgccgtgctcgaagccgctctccacgctgtagtcgccgtaccggaccagggcagggtcgatcggcaggcccgccatcgtcatcgccgagcggtagccgtcgagccgggccagtgagcacagcatgtcctcgaaccccgtgatgatcgcgacgcgttcgtgtccgtggtcggtgaggtgcgggtgccgccaggcccccggcccagttggccgagccgacgacgggacgtcggggtccgggtcaccggccgggtcgacgatgacgaaggggatgttccaggaccgcagccgctgcttgacctccgcgggcagcgaggagaacaccagcacgacgcccagcggtctgcgtcggagcacgccttcgatccagtccggcgcgggtgcgtgccgggtgccgctgcgggtgagtacgacctcggtccggttggccttggcgacgtcctccacgccccggaccagctccatcgcccagacgctgtccagctcgtggaagacgagttcgaccagcggcgagcgcggcgggctcgcgttgcggcgacggtagccgtgcacctcgagaagccgctccaccctggccctggtggtgctggagacatccgaacgaccgttgaggaccttcgaaactgtcggggcagagacccccgcctctttcgccacctcggccagggtcacccgggcgcccacctcaacttcatcgtgcatgcaggaaggataggccatgcgatcgataacgttttgagtcggcagccgcacggccattgaccagaaatccggtctcactttactgtccgaccagcatggactttcggtgatggtgccgaaactttcgaaaggcgaacgatgaagacacgtgcgcgcttgcccagactggtcgccaccggtgcgacgctcgccctggcgctgagcctgtcggcctgcggtgacggggacggcggggcgtcgtcggacgacggcaagatccatgtcctggtctacggggacgccagcaacaagatcgaacagcagatcgtcgacaccttcaacaagacctccgacgtcaaggcggtcctcgacaccatccccggtgccgactaccagacgaagctccagacgatcatcaacaccccgcaggccccggacatcttctacaactggggcggcggcagcatcaagccgttcgtcaaggcggacctgctgctgccgctcgacgacttcatcaagaaggacccgggcctcaaggacaacttcctgccgtccgtcttcaacagcgccgtcgtcgacggaaagccgtacggcataccgatgcgcggcacccagccggtcctgctcttccacaacaagaaggtcctcgaggacgcgggcgtccagccgcccaagacctgggacgaactgctcgccgcggtgggcaagctcaaggacgcgggtgtcacgccgatcgcgctcggcggcggcgacgtgtggccgacccagatgtggttccagtacctctacgaccgcatcgccggtccggagctgttcgcgaaggccatcggcggcgacaagagcgcctgggagagcgcggacagcaagaaggccctggacatgatcagcgagctggtcgactccggcgccttcggcaagaactacgactccgtcaagtacaccaacggcggctcggtccagctggtggcctcgggcaaggccggcttcgagctgatgggctcctggtactactcccagcagctcacggaccacaaggagttcgccgagaaggaccctcgctacaccgccttcccgaccgtcgagggcggcaagggcgacccgggcaacgtcgccggcaaccccaacaactactactcggtgatgaagaagaccaagcaccccgaggccgccgccgagttcctgaagctcatgtactccgacgagttcgtcaaggcccacctcgacatcggcaacctgccgaccacgaccaacaccgacaagttcatcgacgactcggccacccccgagtacacgcgcttccagtacgacctcgtctccgacgccccgaacttccagctgtcctgggaccaggcgtacccgcagaaggccagctcggacatgcacaaggccatccagcagttcttcaacggacagctcgacacggacggcttcatcaaggccatgcaggccctcccgaccgagtgacgaacggctcatgaccacacacctcacgagcgctcggcccgccgccggatcccgcaaggagtcccggcggcggccgcccgccccgtccacgacgacggtgggccgccccagcttcgcctgggcggtgcccgccgcactgttcttcgccctcttcgcgatcgtcccgctgatcatggtggcggtgctgtccttcatgagctgggacgggatcagctcgcccgagttcgtcggcacggacaactggtcgcgcctcgccgacgacccggtgatgctcaagagcatctggctgaccctgctgctcaccgtgctcggcgtggtcctgcagacccctctgagcatcctgctcggcgtctgggccgccggtcaccagcgaacccggccggtcctgtcggtcatctacttcatccccctgctgctgtccgcgacggccgtgtccgtgctctggcgggcactgctcgacccgaacttcggcatcccggcggaggcgacctggctcttcggcgacggcaacctgttcggtgaacagaccaccgccatcggggtgctggcgttcgtcagcacctggcagttcacgccgttccacacgctgatctaccagggcgccgccgcgccggtcccgcaggtgctgtaccaggccgcggagatcgacggggcgggccgctaccggcagttcttccacatcaccctgccgcagctgcgcacctccatgatcacctcgatgatcctgatgatcgtcggcggcctgaccacgttcgagaccgtcctcatcctgacccagggcggccccggcaccgacaccaccatcagcgcctactacatgtacgacaaggccttcaagagcttcgactacggcatcggctccgcgatcgccctggccctggtcgtcgcggccacgatcatctcgctgatcgtcgtccgggtctccggctacgacaagatgcgcatcatggagggtgtgtcatgaggcgccgacccaactacctggccggcgccggctcgctcgtctggctcgtcctggtcggcctgccgctgtacgtgatgctcgccgcgaccctgcgcacccgccaggcctacgccgagaacggccccgtctccctcccggacagcttcacgctggacaacttcaccggcgccttcgactccggcttcggccagtacttcttcaacacgctcgtcgtcaccgcctgcgtgatcggcatcgtgctgctgctggtgccgccgctcgcctacgccatcgtccgcagccgcggcagggccacgtcggcgatcttccggctgttcctgctcggcctcgccatcccggcccaggccgtgatcgtgccgatgttctacctgatcagcgaggccgggctgtacgacaacctgctcggcgtcatcctgcccagggccgcgttctgcctgccgatgtccgcgctcatcctcagcggctccatgcgcgacatctccccggagctgtacgaggccatggcgatggacggcgcgagcctccggcgcatgttcttccagctcgtcatgccgctgtcccgcgggggactgtccaccatcgtggtgttctccgcgctccaggcgtggaacggcttcctgttcccgctggtcctgacccagtccgacttcaccaaggtggtcaccctgggtctgtacaacttccagaccgcgcacgggatcgacatccccggtctgctgggagccgtggtgctgtccatggtgcccatcctgctcgtctacctgttcgcccgtcgtgccctggtccaggggctgatgggtgtcggaggaaagtgactgccgacgtggctgtagagaccacccccgaaatccccctctggaacgaccccaaccaccccgtcgccagcagggtcgacgcgctcgtcgccgcgatgaccctggaggagaagatcgcccagctgtacggagtgtgggtgggtgcctccgaccagggcggcgaagtcgcccccatcagcacgacatggaggaggccgtcgacctcgacgcgctcgtgcccgccgggctcggtcagctcacccggcccttcggcaccgtcccggtcgaccccgcgctcggcgccttctcgctcatgcgcacgcaggccccgcatcacctcggccggccgcttcggcatccccgccgtcgcccatgaggagtgcctggccggcttcgcgccttggggcgccacggcctaccccgtcccgctgtcctggggcgccaccttcgacccggacgcggtgcgccggatggccgccgccatcggccgcgacatgcggtccgtcggcatccaccagggcctcgcccccgtgctcgacgtggtccgcgacggccgctggggcagggtggaggagaccatcggcgaggacccctacctcgtcggcaccatcggtaccgcgtacgtgcagggcctggagtccgccggcatcgtcgccaccctcaagcacttcgtgggctactccgcctcccgcgccggccgcaacctcggcccctcctccgtgggcacccgcgagcggaccgacgtcctgctcccgccgttcgagatggccgtccgcgagggcggctcccgctccgtgatgtccgcctacaccgacatcgacggggtgcccgcagcggccgacgaggcgctgctgaccggggctgtgcgcgacacctggggcttcgagggaacggtcgtcgccgactacttcggcatcgccttcctcaagacgctgcacggcatcaccgccgactgggccgacgccgccggagccgcgctgaaggcgggcctcgacgtcgagctgcccaccgtccaagacttcgggaccccgctcgtcgatgcggtcaccgacggccgggtgcccgaggccctcatcgaccgggctgcgccgcgtcctgggacagaaggcggagctcggactgctcgacccggactggagcccggtcccgccgcgctcgacggagtggacctctcgcacccggaggcgctgcgcggccggatcgacctggaccggcccgagaaccgggaactggcccgcgagatcgccgagaaggcggtcgtcctgctcaccaacgacggcaccctgccgctcgcccggccccgccgcatcgcactgatcggccccaacgccgccgaggccaccgccgtactcggctgctactccttcccgcgccacgtcggggtgcagcacccggaggtcccggtcggcctcgacctgcccaccctgtacgacaccctgaccgccgagttccccgacgccgacatcgccctcgcccgcggcaccggcgtcgacgacggcgaggtgtccggcatcggcgaggcggtggacgcggcccgggccgcggacgtcgtcgtcgccgtactgggcgaccgcgcgggcctgttcggccggggcaccagcggcgagggctgcgacgccgaatccctcaccctgcccggcgcccagcagcggctcctcgacgcgctgctcgactccggcaccccggtggtcaccgtgctcctcgccggacgcccctacgcactcggccgcgcacggcagtccgcggcgatcgtgcagtcgttcttccccggcgaggagggcaccgcggcgctcgccggcgtgctcagcggacgcaccagccccaccggcagactgcccgtcagtgtgcccggcagcgctgcccagccgaccacctacctcggggcgcggctcgcccaggccagcgaggtgtccaacatcgacccgacaccggccttcggcttcgggcacgggctcacgtacaccacgttcgcctggagcgacctggtggcgcacaccaaggaggcgccgaccgacggtgcgttctcgctggagctgaccgtccgcaacaccggcgaacggcacggcaccgaggtggtgcagctctacctgcacgacccggtcgcctccgtcgtccagccggtgcagcgcctcatcggctacacgcgggtgccgctgcgacccggcgaggcccgccgggtgcgcgtcgaggtccccgccgacctcgcctccttcaaccgccgcgacggccgccggatcgtcgaaccgggcgacctggagctgcggttcgccgcgtccagcaccgagccgcggctgacggcgacggtcgcgctcacgggaccggaacggcgggtcgaccaacacccggcgactgcacgccgtcttcgcgcaggagaccgtggaaggcgcggtcgagggcgcctgagcggcccatgggaagcaccggtggtccccgcgaccaccgctcgccgggcggttcagcggacgacgtcgaagacgttcttctggatgccgttggcgtacacctcgtgctcgacgagcctcagcttccgggcgtccttgtccgtgtcgctgaacagccgcttgcccgcgccgagcagcagcgggaagaccagcaggtggtagcggtcgatc

SEQ ID NO: 180 - protein, 300 aa, Streptomyces lividans
MTLAGLRVLREVAERGTFTAAAHSLGYTQSAVSRQMAALEQATGARLFDRFPGGVRPTGAGRALLRHAVAALDALEAADRELRGVRDATGRVRLGYFPAAGAVLVADALSALRREGSRPRVTTREGSTPALVRALRSGTLDLALLTSRPPHRSPDTDDPPLHVEPCWKRVWPWPLRPAAASPNTAPRTSRNIAAQPWIAGPGSTDEPLLGVWPGLPGRPRVAHTARDWLTKLHLVAAGAGVTTASPALLPVIPRGVRFVDVTGVAEEVRRIDLVSLPGRLTAPAAALVNALRRRAADLAD

SEQ ID NO: 181 - protein, 338 aa, Streptomyces lividans
MTLAEVAKEAGVSAPTVSKVLNGRSDVSSTTRARVERLLEVHGYRRRNASPPRSPLVELVFHELDSVWAMELVRGVEDVAKANRTEVVLTRSGTRHAPAPDWIEGVLRRRPLGVVLVFSSLPAEVKQRLRSWNIPFVIVDPAGDPDPDVPSSARPTGPGAWRHPHLTDHGHERVAIITGFEDMLCSLARLDGYRSAMTMAGLPIDPALVRYGDYSVESGFEHGMDLLAGPGRPTAVFAGSDLQALGVLEAARVRGLRVPQDLSVVGYDDVPLAQWSSPPLTTVHQPLRHMAEEATRMLFRPDEPGRAGRRIELATHLVVRQSTAPPGGSAAAPGGADA

SEQ ID NO: 182 - protein, 434 aa, Streptomyces lividans
MKTRARLPRLVATGATLALALSLSACGDGDGGASSDDGKIHVLVYGDASNKIEQQIVDTFNKTSDVKAVLDTIPGADYQTKLQTIINTPQAPDIFYNWGGGSIKPFVKADLLLPLDDFIKKDPGLKDNFLPSVFNSAVVDGKPYGIPMRGTQPVLLFHNKKVLEDAGVQPPKTWDELLAAVGKLKDAGVTPIALGGGDVWPTQMWFQYLYDRIAGPELFAKAIGGDKSAWESADSKKALDMISELVDSGAFGKNYDSVKYTNGGSVQLVASGKAGFELMGSWYYSQQLTDHKEFAEKDPRYTAFPTVEGGKGDPGNVAGNPNNYYSVMKKTKHPEAAAEFLKLMYSDEFVKAHLDIGNLPTTTNTDKFIDDSATPEYTRFQYDLVSDAPNFQLSWDQAYPQKASSDMHKAIQQFFNGQLDTDGFIKAMQALPTE

SEQ ID NO: 183 - protein, 317 aa, Streptomyces lividans
MTTHLTSARPAAGSRKESRRRPPAPSTTTVGRPSFAWAVPAALFFALFAIVPLIMVAVLSFMSWDGISSPEFVGTDNWSRLADDPVMLKSIWLTLLLTVLGVVLQTPLSILLGVWAAGHQRTRPVLSVIYFIPLLLSATAVSVLWRALLDPNFGIPAEATWLFGDGNLFGEQTTAIGVLAFVSTWQFTPFHTLIYQGAAAPVPQVLYQAAEIDGAGRYRQFFHITLPQLRTSMITSMILMIVGGLTTFETVLILTQGGPGTDTTISAYYMYDKAFKSFDYGIGSAIALALVVAATIISLIVVRVSGYDKMRIMEGVS

SEQ ID NO: 184 - protein, 272 aa, Streptomyces lividans
MRRRPNYLAGAGSLVWLVLVGLPLYVMLAATLRTRQAYAENGPVSLPDSFTLDNFTGAFDSGFGQYFFNTLVVTACVIGIVLLLVPPLAYAIVRSRGRATSAIFRLFLLGLAIPAQAVIVPMFYLISEAGLYDNLLGVILPRAAFCLPMSALILSGSMRDISPELYEAMAMDGASLRRMFFQLVMPLSRGGLSTIVVFSALQAWNGFLFPLVLTQSDFTKVVTLGLYNFQTAHGIDIPGLLGAVVLSMVPILLVYLFARRALVQGLMGVGGK

SEQ ID NO: 185 - protein, 861 aa, Streptomyces lividans
MTADVAVETTPEIPLWNDPNHPVASRVDALVAAMTLEEKIAQLYGVWVGASDQGGEVAPISTTWRRPSTSTRSCPPGSVSSPGPSAPSRSTPRSAPSRSCARRPRITSAGRFGIPAVAHEECLAGFAPWGATAYPVPLSWGATFDPDAVRRMAAAIGRDMRSVGIHQGLAPVLDVVRDGRWGRVEETIGEDPYLVGTIGTAYVQGLESAGIVATLKHFVGYSASRAGRNLGPSSVGTRERTDVLLPPFEMAVREGGSRSVMSAYTDIDGVPAAADEALLTGAVRDTWGFEGTVVADYFGIAFLKTLHGITADWADAAGAALKAGLDVELPTVQDFGTPLVDAVTDGRVPEALIDRAAPRPGTEGGARTARPGLEPGPAALDGVDLSHPEALRGRIDLDRPENRELAREIAEKAVVLLTNDGTLPLARPRRIALIGPNAAEATAVLGCYSFPRHVGVQHPEVPVGLDLPTLYDTLTAEFPDADIALARGTGVDDGEVSGIGEAVDAARAADVVVAVLGDRAGLFGRGTSGEGCDAESLTLPGAQQRLLDALLDSGTPVVTVLLAGRPYALGRARQSAAIVQSFFPGEEGTAALAGVLSGRTSPTGRLPVSVPGSAAQPTTYLGARLAQASEVSNIDPTPAFGFGHGLTYTTFAWSDLVAHTKEAPTDGAFSLELTVRNTGERHGTEVVQLYLHDPVASVVQPVQRLIGYTRVPLRPGEARRVRVEVPADLASFNRRDGRRIVEPGDLELRFAASSTEPRLTATVALTGPERRVDQHPATARRLRAGDRGRRGRGRLSGPWEAPVVPATTARRAVQRTTSKTFFWMPLAYTSCSTSLSFRASLSVSLNSRLPAPSSSGKTSRW

SEQ ID NO: 186 - DNA, 2286 bp, Bacillus sp. KK-1
gctatgccgcaggccaggtccaaacacctgaagcgttgacagggatattattaacgacaactgtagttccggttattttccttatattggctatgatcgacattaatttttacaatttaagcgatgaaaaatatgcaaaagtcgtacgtgaattagagaatagagataaagtgacttggactctatgaagaatttcagtggaaatatacattttaaagacaaccgtgaggaggaatgaagatgaaaattatcaatccggtgcttaaaggtttcaacccggatccatccatatgtagagtaggggaagattattatatcgcagtatccaccttcgaatggtttccaggagtgcaaatccatcattcaaaagatttggtgaattggcgtttaattgcacatccgttgcagagggtttcacaattggatatgaaagggaatcccgactcaggcggtgtatgggcgccttgtctaagttatagtgaaggaaagttttggcttatatatacagatgtaaaagttgtggacggagcctggaaagactgtcataactatttagttacttgcgaaaccgtcgatggggattggggggagccgattcaactaaatagttccggcttcgatgcttcattgttccatgatgtcgacggaagaaaatatttgttaaatatgctgtgggatcaccggatcggccgccattcattcggaggcattgtgatgcaggaattttccgtgcgcgaaaaaaggcttatccatcaaccgaaaatcatttttgaaggcacagatattaaactgactgaagcgccgcacctttatcatatcggggattattactatttgttgacagcggaaggcgggacccgttacgagcatgccgccacaattgcccgttcaaaacatatcgaaggaccatatgagattcaccccgacaatccaattttaacgtcttggcacgaacctcggaatccgttgcagaaatgcggacatgcatcaattgtggaaacgcatacaggtgagtggtatttagctcacttaaccgggcgtcctattcatcctgctgatgactcggttattcaccaaagaggatattgtcctttgggaagagaaaccgcgattcaaaaattagagtggaaagacggctggccttatgtggcaggcggaaaagaggggagggtggaggtggaagcgccccgcatatctgaaaccaagtttccatcgacatatcaggaagtcgatcaatttgctgatcggacattaaatatgaactttcagacattgcggattccctttacgaaagaattaggatcattgactgaaaggccgaatcatttacgtttatatggacgtgaatcactaacctctacatttacccaggcgtttgtagccaggcgttggcaaagcctccgttttacagcggagactgctgttgatttcaacccggagacctttcagcaagccgcgggactcgtgaattactacaacaccgaaaactggacggctcttcaagtgacttatgatgaagaccttgggcgcattttggatgtaacgatatgcgataattttacattctcacagccgataaaagacaaaattgtcatcccgcgggacatacaatatgtttatttaagagtaaatgtcgaatgggaaacatattattactcctattcttttaataaaaaagactggtataaaattgagatcccgttggaatctaaaaaactgtcagatgattatgtgcgcggaggaggattcttcaccggagcttttgtgggaatgcaatgccaagatacaagcggagcacatcaacatgccgattttgattactttatgtataaagagctatgagtcaaaaaaacagcgcccccgacaatcgggggcggtttaaatccgttttcgtcccttccagttttaatgctcctttcttccctcggtttattttaaaagttgtcatcctcgctcgcttaacgggtaagtgaaacccggaaggggcagatgcatgataaaacctttcaaattaaacttcattactaaacaatgattccggaaggtgttcattaatgaacatccatcgcttgattgccgattgaatttgaaagttgccccaacttataataaacacatgttcattagttgatgagtgttcagaatggcaaaggaggttttgcgatgaagcaatccgtttgacttttccagcgagccatcctcaagctccatgtcgctttctaaccaaaacctttgatcaaacgcaggaaaacgaacctgggcatgcgtgaacagggctgaaagctt

SEQ ID NO: 187 - protein, 533 aa, Bacillus sp. KK-1
MKIINPVLKGFNPDPSICRVGEDYYIAVSTFEWFPGVQIHHSKDLVNWRLIAHPLQRVSQLDMKGNPDSGGVWAPCLSYSEGKFWLIYTDVKVVDGAWKDCHNYLVTCETVDGDWGEPIQLNSSGFDASLFHDVDGRKYLLNMLWDHRIGRHSFGGIVMQEFSVREKRLIHQPKIIFEGTDIKLTEAPHLYHIGDYYYLLTAEGGTRYEHAATIARSKHIEGPYEIHPDNPILTSWHEPRNPLQKCGHASIVETHTGEWYLAHLTGRPIHPADDSVIHQRGYCPLGRETAIQKLEWKDGWPYVAGGKEGRVEVEAPRISETKFPSTYQEVDQFADRTLNMNFQTLRIPFTKELGSLTERPNHLRLYGRESLTSTFTQAFVARRWQSLRFTAETAVDFNPETFQQAAGLVNYYNTENWTALQVTYDEDLGRILDVTICDNFTFSQPIKDKIVIPRDIQYVYLRVNVEWETYYYSYSFNKKDWYKIEIPLESKKLSDDYVRGGGFFTGAFVGMQCQDTSGAHQHADFDYFMYKEL

SEQ ID NO: 188 - DNA, 4005 bp, Aspergillus nidulans
accggtttggccgaaccatgccgtccagtttcacctcggtctccaccaacgactcagcgaaagtgttcgccaaccaagcgcgcgaactgcgcagccgccattctggtactcttttgagtacggcatggcgcacatcgtcatgataacaccgaaactgatttcgaagacgcgcccagcggaaaaggcggttcggctcatctaaacggcgggcctttcggcgcaaagaaccagcaactcgagttccttgaagccgacctggcgagtgtcgaccgcgatgttacaccgtgggtcatcgtcgccggccatcgctggtacacggccggcagcgcatgcacaccgtgccaagaggcattcgaggatctgctgtatacctacggcgtcgacctaggtgtcttcgggcacgtacacaacgcgcaacgcttcttgccggtctacaacagcgtcgcggaccctaacggaatgcaggaccccaaggcgcccatgtatattgtcgctggaggcgcggggaatatcgagggcttgagctctataaccaagcagttggatttcaccgagttcgcaaatgatgaggattatacctattcaacaatcaggtttttggatcggaatcacctccaagtggactttatcaactcggtctctggggaggtgttggatacgagcacgcctgtataagagtcatgaggcgcggtttgtgaggcagtgacgggccgggttctgtatatatagcagaaacatcactcgggtatatacgcttgtggattgtacatagttggtgatgcggcaatggccttctgttgcgttttcagctctctgcctggtctctcagccccgccggatatcccccagcttgtttagccggaccccgtgggggcctcactttctatctccaatccccaccactcttcctcgcacggacatatccccggctaaagaagagctgggtgtaacgccacaacgcccacttcggaagatcgccgccttggtcatgattcagcctgaaggcaaatgatccgatctccgatgtctcctagaagttatcatgacggtttgatgacattgctcttgacctttggagatcaccaagcctgagtctcactttgttaggataccggcagtgagcagccctaaaacctcattctgagctgctaccttggataatccggctattcaggctaaattcctgcctgctctcgcctccccgcattgtacgccctgatcggcatctccaaatgccggtatccttggatcaccggcgggcgagatggcgatcgtcactgcgtgagctggagctccctttatccatcggcaatagtccgggacattatgacaataagcaaggtataagaaacgctcgacgctcgcggcagtcacagtagcggaccagagcaaccttcaagcgcacaggtagagctcaccatgaggtctctcatctctgtggccgttctgtcggctctggcagccttctctcaagcgaacaccagctacacagactacaatgtcgaagccaaccccgacctcttcccgctatgccttcagcatctcaacgcgtccttcccggactgcgccacgggcccgctcagtttgacccccgtctgcgaccgctcgttgagccctaaggaccgcgcgacagcgctcgtctcgctcttcaccttcgatgaactcgtcaacaacaccggtaatacaggtcttggcgtttcacggcttggactgcccaactaccaggtctggggtgaggcgctccatggcgttggaagggctaactttgtcgaatccggcaatttcagctgggcgacgtcattccccatgccaatcacgatgatggcggccctgaataagaccctgatccatcagatcgggaccattgtctccacgcagctgcgcgcattcagtaacgccggactcggcggagtagacgtctactcccccaacatcaacactttccgacacccggtctggggccgcgggcaggagacgcctggtgaagacgcatttcttacttcggtctatgggtacgagtacattaccgcgttgcagggagccgttgacccggagacgtccaagatcatcgcaacagcgaaacactacgcgggctacgatattgagagctggaataaccactcgcgtcttggaaacgacatgcagatcacccagcaggagctgtcggagtactatactccgccctttattgttgcctcgcgcgacgctaaggtccgcagcgtgatgtgttcctacaatgctgtgaacggggtgccgagctgcgccaataaattcttccttcagactttgttgagggatacatttgagtttagcgaagacgggtacgtctccggtgactgcggtgctgtctacaacgtgtggaaccctcatgggtatgcgagcaacgaggcggctgcgtccgcggattcgattcttgccggcacagacatcgactgtggaacttcataccagtggcactctgaggatgcattcgaggacagtctcgtctcgcgatcggacattgagcgcggcgttatccgcctctacagcaacctcgtgcaagctgggtactttgacggcgaagacgcgccataccgcgatattacatgggacgacgtcctcagcaccgacgcctggaacatcgcgtacgaggcagccgtcgagggaatcgtcctgcttaagaatgatgagacgctccccctttccaaggacatcaagagcgtcgcggtgatcggtccttgggcgaacgtcaccgaggaactccagggcaactattttggcccagcgccctacctcattagcccactgactggcttccgcgactctggtctggacgtccactacgcgctcggcaccaacctgacctcgcactcgacatccggtttcgaagaggcgctcaccgcagctaagcaagccgacgcaatcatctttgctggcggaattgacaacacaatcgaagccgaagccatggaccgcgagaatatcacttggcctgggaaccagctcgacctaatcagcaagctcagcgagctcggcaagccgcttgtcgtcctgcaaatgggcggtggtcaggttgattcatcctccctaaaagacaacgacaacgtcaacgcactcatctggggcggataccccggccagtcgggtgggcatgcactcgccgatatcattaccggcaagcgcgcgcctgctggccgcctcgtgacaacgcaatatcctgctgaatatgcagaagtgttcccggccatcgatatgaacctgaggccgaatgagactagcgggaaccctgggcagacgtacatgtggtacactgggactccagtctatgagttcggacacggccttttctatacaactttcgaggagtcgacggagacaacagatgcgggatctttcaacattcagacagtccttacgacgccgcactcgggatacgagcacgctcagcagaagacactcctaaacttcaccgcgacggtcaagaacactggcgagcgtgagtccgactacacggcactagtctacgttaacaccaccgctggtccggcgccgtatcccaagaagtgggttgttgggttcgaccggctcggaggattggaaccgggtgactcgcagaccctgacggtccctgtgacggttgagagcgtcgccaggacagacgagcagggaaacagggtgttgtatcctggctcttatgacgtggcgctgaacaacgagcgctctgttgttgtgaagtttgagctgaaaggcgaggaggcggttattctgagttggccggaggatacgacctcggactttgtttctagcattgacggaggccttgacaggaagcaggatgttattgcttagtgtttctatctggatatgcctagcattaatattggagctgcaatatcatagacagactgcctgtcttcacttcgcctcttcagaactctacgagtagtcttcatagtggccagaataaatcgcaagtgtccaactataaccgtaagcactgaatcatagaatctctcaactgaattc

SEQ ID NO: 189 - protein, 802 aa, Aspergillus nidulans
MRSLISVAVLSALAAFSQANTSYTDYNVEANPDLFPLCLQHLNASFPDCATGPLSLTPVCDRSLSPKDRATALVSLFTFDELVNNTGNTGLGVSRLGLPNYQVWGEALHGVGRANFVESGNFSWATSFPMPITMMAALNKTLIHQIGTIVSTQLRAFSNAGLGGVDVYSPNINTFRHPVWGRGQETPGEDAFLTSVYGYEYITALQGAVDPETSKIIATAKHYAGYDIESWNNHSRLGNDMQITQQELSEYYTPPFIVASRDAKVRSVMCSYNAVNGVPSCANKFFLQTLLRDTFEFSEDGYVSGDCGAVYNVWNPHGYASNEAAASADSILAGTDIDCGTSYQWHSEDAFEDSLVSRSDIERGVIRLYSNLVQAGYFDGEDAPYRDITWDDVLSTDAWNIAYEAAVEGIVLLKNDETLPLSKDIKSVAVIGPWANVTEELQGNYFGPAPYLISPLTGFRDSGLDVHYALGTNLTSHSTSGFEEALTAAKQADAIIFAGGIDNTIEAEAMDRENITWPGNQLDLISKLSELGKPLVVLQMGGGQVDSSSLKDNDNVNALIWGGYPGQSGGHALADIITGKRAPAGRLVTTQYPAEYAEVFPAIDMNLRPNETSGNPGQTYMWYTGTPVYEFGHGLFYTTFEESTETTDAGSFNIQTVLTTPHSGYEHAQQKTLLNFTATVKNTGERESDYTALVYVNTTAGPAPYPKKWVVGFDRLGGLEPGDSQTLTVPVTVESVARTDEQGNRVLYPGSYDVALNNERSVVVKFELKGEEAVILSWPEDTTSDFVSSIDGGLDRKQDVIA

SEQ ID NO: 190 - DNA, 2564 bp, T. reesei
ggacagccggacgcaatggtgaataacgcagctcttctcgccgccctgtcggctctcctgcccacggccctggcgcagaacaatcaaacatacgccaactactctgctcagggccagcctgatctctaccccgagacacttgccacgctcacactctcgttccccgactgcgaacatggccccctcaagaacaatctcgtctgtgactcatcggccggctatgtagagcgagcccaggccctcatctcgctcttcaccctcgaggagctcattctcaacacgcaaaactcgggccccggcgtgcctcgcctgggtcttccgaactaccaagtctggaatgaggctctgcacggcttggaccgcgccaacttcgccaccaagggcggccagttcgaatgggcgacctcgttccccatgcccatcctcactacggcggccctcaaccgcacattgatccaccagattgccgacatcatctcgacccaagctcgagcattcagcaacagcggccgttacggtctcgacgtctatgcgccaaacgtcaatggcttccgaagccccctctggggccgtggccaggagacgcccggcgaagacgcctttttcctcagctccgcctatacttacgagtacatcacgggcatccagggtggcgtcgaccctgagcacctcaaggttgccgccacggtgaagcactttgccggatacgacctcgagaactggaacaaccagtcccgtctcggtttcgacgccatcataactcagcaggacctctccgaatactacactccccagttcctcgctgcggcccgttatgcaaagtcacgcagcttgatgtgcgcatacaactccgtcaacggcgtgcccagctgtgccaacagcttcttcctgcagacgcttttgcgcgagagctggggcttccccgaatggggatacgtctcgtccgattgcgatgccgtctacaacgttttcaaccctcatgactacgccagcaaccagtcgtcagccgccgccagctcactgcgagccggcaccgatatcgactgcggtcagacttacccgtggcacctcaacgagtcctttgtggccggcgaagtctcccgcggcgagatcgagcggtccgtcacccgtctgtacgccaacctcgtccgtctcggatacttcgacaagaagaaccagtaccgctcgctcggttggaaggatgtcgtcaagactgatgcctggaacatctcgtacgaggctgctgttgagggcatcgtcctgctcaagaacgatggcactctccctctgtccaagaaggtgcgcagcattgctctgatcggaccatgggccaatgccacaacccaaatgcaaggcaactactatggccctgccccatacctcatcagccctctggaagctgctaagaaggccggctatcacgtcaactttgaactcggcacagagatcgccggcaacagcaccactggctttgccaaggccattgctgccgccaagaagtcggatgccatcatctacctcggtggaattgacaacaccattgaacaggagggcgctgaccgcacggacattgcttggcccggtaatcagctggatctcatcaagcagctcagcgaggtcggcaaaccccttgtcgtcctgcaaatgggcggtggtcaggtagactcatcctcgctcaagagcaacaagaaggtcaactccctcgtctggggcggatatcccggccagtcgggaggcgttgccctcttcgacattctctctggcaagcgtgctcctgccggccgactggtcaccactcagtacccggctgagtatgttcaccaattcccccagaatgacatgaacctccgacccgatggaaagtcaaaccctggacagacttacatctggtacaccggcaaacccgtctacgagtttggcagtggtctcttctacaccaccttcaaggagactctcgccagccaccccaagagcctcaagttcaacacctcatcgatcctctctgctcctcaccccggatacacttacagcgagcagattcccgtcttcaccttcgaggccaacatcaagaactcgggcaagacggagtccccatatacggccatgctgtttgttcgcacaagcaacgctggcccagccccgtacccgaacaagtggctcgtcggattcgaccgacttgccgacatcaagcctggtcactcttccaagctcagcatccccatccctgtcagtgctctcgcccgtgttgattctcacggaaaccggattgtataccccggcaagtatgagctagccttgaacaccgacgagtctgtgaagcttgagtttgagttggtgggagaagaggtaacgattgagaactggccgttggaggagcaacagatcaaggatgctacacctgacgcataagggttttaatgatgttgttatgacaaacgggtagagtagttaatgatggaataggaagaggccatagttttctgtttgcaaaccatttttgccattgcgaaaaaaaaaaaaaaaaaaaaaaaaaaaaaaaaaaaaaaaaaaaaaaaaaaaaaaaa

SEQ ID NO: 191 - protein, 797 aa, T. reesei
MVNNAALLAALSALLPTALAQNNQTYANYSAQGQPDLYPETLATLTLSFPDCEHGPLKNNLVCDSSAGYVERAQALISLFTLEELILNTQNSGPGVPRLGLPNYQVWNEALHGLDRANFATKGGQFEWATSFPMPILTTAALNRTLIHQIADIISTQARAFSNSGRYGLDVYAPNVNGFRSPLWGRGQETPGEDAFFLSSAYTYEYITGIQGGVDPEHLKVAATVKHFAGYDLENWNNQSRLGFDAIITQQDLSEYYTPQFLAAARYAKSRSLMCAYNSVNGVPSCANSFFLQTLLRESWGFPEWGYVSSDCDAVYNVFNPHDYASNQSSAAASSLRAGTDIDCGQTYPWHLNESFVAGEVSRGEIERSVTRLYANLVRLGYFDKKNQYRSLGWKDVVKTDAWNISYEAAVEGIVLLKNDGTLPLSKKVRSIALIGPWANATTQMQGNYYGPAPYLISPLEAAKKAGYHVNFELGTEIAGNSTTGFAKAIAAAKKSDAIIYLGGIDNTIEQEGADRTDIAWPGNQLDLIKQLSEVGKPLVVLQMGGGQVDSSSLKSNKKVNSLVWGGYPGQSGGVALFDILSGKRAPAGRLVTTQYPAEYVHQFPQNDMNLRPDGKSNPGQTYIWYTGKPVYEFGSGLFYTTFKETLASHPKSLKFNTSSILSAPHPGYTYSEQIPVFTFEANIKNSGKTESPYTAMLFVRTSNAGPAPYPNKWLVGFDRLADIKPGHSSKLSIPIPVSALARVDSHGNRIVYPGKYELALNTDESVKLEFELVGEEVTIENWPLEEQQIKDATPDA

SEQ ID NO: 192 - DNA, 1846 bp, T. reesei
atttgactactctgctacagtggctattgaagctttctcgcccaagttcagacttttcttacgagcctgccttgctttgaagttttcgcccctggcattacaatgctctccaacgctcgtatcatcgcagcgggctgtattgctgcaggctctctcgttgctgctgggccttgtgacatctactcctcgggcggaacgccttgcgttgccgcccacagcaccactcgagctctgttcagcgcttataccggcccgttataccaggtaaagcgcggctccgatggtgccacaaccgccatatcgcccctctcaagtggtgtggccaacgctgccgctcaagatgctttctgtgcgggaactacatgcctcattaccatcatatacgaccagtcgggtcgcggcaaccatctcacccaggccccgccgggcggcttcagcggcccggaatccaacggctatgacaacctggctagtgcaattggggcgccggtaacactcaacggccagaaggcgtatggagttttcgtgtctccaggaacggggtatcggaataacgctgccagcggcacagccaaaggagatgccgcggagggcatgtatgcggttctcgatggtacacactacaacggcgcctgctgctttgactatggcaacgccgagaccaacagccgcgatacaggcaacggtcatatggaggccatctattttggcgacagcactgtctggggtactggctcaggcaagggtccgtggatcatggctgatctcgagaacggcttgttctcaggctccagtcccggcaacaatgccggtgatccgtccatctcgtaccggttcgtcactgcagcgatcaaggggcagccaaaccaatgggcaatccgtggcggcaatgctgcgtctggctcgctgtcaactttctacagcggcgctcgcccacaagtctccggatacaatccgatgagcaaagagggcgccatcattctcggcattggcggcgacaacagcaacggcgcccagggcacattctatgagggcgtcatgacctctggatatccttccgatgcaacagagaattcagtgcaagccaacatcgtagctgccagatatgccgtcgcgccgctgacaagtggtcctgccctcaccgtcggttcgtcaatctctctacgagccacaacagcttgctgcacgactcgctacatcgctcatagcgggtctacggtcaacacccaagtcgtctcatcatccagcgccacagccctcaagcaacaggccagctggacggttcgtgccggcctggcaaataacgcttgcttctcgtttgagtccagggacacgtcgggcagctacattcgccactccaacttcggtcttgtgttgaatgccaatgatggcagtaagctctttgctgaggatgctaccttttgcacgcaggcgggcattaacggccagggaagctccattagatcttggagctacccaacgcgatactttcgccactacaataacacgctctacatcgcgagtaacgggggcgttcacgtattcgatgccactgccgctttcaacgacgacgtgagctttgtggttagtggcggttttgcttaagtcacctcccttgccatggggtgatgcgaacgtacccgatgtatatagcgaatccactccttactgtgtgacctacatatggggcatttgcaggtagatagctggtgtttgatcagacctgtctggggggcgagggggattttctcagtggaggtcagacaatcgtttctgttgtggctatttgtacctatttcaggctttcgttcgaatacacctaacgtataaaaaaaaaaaaaaaaaa

SEQ ID NO: 193 - protein, 500 aa, T. reesei
MLSNARIIAAGCIAAGSLVAAGPCDIYSSGGTPCVAAHSTTRALFSAYTGPLYQVKRGSDGATTAISPLSSGVANAAAQDAFCAGTTCLITIIYDQSGRGNHLTQAPPGGFSGPESNGYDNLASAIGAPVTLNGQKAYGVFVSPGTGYRNNAASGTAKGDAAEGMYAVLDGTHYNGACCFDYGNAETNSRDTGNGHMEAIYFGDSTVWGTGSGKGPWIMADLENGLFSGSSPGNNAGDPSISYRFVTAAIKGQPNQWAIRGGNAASGSLSTFYSGARPQVSGYNPMSKEGAIILGIGGDNSNGAQGTFYEGVMTSGYPSDATENSVQANIVAARYAVAPLTSGPALTVGSSISLRATTACCTTRYIAHSGSTVNTQVVSSSSATALKQQASWTVRAGLANNACFSFESRDTSGSYIRHSNFGLVLNANDGSKLFAEDATFCTQAGINGQGSSIRSWSYPTRYFRHYNNTLYIASNGGVHVFDATAAFNDDVSFVVSGGFA

SEQ ID NO: 194 - DNA, 3078 bp, Clostridium stercorarium
gcagatgtggcaacaatcatcatgacagccataaccagtgagataattcttgcttttttcattttttgctctcctttcatttttttatattaaagattattaattacgttttttctcaccggctgccaatttccacagagttgctaattgattggtaaaaagttgtaaaattcatatactgccatattttattattgttaattttattatatttaatagaattttgggttgtcaagataaaacgttttatattattaattttgtgccgactttatatgagttaatatttttaacttcgcttagcgccttgataacactacaatagtgtctggcagggaataattgccgaacctgagtgaccaaagggcatataataaacgtttatacctaatctaatatatgcaataggatttattaaatgaatcggtaataaaagttgttaaattaaataaattactgtatattgaaactaaggtaaaaaaagatataaagaaattccggaaagaagaggaggcgaaataatgagaaaacagagattcaacccatatcttccttcatgggaatatatacccgatgccgaaccttacgtgtttaacggcagagtatatatttacggctctcatgaccggtttaacggccacgccttttgtctaaacgattatgtatgctggtctgcgcctgttgacgatctttccgagtggcggtatgaaggtgtgatatacagaaaaaccgatgatccgcttaatcctgatggcagaatgtgcctctatgcgcctgatgttactttggggcctgacggaaggtattatttgtattatgttctggataaagtccctgttgtgtcggttgcggtttgcgatactcctgcgggtaaatacgaattttacggttatgttcgttacgctgacggaacgcgtcttggcgaaagggaaggggattggccgcagtttgatccggcggtacttacagaaggggaaagaacatatctgtatacaggtttttgtcccaagggtgacaaatcaaggaagggagcaatggctaccgttttgggacctgatatgctgacagtggttgaagagcctgtgattattgttccaagtgaaccatacagcaggggaagcggttttgaagggcatgaattttttgaggcgccttccatcagaaaaaaaggagacacatactattttatatattcttcggttgtaatgcatgaactttgctatgctacaagcaagcatccgactaaaggttttaaatatggcggcgtgatagtcagtaactgtgatcttcatattgattcgtataagcctgcggaaaagccaatgtattatggtggaaacaatcatggcagtattgttgaaatcaacggagaatggtatatcttttatcatcgtcataccaacgggaccagtttcagccggcagggatgcatggaaaaaattaaaattcttgaagacggttcaattcctcaggtggaaatgacgtcgtgcggttccgccgacgaaccgttacccggaagaggggaatatcctgcatatatagcatgtaacctgttctgcggtgaagaatccgtttataccgatttaactggcgcatggatgaacaatcagtttccgaagatcacccaggacgggaaggacggggatgaagagccggggtacatagcgaacatgaaagactctgcaacggcgggcttcaagtattttgactgcaaggggatcaaatcggtcaagattaaagtgcgcgggtattgccgaggtgtttttgaggtaaaaacatcctggaatggggaagtacttggaaaaatccctgttgaattttcaaatatatggactgagttctcagccagtatacccattccggacggaatacatgcactgtattttacatacagggggtcgggcagtgcaagcctcaaatcattcactctgtgtactgactaaagttagtccatgctgttttcaactgggttggtattttcaagcgaagcatcttcgcttattttttttaccgactcgcgaataacaagcctgcaaggtattttaatgatttctccgggagcaggttcatagccctgttcgagcatctgtatcattacttttgcagcctcatgccctattttccccagttgaatctcatttgttgtgaggccgggattaatacattcagcaatctctttgttgtcataaccggctaccgaaatatcttctcctattctgatacctttttcataaagatagtggtataagcccaccgccattaaatcattcatgcagaagaccgcggtaacgccctgacttacaaggctttctgcaagtttgtagcctgatgctctcatccagtcgccgtatttgacaaggtcaggattgaacagaattttttcttcaaacagtgccttctgaaatccttccagacgtttcattgtatgtatattatcaggggtgcctgcgattacgcctattttacgatgccccattgaaatcaggtatttggcaatatcatatcctcctttttcatcatcaattacaattgaggtatacttcggcgaatcagatattccatagacaacaattcccggaatgccgaagtcatcggggaaacattttataatacggcagtgaccggcaacatatacaataccgtccacctttattgagagcagttccttgacggaaggctgaagtaccgagttatatttttgactgtcgttataccacgtgttggaccatttataatacagccgcatgtcaacaagaacggtgcggtaattatgctcctcgcagtaagccattattgccccgacaataggggccgtgctgaatatatttaaatcttccacaataatgccgataatccgtgttttttgcttacgaatgccctgggcaaaataatttggcttataaccggtccgacggacaacttcaagtaccttctgccctgttttttcgctgacgtttgttttgccgttcagtatgtttgagactgtacttacggatacattacataattgcgctatttctttcagtgtaaccaattttcccgttcctttccattgtaaccggtaaaacatttaatcag

SEQ ID NO: 195 - protein, 473 aa, Clostridium stercorarium
MRKQRFNPYLPSWEYIPDAEPYVFNGRVYIYGSHDRFNGHAFCLNDYVCWSAPVDDLSEWRYEGVIYRKTDDPLNPDGRMCLYAPDVTLGPDGRYYLYYVLDKVPVVSVAVCDTPAGKYEFYGYVRYADGTRLGEREGDWPQFDPAVLTEGERTYLYTGFCPKGDKSRKGAMATVLGPDMLTVVEEPVIIVPSEPYSRGSGFEGHEFFEAPSIRKKGDTYYFIYSSVVMHELCYATSKHPTKGFKYGGVIVSNCDLHIDSYKPAEKPMYYGGNNHGSIVEINGEWYIFYHRHTNGTSFSRQGCMEKIKILEDGSIPQVEMTSCGSADEPLPGRGEYPAYIACNLFCGEESVYTDLTGAWMNNQFPKITQDGKDGDEEPGYIANMKDSATAGFKYFDCKGIKSVKIKVRGYCRGVFEVKTSWNGEVLGKIPVEFSNIWTEFSASIPIPDGIHALYFTYRGSGSASLKSFTLCTD

SEQ ID NO: 196 - DNA, 4197 bp, Butyrivibrio fibrisolvens
aattgtggatgcacatatgaaaagctgatttatgcttataaggcaggtcttgtcaaggaagagaccatcgatgaggctgttactcgacttatggaaatcagacttcgtctaggtactattccagagagaaagagtaagtatgatgatatcccatatgaagtggtcgaatgcaaagagcatatcaaacttgctcttgacgctgcaaaggatagctttgtccttttgaagaatgatggtttacttccactgaataaaaaggattataaatctattgctgttattggacccaactctgattcaagaagagctttaattggaaattatgagggcctttcttcagagtatattacagttttagaggggattcgtcaggttgtcggtgatgatattagattattccacgctgagggcactcatctttggaaggatagaattcacgtaatcagtgagccaaaagatggatttgccgaggctaaaatcgtggcagagcattcagatttagttgtgatgtgtcttggacttgacgcatcaatcgaaggagaagaaggagacgagggtaatcagttcggtagcggagacaagcctggattaaagcttacaggttgtcagcaagagctacttgaggaaattgccaaaatcggcaagcctgttgtacttcttgtgctttcaggttctgctcttgatttatcatgggcgcaggaatctaataacgtaaatgcgataatgcagtgctggtatccaggcgcaagaggtggacgtgctattgcagaggttttatttggcaaggccagtccaggcggtaaaatgcctcttacattttatgcctcagatgatgaccttcctgatttttctgattattcaatggaaaataggacatacagatatttcaagggcacaccactttatccatttggttatggactaggttattctaaaattgattatctatttgcttctattgataaagataagggagcaattggtgatacattcaagctaaaggtagatgttaaaaataccggtaagtatacacagcatgaggctgttcaagtatatgtaacggaccttgaggcaacgacaagagtgcctattagaagccttagaaaggttaaatgtctagagcttgagcctggtgaaacaaaagaggttgaatttaccctttttgcaagagattttgccattattgatgaaaggggaaaatgtatcatagagccaggcaagtttaagatttctattgggggacaacagccagacgatagaagtaaagaacttatgggcagagagtgtgatatttttgaaattgaattaacaggctctgttacagaagttgaatattaattgagaggtgcatcatggttatagctaacaatccaattttaaaaggtttttatccagacccttctatctgcagaaaaggggatgatttttatctagtttgttcaagttttgtgtatgctccgggagtaccgatttttcacactaaggatttggcacattttgagcaaattggaaatatattagacagagaaagtcaacttccattgtcgggagatatatctagaggcatatttgccccaacaataagagagcataatggaatcttttacatgataacaactaatgtaagctctggcggcaactttattgttactgcaaaagatccagctggtccttggtcagagccatattatttaggtgaagatgaggcgccaggtattgatccatctctgttttttgatgacgatggcaaatgttattacgttggtaccagaccaaatcctgatggagttcgttacaacggtgattgggagatatgggttcaagagctggatttagagcaaatgaaacttgtaggtccttcgatggcaatttggaagggcgctcttaaggatgttatttggccagaaggaccacacctttataagaaagatggatattattatcttttacatgcagaagctggcacaagctttgaacatgctatttctgtagctcgctcaaaggagctattcaaatggtttgagggatgtcctagaaatcctatatttacccatagaaatttaggcaaggattatccagtatgcaatgttggacatgctgatttagttgatgatatcaatggcaactggtatatggtgatgctggcatctagaccatgcaagggaaagtgcagcttgggacgagagacattccttgcaaaagtaatttgggaagacggatggccagtggttaatccgggagttggtcgtttgactgatgaggtggagatggaccttcctgaatatagattctcaaaagagattactacaaaggataaaatgacctttgaagagacagtcctagatgatagatttgttggaattgaaagaagaagtgaggacttttattcccttactgacaatcctggattcttaagattaaagcttcgtcctgaggccatagaaaatactggcaatccatcttacttaggaattcgtcaaaagactcattcgtttagagcaagctgtggccttaagtttacaccagcaaaagataatgaatgtgcaggaatggtgttattccagaataatgaaaatcacttggagcttttagttgtaaagaagaaagataagctacagtttaaagtaggaccagttattaaaggaaccaaaatcagacttgctacttttgatatttcatcaggtgatttagaaattattcttgaggcagcaaatcagctggctaatatctatattaaaaagaataatgaaaagattcttgtggcagaatgtattgatttgagcccatacactaccgaagaatcaggcggattcgtaggatgtaccattggactatatgcttcttcaaatggaaagaccagtgataactattgcgattattcctactttacagtagaagaagtatagcattttcaatgagcgaatttgcaagttttatatacgggattaattgtacgtaaaaaccatacaggtgtaaaatagtttccagagaaagttttttctctggaattttttattatggaggggattatgcttcaggaaagtattaagaagttggtacagtacggtattgatatggggcttacaccagaatgtgagagaatatatactacaaatcttttgcttgaatgtatgaaagaagatgagtacatagatccagactgtgatttaagcaatattatacttgaagatgtattaaaggaacttttagatgaggcagttaatagaggtatcatagaggattcagttacacatagggatttgtttgatacaaagctaatgaatcagctatgcccacgtcctaaacaggttatagatgattttaaccgtatatacgataaccatggtccaatagctgcaacagattatttttacaagttaagcaaagcctctgactatatccgtacttacagggtaaaaaaggacctaaaatggacatgcgatacagagtatggcactcttgacataacaattaatctctctaagccagaaaaagacccaaaggcaattgctgcagctaagaatgcaaaacaatccacatatccgaagtgccaattatgtatggaaaatgaaggctatgctggtcgcattaatcatcctgctagagagaatcatcgcataattcctataactataaataacagcaactggggatttcaatatagcccatacgtttattacaatgagcattgcatagtctttaacggagagcatactcctatgaaaatagagcgagctacttttgttaagctatttgattttatcaaactatttccacactattttttaggaagcaatgctgatttaccaattgttggaggatctattttaagccatgaccatttccaaggcggccattacacatttgccatggaaaaagctccaattattcaggaatttactgtaaaaggatatgaggatgttaaggctggtatagttaaatggccactttcagtaattagacttcagtgcaaggatgagactagacttattgatttagcgactaatatattagacaaatggagaaattacaccgatgaagaggcatatatttttgctgaaacagatggtgagcctcacaatacgattacacctattgctagaaaaagaggggattactttgaactagatcctctagagtcgacctgcaggcatgcaagcttggcactggccgtcgttttacaacgtcgtgactggg

SEQ ID NO: 197 - protein, 445 aa, Butyrivibrio fibrisolvens
NCGCTYEKLIYAYKAGLVKEETIDEAVTRLMEIRLRLGTIPERKSKYDDIPYEVVECKEHIKLALDAAKDSFVLLKNDGLLPLNKKDYKSIAVIGPNSDSRRALIGNYEGLSSEYITVLEGIRQVVGDDIRLFHAEGTHLWKDRIHVISEPKDGFAEAKIVAEHSDLVVMCLGLDASIEGEEGDEGNQFGSGDKPGLKLTGCQQELLEEIAKIGKPVVLLVLSGSALDLSWAQESNNVNAIMQCWYPGARGGRAIAEVLFGKASPGGKMPLTFYASDDDLPDFSDYSMENRTYRYFKGTPLYPFGYGLGYSKIDYLFASIDKDKGAIGDTFKLKVDVKNTGKYTQHEAVQVYVTDLEATTRVPIRSLRKVKCLELEPGETKEVEFTLFARDFAIIDERGKCIIEPGKFKISIGGQQPDDRSKELMGRECDIFEIELTGSVTEVEY

SEQ ID NO: 198 - protein, 517 aa, Butyrivibrio fibrisolvens
MVIANNPILKGFYPDPSICRKGDDFYLVCSSFVYAPGVPIFHTKDLAHFEQIGNILDRESQLPLSGDISRGIFAPTIREHNGIFYMITTNVSSGGNFIVTAKDPAGPWSEPYYLGEDEAPGIDPSLFFDDDGKCYYVGTRPNPDGVRYNGDWEIWVQELDLEQMKLVGPSMAIWKGALKDVIWPEGPHLYKKDGYYYLLHAEAGTSFEHAISVARSKELFKWFEGCPRNPIFTHRNLGKDYPVCNVGHADLVDDINGNWYMVMLASRPCKGKCSLGRETFLAKVIWEDGWPVVNPGVGRLTDEVEMDLPEYRFSKEITTKDKMTFEETVLDDRFVGIERRSEDFYSLTDNPGFLRLKLRPEAIENTGNPSYLGIRQKTHSFRASCGLKFTPAKDNECAGMVLFQNNENHLELLVVKKKDKLQFKVGPVIKGTKIRLATFDISSGDLEIILEAANQLANIYIKKNNEKILVAECIDLSPYTTEESGGFVGCTIGLYASSNGKTSDNYCDYSYFTVEEV

SEQ ID NO: 199 - protein, 389 aa, Butyrivibrio fibrisolvens
MLQESIKKLVQYGIDMGLTPECERIYTTNLLLECMKEDEYIDPDCDLSNIILEDVLKELLDEAVNRGIIEDSVTHRDLFDTKLMNQLCPRPKQVIDDFNRIYDNHGPIAATDYFYKLSKASDYIRTYRVKKDLKWTCDTEYGTLDITINLSKPEKDPKAIAAAKNAKQSTYPKCQLCMENEGYAGRINHPARENHRIIPITINNSNWGFQYSPYVYYNEHCIVFNGEHTPMKIERATFVKLFDFIKLFPHYFLGSNADLPIVGGSILSHDHFQGGHYTFAMEKAPIIQEFTVKGYEDVKAGIVKWPLSVIRLQCKDETRLIDLATNILDKWRNYTDEEAYIFAETDGEPHNTITPIARKRGDYFELDPLESTCRHASLALAVVLQRRDW

SEQ ID NO: 200 - DNA, 3194 bp, Thermoanaerobacter
ctgcagtatttgagaatggcaacacatcaaggataatacctgctgtagaagcattggtatatccatatgttgtaggatatactgactttgtaagtgaagatggtgtgtttggtgagcttataaaagccttaaagaagcatgtaatgacgatcatgaagcctggtatatgcatagatgaagtatctggcggttggaaactttcgtcaaccagcaagaatacatggaatagcaaaattttcttgtgtcaatatgtgataaaagatgtgctaaatatagattttggagaaaaagaaggcgaatgggacaaagtacatgccacatggcaacaggtgtcttgcagtgaagattgtgctacagatcaggtaaacagcgatacaggtacgccaagaggaagccgcttgtatcctaggcttgtaaccagcatactgtggatgaaatagactttggggggtttaacatgattaaagtaagagtgccagatttttccgataagaagttttctgatagatggagatattgtgtcggaacaggcagacttggccttgcgcttcaaaaggaatacatcgagacattaaaatatgtgaaagaaaatatagactttaagtatataagaggacatggccttttgtgtgacgatgtaggcatatacagagaagatgtggtaggagatgaggtaaagcctttttacaattttacctatattgacaggatttttgactcatttttagaaatcggaataaggccatttgtggaaatcggatttatgcctaaaaaattagcatctggtacacagacagtattttattgggaggggaatgtcactcctcccaaggattatgaaaagtggagcgatcttgtcaaagcggttttgcatcactttatttctcgatatgggattgaagaagtcttgaagtggccatttgagatatggaatgaaccaaacttaaaagagttttggaaagatgctgatgagaaagaatattttaagctgtacaaggttactgcaaaggctataaaggaagtaaatgaaaatttgaaggtaggagggcctgctatatgcggtggtgctgactactggatagaagattttttgaatttctgctatgaagaaaatgttcctgtagattttgtatcgcgacacgctaccacatctaagcaaggtgaatatacgccacatctcatataccaggagattatgccatctgaatacatgctaaacgaatttaaaacagtgagagagatcataaaaaactcacattttccgaaccttccgtttcatataactgagtacaatacttcatatagtcctcaaaatcctgtacacgatacgccatttaatgctgcctatattgccaggattttaagcgaaggcggagattatgttgattcattttcttactggacgtttagcgacgttttcgaagaaagagatgtgccgcgatcccaattccatggaggatttggacttgtggcattgaatatgataccaaagcctaccttttacacatttaaattctttaatgctatgggagaggaaatgctttatagagatgagcacatgcttgtgacgaggagagatgatggctctgttgcactcatagcttggaatgaagttatggataagactgaaaatccagatgaagattatgaagtcgagataccagttagattcagagatgtgtttattaaaagacaattgattgatgaagaacatggcaatccatggggaacgtggatacacatgggaaggccgaggtatcctagcaaagaacaggtaaatacattgagagaagttgcaaagccagagattatgacaagtcagcctgttgcgaatgacggatacttaaatctaaagtttaaattaggtaaaaatgcagttgtattgtatgaattgactgagagaattgatgaatcaagcacatatataggacttgatgatagcaagataaatggatattgatgcacattaggagggattgatatgggactttttgacatgccactgcaaaagcttagagaatacactggtacaaatccatgccctgaagatttcgatgagtattgggatagggctttagatgagatgaggtcagttgatcccaaaattaaaatgaaaaaaagtagctttcaagtgccttttgcagagtgctacgatttgtactttacaggtgttcgtggtgccagaattcatgcaaagtatataagacctaagacagaagggaaacatccagcgttgataagatttcatggatattcgtcaaattcaggcgactggaacgacaaattaaattacgtagcggcaggctttaccgttgtggctatggatgcaagaggtcaaggagggcagtctcaagatgttggcggtgtaaatgggaacactttaaatgggcatattataagagggttagacgatgatgctgacaacatgctttttaggcatatcttcttagatactgcccagttggctggaatagttatgaatatgccagaaatcgatgaagatagagttgcagtcatgggaccttctcaaggtggaggtttgtcattagcgtgtgcagcattggaacccaagatacgcaaagtagtatcagagtacccattcttgtctgattataaaagagtttgggatttagaccttgcgaaaaatgcttaccaagagattacggactattttaggctttttgatccaaggcatgaaagagaaaatgaggtgtttactaagcttggctatatagatgttaagaatctggcgaagaggataaaaggcgatgtgttaatgtgcgttgggcttatggatcaagtatgtccgccatcaactgtctttgcagcctacaacaacatacagtcaaagaaggatataaaagtgtatcctgattatggacatgagcctatgagaggatttggagatttagcgatgcagtttatgttggaactatattcataaggagatgcaaagtgcatctcttaactgtattctttattaattttttatattcgcttacgttacgtttaagcctgtgtattttttaaaacacgatgaaaaataatttgggtcttgtatgcctacagacttggcgatttcaaatgacttcatgtttttttctttaataaggcttatggcttatggctttttccattcgcttatttgtcaggtattctatgaagtttatgcctgtctcctttttgaatgttgg

SEQ ID NO: 201 - protein, 500 aa, Thermoanaerobacter
MIKVRVPDFSDKKFSDRWRYCVGTGRLGLALQKEYIETLKYVKENIDFKYIRGHGLLCDDVGIYREDVVGDEVKPFYNFTYIDRIFDSFLEIGIRPFVEIGFMPKKLASGTQTVFYWEGNVTPPKDYEKWSDLVKAVLHHFISRYGIEEVLKWPFEIWNEPNLKEFWKDADEKEYFKLYKVTAKAIKEVNENLKVGGPAICGGADYWIEDFLNFCYEENVPVDFVSRHATTSKQGEYTPHLIYQEIMPSEYMLNEFKTVREIIKNSHFPNLPFHITEYNTSYSPQNPVHDTPFNAAYIARILSEGGDYVDSFSYWTFSDVFEERDVPRSQFHGGFGLVALNMIPKPTFYTFKFFNAMGEEMLYRDEHMLVTRRDDGSVALIAWNEVMDKTENPDEDYEVEIPVRFRDVFIKRQLIDEEHGNPWGTWIHMGRPRYPSKEQVNTLREVAKPEIMTSQPVANDGYLNLKFKLGKNAVVLYELTERIDESSTYIGLDDSKINGY

SEQ ID NO: 202 - DNA, 12066 bp, Paenibacillus sp. W-61
tttcagaaaatctcaacgtccatcaaagataagggtgacctgtattccgcagtggtggtatggatcccccaaaatttctcgatcgataactttcagcaggctatccgggttatggattactgggcgactctgttcaataccttcgctctgtcagcgacaacaacactgttaacgacagcgtcctgtgcccttgcagggtatggtttcgccaggttgaagttcaaggggagcaatttgctgttcgcaggtgtcattctcacgattctcgttccgcccacgacgattttgattccggtgtatctcaatctgaaaagcttcgacctgatgggcttgatgacactgattactggcaaaccggtgaacctgctgaatacctactggccgttcattctgaccgccattacggccaattcgcttaaagccggattgtatatttttatctttcgtcagttcttccgcggcattccgaaggaagtggaagaggcggcatatgtggacggtgcaggcattgggcggacctttgcccgaattatgctgcccaatgcaattccatccatggtaaccgtgatgctgttttcctttgtatggcagtggaatgatagcttctacacgaccacgtatctgacttcaagtaaggtcatgtcgacccaactgtcttcgcttccgtataatctggcccaacaagtaagtgatggagcctctaaggcggatcctttttatctaagcatgattcaggatacgggaatattgctcgccattctgcctttgattgttatctatctcttcgtgcagcgttatttcgtggaaagtgtagaacgtacaggaatcgttggctaaaacgttaggcttaaccgtgaagaaagatccgagacagatcgatacgatctgaagagaggaggaggagtcttgcccctgaacgtgtggaacgggttgcggaagcgtgcgccaaccgatgcttagtctactcttaggctttgctgcgattcatcggatattgcattgaggaaaagcaatcgatcatgacaggaggatataaagtgaaaaagatgtggatgtcttgtaaacttttactcgttttggctttactgattacgattgctccatggggaggaagccgcgcagaggcgtgggttggcatgcctatgggcaagcttcacgtaagtggcaagaatctggtgaacagcaacaatcagcctgtgcttctgaacggttggcatcaaccttcaggtgcctactggacgtatcagaacagcaattattatcttaatctgcacggcaacaatcgtcatgcggctacactggcctacctgaaagacattaccgatacatttgcggacacaagtccgaaatacggcagcaatcatggatggaacatgaatcaggtacgtctgttcattgatcgtgaggacatgggtgatgtggcggcgggttcatacaattttgccggtgtgcagaccgttacgcagaacgtcattatcccatacattcaatatgccaaaaccaaaggtgtgtatgtcgtcctgggactcgactttacgttgaaggatgaccaggcaaccaccgcttccaacctgcagaaattcaatcaaatctggggatatcttgcatctcgtcccgagattaaaagtgccgataacgttcactttgagctcattaacgagccagtgaaatcgtatgcgaatggacattggggcggatacaacggggaaaatgattttgtggatcactggaatgacctgcgcaatttccagaactccatcatctccacgattcggaaccagggtgccgataacgtaatctgggctgcaggtctggggtataaccagttctacagtctgacggcaagccatccattgacggatcccctgaacaactacggatatgccgttcactggtatccgggttacggcgcgtacgataacttctccattttgcaagatcagtggaataccaatgtgaaggcagcagcagacaagtatccgatcaatatcacggaagtaacctggtttaagaacaaagctggtgattcggcctattggaacctgtttaatggcagcaacgaaggtttcggtaccaataccaaaaccatcttcaacgcggctggaaacgttagtattgcggctcacatgaacggcttcattcttgagccagggcagcgcagttcttttgccgatccaacggctggactgaaatgggatggcgatgcttcacgaagtgccatgggacgattcctgttcaactggtaccatgaacgtgctcaatcgtatccaggtagtggaaatggtggtggacccacaaccgggcttgtgtcaggtgcaacctacaaaattgtggccagacattctaataaggtcattgacgttcctggggggcaaaatcaaaacaatctacagcttcagcagtggagcgatctgggcggcaatcctcagaagtgggttctgacctccatcggcggtggcagttatacactaaccagcgtgaactcaccggacaaagtgattgatattcgcaacggtaccctcacgaacggtgaagcggttcagctcatgagcaatctgaacacgaccgcacagcatttcaaagtcaacgatctggggaatggatattggagtattattaacgtgaacagcaacaaagcgattgaagtagaaaacgcttccacatccgatggtgccaagttgcagcagaatacgtacacgggtgcaacgaatcaacaatggaaatttatcgcggttagcaattaacattattgcacaagaggaccttcacggctgttattgccggaaaggtcctctttacgtgagatttcagtctacgcgatgcgctgtgatgcataggaactccatttgtacgatgactcattgtagagggattaatatatccgatatttgccgcttaaagccagcaagctgaaaaaatacagacagttatcataatagcggcgctcaccctgccgcaggggggtgttccaaaagaggcgtacgaaatgttcgacatgtggaccatctgcagccagtgaggccattgcgttggtagcgagcagaccgatcggatgcaaggaaggttcatcgaacggttcaccctcaatggtatatctgcgatattcggcgacatcaatactgctgaagaaggactgaattcgattggattgctccacctgccagggatccttgccgaaccattcccagtccagagcaatattcgcggcaacccggtaagcatcgctgtaaaagtgtctaaaatcaccatgcggctgaacaggagcgggtgatccgtcatagttcgcatattcaggcgaaagcccggttacaggatgacaggcggtatgcagataagctcgacttgccgcagctgcatctctccagaaggattgatcgtcttcatccgcatataatgcaaacaactcatagaaatgggggagatggtaggatggatcactgaatggagattccggtacgaatttgatcaatttggtttccgggtcccacatgggatctccctcgccattttcaccttgatgaatgcatgcgcggaggattcttctggcttgttccttatagttaagaggcgcatctccatcaccccagcggttagaagcaaagaacagagccatcgcgaaaaactcctcaccatcaggtgcaggaccttgagataagcgggttccatcaggtttgcagtgccaggcaaaataatccttgtatcgaccttcagcatgctgcatgaacgcatgggaaaaattccagagccgatcgaattcttcttttttgtccatctgaacagccatcatcatgccataagacatgccttcggagcgaacatcgttattaccggtgtcgagtaaatagcctttgtcctcacccatcgggtaatagattcgcgtatcctcttctccatcaaacagctcgttccatgactcctccagccgtgcgtttatttcctgttcatcataaccaaatttgtggaagagattgttgtatgtatttgtatcataggcgccttgaccggtgatattcatgggttttcctcctcttattgcaaacgttaaacccattatatcacggtaaatgtgtataaattaaagcgtttacattggaaatcttagttctttcctttttccgattatcatgaccaaaatgaaatgatatgattgctgcaagtcctatactttatcgggtatctgtaaaattatgtaagtgttacactcgtgaagaaggacccaccaagcataaagttttacccgtttggattccttcaaatgacgatgaactttatgatcgaagaaaggatggtggtaaacatggttcgcgatgcaggagatacaccagaagcagatatacaccaagggataactgcaccgcgcgatcccgttggagtgaaggagacgaataacgaggcaacgttcgattactgctcccctgaatatcacaaaatgattagccaatctcttttgaacaaaggtcacaatgccagattaaaacgggcaattcagaaggctggacagggtgaacctgttgttatggcttatatcggtggttcgatcacccacggcgctggcgcaattcctattcatctccgtagttacgcctatcgatcgtatgagcggttcaaggcgatgtttgctccatcagacagtcgttccattcagctggttaaagccggagtaggcggaacgccttccgaactgggaatgatacgctatgatcgtgatgtgcttggagatggccaaattcaaccggatatcgtcgttattgagtttgcagttaatgatgcggacgatgaaacccgggggaactgttatgaaagtttaatattgaaagcgcttgctgcagataacaagcctgcagtcatccttttgttcagtgtctttgagaacgactggaatctacaggatcgcctagctccggtgggctggcattacaatctgcccatggtgagcatgaaggatgctcttgtcgagcaattccacaagaccaagcaagaaggtaacgtcataaccaaagagcaatattttcatgatatatatcatccgaccaacctgggacatcagatcatggccgatgcactgggtcacctgtttgatgccgtgaatcatgccgaactggaccaggacgatcatgatctgagaaggccgcccgtgattggggatgatttcgtccacgtgaaactgcttgatcgaaaaaacggcaatcagcttgccaaaatcaacccggggtgcttcgcgcagacggataccgacctgcagatggccgagatggatgatcacgattatgctacgccgctcttcccgcacaattggatgtatacccgcggtgatagggccgaagcgcaaaagttcaagctgcaaatgcgttgcaggtgtcttctattaattttcaaagactccggaagcgacgagttcggaacagcccttatcaaagtggatggtgttctcaccaaacaagccaatccgcatgaagtaaattggacacgctgtcatgccatgctcctaattcaagataagcacgtcagagagcatacgatcgagatcgaaatggcagaagggcatgaggataaacgcttcacgattcttggttttggctatgtcagttaacaaaacaaaggccggagattaatccaatagctaaatgcacctatgaagggagtactgtacatgatatcttcagcaccggctggatttgaccaatatcgcaatgatatacctcgcggagcaatagagacgatagagtatgattccactacggtagggaatacccggaaagcactggtgtacacacctccaggattttcttccgaaaacacataccctgttctttacctgcttcacgggatcggtggagatgagatggaatggcagcagcatggtagcccgcagattatcttggacaatctttacaacgataacctgctggagcccatgattgttgttttgcccaacggtcgcgccatgccaaacgatcgagccgagggagatctatttgacccggagaaaataaaagcctttgaacgatttgaatccgacttgattcatgaccttattccttatattgaatctaattattccgcaagtacaaccagggataatagggcaatcgccggcttatccatgggcggaggacagtccttaaacatagggttgggcaatctcaaccatttcgcttgggtcggtgccttctctcccgctccaaacaccaaagcgccagagctgctccttcctaatccgcaggaagcaatctcgcttttgtcgcttctttggatctcctgtggcgatcaggataatcttatccaaattagcgttgacgtacatcaatatttggagcagcaggacgtaccgcacatctggtatgaagagagcggaggtcatgactggccagtgtggaaaaatgatttgtatctgttttccaaacgtctttttaaataaataccaactcaactccaactccagtgtctacccaaaaaagtaccgaattattcaaaaactaatccaaatatcaggaggtttttaccatgtttaaattcggaaaaaaattgttaactgttgtccttgccgcttccatgagcttcggagtatttgccgctacatccagcgcagcaacagattattggcagaactggacagatggagggggtacagttaatgccgtgaacggttcgggaggaaactacagtgtaaactggcagaacacggggaactttgttgtcggtaaagggtggacttacggtacacctaatcgagtagtgaattacaatgcgggtgtattctctccatctggcaacggatatttgacgttttacgggtggacacggaatgcacttattgaatactacgtggtggacaactggggaacataccgtccaaccggaacatataaaggcacagtgaacagtgatggcggcacatatgatatctataccaccatgagatacaacgcaccttccattgatggaacgcagaccttccctcaatattggagtgtgagacaaaccaagcgtcccattggtgtgaactctacaattacgttcagcaatcacgtgaatgcatgggcaagcaaaggcatgtatctgggcaacagctggtcttatcaggtgatggcaactgaaggatatcaaagtagcggaagctccaacgtgaccgtttggtaacgtcctagcttctggtcatcattcccagggaatggttcaatcgtaatttcctgaacaggagatctagcaagacaggtccaaggcctgtcttgctttcaatccaggaaccagaaggagacatagaatgaaaaagtggatgctatttctgttcattgcagctgtggcttgcctaagcgcttgttcatcaacgaatgctgatgtaggggatcattttgtatacgtggagggtggaacctttaagagcaccaagtcgacgtttagcggtaaggacgtaaccgtttctgatttttatatcgggaaatacgaagttacgcagaaggaatggatggagatcatgggcgagaatccatccggcttcaagggagacgacctgcccgttgaaatggtgagctggtacgatgccgtggaatactgcaatcagcgcagcatcaaggaaaacctgaaaccctactataatatcgacaagaatacgaccgatccaagcaacaaaaacgaaaacgacaatctcaaatggacgatcactgtaaatgaaggcgcagacggttatcgcttgcccactgaagcagagtgggagtatgctgcaagcggaggccaaaaaagcatgaactacgtctatagtggaagcagcaatcctgatgaagtagcctggtattggatcaatgcaggggacaagatattgactggcgactggagctggcctgcgattgagagcaaccgaaatcaaacccaaaaagtgggtaccatgaaggccaatgaactgggcatccatgatatgtcagggaatgtgagagaatggtgctgggactggtacagccatcccgagagcccggagaatacctggcgtgtagtcaaggggggcggctggattggcggtgttaacaacaatgagatttcctttccgggtaaatttgatgccaatggatttggccccgatcaggggtttcgagtcgtacgtggaatataagaggtcccttcctaacagaagggccttttttatagaagacgacagagaacatgatcttaaaaaatgaatatttattcttggaagtttgctatagttcgtcattttcgatccgggtaaaatggaaataccaaccaatgtatgcgctttattaaatgggtggaatccttaatggaggtgtatgatgaaaaggaagacatggtacacattgattgtttcgggagtggtttctttatttttttcggtaagcgctttcgcggggtatgtgttctgggagccgttaacctacttcaattctagtacgtggcaaaaggcagatggatactccaacggctccatgtttaactgtacttggcgggcgaacaatgtcaattttacaagtgatggtaaactgcgactgggtttgactagttcggcatacaacaaatttgattgcggagaataccgaacaaccaacagttatggatatggactttacgaagttagcatgaagcctgctaaaaatacagggattgtatcctcttttttcacctataccggtccttctgatggcacacaatgggatgagattgatatcgagttccttggcaaagacacaacgaaagtgcaattcaattattatacaaacggcgttggaaatcatgagaagatcgtaaatctgggcttcgatgcgtcccagggattccacacgtatgcgtttgattggcaaccagggcacattaagtggtacgtcgatggcgtgctgaaacatacagctacaaccaatattccgaaaacaccaggtaaaattatgatgaacttgtggaacggaaccggcgttgacagctggttaggggcatataatggagctaatccgttatacgcagaatacgattgggtgaaatatacgagtaactaacagaaactcacgatcatgtccaactagtgcaataaactgcaaaaaacagagaagcggattacgtccgcaatcctctgtttttttatgatcattttcaacctttacagaacaatcgaaacgtaagagagacaagagtaagacgttgtactaatacaacatccgtattcactttttaatatcctaaattaatacaataaatgttgcaatattagtatgggcattcatatggttcattcattatgatggactctgtagacaacatcactacatacagggggactcacaagttgaaaacaatcaagaaaagaaagattggcggtttggctttggcaggaatgttggcgcttacagcagttcttagcggatgtaacagtggagcaggcaaagaggctgcaccgagcacaccgagcactgcactggaattgaaggacgggaagtatgatccacccgtaaaacttacttatttacgtccctggggacccgaaatcaaattcaaatctggtgaagatcaggacaataacgtgcacaccaaatgggcaaaagacaagctcggcattgaattaaaaaatcagtgggtatcaccgtccaccaacaatgcgtttgaaacgaagctgcgcttgtcgctggcttccaatgcagaaatgccggatattatttcatatcgcggcgatttcaatctggcacgtgagttgattgaaacaggcaagttcgttgatgctggtgaattgtttgataaatatgcaagtgatacatggaaagctgccgtgaatgaagatccttccgtatggtatccgtacatgcaggatggtaagcggattggtattccgattctggattactcctacaatagtgatccagtgatgtggattcgcgaggattggatgaagaagtttaatttgaaagcacctgaaacgctggctgatcttgaagtgattatggaaacgtttacgaataaagacccggatggcaatggtaaaaaagacacctacggtctgaccatcggattcaaaaactggctcagcacatggatgtctgatgctggttgggtcttcggagcctacggcacgatgccaaatcagtggaatctgaacgcagaaggcaaactggagtacggttctgtaaatccaggagcaaaacaagctttggcaacactggctgactggatgaaaaaagggtatattccagaagaagctggggtatatgatgaaaccaaagcagcagaagagtttacagcaggtaaagcagggattgttgtcgggcctcactggatgccgtcatggccgctcgaagatgtgaagaaaaacaatccggaagcggagtacaaagcttacccgattccatctggacctgatggcaaggcaggcagacgcggtaccgcgaacgacaacggtgtagttctgattaacaaagatatgaaaaacccagaagtctttttcacttatcaaaactatctgtttgatcactatgcaaatccaaaagcaggtgatgaattcgaaaatggcttcgctgaagggtatgactgggcaatgaaagacggcaaagtaccaacggatgctagtgtgacaggcggttatgcacctgagaaatacaccctaacgtttgatggtgcacgtatcccaagtctgaacatgactacgcttgcgaagtttgctaacggtgaagaagcaacaacacctttcgagaaaaaacttaagtctggtgtaccggtacccatggtggaagcggccaagattgttcaggatcaaaaagatatcgctttaaaacagatgttcacaggtgcaccaacgatgtcaatgcaaatgaacaacgacattttaaccaaaatggagaaggacctgttctcgcaaatcatctatggtaaagctccggttgatgcttttgatacatttgtagagaagtggaaatcatccggtggagatcaaaatacgaatgaagttaatgagtggtaccaatccgttacgagcggaaagtaagtacgagctatgtaactatcttatccgttatttcattctcaccaagctgctcaaacaggtgggaaagtacaaagaaaaggccttgctggaaatcattccagcgaggcctttttgcttcaaaccggcagattctctctatattcctgtggtgtcagatcgtaaaattttttaaatacccgaataaaatacgccgtgttgttgtagccgacaagctccgcaatttcgaataccttggcacttgaggatcgcaaatagtaagctgctttttccatccgcaaacgatagacataagctgtcagcgcttctccagtctccgtcttatacactttggaaagatacacagggtgcaggtggacatgctcggcaatagccggtaaggaaacatcggaagccagatgcaggtccacaaagcttttgacactgcgaacgatggtactgtgattgtccttcagctcctgttctgcgtcttcactgatggaatgaagtgtgcggatcgaccagtctttcaactgctgggcggtagcatagcttggagcctggaagtatttatacgtttcggcaggcaggacagaagaaatttgttttccattcttatggatgatataagcaaacgcccctgccaaggcatgatacacctcaatcgtcgtttctgcgatatcatgatgctgcgcggattcgagcaattcctcgaaaatgacctcaattttctgttccacatcgtcaaagcggccagcttccagaagactgattagggttggaggcttgtacagagaacggatggcaggaagggggtgtacatccttatcgtctgaagccgtgatgaacaagccttgagcatgtcccatacgcttccgcatggatctgacagcactctcataaatctcaccaatctcattagggaatttgccccagtgagagactgcgattgaaatagccccttttaaatacaactgaacgtttgtctgaatttgggcagcgtaatgttccagcagcacttgaggtttttcctctttgctcatactttgtgtcccgtcttttttgacactaaccagcacaaccagataatcatggacatcccgcgtatgccacatatg

SEQ ID NO: 203 - protein, 574 aa, Paenibacillus sp. W-61
MTGGYKVKKMWMSCKLLLVLALLITIAPWGGSRAEAWVGMPMGKLHVSGKNLVNSNNQPVLLNGWHQPSGAYWTYQNSNYYLNLHGNNRHAATLAYLKDITDTFADTSPKYGSNHGWNMNQVRLFIDREDMGDVAAGSYNFAGVQTVTQNVIIPYIQYAKTKGVYVVLGLDFTLKDDQATTASNLQKFNQIWGYLASRPEIKSADNVHFELINEPVKSYANGHWGGYNGENDFVDHWNDLRNFQNSIISTIRNQGADNVIWAAGLGYNQFYSLTASHPLTDPLNNYGYAVHWYPGYGAYDNFSILQDQWNTNVKAAADKYPINITEVTWFKNKAGDSAYWNLFNGSNEGFGTNTKTIFNAAGNVSIAAHMNGFILEPGQRSSFADPTAGLKWDGDASRSAMGRFLFNWYHERAQSYPGSGNGGGPTTGLVSGATYKIVARHSNKVIDVPGGQNQNNLQLQQWSDLGGNPQKWVLTSIGGGSYTLTSVNSPDKVIDIRNGTLTNGEAVQLMSNLNTTAQHFKVNDLGNGYWSIINVNSNKAIEVENASTSDGAKLQQNTYTGATNQQWKFIAVSN

SEQ ID NO: 204 - protein, 380 aa, Paenibacillus sp. W-61
MNITGQGAYDTNTYNNLFHKFGYDEQEINARLEESWNELFDGEEDTRIYYPMGEDKGYLLDTGNNDVRSEGMSYGMMMAVQMDKKEEFDRLWNFSHAFMQHAEGRYKDYFAWHCKPDGTRLSQGPAPDGEEFFAMALFFASNRWGDGDAPLNYKEQARRILRACIHQGENGEGDPMWDPETKLIKFVPESPFSDPSYHLPHFYELFALYADEDDQSFWRDAAAASRAYLHTACHPVTGLSPEYANYDGSPAPVQPHGDFRHFYSDAYRVAANIALDWEWFGKDPWQVEQSNRIQSFFSSIDVAEYRRYTIEGEPFDEPSLHPIGLLATNAMASLAADGPHVEHFVRLFWNTPLRQGERRYYDNCLYFFSLLALSGKYRIY

SEQ ID NO: 205 - protein, 434 aa, Paenibacillus sp. W-61
MVVNMVRDAGDTPEADIHQGITAPRDPVGVKETNNEATFDYCSPEYHKMISQSLLNKGHNARLKRAIQKAGQGEPVVMAYIGGSITHGAGAIPIHLRSYAYRSYERFKAMFAPSDSRSIQLVKAGVGGTPSELGMIRYDRDVLGDGQIQPDIVVIEFAVNDADDETRGNCYESLILKALAADNKPAVILLFSVFENDWNLQDRLAPVGWHYNLPMVSMKDALVEQFHKTKQEGNVITKEQYFHDIYHPTNLGHQIMADALGHLFDAVNHAELDQDDHDLRRPPVIGDDFVHVKLLDRKNGNQLAKINPGCFAQTDTDLQMAEMDDHDYATPLFPHNWMYTRGDRAEAQKFKLQMRCRCLLLIFKDSGSDEFGTALIKVDGVLTKQANPHEVNWTRCHAMLLIQDKHVREHTIEIEMAEGHEDKRFTILGFGYVS

SEQ ID NO: 206 - protein, 261 aa, Paenibacillus sp. W-61
MKGVLYMISSAPAGFDQYRNDIPRGAIETIEYDSTTVGNTRKALVYTPPGFSSENTYPVLYLLHGIGGDEMEWQQHGSPQIILDNLYNDNLLEPMIVVLPNGRAMPNDRAEGDLFDPEKIKAFERFESDLIHDLIPYIESNYSASTTRDNRAIAGLSMGGGQSLNIGLGNLNHFAWVGAFSPAPNTKAPELLLPNPQEAISLLSLLWISCGDQDNLIQISVDVHQYLEQQDVPHIWYEESGGHDWPVWKNDLYLFSKRLFK

SEQ ID NO: 207 - protein, 211 aa, Paenibacillus sp. W-61
MFKFGKKLLTVVLAASMSFGVFAATSSAATDYWQNWTDGGGTVNAVNGSGGNYSVNWQNTGNFVVGKGWTYGTPNRVVNYNAGVFSPSGNGYLTFYGWTRNALIEYYVVDNWGTYRPTGTYKGTVNSDGGTYDIYTTMRYNAPSIDGTQTFPQYWSVRQTKRPIGVNSTITFSNHVNAWASKGMYLGNSWSYQVMATEGYQSSGSSNVTVW

SEQ ID NO: 208 - protein, 279 aa, Paenibacillus sp. W-61
MKKWMLFLFIAAVACLSACSSTNADVGDHFVYVEGGTFKSTKSTFSGKDVTVSDFYIGKYEVTQKEWMEIMGENPSGFKGDDLPVEMVSWYDAVEYCNQRSIKENLKPYYNIDKNTTDPSNKNENDNLKWTITVNEGADGYRLPTEAEWEYAASGGQKSMNYVYSGSSNPDEVAWYWINAGDKILTGDWSWPAIESNRNQTQKVGTMKANELGIHDMSGNVREWCWDWYSHPESPENTWRVVKGGGWIGGVNNNEISFPGKFDANGFGPDQGFRVVRGI

SEQ ID NO: 209 - protein, 238 aa, Paenibacillus sp. W-61
MMKRKTWYTLIVSGVVSLFFSVSAFAGYVFWEPLTYFNSSTWQKADGYSNGSMFNCTWRANNVNFTSDGKLRLGLTSSAYNKFDCGEYRTTNSYGYGLYEVSMKPAKNTGIVSSFFTYTGPSDGTQWDEIDIEFLGKDTTKVQFNYYTNGVGNHEKIVNLGFDASQGFHTYAFDWQPGHIKWYVDGVLKHTATTNIPKTPGKIMMNLWNGTGVDSWLGAYNGANPLYAEYDWVKYTSN

SEQ ID NO: 210 - protein, 545 aa, Paenibacillus sp. W-61
MLALTAVLSGCNSGAGKEAAPSTPSTALELKDGKYDPPVKLTYLRPWGPEIKFKSGEDQDNNVHTKWAKDKLGIELKNQWVSPSTNNAFETKLRLSLASNAEMPDIISYRGDFNLARELIETGKFVDAGELFDKYASDTWKAAVNEDPSVWYPYMQDGKRIGIPILDYSYNSDPVMWIREDWMKKFNLKAPETLADLEVIMETFTNKDPDGNGKKDTYGLTIGFKNWLSTWMSDAGWVFGAYGTMPNQWNLNAEGKLEYGSVNPGAKQALATLADWMKKGYIPEEAGVYDETKAAEEFTAGKAGIVVGPHWMPSWPLEDVKKNNPEAEYKAYPIPSGPDGKAGRRGTANDNGVVLINKDMKNPEVFFTYQNYLFDHYANPKAGDEFENGFAEGYDWAMKDGKVPTDASVTGGYAPEKYTLTFDGARIPSLNMTTLAKFANGEEATTPFEKKLKSGVPVPMVEAAKIVQDQKDIALKQMFTGAPTMSMQMNNDILTKMEKDLFSQIIYGKAPVDAFDTFVEKWKSSGGDQNTNEVNEWYQSVTSGK

SEQ ID NO: 211 - DNA, 1500 bp, Aspergillus niger
atgttctcccgccgaaacctcgtcgccctagggctggcagccaccgtcagcgccggcccctgtgacatctacgaagccggcgacacgccctgcgtagccgcgcacagcaccacccgcgccctatacagctccttcagcggcgccctctatcagctccaacgtggctccgacgacaccaccaccaccatctccccgctcacagccggtggcgtcgccgacgcctccgcccaagacaccttctgtgccaacaccacctgcctgatcaccatcatctacgaccaatccggcaacggcaaccacctgacccaagcacccccgggaggcttcgacggccccgacgtcgacggctacgacaacctcgccagcgccatcggcgcccccgtcaccctcaatggccaaaaggcctacggcgtgttcatgtcccccggcacgggctaccgtaacaacgaagccaccggcactgccaccggcgacgagcccgaaggcatgtacgccgtcctggacggcacgcactacaacgacgcctgctgcttcgactacggcaacgccgagaccagcagcaccgacactggcgccggccacatggaggccatctacctcgggaacagcaccacctggggctacggcgccggcgacgggccctggatcatggtcgatatggagaacaacctcttctccggtgctgatgagggatataactccggtgatccctcgatcagctacagctttgtcactgccgcggtcaagggcggggctgataagtgggctattcgcggtggtaatgctgcctctgggtccctctctacttactacagcggcgctcgcccggattactccggctataaccccatgagcaaggagggcgctatcatcctgggtatcggcggtgacaacagcaacggcgcccagggtaccttctacgagggtgtcatgacctccggctacccgtcggacgatgtcgagaactccgtccaggagaacatcgtggctgcgaaatacgtctccggctcgctggtcagcggcccgtcgttcacctccggagaggtggtctcgctgcgtgtcactacgcccggttacacgacgcggtatattgcgcacactgacaccactgtgaacacgcaggtcgtggacgacgatagttccaccacgctgaaggaggaggctagctggaccgtggtgaccggtctggctaatagtcagtgcttctcgttcgagtcggttgatacccctggtagctatatccggcattacaactttgagttgctgcttaatgccaatgatggcacgaagcagttccatgaggatgctactttctgtcctcaggcgccgttgaatggagagggtacttcgttgagatcgtggagttatccgacgaggtatttcagacattatgataatgtcctgtatgctgctagtaatggcggtgtgcagacgtttgattccaagacatcgtttaataatgatgttagctttgagattgagacggcgtttgcttcgtaa

SEQ ID NO: 212 - protein, 499 aa, Aspergillus niger
MFSRRNLVALGLAATVSAGPCDIYEAGDTPCVAAHSTTRALYSSFSGALYQLQRGSDDTTTTISPLTAGGVADASAQDTFCANTTCLITIIYDQSGNGNHLTQAPPGGFDGPDVDGYDNLASAIGAPVTLNGQKAYGVFMSPGTGYRNNEATGTATGDEPEGMYAVLDGTHYNDACCFDYGNAETSSTDTGAGHMEAIYLGNSTTWGYGAGDGPWIMVDMENNLFSGADEGYNSGDPSISYSFVTAAVKGGADKWAIRGGNAASGSLSTYYSGARPDYSGYNPMSKEGAIILGIGGDNSNGAQGTFYEGVMTSGYPSDDVENSVQENIVAAKYVSGSLVSGPSFTSGEVVSLRVTTPGYTTRYIAHTDTTVNTQVVDDDSSTTLKEEASWTVVTGLANSQCFSFESVDTPGSYIRHYNFELLLNANDGTKQFHEDATFCPQAPLNGEGTSLRSWSYPTRYFRHYDNVLYAASNGGVQTFDSKTSFNNDVSFEIETAFAS

SEQ ID NO: 213 - DNA, 999 bp, Aspergillus niger; identical to SEQ ID NO: 1

SEQ ID NO: 214 - protein, 332 aa, Aspergillus niger; identical to SEQ ID NO: 2

SEQ ID NO: 215 - DNA, 1512 bp, Aspergillus niger
gaattcatgttctcccgccgaaacctcgtcgccctagggctggctgccaccgtcagcgccggtccctgtgacatctacgaagccggggacacgccctgcgtcgcggggcacagcaccacccgcgcgctatacagctccttcagcggtgccctctaccaaatcaaacgaggctccgacgacaccaccaccaccatctcccccctgacagctggcggtgtcgccgatgcctccgcacaagacaccttctgcgccaacaccacctgcctgatcaccatcatctacgaccaaaccggtaacggcaaccacctcacccaggcccctcccggtgggttcgacgggcccgacaccgacggctacgacaacctcgcgccgacgatcggcgcccccgtcaccctgaacggccaaaaggcctacggtgtgttcatgtcccccggcacgggctaccgcaacaatgccgccacggggaccgccaccgggcacgaagccgaacggatgtacgccgtgctggacggcacgcactacaacgacgcgtgctgcttcgactacggcaactggcaaaccagcagcaccgacacgggcgccggccacatggaagccatctacttcggcaccagcaccacctggggctacggtgccggcgatgggccctggctcatggtcgacatggagaataacctcttctccggtgccgacgagggctacaactccggtgatccctcgatcccgtacaccttcctcactgctgcggtcaagggcggcgccgataagtgggcgattcgcgggggtaactctgcctcgggctcgctttctacttactacagtggcgtgcgcccagattactcgggctataaccccatgagcaaggagggcgctatcatcctgggtatcggcggtgataatagtaacggcgcgcaggggaccttctacgaaggtgtcatgacctccggatatccatcggatgctaccgagaactctgtgcaggagaacatcgtcgcggcgaaatatgccgttggctcgctggtcagtgggccgtcgttcacctctggggaggtggtctcgctgcgtgtgactacacccggttacacgacgaggtatatcgcgcacacggatacgacggtgaacacgcaggtcgtggatgatgatagtgactcttcgttgaaggaggaggccagttggacggtcgtgcacggtctggctaatagtcaatgcttctcgttcgagtcggtggatacccctggcagctatatccgccattataactttgcgttgttgttgaatgcgaatgatggcaccaagcagttccatgaggatgctacgttctgtcctcaggctgcgttgaatggggagggcacttcgttgcgctcgtggagttaccccacgcgctattttagacattatgagaatgtcctctatgctgcgagtaatggtggcgtgcagacgtttgattcgaccacgtcgtttaataatgatgtgagctttgagattgagacggcgtttgcttcgtaactcgag

SEQ ID NO: 216 - protein, 499 aa, Aspergillus niger
MFSRRNLVALGLAATVSAGPCDIYEAGDTPCVAGHSTTRALYSSFSGALYQIKRGSDDTTTTISPLTAGGVADASAQDTFCANTTCLITIIYDQTGNGNHLTQAPPGGFDGPDTDGYDNLAPTIGAPVTLNGQKAYGVFMSPGTGYRNNAATGTATGHEAERMYAVLDGTHYNDACCFDYGNWQTSSTDTGAGHMEAIYFGTSTTWGYGAGDGPWLMVDMENNLFSGADEGYNSGDPSIPYTFLTAAVKGGADKWAIRGGNSASGSLSTYYSGVRPDYSGYNPMSKEGAIILGIGGDNSNGAQGTFYEGVMTSGYPSDATENSVQENIVAAKYAVGSLVSGPSFTSGEVVSLRVTTPGYTTRYIAHTDTTVNTQVVDDDSDSSLKEEASWTVVHGLANSQCFSFESVDTPGSYIRHYNFALLLNANDGTKQFHEDATFCPQAALNGEGTSLRSWSYPTRYFRHYENVLYAASNGGVQTFDSTTSFNNDVSFEIETAFAS

SEQ ID NO: 217 - DNA, 3958 bp, Aspergillus niger
aagggactgactgaactcagtgagatgtgccgcgaagtaactaagcgctgtgcctgcagtgaggcgtgatggaacactgcatccgatctccaagaccccgatatgaaccttaatgacaatggtctaagtttttttgtcatctcgcatagcacggtaggcgactaagttgaaggataaagagagcaggattaggatggctcgagatcaaattgaaagtaatagagtaacaggggaaaactctaacagttggctatgacgaaggtggcagcgacttcccggagagagattaagccgggtagaaccaagggacggctgtggctggatcaggaacccaaatctattccagtatcggaggatactcaggggtcccgccggggttttcccttgatcggagaacatcaaccacatcaaaatgcggagtaacgatgagggggaagtgcacggccgacgtcagagtttcgcttgggtggatctgcaatgtttaggcggccgactagaccgacagtccagcacctgccctgggagttcaagacagtggtttgaccatcttttgagaagactgaaattcccgtagattccatcaagattattcatgtatcactagcgactcagcactgggtaagctgcacccacggattttctcagctatctgaatgtatcagagacaaagatcttcgtggatggaggccatcaaccgagctttaatgcgccaaacctactgtatgactgaataatggatggatcggcatgtcgtacgatcgggtaagggtcctaaaaatggagggccggggaattctggggttagccgtcgggattatttcggtacgacaaactcactgttcactttgatctcggcgtggttgcggctaaaaagatgaccttgaaggtggagcgaacaactggaggtgctcggagggacgcggagaagagaggatccaagacatcggggcagggaagtccatgccgcgtgcagtcacgcttttcctccctctgctctcttctcctccacattccacattccacctccacactcctccactcttcctctggcaccttcctcttcctcgatttcttggcttctcggttgattgtcttcgacctcgttgcgatgaccccaccgcattttctgctgccttggcctgtctgatgccccggttaatttcacgaaagtccggtcataaaaggcgttgtatcctccctttgcaacaatgacaccaggctcagcttcctccagacagccggcaacatggtggccttttcagctctttcgggcgtcagcgccgtttctttactactatccctcgttcaaaatgcacacggaatctccttgaaggtctccacccagggtggcaactcatccagccccatcctatatggcttcatgtttgaggtaggccgcagactaagcagtaaaagacaattggttctctgacggtgattaggatatcaatcactcaggagatggaggaatttatgggcaaatgctgcagaaccctggccttcagggaacggcgcctaatctgactgcctgggcggctgtcggtgacgctaccatcgccattgatggcgacagtccattgacctctgccatccccagcaccatcaagcttaatattgcggacgatgctaccggtgcggtgggtctcaccaatgagggatattggggcatcccagtcgatggcagcgaattccatagttccttctggataaagggagattactccggcgacatcaccgtccgactggttggaaactacaccggcacggagtacggctctaccactatcacccatacgtccacagcagacaacttcacccaagcctccgtcaagttccccaccaccaaggctccagatggcaacgttttgtacgagctcacagttgatggaagcgtggctgctggctcgtctttgaacttcggctacttgacgctttttggcgaaacctataagtcaaggtttgcttccctatactccgaagagtgaattaggggctaattgtgtagggaaaatggcctgaagccccagcttgccaatgtgttggatgatatgaaaggatccttcctgagatttcccggcggtaacaacctgtaagtctcagctcgcccggtaagtgtatagaagctcatcagaggtagtgagggaaacagcgcagaaaaccgctggaagtggaacgagacaatcggcgatctttgtgatcgtcccggacgtgaaggtatgtctcattattaggattgaagcattcatccctgacggtatataggcacttggacttactataacaccgacggactgggtaagtaaagggctatatacaagtacctagatactgtactaacgcttgtaggccttcacgaatacttttactggtgtgaggatttggggctcgtaccggtgctcggtgtctgggatgggttcgctctggagtcgggtggcaacacccccctcacgggcgacgcactgaccccttatatcgacgatgtcttgaacgagctcgaggtatgttgagcggcatatcaaattgatagctgaagctaacccattggcagtacatcttgggtgatacgagcacgacctatggagcgtggcgcgcggcaaacggacaggaggagccgtggaaccttaccatggtcgagattggcaatgaggacatgctgggaggcggatgcgagtcctacgcggaacgtttcactgccttctatgatgcgattcatgctgcttatccggaccttatcctgattgccagcaccagcgaggcggattgcttgcccgagtcaatgcccgagggtagctgggtcgactaccacgactacagcacgcctgatggactggtgggccagttcaactacttcgacaatttaaaccgctcggtaccatacttcatcggcgagtactcgcgctgggagattgactggcccaacatgaagggatcggtcgctgaagccgtcttcatgatcgggttcgagaggaacagcgacgtggtgaagatggcggcgtatgcgcctttgctccagctaatcaactcgactcagtggacggtaagtcacgactgagcagcggggtttcaggtatgaatgagctaacgagtggtagccggacctgatcggatacacgcagtcacccggtgacattttcctgtcgaccagctactacgtgcaggagatgttctcgcgcaaccggggtgatacaattaaggaggtgacgtcggacagcgacttcggaccgttgtactgggttgcgtcgagcgccggggactcgtactacgtgaagctggccaactatggctccgagacgcaagacctcacggtgagcatcccaggaacgagcacaggcaagttgacggtgctggcggacagtgatccggatgcgtataactcggacacccagacgctggtcacgccgagtgaatcgacggtgcaggcgagcaatggcacttttacctttagtttgccggcatgggcggtggctgtcctggcggcgaactagcgttgattggggcgagctcgtatgggcggcaagtcgaatattatctgcaggtgtggtgtcatgtactgcagtatttctgattaacgatagagagatagatccatgctatatacctgcttgtatatccaaggcatttatccaatgataggcaacgccaccacacgtggctatgcacatactagtcaggaggtagtagagtgactgactgctatgtagcggtcggccggggatagcagttgaatgaccccaattaacagaaccgcctgactctccaacgtgtacctctaggttattttatatttcttgttaaagccccccagaaacacaaccgaagaatcaatggatgcgatgaaaacaaggcactggtaagcgaaggagggaaaaacaagcggattggttggttgtggcccgatgcaaacgggcggcctctccactcgaattggacagaagcgaaggccgtgcgccgagacggg

SEQ ID NO: 218 - protein, 628 aa, Aspergillus niger
MVAFSALSGVSAVSLLLSLVQNAHGISLKVSTQGGNSSSPILYGFMFEDINHSGDGGIYGQMLQNPGLQGTAPNLTAWAAVGDATIAIDGDSPLTSAIPSTIKLNIADDATGAVGLTNEGYWGIPVDGSEFHSSFWIKGDYSGDITVRLVGNYTGTEYGSTTITHTSTADNFTQASVKFPTTKAPDGNVLYELTVDGSVAAGSSLNFGYLTLFGETYKSRENGLKPQLANVLDDMKGSFLRFPGGNNLEGNSAENRWKWNETIGDLCDRPGREGTWTYYNTDGLGLHEYFYWCEDLGLVPVLGVWDGFALESGGNTPLTGDALTPYIDDVLNELEYILGDTSTTYGAWRAANGQEEPWNLTMVEIGNEDMLGGGCESYAERFTAFYDAIHAAYPDLILIASTSEADCLPESMPEGSWVDYHDYSTPDGLVGQFNYFDNLNRSVPYFIGEYSRWEIDWPNMKGSVAEAVFMIGFERNSDVVKMAAYAPLLQLINSTQWTPDLIGYTQSPGDIFLSTSYYVQEMFSRNRGDTIKEVTSDSDFGPLYWVASSAGDSYYVKLANYGSETQDLTVSIPGTSTGKLTVLADSDPDAYNSDTQTLVTPSESTVQASNGTFTFSLPAWAVAVLAAN

SEQ ID NO: 219 - DNA, 20 bp, Synthetic contruct
ttaacatgtaaggctcttgg

SEQ ID NO: 220 - DNA, 20 bp, Synthetic contruct
ccatcttccctcttatcctg

SEQ ID NO: 221 - DNA, 1876 bp, Aureobasidium pullulans
gatcccgccggattacggaaaataacagagcgagttcgtatgcgatgatcttcgctggagatgtgctacatccacagctcgaacataaatagagaagacaatgccgcctggctgtccaacatcaactcctctcatatccgcaagcttcctgtcaaccctcctcacagttcgctcatcactcaaacatgcgttccaggacgaacatcgctcttggcctagctgccactggttccctagtcgctgccgcgccttgcgatatctatcagaatggcggtactccttgcgtagctgctcacggcacaactcgcgcattgtatgattcctacactggtcctctctaccaacttaagagaggctcagatggcactacgaccgatatttctcctttgtctgctggtggtgttgccaatgctgctgctcaggactctttctgcaagggtactacctgtcttatcagtattatctacgatcagtctgggcgtgcaaaccatctttatcaggcccagaaaggtgctttcagcggaccagatgtcaacggaaacgacaacttggcaggcgctattggagcaccagtgactttgaatggcaagaaggcatatggcgtgttcatctcgcccggcactgggtacagaaacgacgaagtcagcggcacggccactggaaacgaacctgagggcatgtatgctgttcttgacggcactcattacaacgatgcttgctgctttgactacggaaacgcggaaatcagcaacacggatactggtaacggacatatggaggccgtctactatggtaacaacacgatttggggcagtggctctggcagcggtccttggctcatggccgaccttgagaacggtttgttctctggccagggtaccaagcagaacactgcagacccttcaatctccaacagattcttcaccggaatggtcaagggagagcctaaccagtgggcgcttcgcggtagcaatgccgcgtccggttccttgtcgacctactacagtggcgctcgtcccaccgtcggcggttacaaccccatgagcctcgagggcgccatcattcttggcatcggtggcgataacagcaatggcgctcagggcactttctatgagggggtcatgacctcgggctacccgtctgatgccactgaagcctcggtgcaggccaacattgtggctgcgaagtacgctaccacatctttgaacacagcaccactcactgtcggcaacaagatttcgatcaaggtgaccacccccggctacgacacccgctatctggcacacaccggagccaccgtcaacacgcaggttgtctcttcatctagcgcgactagcctcaagcagcaggccagctggactgttcgcacaggcctcggtaacagcggctgttactctttcgagtcggttgatacacctggaagcttcatcagacactacaacttccagctccagctcaacgcgaatgacaacaccaaggctttcaaggaagacgcgactttctgctctcagaccggtcttgttaccggcaacactttcaactcgtggagctaccctgccaagttcatccgtcactacaacaatgttggatacatcgccagcaacggtggtgttcacgactttgactctgctacaggcttcaacaacgatgtcagctttgtggttggaagcagctttgcttagatgtaaaaggtcaggatgaatatgatggatgtttatgacaaaagaagttatgagtttgtagttatggaatcttagctgtagcttttgaaagcctttgggatatcagatgtttgtctcttgttcatgtgccgttgcaaagaagaaaagaaggagcagcaagcagtgaggctcttatcgggcgatagggctagatc

SEQ ID NO: 222 - protein, 498 aa, Aureobasidium pullulans
MRSRTNIALGLAATGSLVAAAPCDIYQNGGTPCVAAHGTTRALYDSYTGPLYQLKRGSDGTTTDISPLSAGGVANAAAQDSFCKGTTCLISIIYDQSGRANHLYQAQKGAFSGPDVNGNDNLAGAIGAPVTLNGKKAYGVFISPGTGYRNDEVSGTATGNEPEGMYAVLDGTHYNDACCFDYGNAEISNTDTGNGHMEAVYYGNNTIWGSGSGSGPWLMADLENGLFSGQGTKQNTADPSISNRFFTGMVKGEPNQWALRGSNAASGSLSTYYSGARPTVGGYNPMSLEGAIILGIGGDNSNGAQGTFYEGVMTSGYPSDATEASVQANIVAAKYATTSLNTAPLTVGNKISIKVTTPGYDTRYLAHTGATVNTQVVSSSSATSLKQQASWTVRTGLGNSGCYSFESVDTPGSFIRHYNFQLQLNANDNTKAFKEDATFCSQTGLVTGNTFNSWSYPAKFIRHYNNVGYIASNGGVHDFDSATGFNNDVSFVVGSSFA

SEQ ID NO: 223 - DNA, 1509 bp, Geobacillus stearothermophilus strain KCTC 3012
atgaacacgaaaaaagctaaaatgattgtcgaaaaagatttcagaattgcggaaattgataagcggatttatggttcatttatagaacatcttggccgggcggtatatggaggaatttacgaaccaggtcatccacaagctgacgaaagaggatttcgaagagatgttatcgaattggtaaaagagctgcaggttccattaattcgttatccaggaggaaactttgtttccgggtataactgggaagacggggtaggtccgaaagaacagcggccgcggcgtttggagttggcgtggaaatcaattgaaacaaatgaaatcggtgtcaatgaattcgtagagtgggcgaagcttgtcaatgctgaagtaaatatggcggttaacttaggaacacgcggcattgacgctgcccgcaatttagtcgaatattgcaaccatccatcaggttcgtattatagtgatttgcgtatttcccacggctacaaagaaccgcataagattaaaacatggtgtttaggaaatgaaatggacggcccatggcaaatcggccataagactgcggtagaatatgggcgcattgcctgcgaagcggcaaaggtcatgaaatgggtcgatccaactattgagcttgtcgtttgtggaagttcccaccgcaacatgccaacctttgcggaatgggaagcaaccgttcttgatcatacgtatgagcatgtagaatacatttcgttacatcaatattatggaaatcgtgataatgatacagcgaattatctggctctcacattagaaatggacgattttatccgttctgtggcggcaattgcagattatattaaagcgaaaaaacgcagtaaaaaaacactttatctttcttttgatgagtggaatgtctggtaccactctaacgaagcggataagttaatcgaaccttggacgattgcccctcctttattagaagatatttataactttgaagatgcattattggttggatgcatgttgattacattgatgaaacatgccgatcgtgtgaaaattgcttgtttagcgcagttggtgaacgtaattgcaccgatcatgacagagaaaaatggcccagcttggaaacaaacgatttactatccatttatgcatgcatctgtgtatggcagaggtgtagccttacatccagtgatctctagcccgaaatatgatagcaaggactttactgatgtcccatatttagaatccattgcagtttataacgaagaaaaagaagaattaactatttttgcagtcaaccgtgatttggaagatccgttgttgctagagtgcgatgttcgtaatttcgatgggtaccaagttatcgaacatattattttagagcatgagaatgtaaaacaaacaaattcggcaacccattcccctgttgttccccacaacaatggaaatgcccatctatcagatggaaaagtggtagcccagttgccaaaactatcgtggaatgtgattcgtttggctaagaaataa

SEQ ID NO: 224 - protein, 502 aa, Geobacillus stearothermophilus strain KCTC 3012
MNTKKAKMIVEKDFRIAEIDKRIYGSFIEHLGRAVYGGIYEPGHPQADERGFRRDVIELVKELQVPLIRYPGGNFVSGYNWEDGVGPKEQRPRRLELAWKSIETNEIGVNEFVEWAKLVNAEVNMAVNLGTRGIDAARNLVEYCNHPSGSYYSDLRISHGYKEPHKIKTWCLGNEMDGPWQIGHKTAVEYGRIACEAAKVMKWVDPTIELVVCGSSHRNMPTFAEWEATVLDHTYEHVEYISLHQYYGNRDNDTANYLALTLEMDDFIRSVAAIADYIKAKKRSKKTLYLSFDEWNVWYHSNEADKLIEPWTIAPPLLEDIYNFEDALLVGCMLITLMKHADRVKIACLAQLVNVIAPIMTEKNGPAWKQTIYYPFMHASVYGRGVALHPVISSPKYDSKDFTDVPYLESIAVYNEEKEELTIFAVNRDLEDPLLLECDVRNFDGYQVIEHIILEHENVKQTNSATHSPVVPHNNGNAHLSDGKVVAQLPKLSWNVIRLAKK

SEQ ID NO: 225 - DNA, 969 bp, Hypocrea jecorina
atggagcttaaagcactcagtgccgttgtgctgagctttgtaactcttgtcgcggcagcaccggcgacctgcacgcttccgtccacataccgctggaattcgaccggtgctttagccagcccgaaatcaggctgggtctcgctgaaagacttctcccatgtcatttataatggccagcatcttgtatggggctcgactcatgacacaggaacaatctggggttcaatgaactttggtctgttcagtgactggtccaatatggcaacggcaagccagaacaaaatgactcccggcactgttgctcctaccgtcttctactttgccccgaagaatatttgggtactcgcctatcaatggggcccgaccacgttttcctacctgacgtcaagcaacccctccagcgtcaatggatggtcgtcaccacagcctctcttctccggcagtatctcaggctccagcccgctggatcagacggtcattggcgacagcacgaacatgtatctgttcttcgcgggggacgacgggaaaatctacagggcgagcatgcctatcggtaacttccccggaagcttcggttcgacgtcaacggtggtcctgagcgatgaaaggaacaatctgtttgaggcagttcaggtctataccgtctcagggcagaagcaatatctcatgattgtcgaggcaataggcgcaaatggccggtatttccggtccttcacagcgacaaacctcggcggcacatggactccgcaagccaccagcgaaagtcagccgtttgccggtaaggcaaacagtggcgctacctggacaaacgacatcagtcatggtgatctaattcgtagcaaccctgatcagacaatgactatcgacccttgcaatctgcagttcttgtaccaggggagagcgacaaactctggcggcgactacggcctcttgccctatcgaccagggctgctaactctccagcgctga

SEQ ID NO: 226 - protein, 322 aa, Hypocrea jecorina
MELKALSAVVLSFVTLVAAAPATCTLPSTYRWNSTGALASPKSGWVSLKDFSHVIYNGQHLVWGSTHDTGTIWGSMNFGLFSDWSNMATASQNKMTPGTVAPTVFYFAPKNIWVLAYQWGPTTFSYLTSSNPSSVNGWSSPQPLFSGSISGSSPLDQTVIGDSTNMYLFFAGDDGKIYRASMPIGNFPGSFGSTSTVVLSDERNNLFEAVQVYTVSGQKQYLMIVEAIGANGRYFRSFTATNLGGTWTPQATSESQPFAGKANSGATWTNDISHGDLIRSNPDQTMTIDPCNLQFLYQGRATNSGGDYGLLPYRPGLLTLQR

SEQ ID NO: 227 - DNA, 1199 bp, Aspergillus sojae
cattgaatatagaatccacaatgaaagttacaaagaaagttcttgatcaatccctatgttgcacagcattgcttgccttagtgggaggtgccgcggcgcaatgcgccctcccatcgagctacagctggacatcaaccggcgcgctcgcggagcctaaggcaggatgggctgcgctcaaggacttcaccaatgttgtgttcaacggccagcatatcgtctatggatcagttgccgatacctccggaaactatggctcgatgaacttcggtccttttagcgactggtctgagatggcctcggcaagccagaacgccatgagccaggggacggtggcccccacactcttctactttgcgccaaaggatgtctggatcctcgcctatcaatggggtccgacctcattctcctacaagacctccagtgatcccaccgacgccaatggttggtcagcggcccagcccctcttctcgggaactatttccgactccgatacgggagtcatcgatcaaaccgtcattggcgatgatacggatatgtatctcttctttgcgggtgataatggcaagatctaccgcgccagcatgcccatcgataacttcccgggcgatttcggtacccaatccgagatcatcctgagtgacacgaaggagaacctcttcgaagcggttcaggtctacaccgtcgacggccaaaacaaatacttgatgattgtagaggccatgggcgccaatggacgctatttccgctccttcacggctgatagtctagatggggagtggactgtccaggcgggcaccgagagccagcccttcgctggaaaggccaacagtggcgccacctggacgaacgacatcagtcacggtgatctggttcgcaacaaccccgatcaaacgatgacagtggatccttgcaatttgcagttgctctaccaaggacgggacccgaatgccagtggcgattacaatctgctgccatggaagccaggtgtcctcacactgcaggtgtaaagtgatgggtgctttattagctgttgctagtggctatagtgaggagtgtagagtgttactactccctaacaaactttaagtgctggacaagtcggtcatagtaggcttgaaagtggaaagggtgtggatggaagcactagtaacagcctattacaatgattatttttacagattaaaaaaaaaaaaaaaaaa

SEQ ID NO: 228 - protein, 328 aa, Aspergillus sojae
MKVTKKVLDQSLCCTALLALVGGAAAQCALPSSYSWTSTGALAEPKAGWAALKDFTNVVFNGQHIVYGSVADTSGNYGSMNFGPFSDWSEMASASQNAMSQGTVAPTLFYFAPKDVWILAYQWGPTSFSYKTSSDPTDANGWSAAQPLFSGTISDSDTGVIDQTVIGDDTDMYLFFAGDNGKIYRASMPIDNFPGDFGTQSEIILSDTKENLFEAVQVYTVDGQNKYLMIVEAMGANGRYFRSFTADSLDGEWTVQAGTESQPFAGKANSGATWTNDISHGDLVRNNPDQTMTVDPCNLQLLYQGRDPNASGDYNLLPWKPGVLTLQV

SEQ ID NO: 229 - DNA, 1584 bp, Uncultured bacterium clone
atgaaatttctaaatcctgttatacccggttttcaccctgacccaagcatagtaaaagtaggagagaatgacttttacttagtaacaagttcattcgaatacttcccagctatcccaattttccacagtaaagaccttgtgaattgggaacaaatcggtagtgtcttaactagagaaagtcaagttaacttaagaaatagtaagagttcgggtggtttatatgcaccaacattaagatatcacgatggtactttttatatgatttcaacagatgtatcaggtaccggcaatttttatgtcactgcggaaaatcctaaaggaccatggtcagaccctataaaaataccatacggaaatattgacccttcattgatgtttgatgatgacgggaaagtgtatgtaacagtccaaaatggtgctggttatgaatcacacattattcaatatgaaataaatatcgatacaggagaggcgctaactgaaccaatcgcaattttccatggtgatgggggccaatggacggaagcaccacatctttataaaataaacggaacttattatttactatgtgcctgtggtgggacaggtgaagagcatcggtcaattattgctaaaagtacaatgccatacggaccgtttgagatgctagatagaccaattttaacgcataatcaacttagtcaccatccgattcaaaatgtaggccatgcagattttgttgaagacgaaaatggaaattggtgggcagtatttttagggactcggccagtaaaccagcaatttacgctattaggaagagaaacctttttagcgcctataaattggacggaagatggctggcctatgattgataataatgaaggcactgttaatgaaatgactgaagcaccatacttattaggggaatcaaatataaaagataaatataatcgtaatgatgatttcaatgatgaaaagttacatccagagtggttttatttaagagtaaaggaagagaaaaactattcattaactgaacgaaaaggctggttacgtctaatcggtggtgcagataatataagtactgtaaatggagttccgacatttatatgtaaacctcaagggcatgtcgtgatggagtttaaaacattaatagaatttgctccaaatcaggatggagaagaagcaggtttgtctgtaaggttaaatgagtcctcgcactttgagatagcgattaaacaagtagatggtgaaaaaagagtaatcgcaactaagacaattcaaggagtaactgaagaaatcggtcattgtattatacataaagataaaattaaattaagcattagttcggaccgtgagaactattattttaaatttgctgaagaagatggcgagtggaacaagattggggacgcttcattgtgccatctttctagtgaaaaaaatggagggtttggaggtacattcacaggtgtctgtataggtctatatgcaaccgggaatggtaacgaatgtagagaacctgcttactttgattgggtacattatgtaggagaaaattcacttaatgtgactgaggtttctgtaaataatttagaacaataa

SEQ ID NO: 230 - protein, 527 aa, Uncultured bacterium clone
MKFLNPVIPGFHPDPSIVKVGENDFYLVTSSFEYFPAIPIFHSKDLVNWEQIGSVLTRESQVNLRNSKSSGGLYAPTLRYHDGTFYMISTDVSGTGNFYVTAENPKGPWSDPIKIPYGNIDPSLMFDDDGKVYVTVQNGAGYESHIIQYEINIDTGEALTEPIAIFHGDGGQWTEAPHLYKINGTYYLLCACGGTGEEHRSIIAKSTMPYGPFEMLDRPILTHNQLSHHPIQNVGHADFVEDENGNWWAVFLGTRPVNQQFTLLGRETFLAPINWTEDGWPMIDNNEGTVNEMTEAPYLLGESNIKDKYNRNDDFNDEKLHPEWFYLRVKEEKNYSLTERKGWLRLIGGADNISTVNGVPTFICKPQGHVVMEFKTLIEFAPNQDGEEAGLSVRLNESSHFEIAIKQVDGEKRVIATKTIQGVTEEIGHCIIHKDKIKLSISSDRENYYFKFAEEDGEWNKIGDASLCHLSSEKNGGFGGTFTGVCIGLYATGNGNECREPAYFDWVHYVGENSLNVTEVSVNNLEQ

SEQ ID NO: 231 - DNA, 2295 bp, Penicillium purporogenum
atgttagcggaatatcttcttctgccattgttggcatcctatgcctcggccgtgcagatttctgttgctaagtccggtggtaatgtcactactggattgcagtatggtgcaatggaagaggtatgtcctggaatcatttctataatgcgagattgatatttaccaatgttgttctcctaggaaatcaaccactgtggtgaaggtggtctctatgccgagttgatccgcaatcgggccttccagggaagcaccacctacccatccaacttggatgcttggtctgccgtcggtggttcgacactgtctcttcagaacctcactgaccccctctcctctgctctcccaacttccgttcggatcacgggtaaaggtacctcgggtatctccaacactggcttttggggcattgatgtccgccctcagaagtactctgggtctttctacgtgaagggctcttacaaaggctcgttcactgcctctcttcaggctagcaacggcgaagtctttgcttccgctcaggtctcttcgaagagtgttgcaaatgactgggtgcagcatgaattcaccctcacccccaagaagaaggcttccagctccaacaacacctttgtgctgaccttcgatgcctctgtaagttaatcaagaactaacgctttgaatgctctgcactaacttcaaacagaagacatctggtggctccctcgacttcaacttgatcagcttgttccctcccacctggaacaaccgtcccaatggcatgcgccgagatctgatgcaagctttgcaagacttgggtcctgtaagtctcgccatgatagcagatggtattccaacatgctgacttgatagaaattccttcgtttccctggaggcaacaacctcgagggtcagaccattgagggtcgatggaaatggaacgagactattggaccattgactcagcgtcctggccgtgctaccacctggggctatgaggagaccagtggtatgggtctggtcgagtacatggagtggtgtgatgacctcggcatggagcctagtaagtctattatgatagaatatacttcacttgacttgactgacaaacatcccagtcctcgccgtttgggctggtctcgctctgaacggaaacgttgtccccgaagccgagcttgacgtttacgtccaagatgccctcgatgagctcgagttcttgactggctctgttgacaccaagtacggtgctctacgagccaagtacggccaccccaagccctggactatccgttatgtcgaggttggcaatgaggacaacctgagcagtggcctcagctcgtacaagtcctaccgcttccaagcattctatgatgcgatcaccaagaaatatcccaacattcaagtcctggcttccactatcgacatgacccttcccggcaatgcgggtggtgattaccatctgtacgatatccccgacaacttcatcaccaagttcggcatgttcgacagctacagtgacgcgcacccaattcttcttggtatgtgtcatgcataacatcaaatgagctagaactaatagaggtaacaccacaggtgaaatcgccgctactgagtacaacaacggtgtcggcattgactggagtaatactcatttttccttgtacccctggtggctgggctcagtcgcggaggctgtcttcctcttgggagctgagcgtaacgctgacaagattattggaactacctatgtgagtttagtatccgatcatgtccaagcccaaaacactaacgacatgacaggcgccattcttgatgaacctggacagctacgagtggtcgccaaccatgatctctttcaactccaaccccgacgacaccgcaaagtccactagctggcacgtgtacaacgtgagtctatctaaccataaatcatcaaagaatccagtcaatactaacagaccctcaaaatagctcttcaacaagaaccacatgaccaacactctccctgcaacctccaacgacaccttcggccccctatactacgccaccggtgtgaacagcaagaccaactcccacatcttcaaagccgccgtgtacaacagcaccgccgatgtccccgtttctctgacctttgagggtgttggacgcggcacaaccgccgatctcactattttgactgcccccagcgatgtctccatgaatgcagtcggtggcgccaacgtcgtgcagagccagactaccaagatcaaggctggcaagcagggtgttttcagcttcaacctgccaaacctgagtgttgctgtgctcacgactaactag

SEQ ID NO: 232 - protein, 635 aa, Penicillium purporogenum
MLAEYLLLPLLASYASAVQISVAKSGGNVTTGLQYGAMEEEINHCGEGGLYAELIRNRAFQGSTTYPSNLDAWSAVGGSTLSLQNLTDPLSSALPTSVRITGKGTSGISNTGFWGIDVRPQKYSGSFYVKGSYKGSFTASLQASNGEVFASAQVSSKSVANDWVQHEFTLTPKKKASSSNNTFVLTFDASKTSGGSLDFNLISLFPPTWNNRPNGMRRDLMQALQDLGPKFLRFPGGNNLEGQTIEGRWKWNETIGPLTQRPGRATTWGYEETSGMGLVEYMEWCDDLGMEPILAVWAGLALNGNVVPEAELDVYVQDALDELEFLTGSVDTKYGALRAKYGHPKPWTIRYVEVGNEDNLSSGLSSYKSYRFQAFYDAITKKYPNIQVLASTIDMTLPGNAGGDYHLYDIPDNFITKFGMFDSYSDAHPILLGEIAATEYNNGVGIDWSNTHFSLYPWWLGSVAEAVFLLGAERNADKIIGTTYAPFLMNLDSYEWSPTMISFNSNPDDTAKSTSWHVYNLFNKNHMTNTLPATSNDTFGPLYYATGVNSKTNSHIFKAAVYNSTADVPVSLTFEGVGRGTTADLTILTAPSDVSMNAVGGANVVQSQTTKIKAGKQGVFSFNLPNLSVAVLTTN

SEQ ID NO: 233 - DNA, 1524 bp, Acremonium cellulolyticus
atgtttccaaaaataaaacccgagcgtaccagcttgttcgctcttggccttcttgcctcgagctcccttgtcaccgcaactgggccttgcgacatctactcctccggcggcaccccctgcgttgccgcgcacagtactacccgtgccctttatgcctcctacagcggcgcactataccaggtcaagcgtggctctgacggtgctacaactaccatctcgccgctttccgcaggtggtgtcgccaacgctgctgcccaagataccttctgtgccaacacgacctgcctcatcacgatcatctacgaccaatctggccgcggtaaccatctcacccaggctccccccggtggcttcgatggaccggacgtcaatggctatgacaacttggctggcgcaattggcgcacccgtcacgctgaacggtcagaaagcgtacggtgtcttcatctcacccggtaccggttaccgtaacaacgctgccagcgggacagctaccggcgacgcagcagagggcatgtatgctgtgctcgatggaacccattacaacggccaatgctgcttcgattacggtaacgccgagaccagcagcactgatactggcaatggccacatggaggccatctactacggtgacgccacctactggggaagtggctccggcagcgggccatggatcatggctgatctcgagaacggtctgttctccggcgagagtactggcgtgaactctgccgacccttctctttcctaccgcttcgtgactgcggtcgttaagggtgagccaaacttctgggccatccgcggtggtaatgctgcatctggctctctgtccacgtactacagcggtgtgcgcccacaagtttctggctattaccccatgcacaaagaaggtgccatcattctcggtattggcggtgataacagcaacggtgcccagggcacgttctacgaaggtgtcatgacctccggatacccaacagacgccaccgagaactcagtgcaggctaacatcgtggctgccaaatacgctaccacgtcattgaccagcggtccagcactcaccgtcggctctgcgatttcgctgcatgttaccactgccggatacacgacacgctatatcgcacacaacggcaccaccgttaacacccaggtcgtctcatcatccagctctaccactctcaaagagcaagccagctggacggttcgcaccggtcttggcaacagcgcctgcttctcgttcgagtccgttgatacccctggcagctacattcgtcactacaacgtcgagctcctgctcaacgccaatgatggtaccaagcagttctacgaagatgccacattctgcccgcagtctggtcttagcggcacgggcacctcgcttcgaagctggagctatcccacccgctatttccgacactacaacaacgtgctctatgctgccagcaacggcggcgtgcaaacgtttcatgccaccgcatccttcaacgccgatgtgaccttcttggttgagactgcgtttgcttga

SEQ ID NO: 234 - DNA, 17 bp, Acremonium cellulolyticus
  misc_feature (6)..(6): n is a, c, g, or t
garccnaayttytgggc

SEQ ID NO: 235 - DNA, 20 bp, Acremonium cellulolyticus
  misc_feature (3)..(3): n is a, c, g, or t
gtngcrtcytcrtaraaytg

SEQ ID NO: 236 - DNA, 36 bp, Acremonium cellulolyticus
gggaggcctaacacaatgtttcaaaaaataaaaccc

SEQ ID NO: 237 - DNA, 31 bp, Acremonium cellulolyticus
ggggcatgctcaagcaaacgcagtctcaacc

SEQ ID NO: 238 - DNA, 2925 bp, Fusarium oxysporum f. sp. dianthi
  misc_feature (5)..(5): n is a, c, g, or t
  misc_feature (113)..(113): n is a, c, g, or t
  misc_feature (248)..(248): n is a, c, g, or t
  misc_feature (291)..(291): n is a, c, g, or t
  misc_feature (340)..(340): n is a, c, g, or t
  misc_feature (347)..(347): n is a, c, g, or t
  misc_feature (448)..(448): n is a, c, g, or t
  misc_feature (499)..(499): n is a, c, g, or t
  misc_feature (502)..(502): n is a, c, g, or t
  misc_feature (540)..(540): n is a, c, g, or t
  misc_feature (543)..(543): n is a, c, g, or t
  misc_feature (545)..(545): n is a, c, g, or t
  misc_feature (570)..(570): n is a, c, g, or t
  misc_feature (579)..(579): n is a, c, g, or t
  misc_feature (641)..(641): n is a, c, g, or t
  misc_feature (646)..(646): n is a, c, g, or t
atgcntgcaggtccgactctagagggatctactagtcatatggaatgaccgcttgtaagctcgtccaacatgagcatgctgaacaatttcgcctcctgcaggtgaagatgtanaggagggcatcaaggccggcaagtatactcccgatgaaatggcagcattcggcagaatggccgagtttcaaaagaaagagacagcctttataccaacttgacggcaccaagccagctacagcaggctacatcttnggtagcaaccccatcgccctcctcgcctggatcggcagacaangatgcaccgctggtccgacgaaacaccccacaaagacctcatccttacnaacatanctctatactggttcacatggttgttacccaacatctatctatcttcacctcactgtccttgaggatcatgagctcatgaatgaatgcttggaaagagcctnaaggtaccgcttggtcacttcagcgcttcaagaaggagcttgtcacctgcnccngagagatggattcagcagacacagcaggtgaagtggtntanantgcatgacaagggtggacactttgntgcgctccnaatgctctttggaaagatgtgaaggacttcattggggcgttctggaagaatgaagcgatccnctgangacccttcgcttggggaagaagcaggcagcgacaaatgccgagacaagtttaggccaatttaggtaagtttagtaggttcttggactagttgttttcgtctcttacgatcaggtcactgttgtccgtggtctcgaggcagtagacatcaaatatacgaggatataccatctctagtctcactagtcgaatagcccatcaggttaggtcacgacgatctcaataccgcccacatcacgactcggccctaaatgcatcccccacattcttcctccattggctctcttaccaccgaccaacctcttccaacatctaatttgtccgcatcaaattcggcacttgcgtgccggtttatggttacatcaaggcccgggccacgcgatggccgctggggttcttaccccagatgacgatggcgccgatctgcataccccgcagatttggagaagcgggcgaataaggcttggcgctgttcgacgcaccattctttgacggattggtacaacggaggaatttgtgaatagttacgcttggggatagtgagccgaataggaaggtggatagccgcttcgtctgatgttgatgcgatggggtttgggggagggcatcggagggttgccggacgagagaccctcagtatggatatatctatataaggagctcttattctgtgccatactttccatttcttgtaactcagcagctcttcttcaatcttctgtcaaaggctcttggctctggctttacctatcttctcatagtccccggactgaatatcacaatgcttctccaaagcgtcttcgctcttggtctcgccaccaccgcccgtcttgtctctgcaggaccatgcgacatctacaaatccggcgggactccctgcatcgccgctcatagcaccacgcgcgctctgttcgacagctacaacggcgctctctaccagatcaagcgtgcctcagacggtgccctcaccgacatcaagcctctctccgcaggcggtgtcgcagcttcctctgcccaagataccttctgcagcggaactacctgtctcataaccatcatctatgatcaatctggtcccagcaaccacttgactcaagctcctcctggtggcttcaagggccctgaggcaaatggctatgataaccttgccgctgctgatggtgcacctgttactttgaacggcaagaaggcctacggagtgtttgtttctccgggtactggctaccgtaacaaccatgttagtggttctgctacaggtgatgagcccgagggtctgtatgctgttctcgacggaacccactacaacggcgcttgctgcttcgattacggcaatgcagagactagcagcactgatactggaaacggtcacatggaagccatttacttcggtgacaacactgtctggggctctggttccggcagtggaccctggatcatggctgatcttgagaacggtctcttctccggaaagaaccccaagcagaacactgccgaccctaccatcaaccatcgtttcaccagtgccgtcgttaaaggcaagcccggaacatggagtattcggggcggagattctacatcaggtggactgtcaactttctacaacggcgcgtatcctgacggcggatacaaccccatgaagaaagaaggagctataatcctcggaattggcggtgataacagcaatggagctcaaggcaccttttatgaaggagttatgaccagtggttatccttctgatgcgactgagaatgccgtgcaggccaacatcgtcgcggccaagtacgcgacaacctcattgacaagcgggtccgccctcaccgtcggatcatccatctccctcaaagtcactacctccggctacacagaccgctacctcacacacagcgactcaactgtcaacacccaagtcgtctccagctccagcgccaccgccctcaagcagtcagcaagctggaccgtccgcaccggcctcgccaacagcggctgtgtatccttcgagtcaaacgatactcctggtagctacatccgacactctggatttactctgtatgtcaacaagggtgatggaagcaagtcgttcaacgaagatgctacgttttgccctcagaagggtttgagtggatctggaagctctattcgatcgtggaactatcctacaaggtatattcgacattataataaccttggatatgcttcttcgaatggtggtgttcatgactgggatgctgccaagagctttgttgatgatgttacctttgttgttgccaatggttttgcctaa

SEQ ID NO: 239 - protein, 499 aa, Fusarium oxysporum f. sp. dianthi
MLLQSVFALGLATTARLVSAGPCDIYKSGGTPCIAAHSTTRALFDSYNGALYQIKRASDGALTDIKPLSAGGVAASSAQDTFCSGTTCLITIIYDQSGPSNHLTQAPPGGFKGPEANGYDNLAAADGAPVTLNGKKAYGVFVSPGTGYRNNHVSGSATGDEPEGLYAVLDGTHYNGACCFDYGNAETSSTDTGNGHMEAIYFGDNTVWGSGSGSGPWIMADLENGLFSGKNPKQNTADPTINHRFTSAVVKGKPGTWSIRGGDSTSGGLSTFYNGAYPDGGYNPMKKEGAIILGIGGDNSNGAQGTFYEGVMTSGYPSDATENAVQANIVAAKYATTSLTSGSALTVGSSISLKVTTSGYTDRYLTHSDSTVNTQVVSSSSATALKQSASWTVRTGLANSGCVSFESNDTPGSYIRHSGFTLYVNKGDGSKSFNEDATFCPQKGLSGSGSSIRSWNYPTRYIRHYNNLGYASSNGGVHDWDAAKSFVDDVTFVVANGFA

SEQ ID NO: 240 - DNA, 1842 bp, Clostridium stercorarium
  misc_feature (1632)..(1632): n is a, c, g, or t
caagcatacgttttcatgacggcaaattctgggtgttctttgccaagcctgacgaaggaatttttatgtcaactaccaccgatccgtataaaggctgggcacctctgacccatgtcaaaaagacaagaggttggattgatccatgcccgttctgggatgaccacgggaatgcgtatcttgtaagggtttcggaaaaagcaggattgggttcaagagatcctgcatctgtcccgggtgagtctgacggtacctgtcttctcgatgagggagttcatatatttgacggcaatctgaaccatcacaccattgaaggggccaaaatgtataaaagaaacggctattattacatttttgctcctgcaggaggggtaaaaacaggatggcagacggttttacgctccaaaaatatatacggaccgtatgaggacagaatagtaatgcatcagggaaaaaccaatgtaaacggccctcaccaaggcggttgggttgaaactcaaacaggagaacactggttcatacattttcaggacagagggccttacggaaggattgtgcatctgcagcctatggtatgggttgacgactggccggttataggtaaggacaccgaaaactgcggtacgggtgaacccgtggacgtatataaaaagcctgacgtgggaggagtatttcctgttcaggttcctgagacctccgatgattttgacaaaaataagcttggccttcagtggcagtggaatgccaaccctcaggaaaaatggtactcactgaccgaaagagatggctttttacgcctttatgcactgaataattccaatgaaagcggacttctgtaccatgctcctaatatactgacccagctgtttcaggcaccggagttcaccgcttccgcaaagcttgaattttcacctgcacaaaccggagacaaagccggtttggtgatactcggggatgaatacatgtatctgacgatagaaaaaacggaagaagccaacaaagttgcctgcatttatggttcaccctccgaaaacggctacagagaagaggttttggaatcccgtactgctgaaagtaccacggtaatattccgggttgatgtacggaatggggcggtatgctcattcagcttcagttatgaccgtgaaaattttgttaacgcaggcagggattttaacgcaaccgcaggcagctgggtgggtgcgaaactgggtatatttgcgatgaatacatattccgacagtaaaggtttcgctgatttcgactgggtgattgtaggaaagccggtagtaccggcagaggataatattgtttcgagaggtgatattatgaagaaatacgacaataattacggggtaagaatgtgtgattcggttataaaaaggcacagactgcttccggttaaatggtcatatgactacggagtgtatttgagggtatggaaaaaatctggcttaaaacaggcgatgaaaaatatttcaggtacattaaggacaatatggatatttacgtggattcccacggatatataggccattatcagccccatgaatataacatagataatgtaaaaaacggcaggaccattctgatgctctacagaaataccggtgagaaaaaatacaagcttgcggnaagtttgatacgcgagcagttgagacgccatccccgtacgaaagagggaggcttctggcacaaaatgatatatccttatcagatgtggctggacgggctttatatgggacagccgttctactgcgagtacggaaagctgttcaatgagcccgacatttttgacgatgtggggcatcagataattttaatgtatgaaaaggcgaaggatcc

SEQ ID NO: 241 - protein, 487 aa, Clostridium stercorarium
MSTTTDPYKGWAPLTHVKKTRGWIDPCPFWDDHGNAYLVRVSEKAGLGSRDPASVPGESDGTCLLDEGVHIFDGNLNHHTIEGAKMYKRNGYYYIFAPAGGVKTGWQTVLRSKNIYGPYEDRIVMHQGKTNVNGPHQGGWVETQTGEHWFIHFQDRGPYGRIVHLQPMVWVDDWPVIGKDTENCGTGEPVDVYKKPDVGGVFPVQVPETSDDFDKNKLGLQWQWNANPQEKWYSLTERDGFLRLYALNNSNESGLLYHAPNILTQLFQAPEFTASAKLEFSPAQTGDKAGLVILGDEYMYLTIEKTEEANKVACIYGSPSENGYREEVLESRTAESTTVIFRVDVRNGAVCSFSFSYDRENFVNAGRDFNATAGSWVGAKLGIFAMNTYSDSKGFADFDWVIVGKPVVPAEDNIVSRGDIMKKYDNNYGVRMCDSVIKRHRLLPVKWSYDYGVYLRVWKKSGLKQAMKNISGTLRTIWIFTWIPTDI

SEQ ID NO: 242 - DNA, 3642 bp, Streptomyces thermoviolaceus
ggatccgatgatggtcgagatgatggggatggccacccccgaggagctcgaccagctgagcgcggccacgggcgacgccttcgacgtgcagtacctgcggctgatgatcaagcatcacaacggggcgatcggcatgctggaggacgtgctcgccaacggcaccgacgagaccctgcagacgtgggcgaccgacatgctggccaaccagtacgcgcaggtccagatgatgcagcagatgctggacgacaggacgaaggcgacgaggaccgaggcgcggacgacctgaccgtcccgcggtccgtcactccccgcggccgggctcgcggtgcggcggcggcccggacgagggaggcggcgacgacccgggccgccggaccggggcggcacctgcgcggtgtccctccgcccggcgggcggatgctggtggggcggccctgcgtgaagaccctcagcgctgcagcgtcagcaggcccggacggtagggcagaaggtcgtaggtgccgccggagccggggtcgcgcccctggtagagcagctgcaggttgcaggggtcgacggtcatggtctgatcggcagtggtgcggatcagttccccgtggctgatgtcgtcggtccaggtggcaccgctgttggccttgccggcgaacgggttgctctcggacgtggcctggggcgtccactcgccgtccaggctggtggccgtgaacgagcggaagtagcgctgcccctgggcgccgatcgcctcgacgatcatcaggtagcggttctgcccctggagcttgtagacctgcggggcttcgaacaggttgttccgcgtatcgctcatgacgaccgtcgcggtcgagccgaagctgcccgggaagtcgccgatcggcatgctggcccggtagatcttgccgttgtcaccggcgaagaacagatacatgtgggtgtcgtcgccgatgagcgtctggtcgatgggtccggtcgcggagtcggcgatgcttccggagaacagcacctgttcggacgaccagccgttcgggtcggtgggatcgtgcgacgtacggtaggagaaggcgcttccgccccactggtaggcgagcacccagatgtccttcggtgcgaagtagaagagcgtgggggccacggtggggctgttcatcgcgttctgacgggccgtggccatctgcgaccagtcgccgaacggctcgaagttcatcgagccccatcgcgtccctgtgtcgtgcgtggtcgcgtagacgaggtgttggccgttgtaggggacgacggtgaagtccttgagcgagacccatccggacctgggctgggccagggcgcccgtcgaggtccagcggtaggtggacggaagctcgcacgatgcgcgtgtgccgaaaccgtcggtcagctgtgactgccggccggtgccttgcacgtcgtcgctcgggacgacggtcgcggcgccggcgggctgggtgctcatgacgccggccagcagcaagggcgccagaaccccgaacaggcgtttgggacggaacggcagcgagcggtggaacgacaacggaggccctcctcgggagcgggtgcggtgccggcggtggtgcctcgaatgtttcgttgtgtttgccggtgtgtgacgccacaagctaggtaagcggaggccgccggtcaagccccgccgcagtcatccgtccacacagggctttctctcgtcggggcggcacagggctgccccggatgcctcccccgggagtcggcgagcgaaccaagtcggcctgaacgcggtgttgacaggggattcggcaggagaccttccctgtcctcgtccgtctgcggccctgtctcgccgggagcgccgcgctgcgccgacgtaccgcctcggcagaaatgatcttcgaaagtttcgaaagaaaaccggaaagattctccgtccagcgggttgacgagacaccgtcaagtctcaatcatcctgtcggggaaaccgatcctgcaccgagccgcgcaaccatgtcggtcccgagcacccgtgccgcacgacagagccgcgtacgaagcacccgcgtcatgccgtggtacgtcagtgaggtccacaccacggcagtggccggtgcgcatgtgcagcccggggtccggggccgacccgtccgtccgcccgtggaagcggacggtgtctcccccctgcgcctcgctcgttccgtgacgtctaccttggaggcagacccatgggctctcacgcccttcccagaccggctctccgccaaaggatccgcggcggctgtgggcgtggccgcggcgtcctcggtctgggcgccacgctgagcacaccgccgaccgcgcacgccgccgagagcacgctcggtgcggccgcggctcagagcggccgttacttcggcaccgccatcgccgcgggcaggctgagcgactcgacgtacacgtcgatcgccagccgcgagttcaacatggtgacggccgagaacgagatgaagatcgacgccaccgaaccgcagcgcgggcagttcgacttctccgccggcgaccgcgtctacaactgggcggtgcagaacggcaaagaggtgcgcggccacaccctggcctggcactcccagcagccgtactggatgcagagcctgagcggcagtgacctgcgccaggcgatgatcgaccacatcaacggcgtgatgaaccactacaagggcaagatcgcccagtgggacgtcgtgaacgaggccttcgaggacgggaactcgggagcccggcgcgactccaacctgcagcgcaccggcaacgactggatcgaggtcgccttccgcaccgcgcgcgccgccgacccgtccgccaagctctgctacaacgactacaacatcgagaactggacctgggccaagacccaggccgtgtacaacatggtccgcgacttcaagcagcgcggcgtaccgatcgactgcgtcggcttccagtcgcacttcaacagcggcagcccgtacgacagcaacttccgcaccaccctgcagagcttcgcggcgctcggtgtcgacgtggccatcaccgaactcgacatccagggtgcctcgcccacgacgtacgccaacgtggtcaacgactgcctggccgtctcgcgctgcctgggcatcaccgtctggggtgtgcgcgacaccgactcctggcggtcgggtgacaccccgctgctgttcaacggcgacggcagcaagaagcctgcctactccgccgttctcgacgcgctcaacggcggctcctccggcgaacctccggaggacggcgggtccggacagatcaagaacgccgcgtcgggccggtgcctcgacgtctccggtgccggcaccgccgacggcacagcagtccagctctatgactgccacggcggcaccaaccagcagtggacctacaccgacgccggcgagttcagggtctacggcaacaagtgcctggacgccggcggcaccggaaatggagcgcgtgttcaaatttacagctgctggggcggcgacaaccagaagtggcgcgtgaactccgacggcaccatcgtcggtgtccagtcgggcctgtgcctggacgccgccggcacgggcaacagcaccccggtccagctctacacctgctcgtacgccgacaaccagcgctggaccgtctcctgacacggcatgc

SEQ ID NO: 243 - protein, 363 aa, Streptomyces thermoviolaceus
MSFHRSLPFRPKRLFGVLAPLLLAGVMSTQPAGAATVVPSDDVQGTGRQSQLTDGFGTRASCELPSTYRWTSTGALAQPRSGWVSLKDFTVVPYNGQHLVYATTHDTGTRWGSMNFEPFGDWSQMATARQNAMNSPTVAPTLFYFAPKDIWVLAYQWGGSAFSYRTSHDPTDPNGWSSEQVLFSGSIADSATGPIDQTLIGDDTHMYLFFAGDNGKIYRASMPIGDFPGSFGSTATVVMSDTRNNLFEAPQVYKLQGQNRYLMIVEAIGAQGQRYFRSFTATSLDGEWTPQATSESNPFAGKANSGATWTDDISHGELIRTTADQTMTVDPCNLQLLYQGRDPGSGGTYDLLPYRPGLLTLQR

SEQ ID NO: 244 - protein, 476 aa, Streptomyces thermoviolaceus
MGSHALPRPALRQRIRGGCGRGRGVLGLGATLSTPPTAHAAESTLGAAAAQSGRYFGTAIAAGRLSDSTYTSIASREFNMVTAENEMKIDATEPQRGQFDFSAGDRVYNWAVQNGKEVRGHTLAWHSQQPYWMQSLSGSDLRQAMIDHINGVMNHYKGKIAQWDVVNEAFEDGNSGARRDSNLQRTGNDWIEVAFRTARAADPSAKLCYNDYNIENWTWAKTQAVYNMVRDFKQRGVPIDCVGFQSHFNSGSPYDSNFRTTLQSFAALGVDVAITELDIQGASPTTYANVVNDCLAVSRCLGITVWGVRDTDSWRSGDTPLLFNGDGSKKPAYSAVLDALNGGSSGEPPEDGGSGQIKNAASGRCLDVSGAGTADGTAVQLYDCHGGTNQQWTYTDAGEFRVYGNKCLDAGGTGNGARVQIYSCWGGDNQKWRVNSDGTIVGVQSGLCLDAAGTGNSTPVQLYTCSYADNQRWTVS

SEQ ID NO: 245 - DNA, 6595 bp, Bifidobacterium longum
caccggtgtcggaggtgatgtagtagttgtcgcccagagcgtgaatcttcttggcggcgtcgtagtactgatcccaggtcttgatctgctcggcgtcaacaccggccttgtcgaagacctccttgttgtagaagaaggccattgggccggaatccatcggcaggccgtagaccttgccggcgaactgcacggaagcccacgggccaggggtgtagaagtcggagtagccggaggtcttgtcggtgatgtccagcaggttgcccttgatggcgtactgcgggatggcgtagtactcaacctgagcgacgtccggagcaccggagccagcctcgatggcgttatcaagctgggtgtattccttggtgttggtgccgacgttcttgagatcgaccttgatgccggtcttcttggtgaagtccttggcaacctgggtcagcgtgggctcccaagcccacacggtgatttcggtaacgtccttatcttgagccggcttgccactggcggtgtcggaaccgcaggcggcaacggaacccagcatggcaaccgcaccggtaagtgcaatggccttcttagcaacggtgaacttcatcgttctgttctccttccttggatcgcctttcggcggtctgcagtgattgtcaccacaacagcatggcaactctcctcgtcgtcatgctatcgtgaaccatcactctatggttcagtagtcacaaaacggctttgtttcgccactttgtagctatggttgcgataacatcttttattatacacattcttcggcaacacgccatcttggtatcgcaatccgcgcgccactgctcccatggcataagaaaatcgggcgctccgaagagtgcccgaccctgttatcgcaacctcccgctacagaaaccacaggaggaagtctgctgtgattgccgttacttcacctggtagccctgctgcttggcgtaatcttgcaggtccttctgccaggaagccacggcatcggagagcgtggtcttgccggtgtaggcatcgccggcgtagtcgccgaacttgccgcgagcgtagacctcgaagggcaggaacttgtagccggtggacacattggctgcggccttggccagctcctcgttgaacttctgaccgccgaagtactcgtgggccttgccgtcggagtcggtcagggaggtcatgttgaggaagtcgttggacttgagggtgtcgttgtcggccgggaaggcaccgccgtcaacacgggtcttaatgccctcggcgtcgtggcaggcgtattccatgaacttgtaggcggcggcgaccttgtccttgtcgtcggacttcacgatggccagcgaggaaccaccgttctcggagttggtctcggagccgtctgcggtcggcatctgggcgatgcgccacttgccgtcaccgttcggagcgccggaaagcaggttgtacggcatccaagcgccggtcagcagggatgcgatggagccgtcatccagacccttgttccaatcgtcggtccagccgacggtcttggtgtcgatgagatcttcgtcgatcatcttctgccagaagtcggtgaaggtcttgacgttcttgtcaccggtcaggttgatggtcacggtcccgccgtccttggaggtctcgaacggggtcgcgccggccagccaggtcatggagtcgaagaagccggcgtcaccggaatcggaggtgatgtaggagtccacggcgcgaatcttcttggcggcctcgtagaagtcgtcccacgtgcgcacctgagtcggatcgacgccggccttgtcgaagacgcccttgttgtagaaccaggccatcgggccggaatccatcggcagggcgtagacgccgtcattgatgttcaccgaggaccacgtgcccggggtgtagaagtccttgaaatcggaggcaccgagatcggaaaggttctcgaggtggccgcgaatcacgtattcgggcagtgcgtagtattcgatctgggcgatgtccggagcaccggagcctgcctcgatggcattggacagtgcgttgtactcgtccttgttggtgccggcgttggtcaccttcaccttaatgttcgggttcttggcctcgaatcccttgaccgtacgaggcagtgtggaatcccaggaccacacggtcagctcgaccttcttatcagaggagccggtgcttccgccatccccggcagaagtggaaccgcaggcagctacagaggagagcatggccacagcaccaatcagggcaattgtcttcttgccgaacttcatcgttctttccttccttgttattggaaacgacgggacttggcgttttgttccaagtcttgtatcgttttaagaaacggtaccacatgttttatgtttacgcaaacacgacacgtcgcaccatggtgactaaccgcaaaccgaaggagatgcatcccgctcatgaccactcacaacagccagtattccgccgaaaccacccatcccgacaagcaggaaagcagcccggcgccgaccgccgccggcaccacggccagtaacgtctccacaactggcaacgcaaccacgccggacgccagcatcgccctcaacgccgacgccactccggtagccgacgttcccccgcgtctgttcggctcattcgtagaacatctgggccgctgcgtctacggcggcatctacgagcccagccatcccaccgccgacgaaaacggcttccgccaagacgtgcttgacctggtcaaggagctgggcgtcacctgcgtgcgctaccccggcggcaatttcgtatccaactacaactgggaagacggcatcggtccacgcgagaatcgccccatgcgccgcgacctggcctggcattgcaccgaaaccaacgagatgggcatcgacgacttctaccgctggagccagaaagccggcaccgaaatcatgcttgccgtcaacatgggcacccgggggctgaaagccgcgctcgacgagctcgagtatgtcaacggcgcgcccggcaccgcttgggcggatcagcgcgtggccaacggcatcgaggagccgatggatatcaagatgtggtgcatcggcaacgaaatggacggcccgtggcaggtgggccacatgagcccggaagaatatgccggcgcggtggataaggtggcccacgccatgaagctcgccgagtccggtctcgaactcgtggcctgcggttcctcgggtgcctatatgccgaccttcggcacgtgggagaagaccgtgctcaccaaggcttacgagaatctcgacttcgtctcctgccatgcctactacttcgaccgcggccataaaacccgggccgccgcctccatgcaggacttcctggcctcttccgaagacatgaccaagttcatcgccaccgtctcggacgcggccgatcaggcgcgcgaagccaataacggcaccaaagacatcgccctgtccttcgacgaatggggcgtatggtattcggacaagtggaacgagcaggaagaccagtggaaggcggaggccgcgcagggtttgcaccacgagccatggcccaagtctccacatttgctggaagacatctacaccgcggccgacgcggtggtcgaaggttccctgatgatcaccctgctcaagcactgcgatcgcgtgcgttccgcctcgcgcgcccagctggtcaacgtcatcgcccccatcatggccgaggaacacggcccggcatggcggcagaccacgttctacccgttcgccgaagccgcccttcacgcgcgcggccaggcctacgctccggccatcagctcccccaccatccataccgaggcatacggcgacgtgccggccatcgacgcggtagtcacgtgggatgaacaggcccgcaccggtctgctgcttgccgtcaaccgcgacgccaacaccccgcacacgctcaccatcgacctttccgggctgcccggcctgcccggtctcggcacgctcgcgctcggcaaggcgcaactgttgcatgaggacgatccgtaccgcaccaacaccgccgaagcgcccgaagccgtcacgccgcaaccgctcgacattgcgatgaacgccaccggcacctgcacggcaacgcttcccgccatctcctggatcagcgtggaattccacggctaaaagacggagagtcacgcccgtaccaagtacagtcaagtccaatacgaccagggcccgtcaatcaccatacgattgacgggccttgtcattcacttcggatatttcgaaccatggattcatcaggcgcaggccaacgccggcgaggactcgcgcagggagaggctatagggggcctcgatggtttgggcaggagcgcgactgccggattcgacctgttggatgatggattcgacggccagtcgggcgatggcttccctgccggggttaacggtggaaagagacggcaccatgtaggccgattcctccacgtcatcgaagccgatgacgcgaacatcatccggcacggcaacgccgcgttcgcgcagttcacgcagcacgccccacgccagcaagtcattcaaagcgaacacggcatcgaattgcaggccactctccagcatggtgtccaccgcggccaaaccgtcggcgctcccccagccttgggtttcgataagcagactgtcatcacaggggatgtcgcgcgcggccagcgcctcacgatatccgtgggtgcggatggagcccgacgagaaatcgtgctcggggtggggcacggcaccgactacggcgatgcggcggcaaccggcatcaagcaggtgataagtcgcggcggcggccccttcgcgattgcgaatcactacgtgcggcgcgttgacgccgaacaaacgttcacccaacagcacgagcgggtaatcgccatccaaagccgcgatatcgtcaaccgtcatcatcagagggcttaagatgagcccgtccgcgctgtgcgtgcccatcgatgcgatgctttccagctcgcgggcacgattgttggtggtggattccacgatgacgccgtagccatgttgccgggcctcggccagaatatcctcggcgagttcggagaagtacacctgccgcagatcgggaatgaccagcttgagcaaccgggtacgcccggaacgcaggtttctggccgacgagttgactttgtatccgagcctgtcgatggcttccgcaatacgcgcggccatcgcctcgctcatatatggctgtttgttcagaaaattagacaccgaggctaccgaaacaccggcctcatgggccacgtccgccatcgtcactctgtttttgcctcgcacggtgaccaccctacccgactttgctggagatacgaaaacgactcccctgctacgatgagcagcaggggagcctttcggtaattaggcgctatgcgcggttttacagcttgacgacgagtacgccgttgggctggatggcggccgtgtgctcggactcgttgacctgggccagcgaggcgaccagcggttcgccttccacgtccacgaccgcaacatcgtgggtgcggttgaacaggaacacgaagtggttctcgccagtttcgtccgcacgctcgacgcgcagcacttcaccgcgatcgtcctcagccgaagtctcgatgccgagttcctccagcagcacgggcaggctcttggccaaaccctcacggccgagacgggcaccgacgtatgcggccttgccgtcgccgaagtcgttgacggtgatggcgggagcgccgtcgaaaccggtccacttatctgccttgaaggaggcgaccacgtgagcggtatcggccacggaggtgatcacgtcggcgaaatcgtgcgccacggttccgttgtccaagtcaaggtggtccatggcaccggggaagtcgttgcccatcggggcgaattcctcaacgcgcacacccaccacgtcacggatggaaccggggtagccacccagccagacgtgatccttgtcgtccaccagaccggtgtagtaggtcacgaacagcttgccgccgttcgccacatactcgcgcacgcggcgcgtggtctcttcggacaggatggtcaggctcggcagcacgacggcttcgtactcgtcccaagggccgcgaaccggcaccacgtctgcagtcagaccgttgtccgccagcgcgcggaaccacgcgagcggctcggtccaatggcgtacctcctgagtaggcgtggcggtgtgttccgtagcccactgggactcgtaatcgaagacgacggcgaccttggacttgaccagcttggtgctcagcaggccctcgtcagcaagcttgttgaggtcggcacccagctcgcacacatcgcggaagatctgggagccggggcccgcgtgaggaaccatcgaagagtgccacttctcggcaccggccttggactggcgccactggaagtagcagatggcgtcggagcccatggccaagtgggccagggagtcgcgcaccaattcgccgggctcgacgcgatagttgatcgggcgccaattgacggcggagctggagtgctccatgaggaaccacggattcttgcgggcgatgccgtcacatagggaggccgagtaagccagctcgtcgaagtgagcttcgc

SEQ ID NO: 246 - protein, 566 aa, Bifidobacterium longum
MTTHNSQYSAETTHPDKQESSPAPTAAGTTASNVSTTGNATTPDASIALNADATPVADVPPRLFGSFVEHLGRCVYGGIYEPSHPTADENGFRQDVLDLVKELGVTCVRYPGGNFVSNYNWEDGIGPRENRPMRRDLAWHCTETNEMGIDDFYRWSQKAGTEIMLAVNMGTRGLKAALDELEYVNGAPGTAWADQRVANGIEEPMDIKMWCIGNEMDGPWQVGHMSPEEYAGAVDKVAHAMKLAESGLELVACGSSGAYMPTFGTWEKTVLTKAYENLDFVSCHAYYFDRGHKTRAAASMQDFLASSEDMTKFIATVSDAADQAREANNGTKDIALSFDEWGVWYSDKWNEQEDQWKAEAAQGLHHEPWPKSPHLLEDIYTAADAVVEGSLMITLLKHCDRVRSASRAQLVNVIAPIMAEEHGPAWRQTTFYPFAEAALHARGQAYAPAISSPTIHTEAYGDVPAIDAVVTWDEQARTGLLLAVNRDANTPHTLTIDLSGLPGLPGLGTLALGKAQLLHEDDPYRTNTAEAPEAVTPQPLDIAMNATGTCTATLPAISWISVEFHG

SEQ ID NO: 247 - DNA, 1173 bp, Aspergillus oryzae
gcttgccttggctcaaatcgttcatgacacccatctaggccatggcgcctgtagagcaggttacatttcatggccggttaatccgaatccagtgcttgcacatgtagcgccacatggtctgtgctattctattctgtgttataatagtgtgatttattgcgtttgggcgtttcagttgattcgactggccttgcacattactctcgcattccacagctggctggaggagttatctttacttcttctttgtgactgtggctgcatgaggcgcttagtatactatcagctgatactatgttgaaactgaatcacggtgcttgaaggtctgcgtgaagtggttcattgggctgtgatattaaccgcagcctgtctagaactatgactagacggagcgccaagaatggacgacaacaggaatactgcccagctagccacagctgaatcctaaagaagtttgccagccctcgtattcctatcctgcatggacggcaacattgccctgacgagctaaattaggccgcagcgctagtattagaatgaactacggtagcaatgaggggaacgcccacaagccaattaacagcgctagtcttgatatgacgggcctagccttaattacggggtactgtgaggacgttgtgcctgctgcaattgtctatccgtgccgacggtgttgacagccactagccattcagctcgccacactttcaaccccacacctcaaagtaagacctaaacttattttggacttccttgcagctactatgctgtcactgttatttgactggacatgacatgcagtatcatggcgccaataaagagagtatctcgagagtttcattgcatcgtaggaaaggcttgcattccggtgttgccgggaaagggatcattggtaatgcgtagttgttttgtctagctgtgatgccgggctttgatggacggaggacctggagtgcagctcttcatgcaaagcccgagatagactgatttgtaacatgtgtgatgcgtatcattcattatcaatacgtctcgtggatatttaagaagggcgacagtcgtgtgaatatccgctacttcaagttcaaaacatcattcctacgaaaaggaaaaccacagcttccgcttcaaagccctagtcaacactagttcatcttctgattactttggttcaca

SEQ ID NO: 248 - DNA, 3752 bp, Aspergillus oryzae
aacatagacacaaccaatccgctagtagactgtcagtgagccttgttcaatacaatattatctttgccgcgtcttgtgggagtcttacgtctgggtgtcatttgctgcgaacttgtcttcgaacgaatggctggcaataacctccgcaataacacccaaatcgtctagagtcgtaacagtcagtatgggcttgatagcctattgatgcactgtcactcacatccataaaggaacgatcccagcgaggcgaaaacgcccaccagaaactgtgtaattgatcagcaactatagaagctatcccttcgttaaacatggatactcacttggtaccacgcaggagagagacgcatggtgatctcaatatcaaatcaaacaatctaactgtccactatgccctgagagcaaactcaataggtagaccggtggaccagatgcggggatttccctggggtatggggttccgcaggcctttaagaacttctggagatcgccagctcagatccagcactaaggcctcggagcccccgacaacagtctatggggatcgtggttcatattgtctcgtggtgggattccggagcttttttccaaaagcatggtaaaggcgccatagcgtgtcgataattcccggattccacaccaatgaaggaacatgccctatagaaacaagaacttcgcagcgaatcaggaccccagtcccatgagaaaggattcaattggtgcttgaccgtttgcggggggccgtcgtggtgtggctttcggagtcgcgagatactcgtgcaagcgcgagccctgattgatggaagatctcgtggcgttgcctcggcttcaaaaccaagacgacggcgccgttcccaagcatcgcctgcactttctacacatgattcacgccaatttccttcgtggtctggaacaaccccgcaggagattttcccgttctattacgatagctacgatgggtgttcagtccacattaattagttggcgctgtccagctgcttccaccacggatcttgcaagagtacttagtctagcaccatcttccctcttatcctgccaatcaatctctcgggcaattcaatttaccactttactgtgcaatttatgatattttaacggccgcaataatgactaccttcacgaaacttagcgatcaggatacgccgagtatcgcgatccacccatcccggcgtatttccaagatcaatcccaacatctatgcaggtttcacagagtaagcttagatttaatttttcctattcagtactagagcgccaaaggaatcaagctcacgcatgatcgcaggcacatgggccgatgcatttatggcggcatctacgacccgggtaatcccttgtcagatgagaatggcttcaggaaagatgtcctcgaagctctgaagacgctagacattcccgttgtccgctacccaggcggcaacttcatggcaacttaccactggatcgacggtgttggtcctaaagaccagcgtcctgcacggtatgttgtgtgatcattcagcttctgttaaccctccttctgtggtgtgctcgagcaacatatccctttctgcgatgggtttcttggtcactagaaggttttgaacatgaatgctgactatcaaaaggcctgagctggcttggctgggcacagaaacgaaccagttcggaactgatgaattcctcaagtggtgtgaagttcttggaactgagccatacttctgcctgaactttggaacaggtactcttgacgagggtaggctttgatctaatcccaatcattaaagccttgtgaaactaaccaggtttctatagcactcgcatgggttgagtattgcaatggtactggaaacacttactatgcaaacctccgccggaagaatggccgccaagagccttacaatgtatgcgcctttttcatgctaatcatatcacttggctgacatcacgcgtacaggttaaatactgggctctcggaaacgagacctggggaccgtggcaagtagagcaaatgaccaaggaggcatactcccacaaggcttatcaatgggcgaaaggtaaatatcaattttcaaatgccgctatgaccaaaagtactaatcaagtcccatagcccttaaactccttgaccccagcttagttctgatcctctgtggacaggatggtacagcatcatgggactactataccctgaagcactgtttgcttcccgtcaactcacccctatctaccagtgctgtccccctcattgacatgcacagcattcacctgtacacctcctcatcttcgcacctgcctaatgccaccgcccctctggctgctcgagcgtgcaattgagatcacatcctccctgatcgatctcgcccggatcgagaacggtgttcctccagagcaagcacgcccaaccatctgctttgatgaatggaacgtctgggaccccatccgtgccgaaggcagcaagggtgcagaggaatgctacacgctttccgacgcgctggccgtggccgtctggctcaatgtctttgtccgtaagagcaaggacttgggcatggcatgcattgcacagaccgtcaatgttatctccccactcatgacgaccaaggagggcatcaccaaacagactacctggtggcctctgtacctgttctctaagtatatgcgtggctggacaatcagcgcgcatctcgccagtgcaacctacgagggcgaaacctctcccaagtggattcgtggtgtcaaggagaccccttggttggacgtcagtgctgttctgggtgaggatggctacgtcaacgttgctgttgtcaacatccacgaggagaaggccattgaaacaacgatcgacggtgcttcgggtgaggttactgtgttcactgtcactggtgacagcgtcgccgcgaccaacatgaagggcaaggaagaagttgccgtagttgagagcacctgggatggacagggaccctacacattccctaagcactctcttactctcctgagatggaaggcttaagtgtctctggtagacaccagctaagtttccggcataatagaaatagactagataaattcattacatctgtaccatctccacatcgatatccgtcataaatggccgtggctcatcacagatgaatctatccatatgtagcatccgtctagcatacatcatccaaagtcgttctatacattatcatagccttaaccgaagtgaacatcatgaacagtgccctgttcatccaagtgtacgttcaacctgtaaatcaatcacgtcagtcccatatccttatcacagaaagcaacagcctagagaccacaacataccgttcaggcttataatccatcgtcatcatatcgccgggtttaacaatccgatgagactggggcaaatccttcttcgcaaatgactaccaacacccagaattagcttaatccatagaccatacctccgaaagggtaacaaagggcaaacaaacagtaacgtcactcgttccctccgtgatcgtcttcccggccagcttattgagccattcgttcttatcgccggcgttaacctgggggacgactagaggcatggtggaatgaaagatttgttattgaatagagatctttgtgttgatttgatcgtatttgtgacctcaataatactcgagaggaaaaacgcatgagatggtggaataggatagaaagtgcctggaggggtgatagctttatcatcatcactggtcactggcaatgatgtcatggcgaaggctt

SEQ ID NO: 249 - DNA, 6850 bp, Clostridium cellulovorans
gctagctgctatagaaccattagtaattcgtgctcaagcagaagcgaaatcagaagaagatttagaaaacttatttcaattttatattttagctggtgttttagttggcttgggaaaaaatatcaatgaagctattgaacaggtggaacaatggcaagcagaagatgattctaaactactatttaaaaataaaactgtaagagggtatatttattagtgaaaaaccaataatataattagacttaaagacttacgttatttggttaatctgagttagaagaaatttgtataaaagtagttttaaagtaatttacgagggttttcaaatttttataagaaaatcctctttttctattgaataattgaaagtaattaggcataatgtatttataaacatataaattaatttaaaggaatataaagtgatacataataatatatgatgaaggggaataagtatgaacaagttaactattaatgcacaaaataaaaagggtcaaatagacaaaaacatatatggtaattttgctgaacatttaggcagatgtatttatggaggattttgggttgggaaagattcaagtatcccaaatgtaaacggtatccgaactgatgtagtggaagcgctaaaagaaattaagcttccagtattaagatggccaggcggttgttttgctgatgaataccattggaaggatggtataggagatcctgaaatgcgtcctagaatggtaaatgctcattggggtggaactgttgaaaataaccattttgggactcatgaatttttagaattatgtgatatgttaggtgctgagccttatataaatggaaatgtcggaagtggaactgttcaagaaatgagagaatggattgaatacatgacttttgatggagagtcaccgatggcaaatttaagagctgctaatggaagaaagaacccatgggaaattaaatattttggtgtaggaaatgaaagctggggttgcggcggaaatatgagaccagaatattatgcagatttatttagaagatatggaagctatgtaagaaattttagtggaaatcaagtatataaaattgcttgtggacctaattcagttgattataattggacagaagtacttatgagagaagcaggacaattcatggacgctttaacacttcattattatacaacaggtactggagtgtgggaaaacaagggttcagctacagaatttgaagaagatctatggtttagaactatgaaaaatactttggtaatggaagaattagtaacaaaacatgatgaaattatgacaaagtatgatccagaaaaaagagttgcacttatagttgatgaatggggaacttggtttgaagttgaaaagggaacaaatccaggtttcttatatcagcaaaatacaataagagatgctcttgttgctggaattaacttaaatatatttaatgagcattgtgatagagtaaaaatggcaaatatagcccaaacaatcaatgttcttcaagctgtaatattgacagaaggtcctaaaatgttgctaactcctacataccatgtatttaatatgtataaagtgcatcaagatgcagaattattagaggtaggaaaaattgctcaagattatatatttggtgaagaaaaggttcctcaaatccactcgtctgcatcagtagataaggatgggaaaattcatatatctatttgtaatcttgacccaaaagcttcagcatcaattgaatgtgatgtagaaggtagggatattaaaactgttaacggtagtgttttagcttcagaaaaaattaatgatcataatacctttgagtgtccagataaagttaagcctagtgaattctcagattattcattagataataataagattactttaacagtacctgccatgtctgtgttagtgttagaattgcagtaaaaggaatcatggagaagaaggaaaattgtaagggctgtagggcaaatgttaatgttgatattaattcaatagaagccttggtagaggagataagaaataatagtgaatttgatgtagttagttcagaggtttacgataatagacttaatatatgtaaggaatgtaaggactttgtatatgggactacctgcaatcaatgtggatgctttgtgaaggtaagagcgttgcttaaaagcagtgtgtgtcctagttataagggtgatctttggggtcactaactggttaaaaaccacaactccttaaattaagcctataaattattcttaatatgagctaattatctcgtataagcaagagcgattaatgtaatttctataaaataatatgcattttgtataaagcactctacctcttagaaactagtatgttataataacttttgtgaaatcttttacactacagaaaggtacaataaaaatagaaagtgtaatagataaggaggattaaaatgaggataggtgttgattattatccagaacattgggatagacaattgtgggaaaaagatgctcagctaatgaaagaaataggggtaaaggtagtgagactagcagagtttgcttggtgtaagctagaacctatagaaggtcaatatgattttaaatggttagatgatgttattgaaatcttttcagttagaaatattgagattgtactaggaacaccaaccaatacccctccactttggttatatgaaaaatatccagatgctatccaagttaatgaaagtggagagagacaatttattggaatacgaggtcatagatgttacaatagctcatcgatgagaaaatatacaaaagctattgttgaagctatgaccgaaagatatgcaaataataaagctgtaattgggtggcaaatagataatgaactagatgcaacacattgttgttgtgacaattgcacagaaaaatttagaggatggctgaaaaataaatattcaactcttgagaatataaataaagagtatggaaacgtagtttggagtggtgaatattctgcttggtcgcaagtaacagcgcctcttggaggttcaccttttcttaatccatcatacttattggattacaataggtttgcttcagattcaatggttgaatatattgattttcaaagggaaattataagaaaaaactgtccttcacaatttattactacaaatacttggttcactggtaatttacctaatttttatgacgctttcgagaatctagattttgtttcttatgataattatcctacaacaaatgaaataactgatgaagaagaactacattcccatgcttttcattgtgacctaatgagaggaataaagaagaaaaacttttggataatggaacagctcagtggaactccaggatgttggatgcctatgcaaaggacaccaaaacctggaatgattaaagggtattcattccaagcaataggaagaggggcagaaacagtagttcattttagatggagaaatgcaattattggagctgagatgttttggcacgggatcttagaccatagcaatgtaaaaggaagaagattttatgagttcgcagagttatgtagagaagtgaataaaataaatgaagaaatacctgactacaaaataaataatgaagtagcaatcttgtattcttctgatcaagactttgcatttaaaattcagccgcaagtagaaggactgtattatctacaacagctaaaagcttttcataacgcacttataagactgggagtaggtactgatataataaattggagtgaaagtttaaataaatataaggtagttatagctccaacgctatatttaactgatgataatgtaacaactgaattatatagatttgttgaggctggtggtacattaattcttacaaatagaactggcgtaaaaaatatgaataatgtatgtttaatggaacaaatgccaagcaatctaaaggaatgtgctggtgtagtagtcaaagaatatgatcctataggacacagtattcatacaattaaagatgaagctggaaaagtatatcagtgcaaacaatggtgtgatattttagagccaactactgcaaaggttattgctacatataacgatgatttttatattgatgaggcagcagtaacagtaaataaatataaaaaagggaatgtttattacttaggtacagtattcaatagtgattattatatagaacttttatcaaagatattagatgagaaagaattgccatattacaagaaacttccttatggtctagaactttcggtgttagaaaatgaaaatgggaagtatctaatggtatttaacaatagtaatgaaataaaatgctttgaaggaaaacatgaaggtaaaagtattattaggaacgagttagatggaaaaagttttactctagaaccctatgggatagaagttttacaattagttgaataatgaggaaaaaccttgataaatcaaggtttttttgtttgcttaataatataaggatatttctaagttgacaaaatagtaaaaatattacagtgtaaaattaagaataaagtaataaaaaggagaaaatatgagaaaaagagtaagtgcattattagtattagctttcttattaagtggttgtggtgaaaacgatttgaaaaaagacactacagacaagtcggtagaaactacacaatcggttgagtctacagatacaactgagacaaaggattcagatgctactaaaacagaagaagaagtaatggatgaggcaaataaagaaacggcagaaactatggaagctggtaaagatgagccattaagagtaactcaggttacgataatgggtcaaaataatatcattgcgaagcttataagtgcagatggtaaaacacttgatcctagtattgatacatctattgataaattgaaagggattcaagaaaaagtaaaaagtgcattagattatttaaataatacacaagacaatttaagtgataagaatgttgcaattgataaactgaaattagcatctgaaaaattaggagaacttataacttcttgtgaaaaaaatggatctccagaagaaaaattagaaaaagcaaaagcacttaaagatgcctatggaaatgcagtaaaagctattatgaaagtttcaaaggtttaaaatttatgttaaacttcaaattctattaatacataatgtaataattccattttagaaggaaaaataaatctagttttagattataaatatatatgggaatcaaagctttgtgtaagtagtatcataatttgaaagtacttttaaggattagtattattgtatattgtaatactaatccttatttcgcatatatttttagacgtaaaataatgtagcatatatatctgcaattttttgtattgtatccctccatgaataattttttcttacaaaatcttttagcttatcatttttaggcgtattaaatgcttgataaatagtatctttaatttcatttttgtcaaaaggcgaggtataaaaagctaggtctttaaagtattcttttgaacttccctcagtagtacaaactacattacaaccataagcagctgcagctaaggaggataagcctggaatttcaccaaaggaaggcattgcgtgaacttttgcaaatttatatgcgttataagtgaaatacgaattcatatcgcctaaatataaaacgttttcattctcggtacacatttttaaataatttttatctccagatccaatgagtaccagttgaatcccaagttctttagtggctttagctaaagctaattggttttttcgttttgaaatattccctacagcaagaacatagtcatcaattttatatctttccttgaagtttaatagaggtatttcatcactttcattaaaaaaacctgtgtatactatttcacattttatatttttaccatattcctcttgtataagctttttttcagattcggaactacagataactttgttgctgcgccttagtatttcccgcctatagcagtttatttgtctccaaagttttaatttttcctcatcaccaatagaagaataataattttctaaattccaatacataggacttataactatttttttattaatttttttggctattttgaaatacctataagtttctcctattgatgtcaagttaaagagatgtataatgtcaaaagatgaaaagtttctatagttccgtcatttataacaatttcgataggcgtcgtttctaaaaacttttttatcatagatacatacatagaatccccagcattaaatcttttataatctttcctaacacataataaaactctcataatccttccttctttttaatcttgtttctatctttaggatattattatgcttagaaatgtgtgattatccttaattgcacttaaaaaggtaaaaccataaaagaaatattatggttttacctttttaataattggtgctttggaattatctttttttaattttgttatcatgacttgactatcgataattttattttcatattcaattattctatatttggcactttgaagattgaattttaactctttattattggcaattaaagctttattttcttcttttatctttttggcttcctctttaagaacctcaaattgctctttaagggaaagataatcttgctgaagattatcggatgaatacttttcaagtttactttctaattctttattatatttatctaagtgagtaacttgaagtttaagggactctgttgtttcctttaagcctttttgcgtgctctcaaggattgcagttttattttctaattcttctatataatctccccatttaaaaagctcatctgcagaattc

SEQ ID NO: 250 - protein, 492 aa, Clostridium cellulovorans
MNKLTINAQNKKGQIDKNIYGNFAEHLGRCIYGGFWVGKDSSIPNVNGIRTDVVEALKEIKLPVLRWPGGCFADEYHWKDGIGDPEMRPRMVNAHWGGTVENNHFGTHEFLELCDMLGAEPYINGNVGSGTVQEMREWIEYMTFDGESPMANLRAANGRKNPWEIKYFGVGNESWGCGGNMRPEYYADLFRRYGSYVRNFSGNQVYKIACGPNSVDYNWTEVLMREAGQFMDALTLHYYTTGTGVWENKGSATEFEEDLWFRTMKNTLVMEELVTKHDEIMTKYDPEKRVALIVDEWGTWFEVEKGTNPGFLYQQNTIRDALVAGINLNIFNEHCDRVKMANIAQTINVLQAVILTEGPKMLLTPTYHVFNMYKVHQDAELLEVGKIAQDYIFGEEKVPQIHSSASVDKDGKIHISICNLDPKASASIECDVEGRDIKTVNGSVLASEKINDHNTFECPDKVKPSEFSDYSLDNNKITLTVPAMSVLVLELQ

SEQ ID NO: 251 - protein, 89 aa, Clostridium cellulovorans
MEKKENCKGCRANVNVDINSIEALVEEIRNNSEFDVVSSEVYDNRLNICKECKDFVYGTTCNQCGCFVKVRALLKSSVCPSYKGDLWGH

SEQ ID NO: 252 - protein, 659 aa, Clostridium cellulovorans
MRIGVDYYPEHWDRQLWEKDAQLMKEIGVKVVRLAEFAWCKLEPIEGQYDFKWLDDVIEIFSVRNIEIVLGTPTNTPPLWLYEKYPDAIQVNESGERQFIGIRGHRCYNSSSMRKYTKAIVEAMTERYANNKAVIGWQIDNELDATHCCCDNCTEKFRGWLKNKYSTLENINKEYGNVVWSGEYSAWSQVTAPLGGSPFLNPSYLLDYNRFASDSMVEYIDFQREIIRKNCPSQFITTNTWFTGNLPNFYDAFENLDFVSYDNYPTTNEITDEEELHSHAFHCDLMRGIKKKNFWIMEQLSGTPGCWMPMQRTPKPGMIKGYSFQAIGRGAETVVHFRWRNAIIGAEMFWHGILDHSNVKGRRFYEFAELCREVNKINEEIPDYKINNEVAILYSSDQDFAFKIQPQVEGLYYLQQLKAFHNALIRLGVGTDIINWSESLNKYKVVIAPTLYLTDDNVTTELYRFVEAGGTLILTNRTGVKNMNNVCLMEQMPSNLKECAGVVVKEYDPIGHSIHTIKDEAGKVYQCKQWCDILEPTTAKVIATYNDDFYIDEAAVTVNKYKKGNVYYLGTVFNSDYYIELLSKILDEKELPYYKKLPYGLELSVLENENGKYLMVFNNSNEIKCFEGKHEGKSIIRNELDGKSFTLEPYGIEVLQLVE

SEQ ID NO: 253 - protein, 192 aa, Clostridium cellulovorans
MRKRVSALLVLAFLLSGCGENDLKKDTTDKSVETTQSVESTDTTETKDSDATKTEEEVMDEANKETAETMEAGKDEPLRVTQVTIMGQNNIIAKLISADGKTLDPSIDTSIDKLKGIQEKVKSALDYLNNTQDNLSDKNVAIDKLKLASEKLGELITSCEKNGSPEEKLEKAKALKDAYGNAVKAIMKVSKV

SEQ ID NO: 254 - protein, 248 aa, Clostridium cellulovorans
MYWNLENYYSSIGDEEKLKLWRQINCYRREILRRSNKVICSSESEKKLIQEEYGKNIKCEIVYTGFFNESDEIPLLNFKERYKIDDYVLAVGNISKRKNQLALAKATKELGIQLVLIGSGDKNYLKMCTENENVLYLGDMNSYFTYNAYKFAKVHAMPSFGEIPGLSSLAAAAYGCNVVCTTEGSSKEYFKDLAFYTSPFDKNEIKDTIYQAFNTPKNDKLKDFVRKNYSWRDTIQKIADIYATLFYV

SEQ ID NO: 255 - DNA, 3074 bp, Bacillus stearothermophilus
gatccggaaaagcgcgtcgggctcattgtggatgaatggggaacgtggtatgacgtagaaccgggcacgaatccgggattcttatatcaacaaaatacaatccgtgatgcgcttgtcgcagctctccattttcatattttccataaccattgtgatcgagtgcgaatggcgaatatcgcgcaaacggttaacgtcttgcaagcggtcattttgacaagaggggaacaaatgattctcacgcctacgtatcatgtgtttgacatgtataaggttcaccaagatgccgagttgttggcaatagagtcttcatgtgccgagtatgagcatcgcggggaaacgttgccgcaagtaagcatcactgcatccaagaacggggaaggaactgtccatatcagtttatgcaatattgatcatcgaaatgaggcggtagtagatttagagtttcgtggagacagcctcgcacgcaagcaagtattcggcacgatgttaacagcgaatgagatgaatgcccataatacatttgaaaagccggatgcagtgaagcccgaaccgttccgtcaaatagagctcggccaacatacactgatggccaaacttccgcccatgtctgtcgtcactttagcgattgttgaaaataaagcggctttgattgaacgacaatgaagacaaaggcggcggaaaatatggaagaaaaaaattggtgccaagactgcgcgggcagcgtcatcgttacacgggaaatgatggatccgctcattgaataaattgatcgttcagcactcgtttccgatgacgtatatgagaaaaggatcaatatatgcagaagttgttcctctctccaatatggcacaacttgcgcctatagcgggtatcttgtccattaccaggcaaaatggaggcgggaatgttgcccgtttccgggaagggcgaaatggggaagggaagaatagattgacaagttgataaaaaatagaaaggaagagtggcagatggctacgaaaaaagcaacgatgatcatcgaaaaagacttcaaaatcgctgaaatcgacaaacgtatttacggttcttttatcgagcacctcggccgcgctgtatacggagggatttatgagccgggacatccgcaggcagatgaaaacggcttccggcaagatgtcatcgagctggtcaaagagctgcaagtgccgatcatccgctatccgggcgggaattttgtgtccggttacaactgggaagatggagtggggccaaaagagcagcgtccgcgtcggcttgatttggcgtggaagtcggtggaaacgaatgaaattggcttgaatgaatttatggattgggccaagatggtcggagctgaagtgaatatggccgtcaacttagggacgcgtggcattgatgcggcgcgcaacttagtcgaatactgcaaccacccgtcgggctcctactacagcgatttgcgcattgcccacggctacaaagagcctcataaaattaaaacgtggtgcttgggcaatgagatggacggtccgtggcaaatcggccataagacggcggttgagtacggacgaatcgcttgtgaagcggccaaagtgatgaagtgggtcgacccgacgattgaacttgttgtgtgtggaagctcaaaccgaaatatgccaacgtttgcggaatgggaagcgacggttcttgaccatacgtatgaccatgtcgactatatttctctccatcaatactatggaaaccgggacaatgatacggccaattatttggcgttgtcgctggaaatggatgattttatccgttcggttgtcgccatcgccgattatgtgaaggcgaaaaaacgaagcaaaaaaacgatccacctttcgtttgacgaatggaatgtatggtaccactcgaatgaggcagataagttaattgaaccatggaccgtcgcgccgcctctgttggaagatatttataactttgaagatgcgctccttgtcggctgcatgctcattacgttaatgaaacatgcggatcgggtgaagattgcttgtttggcccaattagtaaatgtcattgcgccaatcatgacggaaaagaacgggccggcttggaaacaaacgatttattatccgtttatgcatgcatctgtttatggcagaggagtggcgttgcatccggtgatttccagcccgaaatacgacagcaaagacttcacagatgttccgtatttagagtcgatcgctgtttacaatgaagaaaaagaagaagtgacgatttttgcggtcaaccgtgatatggaagacgcgttgttgttggaatgcgatgttcgcagttttgaagactaccgtgtcattgaacatatcgttttggaacatgacaacgtgaaacaaacgaattcggcccaatcttccccggttgtcccgcatcgcaacggcgatgcccagctttccgatagaaaagtgtcggccacgttgccaaagttatcgtggaacgtcatccgtttaggaaaaaggtgatcggatgaaggctggtcgtataggccagcctatccctttgagaaacaggaaggagggccgaaaatggaacgcaaagcccgctggggaatcgtaagtacggccgccattgcgaaagacgtgatgattcctgccattcatcgggcggattatgccgaggtggtggcgatcgccagtgaaagcgggcgggcggatcaggtagcgcaggagctcggaatttctaaggcgtatgatagctatgaaaagctgctcgatgatcgtgacatcgatgcggtgtatattccgcttccgaacagtatgcatgccgaatggacgatcaaagcggcaaagaagaaaaagcatgtgctttgtgaaaagccggccgccttatgtgaagaggatgtccggcgtatgatagaggtatgcgaggaaaacagcgttttattcatggaggcgttcatgtaccagtttcatccgcagcatgagcgagtcaaacagcttctggcagctggcgagattggtgaagtcaagtacatgcgcgcccatttctccttttacttgcaagaccaggcaacgaatatccgcatgaaccctaagctt

SEQ ID NO: 256 - protein, 220 aa, Bacillus stearothermophilus
DPEKRVGLIVDEWGTWYDVEPGTNPGFLYQQNTIRDALVAALHFHIFHNHCDRVRMANIAQTVNVLQAVILTRGEQMILTPTYHVFDMYKVHQDAELLAIESSCAEYEHRGETLPQVSITASKNGEGTVHISLCNIDHRNEAVVDLEFRGDSLARKQVFGTMLTANEMNAHNTFEKPDAVKPEPFRQIELGQHTLMAKLPPMSVVTLAIVENKAALIERQ

SEQ ID NO: 257 - protein, 502 aa, Bacillus stearothermophilus
MATKKATMIIEKDFKIAEIDKRIYGSFIEHLGRAVYGGIYEPGHPQADENGFRQDVIELVKELQVPIIRYPGGNFVSGYNWEDGVGPKEQRPRRLDLAWKSVETNEIGLNEFMDWAKMVGAEVNMAVNLGTRGIDAARNLVEYCNHPSGSYYSDLRIAHGYKEPHKIKTWCLGNEMDGPWQIGHKTAVEYGRIACEAAKVMKWVDPTIELVVCGSSNRNMPTFAEWEATVLDHTYDHVDYISLHQYYGNRDNDTANYLALSLEMDDFIRSVVAIADYVKAKKRSKKTIHLSFDEWNVWYHSNEADKLIEPWTVAPPLLEDIYNFEDALLVGCMLITLMKHADRVKIACLAQLVNVIAPIMTEKNGPAWKQTIYYPFMHASVYGRGVALHPVISSPKYDSKDFTDVPYLESIAVYNEEKEEVTIFAVNRDMEDALLLECDVRSFEDYRVIEHIVLEHDNVKQTNSAQSSPVVPHRNGDAQLSDRKVSATLPKLSWNVIRLGKR

SEQ ID NO: 258 - DNA, 2100 bp, Aspergillus oryzae
tcgttagaacgcgtaatacgactcactatagggagatgtacatattgtcgttagaacgcgtaatacgactcactatagggagatctagaaccattggaggaaaatccttgctgctttagtacctaccgtatacccctcttaaactacagaacggacatcgcgaaagattataaaaggatacacaggatgcaccaatgtcccacgatttacttactctatcacatcggctcttcgagtatctccgcgccggctttgaaacactcacaggcgtgaccgtctcaccctgggaaagagatcaaacatgtcctcaggattaagcctcgaacgtgcctgcgcagttgctctgggcattgttgcctcggcatctcttgtcgctgctgggccttgtgacatctactcctcgggcggcacgccctgcgtcgccgcgcacagcaccgctcgtgccctatacagcgcctacaccggcgcactgtatcaggtgaaacgaggctccgatggtagcacaaccgacatcgctcctctctctgctgggggtgttgccgatgccgccatccaagactccttctgtgcgaacacgacctgcctcatcactatcatttatgaccagtccggtcgcggtaatcacctcacccaggctccgcccggcggctttaatggtcccgagtccaatggctacgacaacctagctagtgcggttggtgcaccagtcacgctaaacggcaagaaggcgtacggcgtctttatgtcacctggtaccggctatcgcaacaacgctgccagcggtacagctaccggcgacaaggcggagggcatgtacgcggtcctggacggcacccactacaacagtgcctgctgcttcgactatggcaacgcggaggtcagcaacacagatacaggtaatggccacatggaggctatctactatggcgacaacactgtctggggaagcggcgctggcagtggtccttggattatggccgatcttgagaacggcctgttctctggcctcagttctacgaacaacgctggcgacccgtccatttcctaccggttcgtgacagccgtcgtcaagggagaggcaaaccagtggtcaatccgtggcgccaacgctgcatccggctcgctatcgacgtactatagtggcgcgcgcccaagtgcttctggctacaatcccatgagcaaagaaggcgccatcattcttggcattggtggtgacaacagcaacggtgcccagggcacgttctatgagggtgtgatgacctccggatatccgtccgatgccaccgagaactcggtgcaggcggacatcgtagctgccaaatacgccatcgcgtcactgaccagtggcccggcgctcaccgtcggatcctcgatctcgctgcaagttaccacggctggttacacgactcgctatctcgcacacgacgggtctacggtcaacacgcaggtagtctcgtcgtcaagcaccaccgccttgagacagcaggctagctggacggttcgcaccggccttgctaatagcgcctgtctttcgttcgagtcggttgatactcccggcagctacatacggcactataactttgcccttcttctcaatgccaacgatggcacgaagcagttctacgaagacgccacgttctgtccacaggctggtctgaatggccagggcaactcgattcgatcctggagctatccgacccgttatttccgccactacgaaaacgttctttatgtagccagcaacggtggtgttcagacgtttgatgccaccacttcatttaacgatgacgtgagctgggttgtcagcactggctttgcttagatgctggtccaatctctaggagatatgttggagtgagtcataacccttatgaacgtttcttctggtgtccgtaaagagaacaatcgatgatggaccagggcatacagacccttggtctcaccttctcccttcccatcggcctttgctctgccgagtcaaaccccttttatgttgaactcagatatagctcataatgttcacaaccaatgcttttattcaaacttgtatcgattagactgttgggcacacagtagagaatatagggttatcattgctgc

SEQ ID NO: 259 - protein, 506 aa, Aspergillus oryzae
MSSGLSLERACAVALGIVASASLVAAGPCDIYSSGGTPCVAAHSTARALYSAYTGALYQVKRGSDGSTTDIAPLSAGGVADAAIQDSFCANTTCLITIIYDQSGRGNHLTQAPPGGFNGPESNGYDNLASAVGAPVTLNGKKAYGVFMSPGTGYRNNAASGTATGDKAEGMYAVLDGTHYNSACCFDYGNAEVSNTDTGNGHMEAIYYGDNTVWGSGAGSGPWIMADLENGLFSGLSSTNNAGDPSISYRFVTAVVKGEANQWSIRGANAASGSLSTYYSGARPSASGYNPMSKEGAIILGIGGDNSNGAQGTFYEGVMTSGYPSDATENSVQADIVAAKYAIASLTSGPALTVGSSISLQVTTAGYTTRYLAHDGSTVNTQVVSSSSTTALRQQASWTVRTGLANSACLSFESVDTPGSYIRHYNFALLLNANDGTKQFYEDATFCPQAGLNGQGNSIRSWSYPTRYFRHYENVLYVASNGGVQTFDATTSFNDDVSWVVSTGFA

SEQ ID NO: 260 - DNA, 1521 bp, Aspergillus oryzae
atgtcctcaggattaagcctcgaacgtgcctgcgcagttgctctgggcattgttgcctcggcatctcttgtcgctgctgggccttgtgacatctactcctccggcggcacgccctgcgtcgccgcgcacagcaccactcgtgccctatacagcgcctacaccggcgcactgtatcaggtgaaacgaggctccgatggtagcacaaccgacatcgctcctctctctgctgggggtgttgccgatgccgccacccaagactccttctgtgcgaacacgacctgcctcatcactatcatttatgaccagtccggtcgcggtaatcacctcacccaggctccgcccggcggctttaatggtcccgagtccaatggctacgacaacctagctagtgcggttggtgcaccagtcacgctaaacggcaagaaggcgtatggcgtctttatgtcacctggtaccggctatcgcaacaacgctgccagcggtacagctaccggcgacgaggcggagggcatgtacgcggtcctggacggcacccactacaacagtgcctgctgcttcgactatggcaacgcggaggtcagcaacacagatacaggtaatggccacatggaggctatctactatggcgacaacaccgtctggggaagtggcgctggcagtggtccttggattatggccgatcttgagaacggcctgttctctggcctcagttctacgaacaacgctggcgatccgtctatttcctaccggttcgtgacagccgtcgtcaagggagaggcaaaccagtggtccatccgcggcgccaacgctgcatccggctcgctatcgacgtactatagtggcgcgcgcccaagtgcctctggctacaatcccatgagcaaagaaggcgccatcattcttggcatcggtggtgacaacagcaatggtgcccagggcacgttctacgagggtgtgatgacctctggatatccgtccgatgccaccgagaactcggtgcaggcggacatcgtagctgccaaatacgccatcgcgtcactgaccagtggcccggcgctcaccgtcggatcctcgatctcgctgcaagttactacggctggctacacgactcgctacctcgcacatgacggttctacggtcaacactcaggtagtctcgtcaaccagcaccaaggccttgaaacagcaagctagctggacggttcgcaccggccttgccaatagcgcctgtttttcgttcgagtcggttgatactcccggcagctacatacggcactataactttgcccatcttcttaatgcaaacgatggcacgaagcagttctacgaagacgccacgttctgtccacaggctggtctaaatggccagggcaactcgattcgatcttggagctatcctacccgttatttccgtcactacgaaaacgttctttatgtggccagcaacggtggtgttcagacgtttgatgccaccacttcatttaacgatgacgtgagctgggtggtcagcactggctttgcttag

SEQ ID NO: 261 - protein, 506 aa, Aspergillus oryzae
MSSGLSLERACAVALGIVASASLVAAGPCDIYSSGGTPCVAAHSTTRALYSAYTGALYQVKRGSDGSTTDIAPLSAGGVADAATQDSFCANTTCLITIIYDQSGRGNHLTQAPPGGFNGPESNGYDNLASAVGAPVTLNGKKAYGVFMSPGTGYRNNAASGTATGDEAEGMYAVLDGTHYNSACCFDYGNAEVSNTDTGNGHMEAIYYGDNTVWGSGAGSGPWIMADLENGLFSGLSSTNNAGDPSISYRFVTAVVKGEANQWSIRGANAASGSLSTYYSGARPSASGYNPMSKEGAIILGIGGDNSNGAQGTFYEGVMTSGYPSDATENSVQADIVAAKYAIASLTSGPALTVGSSISLQVTTAGYTTRYLAHDGSTVNTQVVSSTSTKALKQQASWTVRTGLANSACFSFESVDTPGSYIRHYNFAHLLNANDGTKQFYEDATFCPQAGLNGQGNSIRSWSYPTRYFRHYENVLYVASNGGVQTFDATTSFNDDVSWVVSTGFA

SEQ ID NO: 262 - DNA, 2715 bp, Penicillium purporogenum
atgttgatctacgccccagcgttacatccacaactcgacctcgtgacgcacatatgctcactcctactgtaagactgaacaagtgggagcattgaatatttggaaactaagaactgatttcatgttattgacttggcatttgaacaagtcagcgtcaggagggttcggggaagaaataatattgtgcgagcttatgtactaatcataataacttaatccgaaatcatttccccgcgctcctcacgcttcccggcgcccgcaaagactctgaggagttgtggggtcttcatctgcacggcacgctagccaatcaagcctgagccacctgagcaagcaccgggcctcttctgagacctgtgtcaatcctgctgcttagatctatcctctttgagtataagcccgctggtaggctatcgcacgaagctccacctcccctcgtttttcgctgcctgtaattccgaaattctgtccaaggtcctgcaagttgatctacctgttgataggagcttgtaagttgatgagcagtaagttgcatgcatcttgtagttcgcaattggcatatctcgacaagatctgttggttttctagccagatgagtctacacaccccatttccggtattgaagatatgacacgattgctcaattcgttacaataacatcaagccatttcaatgtcgcattaaatacaaggctaaatacatgtacagtacagatgctgaatacccgagtttactgatattaaccaccagaataatgcactgtatcttaagttattggaggaaaatttgcaccatgtgaataatgcctcattttctcgattcaaaaatcagacactaggtgaatggcgtccaaaaactatataagggccgactctagacggcaagacaggaggtcctgcgacatacttgttctacctccacggcagttaaaagattgctcggccatttccatcactcaatccgggacttgatcaaaccataccttcaagatgcttccacgcttgagcttcgatcatgcctgggtccttgctctaggccttgttgccaagggcactcttgtgtttgctgggccctgcgatatctactcctctgggggcacgccatgcgtcgccgcgcatagtaccacccgtgcattgtacagctccttcactggagcactgtatcaaatcaagcgtggctctgacggtgctacgactaccatctcgccactctctgcgggaggtgtagccaatgccgccgctcaggacactttctgtgccaacacgacctgtctcatcaccatcatttatgaccagtctggccgcggaaatcacctcacacaggcccctcccggaggcttcagcggcccagatactaatgggtacgacaaccttgctagcgcaattggcgcacctgtgactttgaatggtcaaaaggcctacggcgtctttatctcgcctggcacaggctacagaaacaatgctgtcagcggcacagcaacaggtgacgcagcagagggcatgtatgcagtccttgacggcactcattacaacgatgcctgctgcttcgattacggcaacgccgaaactagtagcactgacaccggcaacggccatatggaagctatctactttggtgacaacacagtctggggtacgggcgcagggagtggcccatgggtcatggctgatcttgagaatggccttttctctggtctgagctcaggaaacaatgctgccgacccgtccgtcagctaccgtttcctcagcacgatcgtcaagggagagtctaaccaatgggcaatccgcggcggcaacgcagtctctggctccctctcaacttactacagtggagcacgcccaagcgcatctggctacaacccaatgagcaaagaaggtgccattattcttggcatcggcggtgacaacagccacggtgctcagggcactttctatgagggcgtcatgacctccggctacccgtctgatgcgacagagaactcggtacaggctaacattgtggctgccaagtacgccgccggttcgctgactagcggtccggcactgactgtcggttcctcgatttcgctgcgcgcgacgacgtcgggctacacgacacgctacattgcgcacaccggttcgactgttaatacgcaggttgtcacttcgtcgagctccacaactctgaaacagcaggccagctggacggttcgcacaggtcttggcaatagcgcctgctactcgttcgaatccgtggacactcccggtagctacatcagacactacaatttcgggctgctacttaacgcaaatgatggcacgaagcagttccacgaggatgccacattctgcccccagtctggtctcagtggccaaggcaactcgattcggtcgtggagctatcctacccgctatttccgccactacaacaacatcctttatattgccagcaatggaggtgtcgatacttttgatgctactgcttccttcaatgctgacgttacctgggtcatcagcaccggctttgcttgatcaccagtccactttctgagcattgcatggaagccggcttgagacccttcccaatttgctcccgaataatggcggttcgaggtacttttttttaagatacagtttgcaattagctaggccactttaaatatcgctaaaatcgagttgcagagattagacttcatccttaattccgctcatcatgactccataacatgttagccgt

SEQ ID NO: 263 - protein, 506 aa, Penicillium purporogenum
MLPRLSFDHAWVLALGLVAKGTLVFAGPCDIYSSGGTPCVAAHSTTRALYSSFTGALYQIKRGSDGATTTISPLSAGGVANAAAQDTFCANTTCLITIIYDQSGRGNHLTQAPPGGFSGPDTNGYDNLASAIGAPVTLNGQKAYGVFISPGTGYRNNAVSGTATGDAAEGMYAVLDGTHYNDACCFDYGNAETSSTDTGNGHMEAIYFGDNTVWGTGAGSGPWVMADLENGLFSGLSSGNNAADPSVSYRFLSTIVKGESNQWAIRGGNAVSGSLSTYYSGARPSASGYNPMSKEGAIILGIGGDNSHGAQGTFYEGVMTSGYPSDATENSVQANIVAAKYAAGSLTSGPALTVGSSISLRATTSGYTTRYIAHTGSTVNTQVVTSSSSTTLKQQASWTVRTGLGNSACYSFESVDTPGSYIRHYNFGLLLNANDGTKQFHEDATFCPQSGLSGQGNSIRSWSYPTRYFRHYNNILYIASNGGVDTFDATASFNADVTWVISTGFA

SEQ ID NO: 264 - DNA, 2143 bp, Cochliobolus carbonum
agaggagcacagaggacttgggtttgtcttttttcttcatatccaaaaaaaaccatgtcttcaaaatcgcttctcgttgcgcttgggcttgtagccacaggttcattggtgcatgcagggccttgtgacatttacgccaaaggcaacacaccatgcattgctgcacatgccaccactcgtgctctgtataattcatacagtggcccgctctaccaagtcaagcgtggctcagacggtgccacaactgacattgctccactgtccgccggcggtgtcgccaatgcagctgctcaagacaagttctgtgccaacacgacatgtctcatttccatcatctacgaccaatctggcaaaggaaaccacctcacacaagcaccaccaggcgctttcaagggcccagacgtcggcggttacgacaatctggcaagtgctatcggtgcacctgtttcgctaggcggcaaaaaggcatatggcgtcttcatctcccctggaaccgggtaccgcaataacaacgtaaaaggctcggccgtaaaagacgagccccaaggcatatacgccgtcttggacggtacacattacaatggcggctgctgcttcgactatggcaatgctgagacaaacaaccttgacactggtaagtatatcacctcccatcaatttttgatatcagccaattgaccacccaaaaaacaggcaacggccacatggaagccatctactttggtgacaacaccgtgtggggcagcggcgctggcaacggcccctgggtcatggctgacctagaaaacggcctcttctccggtgcaaacccaaagcagaacactcaaaacccatccgtctcaaaccgcttcctaacgactgttgtcaagggcaagcctggcgtctgggccatccgcgccggagacgccaccacaggcggactctcaacatactacaacggctcgcgcccaagtgtgtcgggctacaaccccatgagcaaagaaggcgccattatcctcggtatcggcggcgacaacagcaacggcgcacagggaaccttcaccgagggcgcaatgacgttcgggtatcccagcgacgcaatcgaaaacgaagtccaggccaaccttgttgcggctggatactccactggacgcggattgatgactagcggacccgcatacactgttggatccagtgtatctctcagggccacgacatctggctacacggaccgctatctcgcgcactccggagcgacagtgaacacccaagtcgtatcgtcgtcgagcactgcgctgctcaagcgccaggcgagctggattgtccgcgctggcttcaccaacagcgagtgctttgcgttcgaatcaaaggatacggctggaagctttctccgccacgcaaatttcgtgctgcaggtcaatgctaatgatggatccaaggggttcaaggaagatgcgacattttgtcctcaggcgggtcttacgggtaagggtagctcgattagaacttgggcgtacccgacgaggtggattcgccattttaacaatgttgggtatatttcgagcaatggtggtgtcaaggactttgataatgtcagctcgttcaacgacgatatcacgtggcttgttgagagtgccctggcttgaggggaccgggtagtatgtggtggaattttatgtaagtatgaatgcttccgacgtatataagttggttttgtcagaatatgttgatgaatggtatattcctatgtatatatggacgggattgcctctactatgtaagctgcatttgttagcaaatataaagataccaaagtactctagtaaacttctgttaaatttcctcacttaccttgaattttgtaattcatgatcggaagcgggcattgtatcatatcgcatttgaacacgagaaatcaacatccagttcacacacacactgcatatgaacattgaacaagttttgtttaagctactggtacaagttatagtactggctatcaagactgcttacaaaaaagaccctgacatcgcctagtctatggctaaatctaggggatatacacatcaacagggctgggaataacagaaagaagaagatccttttagtcaataagcagactgttcaggcgagcctcagtggcaataacgtccaaggcctgctt

SEQ ID NO: 265 - protein, 503 aa, Cochliobolus carbonum
MSSKSLLVALGLVATGSLVHAGPCDIYAKGNTPCIAAHATTRALYNSYSGPLYQVKRGSDGATTDIAPLSAGGVANAAAQDKFCANTTCLISIIYDQSGKGNHLTQAPPGAFKGPDVGGYDNLASAIGAPVSLGGKKAYGVFISPGTGYRNNNVKGSAVKDEPQGIYAVLDGTHYNGGCCFDYGNAETNNLDTGNGHMEAIYFGDNTVWGSGAGNGPWVMADLENGLFSGANPKQNTQNPSVSNRFLTTVVKGKPGVWAIRAGDATTGGLSTYYNGSRPSVSGYNPMSKEGAIILGIGGDNSNGAQGTFTEGAMTFGYPSDAIENEVQANLVAAGYSTGRGLMTSGPAYTVGSSVSLRATTSGYTDRYLAHSGATVNTQVVSSSSTALLKRQASWIVRAGFTNSECFAFESKDTAGSFLRHANFVLQVNANDGSKGFKEDATFCPQAGLTGKGSSIRTWAYPTRWIRHFNNVGYISSNGGVKDFDNVSSFNDDITWLVESALA

SEQ ID NO: 266 - DNA, 3397 bp, Cochliobolus carbonum
ccgcccgtaggatttccttctttatctcttaggagctgctctcttagtgttcggggggaaatggcggttccactccgtattctgggcgcccagcaccacacctactttacactagctttgcgatgttcaaaagccgacgtggagaaaaaccccggatagaggagaatccacctgcaccaccccacccacccaacctcgcaggaacgggcattggcgggcgaactccggaagatttgtaagtagtgttctatcggtgtaatagtggagatgtgccaagcggtgtgggaaaaaggttcaaaggttgaatatttgatggattgttcagagattgatatgggcactttttttgaaccaggggcgcaatcggcaaaagttacttttttacgtactgtttaaatgttggttgggtggtaaacaatttgctccttgggagacgaaagccggtgtgcaaagtagcattttttgagcatcttttgtccagcatgctccttactctagacatgggcttggtaggtgggccgagttacattggcaacgctcacaaccgccttggcaaggctaagtactgcgtacaatccaagcgctgtggttaccgctactctttaatctgtgcggccgaacaaattccgcgagtcgatctagaagctgaccctcctcccacgtgtttgctggccactgacagtgaatgttgtttagtggagttgagagtgcttagtggcaaaaaagtgcccttgcttatggccggagagtgttgcgtcagttatagttttcataactgcagatgcgcgtcctttgggcggctccttacagcggctccctgctgtagcacgataattgtggttttgcagttttgcgtgattaaggcgcagagcacagttgacgtcggtgtagggacaatttctcgcgccctagctgtccatgcggcatcaatcaagcaatgccaaacctcaaacccgctaagtccaagtcttgacttgtgggcgcagcggaggcagcccttcgactggtggcacttttgcgccactggcacccatgcttctagattccggccaccgggtgtttcatcgcgtgttgacgtttcgctctagtggagagactagcatcggataggaacactcgcggattctagtaaacacccggtgggactttttggagcaataccgccgagattggggcctggcaatcagcgcagcaggccatgtttctttgttcggcgcaagagacgccaacaggactgcttgttagcgcagtgttggtacgtagtcggccggtcatacatcagacgaattgacgtcgacgtcaaaacatagtcgccaagctagcgggttaggcgaatggggtgcagcacatacctgcattaggatttaagcatgcatatagtagtagattaaggaattgcccagcctcacttgtttctgcagtcctacgtgccctttgccgtgcgttccccgcattacggagaattgccgtccgtgcagtcgcgtcaattcccttgaaacatcatgtaatttaatatacccacaacaacggaacaatatgccataccgagagtagacgcatgatgtggatgatcaatttccacgctcaggagatctaggttcccgagcccagtcctgaatcggccaaccctcaagcggtacgtgggcaaggcgtgatacacggcatgccttctgattcgtaggcctagacagcatcggctccaggtataagtatcttatacatgccctcgttctaatagtcatccagctcaccagcatcacattcactcattcaaccaaccaactaccaaacaccccaaaaaaccaaacatgcgtttcgttcccgaccttagcttctcggctgctgccgtcgcccttctggcttccactgcttcggcccagagctgcaagcttcccacctcttacaagtggacctcctccggcgctcttgcccagcccaagtctggatgggccaacttgaaggatttcaccatctccagccttaacggcaagcacattgtctatgctaccgaccacgacactggatccaagtacggatccatggctttcagccccttcggtagcttcagcgagatggcctctgcttcccagaccgccacccccttcactgctgttgcccctaccctcttccgtttcgctcccaagaacatttgggtcttggcctaccagtggggacctaccaccttctcctacaggacctccagcgaccccaccaaccccaacagctggggtggtgtccagactctcttctctggcaagatctccggcagcagcactggtgctattgaccagactgtcattggtgacgccatcaacatgtacctcttcttcgccggtgacaacggcaagatctaccgtagcagcatgcccaaggccaacttccctggcagcttcggcactgcttccaccgtcatcatgagcgacagcaccaacaacctcttcgaggctgttcaggtctacaccgtcaagggtggcggttacctcatgatcgttgaggctgttggctctggcggccgttacttccgctctttcactgcctccagcctcagcggtagctggacccccaacgctgccaccgagagcaaccccttcgccggcaaggccaacagcggtgccacctggaccaacgacatctcccacggagatcttgtcaaggtcaccaacgacgagaccatgaccgtcgacccttgcaacctgcagctgttgtaccagggccgtgcccccaactctggcggcgactacgaccgtctcccctacaggcccggtctccttaccctcaagaagtagagccttctttgctcggctcctggcgaggtaccttcattgtaaatgaatttttgtgtgggagattgtatatagctcagtttgtggtggaattcgtatatatattattttgggccactggctttggctctttggcattgcgcgaggcatcaattgattcttcaacctatctttgaaaatccatctatcttaccttttgagtgacttcttgtgaaacatgactcgatggcttgcctgcctattgcaactccttggagaaaatccgccgacgctgcttatgctggtatatctcgctcctacacacttctagattcttcctctctctaatcgcaatctcctgcaagatggccatgctcttggcagataacaacgggaccgccctttgcactgggtccaggcctcgtgcagttccataaacgcccaagccataccaacaagggcattccggtgcactagccaccgcatactcgtcgcaaccattcattccgcaaaagcagctgactcgggctcgcccagcgacactgcctcgcgcaaattacacggctgctggtagcctgcattaagacacaactctaggccaagttccacgatgccaaccgcctcgccatcatcag

SEQ ID NO: 267 - protein, 325 aa, Cochliobolus carbonum
MRFVPDLSFSAAAVALLASTASAQSCKLPTSYKWTSSGALAQPKSGWANLKDFTISSLNGKHIVYATDHDTGSKYGSMAFSPFGSFSEMASASQTATPFTAVAPTLFRFAPKNIWVLAYQWGPTTFSYRTSSDPTNPNSWGGVQTLFSGKISGSSTGAIDQTVIGDAINMYLFFAGDNGKIYRSSMPKANFPGSFGTASTVIMSDSTNNLFEAVQVYTVKGGGYLMIVEAVGSGGRYFRSFTASSLSGSWTPNAATESNPFAGKANSGATWTNDISHGDLVKVTNDETMTVDPCNLQLLYQGRAPNSGGDYDRLPYRPGLLTLKK

SEQ ID NO: 268 - DNA, 1940 bp, Cytophaga xylanolytica
aattcatggccggtgatgtacgtttcgcaaggactcttttttctcttaaggaaacgatatggattgttgattcaatgtcgttaagttagtgcgattcacaaaagagacaagaagatgatgagactaaagacagatagattagactgaagagacgaagttcacggatctaaatatctgttttttcatctcatcatctgtctcttcgtctgacatctttttctcttaactaaacgacattgattgttgatttgtcgtttgatgattgatttgaaatagtataaattgaaatagtatgaagaaacgaatgagtattcaaaagcgaattgctttcaatggagccttggtgttggcatttatgttgaccatgtgcaccccaaaacctcctcagaatgaggatgtcgtaaaaatgtccgtcgacgtcacgcaaagtggccctgaaatcaaccgtcacatctttggccagtttgccgaacatttgggcacgggcatttacggcggcatttgggtgggacccgaatcggaaatccccaatacccgcgggattcgtaatgatgtggtgaaagctttaaaggccatcaaagtgcccaacgtgcgctggccgggcggttgttttgccgatcagtaccactggcgcgatggcatcggtgcacccgaggaacgcaaaagtcgcatcaatgtcagctggggcggtagtcccgaagccaacacctttggcacgcatgaatatttcgatttcatttctcaaattggttccgaagcctttatttcggccaatgtgggatcgggtactgtgcaggaatcggctgattggctggagtatctcacggcttcagggtcgacattggctctcgagcgtgcccgaaacggtcaccccgacccctacgatgttgccttttggggcgtgggcaacgaagtgtggggatgcggcggtccttttaccccgcaggaatatatcaccgagcttaaaaagtttgccacttttaccaataactacaatgccaacgtcaatactcagtttgttgcggtgggccccgactcgtttgatgaatacagctttggctatcccgaagccatcatggaggcctgggcaaagaaaacctggacctgggatattcaagggctttcgttgcacatgtacacgcgtggcggctggccggcagtgattcctgctaccggtttcaacgaatcgggatacgcagcagtcattaaggaaactctggaaatggacaaatttatcagcgacaatcgcgccatcatggataagttcgaccccgaacacaaagtgtcgatcatggtggatgagtggggcacctggtatgcacccaccgaagggaccaatcccggttttctgcaacagcaaaactcacaacgcgatgctgtgttggcggctttgaatttcaacatctttattcgtcatgccgagcgggtgaaaggggctaacattgcccagatgatcaatgtgttgcaagccatgattctgaccgaaggtgagaagatggtgctcacacccacttatcacactttccgcatgtacgtgccttttcaggatgctacgcgtttgccaatcaatttcaataaaggcttttataaagaaggaaccattgaattgccgcgtgtggatgccattgctgccaaaggaagagatggcaaaatttacgtggccatcaccaatatcgaccccaaaaacaacgcttcgttggatctctcgtttgatgagcaaaccatcaaggatgtgaagggggaaacgctgtatgcttcggccattgatgctgttaacacatttgacaaccctaacaatgttgctcctacatccattaacgcaagtttaacgggcagcaatgtgtcggtaacggtgcagcctcagtcggtcacggtgctcgaaattgtatcggagtgattgcgtttggaggttttggtttatagcatccacctgttctgtg

SEQ ID NO: 269 - protein, 534 aa, Cytophaga xylanolytica
MKKRMSIQKRIAFNGALVLAFMLTMCTPKPPQNEDVVKMSVDVTQSGPEINRHIFGQFAEHLGTGIYGGIWVGPESEIPNTRGIRNDVVKALKAIKVPNVRWPGGCFADQYHWRDGIGAPEERKSRINVSWGGSPEANTFGTHEYFDFISQIGSEAFISANVGSGTVQESADWLEYLTASGSTLALERARNGHPDPYDVAFWGVGNEVWGCGGPFTPQEYITELKKFATFTNNYNANVNTQFVAVGPDSFDEYSFGYPEAIMEAWAKKTWTWDIQGLSLHMYTRGGWPAVIPATGFNESGYAAVIKETLEMDKFISDNRAIMDKFDPEHKVSIMVDEWGTWYAPTEGTNPGFLQQQNSQRDAVLAALNFNIFIRHAERVKGANIAQMINVLQAMILTEGEKMVLTPTYHTFRMYVPFQDATRLPINFNKGFYKEGTIELPRVDAIAAKGRDGKIYVAITNIDPKNNASLDLSFDEQTIKDVKGETLYASAIDAVNTFDNPNNVAPTSINASLTGSNVSVTVQPQSVTVLEIVSE

SEQ ID NO: 270 - DNA, 1839 bp, Cytophaga xylanolytica
ggtcgttggtgaaatacagcggtttgtgtttggagactcagcatttccccgactcgcccaataaggctaattttccctcggtgattcttaatcccggcgagaaatatacttcgactaccattatgaaatttggggtaaagtaacccaatctttaatcaggaggcaccgctcgttgaataatcaacttgggtgcctcttttgtttggtcattattaacttttgatatactgatgaatatgaaaagaatttctattgcctttttgccgacgcttgccttattgcctttgtcggcgcaaaccaaaattactttgcaggccgatcaggccaaggagcgcattaatcctgaaatttatggtcattttgccgagcaccttgggcgattgatttatggtggaattctggtcgagccgggttctcaaattgacaatattcggggcttccgtaccgatgtgattggagccctccgcgacatgaaagtgcccattttgcgttggcccggcggttgttttgccgatacttacaactggcgcgatggcattggtcccaagcaaaatcgtccctctattgtgaatatccactggggtggggtcaccgaagataacagttttggaacgcatgagtttttcgatttttgtgaactgattggtgccgaaccatacgtgaatctgaacgtaggctcaggaactgtgcgcgaagctgctcagtgggtggagtacattacttctaacaaccccagcccgatgaccaatttgcgcaaagaaaacggtcgtgataaaccctgggatatcaagtatttttgcattggtaatgaaaactggggatgtggtggacacatgacgcctgagtattatgccgatttgtatcgtaattatgcaacctattgtggtggtgtgaaatataaaatcgccggcggtcccaatgtggatgattatcgttggacggaagtgttgatgaataaaacgcagcatcacaagttcctcatgcagggattgtcacttcattattatacgttccccggtcgttgggaagataagggttcttctattgtttttgatgaacagtcgtggcatcaaaccttgcgtcataccttgcgcatgcaggaactcatcagcaagcatggcgaaattatggacaaatatgaccccaaaaagcaaatcggcttgattgttgacgaatggggaacctggtacgatgtgatgcccggtacgaaccccggctttttgtatcagcaaaatacgttacgtgatgctctggtggcggggatcaatcttaatatcttcaacaacaacgctgatcgggtgaaaatggctaatattgcccaaatggtcaatgtgttacaggctgtaattctcactcagggcgatgaaatgattctgacgcccacttactatgtctttaaaatgtacaatgtgcaccatggtgctacgttgattcccatgaacattcagacgcaagattatgtgatgggagatcaaaaaattccgatggtcaatgcctctgcctccatcaaggataaaacggtgagtgtaaccttgtgcaaccttcacgcatcccaatcaaccaaagttgaaattgatgtgactggttttgaaggcaaaacggctaccggtcaaatcatcaccggcgaaaaaattaccgattacaacgattttggtaagcctgaaatggttggtctcaaggcttttaatgtggccaagcctaaaggcaataaactgactgttgaaatccccgcgaagtcagttgtgttagtgcaaatgaagtaatttcaatttcttttcccttataaagccgttgccctatagcagcggctttttttgtgttcggtgggagcgatttgtc

SEQ ID NO: 271 - protein, 510 aa, Cytophaga xylanolytica
MNMKRISIAFLPTLALLPLSAQTKITLQADQAKERINPEIYGHFAEHLGRLIYGGILVEPGSQIDNIRGFRTDVIGALRDMKVPILRWPGGCFADTYNWRDGIGPKQNRPSIVNIHWGGVTEDNSFGTHEFFDFCELIGAEPYVNLNVGSGTVREAAQWVEYITSNNPSPMTNLRKENGRDKPWDIKYFCIGNENWGCGGHMTPEYYADLYRNYATYCGGVKYKIAGGPNVDDYRWTEVLMNKTQHHKFLMQGLSLHYYTFPGRWEDKGSSIVFDEQSWHQTLRHTLRMQELISKHGEIMDKYDPKKQIGLIVDEWGTWYDVMPGTNPGFLYQQNTLRDALVAGINLNIFNNNADRVKMANIAQMVNVLQAVILTQGDEMILTPTYYVFKMYNVHHGATLIPMNIQTQDYVMGDQKIPMVNASASIKDKTVSVTLCNLHASQSTKVEIDVTGFEGKTATGQIITGEKITDYNDFGKPEMVGLKAFNVAKPKGNKLTVEIPAKSVVLVQMK

SEQ ID NO: 272 - DNA, 2331 bp, Clostridium stercorarium
aagcttttctttaatgacataatgtatttaagcccggaagaaactgccggttttgtttcatttcatccgcgctttatatgtcttttcggtttaatgtattaccgaacaactgccgttttgttaaaacgcccccaagaatctgacggtatgctcaaatatgctcaacaagttatattattgacatttctcagtttctaatgctatcatacacatagttaaatataaattattttatatttttctgaaaatatttttctaatttattcctgatttttattccgtcctttgtatttttcccgataaaccgggattattataaattattcaaggaggcttaggattatggccaaatacgtaatcaacaccctgaacaggaagagcaaaattaacagggaaatctacggtcacttctcggaacaccttggcaggtgcatatacggcggtttttatgttggtgaaaattcccccattccgaacaccaaaggcatcagaaatgacgtggttaacgctctgaaaaagataagaattccggtacttcgctggccgggcggttgttttgccgatgaataccactggatggacggaattggcccgaaagaacagaggaaaaaaatgatcaatacccactggggcggagttgtcgaagcaagttttgggaccgacgagttcatggaactttgccgccagctggaatgcgagccttatattaacggcaatctgggaagcggtactgtaaaggaaatgcaggactggattgagtatctgacatttgacggcatatccccaatgtctgaattaagggcaaaaaacggaagaaaagaaccttacaggttgaaatatttctgcataggcaacgaaaactggggctgcggcggaaacatgagacctgagttctatgccgacatgtacagaagataccagacttacgtaagaaactacgggaataacaagatatacaaaatcgcctgcgggccgaacagcgatgattacaactggacagaaacggttgttaaaattgcgggcagattcatggacgccatctcgctgcattattacacagtgccgggaacctggcattcgaagggcagttccacgaaattcaccgaagaagaatggtatataaccctgtttaaaactctcaaaatggatgagctgatcactaaacataccgcgataataagaagatacgaccccgacaaccgcatagggctggttgtggatgaatggggtacatggtatgacgttgagcccggaacaaatcccggattcctgtaccagcaaaatacaatgagagacgcgcttgttgcggggattaaccttaacatctttaacaaacacagcgacaaagttgtaatggcaaacctcgctcaaaccattaacgttcttcaggcagtgatccttaccgaaggcgaaaaaatgctcctcacacccacataccatgtgtttgacatgtataaggagcaccagggcgcggaactggttgaaaagcttttattgaaaacggaaaaaaagtcggcacagacaaaatataccgttccgaacctgcatgaatccgcttcggtgaatgccgacggaaaactgcacattactctgtgcaacctgtccctcagcgaaagctacagagtagaaaccgaaatcataggaaagaaagcggaaaacgttaccggacgcattttgacaggaaagatgaacgatcataataccttcgacgcacctgaaacagttaagccccagacatttgacaaaatatccgttagacagaacggccttgttattgaaataccacccgtcagcgtagtcagcattacggttgactgatttattgcaggagcgacatatggaacaaccgtgcagaacatgcctttttaacagtattgaaagagatcagatcgaaaaaaacataaaggaatatattgaaagtctttcaccggatgaaaaagccggtgaaagcatttataacaaccgtcttaggctgtgttttgaatgcccgaactgttttgacgggctgtgcagaatatgcggttgcttcgtccgggcaagagcggccaagctgagatcatactgtcccgaccctgcaaaaaaggtggtagcccgtttacctgataaaatcggttcttatgggcttttctccttttgggaagactattcccttttcccttcccgcttctatgcatttcagaagccatgccatgttattgccaagtgtccgcattgtctgcatgccttcctcatctttcataacttcttcaggggtgctgccgtgtacctgattccagtactgggatgaaaccaccggcattccgctgattgtgaaatatttgtttatctgat

SEQ ID NO: 273 - protein, 491 aa, Clostridium stercorarium
MAKYVINTLNRKSKINREIYGHFSEHLGRCIYGGFYVGENSPIPNTKGIRNDVVNALKKIRIPVLRWPGGCFADEYHWMDGIGPKEQRKKMINTHWGGVVEASFGTDEFMELCRQLECEPYINGNLGSGTVKEMQDWIEYLTFDGISPMSELRAKNGRKEPYRLKYFCIGNENWGCGGNMRPEFYADMYRRYQTYVRNYGNNKIYKIACGPNSDDYNWTETVVKIAGRFMDAISLHYYTVPGTWHSKGSSTKFTEEEWYITLFKTLKMDELITKHTAIIRRYDPDNRIGLVVDEWGTWYDVEPGTNPGFLYQQNTMRDALVAGINLNIFNKHSDKVVMANLAQTINVLQAVILTEGEKMLLTPTYHVFDMYKEHQGAELVEKLLLKTEKKSAQTKYTVPNLHESASVNADGKLHITLCNLSLSESYRVETEIIGKKAENVTGRILTGKMNDHNTFDAPETVKPQTFDKISVRQNGLVIEIPPVSVVSITVD

SEQ ID NO: 274 - DNA, 4690 bp, Aspergillus niger
  misc_feature (711)..(711): n is a, c, g, or t
  misc_feature (1494)..(1494): n is a, c, g, or t
  misc_feature (3788)..(3788): n is a, c, g, or t
  misc_feature (4229)..(4229): n is a, c, g, or t
  misc_feature (4337)..(4337): n is a, c, g, or t
tggctcggccctcaagtcgaggttatacgatgtgcaactcatatgatcgagagggaaatcattctgtgaacgataatccagtcattgctgcttggccagagaccaaagctattcacccacacctctattctaccctatgtggctgagcttggaacctggacattctcactcctcgcgtcgactggtctcccagcttccgggtctgatcaccatttccgacgcccggcggccaacgtacctgagccggcggctttttaaaagaagctaatgatggggttcaggttcccaagtgtgctctgcatggtcgaggacatcgtgcaaggtactcctacaaagttagtattttctggtgccaccggaaagataccaaatcttggcagtctcgagtgatctcttctggaaaggttactttgggctgtttaaaatattggccaatggtaacgtctacatggcgggctgtgccctgaatagtgggaaattccagagtcacagggagccaaacactgattgatgggcatacgtatgcattccacttcctgtatgccgtcttaatgaccgaatcaaccaggttctggaccaaaatgacaggcgaaagttgaatggtctcatggttccctgtgttaatgcctatgacaagcctgtagggcatgtttcaatgataacctcgttgtaggtaacaatcccaacaaatcttgagaggaagagtctganacaagattgtgatcaacacagttacgtagcagtattatcttcgtcaccgcagggctgagtagggttgattggaattcatctgccacccgcggcctagaccaggtactcttgacctgaggtttacgggttccttgagaaatcgctgaagagggggggccccagcagaccccgaccatggagtgtgtgtggtatgacgactctctctactgaatgtgaaatgctcaaaccggctctcgctaggctcacaagtggacaggggtcttgtacctggcgccttaacatgatactgagctgacgaagcctcgacttggcactaaccagccatgagttgggcttggcgcacgagttcgcgcaggagccgaaagcttggcctttgcgaactgcttgcttgggagcagagtagatcatttcgcctcagttgtagacaatatggctggtatatgtatcgaacctagttggaccttctgtcggctgccaaggtgcccgactgcttaagcggagatatgctgactccacccggataaggttattaccgccggacctcttggcgcaggccctgaktagatgcagattagatgcatcccatgccattgtccctgctattcgtctccgggtttcaggtgccgtttggccaaattctggcagcatgtaagcagcaatggcagacaatagacgttgtcagtcacgtctcgctctgctgcaagctcagaatatgtcttcatccgatccgagcgctttcaggcgctttcatcaaactggcccatgatttgagagccagctgtnacagtgatctactgatgtcacctaaacccatcatctggatggttctgctccgggccgcgcaatcgggtgacgagtgttacgatctgagttaatttctgctgcagaatgttaagcccggtggacccagccgatgaatagcctactcacttcactcgggccccaggcgacaggtattacggtacgtcctggtggttggtgagcctgtggcagtatataagaggtacaatagttttcctattgctcctttcagctccgacgtgatgatacgtttttacattctgtatcctttcaacactaattcacctctacacttcttagtgttcgaaacatgcgccaacactcgcgcagtgttcgctgctctggcagcagcactgccaacgcggcctctctctccgatgtctgcactgtctccaacgttcagtctgcccttccttccaatggcactcttctcggcattgacttgatcccctccgctgtcactgccaatactgtcaccgacgccaccgccggcatgggcagcaccaccacctacgactactgcaacgtcaccgtcacctacacccacaccggcaagggtgaccaggtcgtcgtcaagtacgccttccccgctccctccgacttcgagaaccgcttctacgtcgccggtggtggtggcttctccctctccagcgatgccaccggtggtctcgagtacggtgccgcctccggtgccaccgacgccggctacgacgccttctcctacagctacgatgaagtcgtcctctacggcaacggcttcatcaactgggatgccactaacatgttcggctaccaggctctcggtgagatgaccaagatcggcaagcccctcacccagggcttctacggtctctccagcgaccagaagatctacacctactacgaaggttgctccgacggtggtcgtgaaggtatgagccaggttcaccgctggggagatgaatacgacggggtcattgccggtgcccggccttccgctctcgcccagcagcaggggggaccacggcttcccggcaccatcggacacaccatggactactaccctcccccttgtgaactcgagaagatcgtcaccgagaccatctccgcctgcgaccctcttgacggccgtaccgacggcgttgtctcccgtaccgatctctgcatgctgaacttcaacctcacctccctcatcggcaccccctactactgcgccgcccagaactacacctccctgggcttcggcttaagaaagcgcaaagccaaaggcagcaccaccagctaccagcccgcccagaatggcaccatcacccgccgagstgtcgctttggcccaggccktgtacgatggtytgcacgactccgagggmaagcgcgcctacctgtcatggcagatcgccgcggagcttttcgatgctgacaccacctatgactcgaccaccgactcctggaccctcgatatcccctctaccggtggcgaatatgtgaccaagttcgtccagctcctcaacatcgacaacctcgagaacctcgacaacgtcacctacgacaccctcgttgactggatgaacaccggcatgatccgctacatcgacagtctgcagaccaccgtggtcgatttgaccgacttccagaagtctggcggcaagatgattcactaccacggcgaatccgaccccagtatccccaccgcgtcctcggtgcactactggcaggccgtccgtcaggccatgtaccccaacgtgacctacaccgactccctgaagcggatggccgactggtaccagctgtacctgatccccggcgctgcccactgcggaaccaactccctccagcccggcccttaccccgaggacaatatggagatcatgatcaactgggtggagaacggtgtcaagccttcccgtctcaacgccaccgtctcttccggtacttatgagggtgagacgcagatgctgtgccagtgccctctcgtccccctctggaccagcgcctcaacgccaccgtctcctccggtacctatgctggtgagacccagatgctctgccagtggccttcccgtcccctctggaccagcaactccagcttctcttgtgtccatgactccaagtctcttgctacttgggactacacttttgacgctttcaagatgcccgttttttaaataggttgattgagagagttttgggattttggcaggttctttgataggatctgtatccgtttgtatgtagtatcttcgcttcgatagtcgtgtacttcttccactttgtgtcttcctttaatttttatacgtgngaagaaggctttgacccgcttacttagtcaacaatattacttgactgtgtatacctctcactccattataaaatgaacatgttttattgcatctcaatacatgggaaattcctgcacaagccactctagcatatgcctctccgctgtcggcacaaagacgatattcctaaaaacaccaaacaatttcgacattcttcagtgataaggaggacaaataatgtatcgtccacatctacccccaccaaccgacaacagcaaatctcagcagcgtgaccaacgataatacctctagccctcgcaatccttcttcttgttcttcatagccctcctcgcacgtatttcaaaccatatctgtgataatcggatgttctgctaacgcattagcacggtataataacgaagcaaaaggaagagaacagaaaaaaagagcaattgtagatnggggcaatgaagtagagttccaagataaccagtaactaacctgatcagaaaccttccacaaggcataggtcaaaaaaagcgatgcagcaccaaaaacgatataccagngccagtcagggttgttttgcagcgcgtttacgttcatgccgaataggctctgttgctatcagccgggcaaaaaaggaaggaaagagcatatacttaggagcagaaatagtgggtacttaccgatgcaaacatcaatggtaagaaaataaactatttctgtcagccaccaaagcaaacgcaaaataaacgattggagacgaggcgctactcacagtaatgagactgatgcgtctcatgaaaactgtttcttcaacgaaacctagcaaaatactgtcaggtccattcaagtatttaaaatctaattttattaagatcaccttgctttatccatcgatattgatatttttaaaaaa

SEQ ID NO: 275 - protein, 611 aa, Aspergillus niger
  misc_feature (330)..(330): Xaa can be any naturally occurring amino acid
  misc_feature (337)..(337): Xaa can be any naturally occurring amino acid
MRQHSRSVRCSGSSTANAASLSDVCTVSNVQSALPSNGTLLGIDLIPSAVTANTVTDATAGMGSTTTYDYCNVTVTYTHTGKGDQVVVKYAFPAPSDFENRFYVAGGGGFSLSSDATGGLEYGAASGATDAGYDAFSYSYDEVVLYGNGFINWDATNMFGYQALGEMTKIGKPLTQGFYGLSSDQKIYTYYEGCSDGGREGMSQVHRWGDEYDGVIAGARPSALAQQQGGPRLPGTIGHTMDYYPPPCELEKIVTETISACDPLDGRTDGVVSRTDLCMLNFNLTSLIGTPYYCAAQNYTSLGFGLRKRKAKGSTTSYQPAQNGTITRRXVALAQAXYDGLHDSEGKRAYLSWQIAAELFDADTTYDSTTDSWTLDIPSTGGEYVTKFVQLLNIDNLENLDNVTYDTLVDWMNTGMIRYIDSLQTTVVDLTDFQKSGGKMIHYHGESDPSIPTASSVHYWQAVRQAMYPNVTYTDSLKRMADWYQLYLIPGAAHCGTNSLQPGPYPEDNMEIMINWVENGVKPSRLNATVSSGTYEGETQMLCQCPLVPLWTSASTPPSPPVPMLVRPRCSASGLPVPSGPATPASLVSMTPSLLLLGTTLLTLSRCPFFK

SEQ ID NO: 276 - DNA, 1767 bp, Neosartorya fischeri
atgcgtacctcccacggctcagctgttgctgctctggcagtggcagccaatgctgcatctctcgctgacgtctgcaccgtctcccacgtgcagtccgtgcttccttcaaacggaactcttctcggtatcaacctgattccttccgcagtgactgcaagcgcagtctacaacagtacctccagcggcggcatgggcggcatgggcggctccagcagtgccaactacccctactgcaatgtgacagtcacctacactcaccccggtaagggcgacaaggtggtagtcaagtatgccttcccccagccttccgacttcaagaaccggttctacgttgccggtggtggtggctactccctctccagcgatgccactggcggcctagagtacggtgcagcgtctggtgccaccgatgcgggttacgatgccttcagctacagctacgacgaggtggttctttacggcaacggatcgatcaactgggacgccacgtacatgttcgcctaccaggccctgggcgagatgaccactctcgggaagacattgaccaggaacttctacggtctgtccagcgatgccaaagtctacacctactacgaaggatgctccgacggtggacgtgaaggcatgagccaggttcagcgctacggcgatctgtacgacggtgccatcactggtgccccggctttccgctacgcccagcagcaggtcaaccacgtcttttcgtcggttgttgagaagactctcgactactaccctcccccttgcgaactggccaagatcgtcaacgccaccatcgaggcctgcgatcctctcgacggccgcactgacggggtggtctcccgcaccgacctctgcaagctgcactttgacctttcgaagatcatcggtgagccgtactactgcgccgcagagacaagcacctcgctcggcttcggcttcagtaaacgccaggcacccggcagcacgaccagctaccagcctgcacagaacggcaccgtcaccaaggagggcgtggctgtcgccaaggccatttacgacggtctgcacaacacccagggccagcgcgcctacctctcctggcagatcgcctcggaattctccgatgccaccaccgagtggaacaatgacaccagctcctgggagcttagcatcccgtccaccggcggcgaattcgtgaccaagttcgtgcagctcctggatctcgataacctgtccaccctcgacaacgtcacctacgacaccctcgtcgaatggatgaacaccgccatggtgcgctacatggacagcctgcagaccaccgtcccggatcttacgaccttcaaatcctccggcggcaagctactgcattaccacggtgaatccgaccctagtatccccgccgcgtcgtcggtgcactactggcagtctgtgcgctcgatcatgtaccccggtgtgtcggcctcgaagagtctaaaggagcttcaggagtggtaccagttctatcttatccccggtgcggcgcactgcggtgccaactccctgcagcctggtccgtacccgcagaacaatatggacatcatgatcgactgggtggagaacggcgtgcagccgacccgactgaacaccacggtgtcctctggcgactacgccggcgagacccagatgctctgccagtggcctacccgtcctctgtggaaggacaactcgacctttgactgtgtcaacgacgagaagtcgatcgagggctggacctatacctttcctgctttcaaggtaccaatctactga

SEQ ID NO: 277 - protein, 588 aa, Neosartorya fischeri
MRTSHGSAVAALAVAANAASLADVCTVSHVQSVLPSNGTLLGINLIPSAVTASAVYNSTSSGGMGGMGGSSSANYPYCNVTVTYTHPGKGDKVVVKYAFPQPSDFKNRFYVAGGGGYSLSSDATGGLEYGAASGATDAGYDAFSYSYDEVVLYGNGSINWDATYMFAYQALGEMTTLGKTLTRNFYGLSSDAKVYTYYEGCSDGGREGMSQVQRYGDLYDGAITGAPAFRYAQQQVNHVFSSVVEKTLDYYPPPCELAKIVNATIEACDPLDGRTDGVVSRTDLCKLHFDLSKIIGEPYYCAAETSTSLGFGFSKRQAPGSTTSYQPAQNGTVTKEGVAVAKAIYDGLHNTQGQRAYLSWQIASEFSDATTEWNNDTSSWELSIPSTGGEFVTKFVQLLDLDNLSTLDNVTYDTLVEWMNTAMVRYMDSLQTTVPDLTTFKSSGGKLLHYHGESDPSIPAASSVHYWQSVRSIMYPGVSASKSLKELQEWYQFYLIPGAAHCGANSLQPGPYPQNNMDIMIDWVENGVQPTRLNTTVSSGDYAGETQMLCQWPTRPLWKDNSTFDCVNDEKSIEGWTYTFPAFKVPIY

SEQ ID NO: 278 - DNA, 1722 bp, Neosartorya fischeri
atgcgtccctctacctggattcccttcaccgtgggcctggccgttgtgacccatgcagcgactccgtcaacactggaggagctctgcactgtttcttatcttcaaaatgtgttgcctccatccaagttcatccagggcatcacaattgactcagactctctcacgaccagcgtggtgaccaagagcactgtcagcagctttgactaccctacggcgatgatcgactattgcaatgtcaccctggcctactcgcacgatggcatcgacggcgaccgagtcctactccaaatatggctaccagctcctaccaacttccaaaaccgatggttgtctaccggagggggtggttatgccatcaattccggagcgcgcatgctccctgagggtatcatctacggtgcggcgtctggactcacggacggtgggtttgggggcttctcggtcaatgccgacagcgctatgttgctggccaacggcacactgaactatgaggcgctgtacatgttcgggtacaaggctcaccgggaacttagcttgattggcaaggccatcacgcggaatgtctacggcatggccgatagtgagaagctctacgcctactaccatggatgctccgagggtggccgtgagggctggagccaagtgcagcgctatggagatgaatgggatggggccattattggggctccagcgtttcgttggtcgttccagcagacccagcacctcttctcgaatattgttgaaaagactctcgactactatcccccgccctgcgagctggagaggattgtgaatgagactatcgtcgcatgtgatcccctggatggcaggactgacggtgtagtggctagaaccgatctttgcttgctgcgttttgatccgaaagttatcgtgggcaagaagtactcctgcaccgcgtctgccaccgcgccggcccagagtggcactgtttcagccaaggcagtcgaggtcgccaaaaccatcattaacggactgcatgatacccagggccgtcgtgtgtacttctcctaccagcccagcgccgcatttgacgatgctcagacgcagtacaacaccaccactggcaagtgggagctgtctatcaaccaactcgggggcgaacacattgcactgctggtgaacaagaacggcacaactctggacagtctggacgggatcacctacgacacgttgaaagactggatgatttcgggcatgcaggagtactacagcaccctgcaaactacctggcctgatctaacaccattccaccacgctggcggcaaagtgatacactaccatggcgacgctgacttcagcattcccactgcttcgtcgatccgctactgggagtcggtccggagtaccatgtacggcaacctgtcgtacaaagctggtgctaacgctctgaatgaatggtaccgcttgtacactgtgccaggtgccggccactgctcgaccaacgatgccatgcccaatggtccgtggcctcagaccaacctcgctaccatgattgaatgggtcgaaaagggagtgacaccggtcaccctgaatgcaacagtgctccagggggagtatgaaggcgagaaccagcagctctgcgcgtggccattgcgccctctctggaagaacaacggaaagaccctagactgtgtctatgaccaggcgtccatcgacagctggcactatgatttggatgcagttcctatgcctgtatattag

SEQ ID NO: 279 - protein, 573 aa, Neosartorya fischeri
MRPSTWIPFTVGLAVVTHAATPSTLEELCTVSYLQNVLPPSKFIQGITIDSDSLTTSVVTKSTVSSFDYPTAMIDYCNVTLAYSHDGIDGDRVLLQIWLPAPTNFQNRWLSTGGGGYAINSGARMLPEGIIYGAASGLTDGGFGGFSVNADSAMLLANGTLNYEALYMFGYKAHRELSLIGKAITRNVYGMADSEKLYAYYHGCSEGGREGWSQVQRYGDEWDGAIIGAPAFRWSFQQTQHLFSNIVEKTLDYYPPPCELERIVNETIVACDPLDGRTDGVVARTDLCLLRFDPKVIVGKKYSCTASATAPAQSGTVSAKAVEVAKTIINGLHDTQGRRVYFSYQPSAAFDDAQTQYNTTTGKWELSINQLGGEHIALLVNKNGTTLDSLDGITYDTLKDWMISGMQEYYSTLQTTWPDLTPFHHAGGKVIHYHGDADFSIPTASSIRYWESVRSTMYGNLSYKAGANALNEWYRLYTVPGAGHCSTNDAMPNGPWPQTNLATMIEWVEKGVTPVTLNATVLQGEYEGENQQLCAWPLRPLWKNNGKTLDCVYDQASIDSWHYDLDAVPMPVY

SEQ ID NO: 280 - DNA, 1578 bp, Neosartorya fischeri
atgatgcggtggtttcttctgatcgggctggcctcagccgctgcaactgacagctctgccagcttcgagtctcgttgtcaacattttcacaaggaaatccaccttcaaaatgtgcatgtgcattctaccacttatgttcccatcggatccaatatctccatggcctataacccgcctatatgcggtgggacctctagctcatcgatcagcacgattgaattttgccaggttgcactgaacgtgaccacttcggacaagagccagttcttcatggaggcatggctacccagcaattacactggaaggttcttgagcacagggaatggagggttgaatggctgcgtgggttacggggacatgatttatgctagtcagtacgggttcgcaacgattgggaccaataacggccactttggcgacactggccaatactttctgaacaaccccgaagtcattgaggactttgcctaccgagccctgcacacagggacagtggtggggaaggcactgacgaagctattctatcctcaaggatacaagaattcatactatctgggctgctcgacaggtggccggcaagggtggaagtccatccagagattcccagacgactttgacggcgtggtggctggagcaccggccttcaactttgtcaatctatgcaactggggatctcgattcctgaaaatcaccgggccgcctgattcagatacatttgtgacaagcgcacagtggtccataatccacaatgagattatccgacaatgcgatgcactcgatggcgccgtcgatggtaccatcgaggataccgatctctgccagcccatcttcgaaaccctcatttgcaattccacggctgtgaacaagacctcttgcctgacgggtgtgcaggccaacaccgttaacgaggttttctccgccatgtatggcttagacggtaaatggctataccctcgcatgcagcccggctctgagctcgccgcgtctttcatctactacagcggaaacgggttcaagtattcagacgactggttcaaatacgtcgtctacaacgatagcaactgggaccactctacctggacgcttgccgacgcagcggcagccgatgcacaagatcccttccagatctccaccttcgacggagatatctccggtttccaaaaggctggcggcaaggttctgcactatcacggtctggaagatgcgatcatcacctcggatagctccaaggcgtactacaagcatgttgctgataccatggggctgagtccctcggatctggaccagttctatcgcttcttccccatcagtggaatgggacattgttcgccggggactggtgctgcttccatcggccagggatcttccacatatgccggcgatgacccgcaggacaacgtattgatggccatggtgcagtgggtggaaaagggtattgcgcctgaatatgtgcgtggctccaagaagtccattgatggtcagacagagtaccgccgcaagcactgcaagtatcccaagcggaatcgatacgtggggcctggcaagtacactgatgagaatgcttggaagtgcgtgtga

SEQ ID NO: 281 - protein, 525 aa, Neosartorya fischeri
MMRWFLLIGLASAAATDSSASFESRCQHFHKEIHLQNVHVHSTTYVPIGSNISMAYNPPICGGTSSSSISTIEFCQVALNVTTSDKSQFFMEAWLPSNYTGRFLSTGNGGLNGCVGYGDMIYASQYGFATIGTNNGHFGDTGQYFLNNPEVIEDFAYRALHTGTVVGKALTKLFYPQGYKNSYYLGCSTGGRQGWKSIQRFPDDFDGVVAGAPAFNFVNLCNWGSRFLKITGPPDSDTFVTSAQWSIIHNEIIRQCDALDGAVDGTIEDTDLCQPIFETLICNSTAVNKTSCLTGVQANTVNEVFSAMYGLDGKWLYPRMQPGSELAASFIYYSGNGFKYSDDWFKYVVYNDSNWDHSTWTLADAAAADAQDPFQISTFDGDISGFQKAGGKVLHYHGLEDAIITSDSSKAYYKHVADTMGLSPSDLDQFYRFFPISGMGHCSPGTGAASIGQGSSTYAGDDPQDNVLMAMVQWVEKGIAPEYVRGSKKSIDGQTEYRRKHCKYPKRNRYVGPGKYTDENAWKCV

SEQ ID NO: 282 - DNA, 1900 bp, Talaromyces stipitatus
gcttttttcttggctttttcttccactatgcttcatcgcgtgggagaagcaaaacgaatccgtgaacatccgagatgatgttgacaagtgcaatcctcctcctgactctcggggtccagctgagtcacgcagatgattcgtcccgcgagaacttctcaaatcgatgcgaccagctggctaaggagatccatattcccaacgtaactgtaaactttgtggaatatgttgccaatggcaccaacgtcacacttgctgacaatccgccttcatgcgggcagtccaatcaagtggtcctggcggatttgtgtcgagtggctatggaggttacaacctccaaccagagtcagatcaccttggaggcatggtttccggaaaactacactggaaggtttctgagtaccggtaatggtggtctcgcagggtgtcagttccttccctcccctatcttggtggtgtgcattgcggtgaaacaaattaacaccatcacccggagattaggtatccagtatgtagacatggcatatgcgtcgtcaatgggatttgcgacagtaggcgcaaatgggggccacaatggcacctccggagaatccttctaccacaacccggacatcgtagaggatctctcttggcgatcagtgcataccggtgtcgtcgtgggcaaagaattgaccaaaaaattctaccacgaaggattccacaaatcatactatctcggctgctctacaggcggacgacaagggttcaaggcagtccaagaatttgtgcatgactttgacggcgtggtcgcagggtgtccggcgttcaactttgtaaatctcaacagctggagtggacatttctaccctatcacaggcaactcatccgcagacacgttcctgacaaccgcacagtggacactagtacaacaatcggttatggagcaatgtgattctctcgatggcgcggttgacggcgtaattgaagctatcgatcaatgccacccggtctttgagcaactcatctgcagaccgggacaaaatgcttcggaatgtctgacaggaaagcaagtcaataccgcccaactcgtcctttccccaatctacggaacaaaaggagaattcctctatccgcgcatgcagcccggagtagaaaatgtcgacatgtacataacctacaacggtgacccattcgcctacagcaccgactggtacaaatacgtcgttttcagcgatccaaattgggatcccgcaaccttgaacgcgcaggattacgagattgcgcttgctcaaaacccgtccaatatccagacatttgagggtgatttatccgctttccgcgatgcaggagctaaagtcttgacctatcacggcactgcagacccgattatcacgggggagacgtcaaaggtatactaccgtcacgtcgctgagaccatgaacgcagctccagaggaattagatgagttttatcgctatttccggattggaggtatgagccactgcggtggaggcacgggagccacggcgattggtaatgtgctcagtgcgcaatggagcaatgatcctgacgctaatgtgttgatggcgatggtacgctgggttgaggaaggggttgctccggagtatattcgtggtgcttcgcttggtagtgggccgggagcaaaggttgagtatactcggcggcattgcaagtatccgacgaggaatgtttatgttgggcctggaaattggacggacgagaatgcgtggaaatgtattttgtagtagcttcatcaagcttgcagcggattcttcgagagcagggggctggagcatgaaaaggtgtatactagcttgagccaggcactaattgattctaccgtcaagggggggagatgcgggaaagttatacggacgtttaagggctgcgagacattcctgaa

SEQ ID NO: 283 - protein, 530 aa, Talaromyces stipitatus
MMLTSAILLLTLGVQLSHADDSSRENFSNRCDQLAKEIHIPNVTVNFVEYVANGTNVTLADNPPSCGQSNQVVLADLCRVAMEVTTSNQSQITLEAWFPENYTGRFLSTGNGGLAGCIQYVDMAYASSMGFATVGANGGHNGTSGESFYHNPDIVEDLSWRSVHTGVVVGKELTKKFYHEGFHKSYYLGCSTGGRQGFKAVQEFVHDFDGVVAGCPAFNFVNLNSWSGHFYPITGNSSADTFLTTAQWTLVQQSVMEQCDSLDGAVDGVIEAIDQCHPVFEQLICRPGQNASECLTGKQVNTAQLVLSPIYGTKGEFLYPRMQPGVENVDMYITYNGDPFAYSTDWYKYVVFSDPNWDPATLNAQDYEIALAQNPSNIQTFEGDLSAFRDAGAKVLTYHGTADPIITGETSKVYYRHVAETMNAAPEELDEFYRYFRIGGMSHCGGGTGATAIGNVLSAQWSNDPDANVLMAMVRWVEEGVAPEYIRGASLGSGPGAKVEYTRRHCKYPTRNVYVGPGNWTDENAWKCIL

SEQ ID NO: 284 - DNA, 3000 bp, Aspergillus niger
cccggtcagtgcttgattacagtggagactcaagggttcactgcggagtaacaactaccgaccgggggaatttccctcccccttgttcagctccagcatggtgttcgtaggcctttccatatcccacaatgggcattcactgatggcaaatctactggaacaaaaggttacgcgagtatgaaggaatctatagctcaaggaggggctcacgaagtaaaacgggccacgtacgtcgggagcaggggcatggccgtccggccgtccacaacgtgcgggtgcacctgaggaataagctgcccgacgataaagcttatacacgggattccgtatcaaccgacagcttcctgccgtccatacaatcctccgatgtatgcatcaggtatgatacagggctagaaggataccgaggctccgtggcccggcccgcttctcacctgccgtgatcttctgccggtctaacgaaattttcttttcctgagccactccggggttctcactggcttttccggggtagccactgtcaactgcatttacatttccgcttcagtcgttccccagatcagtgcatgtggagccacaattctgggttgcagtcgaatcaccgacgttcaagaaaggcaataaccccgtcagatcgtttcaaaatgcgggggaaggggagcagacgatgagtacagtttctccggtgatgatgtcgaagctggtcactagttcatcgtatcctgcggagttacttgtaactcgcaaaactatgagaccaacctgttgatcaatgcctataagaagggggacctgctgggacttcttctttcgcgttttgcacaggagcgtcccctctcccttcccattgtgtgtcgttcccactctgagcttgcaaaatgaaagtagcaagtctcctctccctggcactgcctggggcagccctcgctgcgaccgaccccttccagtcgcggtgcaatgaattccagaacaagatcgacatcgccaatgtcaccgtcagatcggtcgcatacgttgctgctggacagaacatctcccaagcggaggtcgcctccgtgtgtaaagcatcggttcaagccagtgtcgacctgtgccgggtaaccatgaacatctcgacgtcggatcgcagccatctgtgggctgaggcctggctcccaagaaattataccggtcgcttcgtgagcacggggaatggaggtctagccggctgtaagtgtcgcacccttttctaggccgtcgtgtccggtatatctttcacttcttcagaatttgctgattccgagttaggtgtccaagaaacggacctcaactttgcagccaactttggtttcgctaccgtgggcaccaacggtggacatgacggggacacggccaaatacttcctcaacaactcggaggttctggccgattttgcctatcgctcagtgcacgaagggaccgtggtgggtaagcaactaactcaattgttttatgacgagggatacaactactcctactatttgggttgctccaccggaggccgccaaggctaccagcaagtccaacggtttcccgacgactatgacggagtgattgcgggctccgcagcgatgaactttatcaacctgatctcctggggggccttcttgtggaaggcgacggggttagcggatgatccagactttatctctgcaaacctgtggtccgtaatccaccaggagattgttcgtcagtgcgacctggtcgatggggctctggatggaatcatcgaagaccctgatttctgtgctccagtcatcgagcgcttgatctgcgacgggactaccaacggcacctcttgtatcacgggagcccaggcagcaaaggtcaaccgggccttgagtgacttctatggccccgacgggacagtgtactacccgcgcctgaactatgggggtgaggccgactcggcttccctgtacttcacggggtcgatgtacagccgtacggaggaatggtacaaatatgtggtctataacgacaccaactggaactccagccagtggacgctggagagtgccaagctggccctggagcagaatccgttcaatatccaggcgtttgatcccaacatcacggccttccgggaccggggtggcaagctgctgtcctaccacggcacgcaggatcccattatcagctccacggatagcaagctctactaccgacgggtagcgaatgccctgaatgccgcgccgtccgagctagatgagttctatcggttcttccagatctccggcatgggccactgtggcgatggcacgggagcatcgtacatcggccagggatatggcacgtacacctccaaggcgccccaagtcaacctgctgcgcacgatggtggactgggtggaaaacggaaaggcgcccgagtatatgccgggcaacaagctcaacgcgaacgggtcaattgagtacatgcgcaagcactgccggtatccgaagcataacattcacacggggccgggtaactacaccgatcctaactcctggacttgcgtatagttagcggagggatctagtctctgtagcaggtagttcggtgttgaaagcttaccaaatgccatgtcaaatatcgcttttagcttctttctatggggtaaagatatgtagagatgcgctggtcttttcctttcctcgaaagttcaccgtgcattccggggaatagcagagagatggctggcgggccccgaagaagtggcagagatatgccaacatgacactggcatcgacacagaagaccaagtccagaaaaggcaggtgcgaccaatgcatgtcgaacggaagccgactgctgttgacgcctgaggccaacaagccatagaatgttgctgcctggatggggaacagagcaccatttgaatcacgtgctgtgggtggggccgtggctctggtcggactcggaccgaatcccgctgattcagcaagccaagaccgccaatcggtaaatcctcccccgcttgaagcttccatgcagaaacac

SEQ ID NO: 285 - protein, 521 aa, Aspergillus niger
MKVASLLSLALPGAALAATDPFQSRCNEFQNKIDIANVTVRSVAYVAAGQNISQAEVASVCKASVQASVDLCRVTMNISTSDRSHLWAEAWLPRNYTGRFVSTGNGGLAGCVQETDLNFAANFGFATVGTNGGHDGDTAKYFLNNSEVLADFAYRSVHEGTVVGKQLTQLFYDEGYNYSYYLGCSTGGRQGYQQVQRFPDDYDGVIAGSAAMNFINLISWGAFLWKATGLADDPDFISANLWSVIHQEIVRQCDLVDGALDGIIEDPDFCAPVIERLICDGTTNGTSCITGAQAAKVNRALSDFYGPDGTVYYPRLNYGGEADSASLYFTGSMYSRTEEWYKYVVYNDTNWNSSQWTLESAKLALEQNPFNIQAFDPNITAFRDRGGKLLSYHGTQDPIISSTDSKLYYRRVANALNAAPSELDEFYRFFQISGMGHCGDGTGASYIGQGYGTYTSKAPQVNLLRTMVDWVENGKAPEYMPGNKLNANGSIEYMRKHCRYPKHNIHTGPGNYTDPNSWTCV

SEQ ID NO: 286 - DNA, 904 bp, Aspergillus awamorii
atgaagcaattctccgcaaaacacgccctcgcagttgtggtgactgcagggcacgccttagcagcctctacgcagggcatctccgaagacctctacacccgtttagtcgaaatggccactatctcccaagctgcctacgccgacctgtgcaacattccgtcgactattatcaagggagagaagatttacaactctcaaactgacatcaacggatggattctccgcgacgacagcagtaaagaaatcatcaccgtcttccgtggcactggcggtgatacgaatctacaactcgatactaactacaccctcacccctttcgacaccctaccccagtgcaacggttgtgaagtacacggtggatattatattggatgggtgtccgtccaggaccaagtcgagtcgcttgtcaaacagcaggttagccagtatccggactatgcgctgactgtgacgggccacaggtatgccctcgtgatctctttcaattcaagtgtataatactcactaactctacgatagtctcggagcgtccctggcagcactcactgccgcccagctgtctgcgacatacgacaacatccgcctgtacaccttcggcgaaccgcgcagcggcaatcaggccttcgcgtcgtacatgaacgatgccttccaagcctcgagcccagatacgacgcagtatttccgggtcactcatgcgaacgacggcatcccaaacttgcccccggtggagcaggggtacgcccatggcggtgtagagtactggagcgttgatccttacagcgcccagaacacatttgtctgcactggggatgaagtgcagtgctgtgaggcccagggcggacagggtgtgaataatgcgcacacgacttattttgggatgacgagcggagcctgtacatggtga

SEQ ID NO: 287 - protein, 281 aa, Aspergillus awamorii
MKQFSAKHALAVVVTAGHALAASTQGISEDLYTRLVEMATISQAAYADLCNIPSTIIKGEKIYNSQTDINGWILRDDSSKEIITVFRGTGGDTNLQLDTNYTLTPFDTLPQCNGCEVHGGYYIGWVSVQDQVESLVKQQVSQYPDYALTVTGHSLGASLAALTAAQLSATYDNIRLYTFGEPRSGNQAFASYMNDAFQASSPDTTQYFRVTHANDGIPNLPPVEQGYAHGGVEYWSVDPYSAQNTFVCTGDEVQCCEAQGGQGVNNAHTTYFGMTSGACTW

SEQ ID NO: 288 - DNA, 1584 bp, Penicillium chrysogenum
atgactcgtcttcatgtgttgcccttgttggcagccatgggctcccttgccctggccagccaagacgcctttcaatcaaaatgtgtcgagtttggtgctcaaatcgacattcccaatgtcaaagtcaactttgccgagtttgtgcagggaggtaccaacttatccttggcggataatccacctagctgcggtaggtcgaatcaggccgtccccgtagacttgtgccgggtcgccatggccgtgtcgacttcgaatagcagcgagatcacgctagaggcttggttccctcgtgagtacaagggccgctttttgagcaccggaaatggtggtatctctgggtgtattcaatactatgatctcgcatacaccgcgcaactagggtttgccactgtcggagccaacaacggacacaacggtacatcgggaaagcctttctaccgccaacctgaggtaatcgaagattatgcataccgttctgttcacactggagtggtcataggcaaagaactcaccaagcaattctatgaggagggcttcgacaagagctactacctcggatgctccactggtggccgccaaggttggaaatctgtccagaaataccccaacgactttgacggggtggtcgctggtgcccctgctatcggcttagtcaatctgttctcgtggagcgcacatttctacccgatcactggctccccgacttccgacacattcctgtccccagccgaatggaagatcgtccacgaagagatcatccgccaatgtgatgctattgatggcgccgaagatggaattatcgaagataccgacctctgccatcctgtcttggaaacgttgacatgtgaccccagtgcctcaagcaaaacaagctgtctcacaagcgcccaagtcaacaccgcccagcaagtactatcgccattttacggaattaatggcaccctgctatacccccgcatgcagcctggatccgagatcctcgctgcaccaataatgtacagtggcgcaccattccaatacagccaagactggtatcgatatgtcgtctacaacaacccggcctggagcggggccaacttcacagtaaaagatgctgctgtggctctccgccagaacccgtacaatatacagacgtgggatggtgatatctcttcgttcaaaaatggtggcggcaaaatcctgcactaccacggcctccaagaccagctgatcagctccgacaactccaagctgtactattcccacgtgtcaaaaacaatgaaactaccccccaataaattggacgagttctaccgcttcttcccgatcagcggtatggcccattgcggtgatggagatggagcctatggtattggccagggcgccagtacctacgctggtaccgaccccgaggacaatgttcttatggcaatggttcggtgggtcgaggagggcaaggcgccggagactgttcgtggtaccaagttctctgatggccctggctctgaggtggagtacaagcgcaggcactgccgctggcctcgacgcaacgtgttcaagggtcctggtaactacactgatgagaacgcttggcagtgtgtttag

SEQ ID NO: 289 - protein, 527 aa, Penicillium chrysogenum
MTRLHVLPLLAAMGSLALASQDAFQSKCVEFGAQIDIPNVKVNFAEFVQGGTNLSLADNPPSCGRSNQAVPVDLCRVAMAVSTSNSSEITLEAWFPREYKGRFLSTGNGGISGCIQYYDLAYTAQLGFATVGANNGHNGTSGKPFYRQPEVIEDYAYRSVHTGVVIGKELTKQFYEEGFDKSYYLGCSTGGRQGWKSVQKYPNDFDGVVAGAPAIGLVNLFSWSAHFYPITGSPTSDTFLSPAEWKIVHEEIIRQCDAIDGAEDGIIEDTDLCHPVLETLTCDPSASSKTSCLTSAQVNTAQQVLSPFYGINGTLLYPRMQPGSEILAAPIMYSGAPFQYSQDWYRYVVYNNPAWSGANFTVKDAAVALRQNPYNIQTWDGDISSFKNGGGKILHYHGLQDQLISSDNSKLYYSHVSKTMKLPPNKLDEFYRFFPISGMAHCGDGDGAYGIGQGASTYAGTDPEDNVLMAMVRWVEEGKAPETVRGTKFSDGPGSEVEYKRRHCRWPRRNVFKGPGNYTDENAWQCV

SEQ ID NO: 290 - DNA, 926 bp, Neurospora crassa
ccttttgaccatgttgcccagaacattgctcgggctcgccctcaccgcggccacaggcctctgtgcctcgctgcagcaggtgacgaactggggcagtaacccaaccaacattcgaatgcacacctacgtccctgacaagctggccacaaagcccgccattattgtggctctccacggctgtggcggcaccgccccttcctggtactcgggcacacgcctaccctcctacgccgaccaatacggcttcatcctcatctatcccggcacgcccaacatgtccaactgctggggagttaacgaccctgcttctctcacgcacggagccggcggcgactccctcggtatcgttgccatggtgaactacaccatcgccaaatacaacgccgacgcttcgcgcgtctatgtcatgggcacctcctcgggcggcatgatgaccaacgtaatggccgccacttatccggaggtctttgaggccggggctgcgtactcgggcgttgcgcacgcttgtttcgccggtgctgcgtcggctactcccttttcgcccaaccagacctgcgccaggggactgcagcacactccggaggaatggggcaactttgtgaggaattcttacccggggtacacgggacgtagaccaaggatgcagatctgccatggcctcgccgacaatctggtatatccaaggtgtgcgatggaggccctgaagcagtggtcgaacgtgctgggggtagaattttcgaggaatgtcagcggagtgccgagccaggcgtatacgcagattgtgtatggagatggcagcaagctggttgggtatatgggtgcaggcgtggggcatgtggcaccgacgaatgagcaggtaatgttgaagttctttgggttgatcaactagatgtcgagcaaaaggttagttgatggcttgatgaagg

SEQ ID NO: 291 - protein, 292 aa, Neurospora crassa
MLPRTLLGLALTAATGLCASLQQVTNWGSNPTNIRMHTYVPDKLATKPAIIVALHGCGGTAPSWYSGTRLPSYADQYGFILIYPGTPNMSNCWGVNDPASLTHGAGGDSLGIVAMVNYTIAKYNADASRVYVMGTSSGGMMTNVMAATYPEVFEAGAAYSGVAHACFAGAASATPFSPNQTCARGLQHTPEEWGNFVRNSYPGYTGRRPRMQICHGLADNLVYPRCAMEALKQWSNVLGVEFSRNVSGVPSQAYTQIVYGDGSKLVGYMGAGVGHVAPTNEQVMLKFFGLIN

SEQ ID NO: 292 - DNA, 1273 bp, Volvariella volvacea
tggagaacccaccacccgcatattttctcttcatcttccgctactctcatctatcacaagcagagatgattctgaggatcctcaacctcgttatgttggccatcctggccaggaccacctttgctcagcttcagcaagttaccaactttggtcccaaccctaccaatgtcgggatatacgcataccgtccatcaggcctcccagcgaaccctgcactgattgtcgccatgcactactgcactggtaccgctcaagcctactactccggaacgcgatatgcgactctcgccaacacctacaaattcatcgtcatctaccccaatgcacctgattccggaggctgttgggatgtccacaccaacgctaccctcacccacgatgcgggaggtgactcgttgggtattgcttcggcaattaggtacgcgatcaacacctggggtgtcgaccgcaaccgcgttttcgccactggtacatcgtcgggcgccatgatgaccaacgtcctggccggtgcataccccgacttgattaaagctggtgcggcgtttgctggagttccctacggttgcttcgctggccctggcatgtggaatagccaatgcgctcaaggtcaattgaccaagactgctcaacaatggggtgaccaagtccgttcgggctatcccggctatactggcagccgccccaagatgcaaatctggcatggaactcgtgacgagaccctcaactacaataacttcgacgaagcgatcaagcaatggactaacatcttcgggtacagcacgaccgcaacacaagtccaacaaaactcccctctctcaggctggacccgcagcacttatggccccaacttccaagccattagcgctgccaatgttccacacaacattcccgtccaggagaacgacgttttgaactggttcggtatcactggtggaggcccaaccaccaccactaccaccactggccctactcagcctcccacaacgacaacacctggcggtcctctccagacacaatggggccagtgcggaggaattggctggactggaccaactgcttgccaacctcccttcacttgccaatacactaacgactggtactctcagtgccgttaaacgacttgcctattgagcagtggtatacagggtcctatataagtaaaagagtcacggttatatctagtcttatcgtttccccccgcttgattcgtctgtacgatgcgtatgaactaagaccatactttacggaaaaaaaaaaaaaaaaaaaaaaaaaa

SEQ ID NO: 293 - protein, 349 aa, Volvariella volvacea
MILRILNLVMLAILARTTFAQLQQVTNFGPNPTNVGIYAYRPSGLPANPALIVAMHYCTGTAQAYYSGTRYATLANTYKFIVIYPNAPDSGGCWDVHTNATLTHDAGGDSLGIASAIRYAINTWGVDRNRVFATGTSSGAMMTNVLAGAYPDLIKAGAAFAGVPYGCFAGPGMWNSQCAQGQLTKTAQQWGDQVRSGYPGYTGSRPKMQIWHGTRDETLNYNNFDEAIKQWTNIFGYSTTATQVQQNSPLSGWTRSTYGPNFQAISAANVPHNIPVQENDVLNWFGITGGGPTTTTTTTGPTQPPTTTTPGGPLQTQWGQCGGIGWTGPTACQPPFTCQYTNDWYSQCR

SEQ ID NO: 294 - DNA, 222 bp, Aspergillus fumigatus
atgggcaggctctgccgttcgtcaattagttcccaagtcatgcatccgctgcaggtcctcacaccgaacggctctgctccgcccaactgcaacgagacggtcgagacctgcatgcagtgggtgggaatctttgggtataagtatgacgctctaaagagtgtcgtagagaatacacccgacgacaagtatgaaaaccatttgagggtgacaagttgcaagtga

SEQ ID NO: 295 - protein, 73 aa, Aspergillus fumigatus
MGRLCRSSISSQVMHPLQVLTPNGSAPPNCNETVETCMQWVGIFGYKYDALKSVVENTPDDKYENHLRVTSCK

SEQ ID NO: 296 - DNA, 912 bp, Aspergillus niger
atgctatcaacccacctcctcttcctcgccaccaccctcctcacatccctcttccatcccattgccgcccatgtcgccaagcgcagtggtagcctccaacaaatcaccgatttcggtgataaccccacaggtgtaggcatgtacatctacgtgcctaataacctggcctcgaatcctggtatcgtggttgcaatccactactgcaccggcactggacccggctactacagcaactccttctacgccaccctctccgagcaatacggcttcatcgtgatctacccgtctagcccgtactccggaggctgctgggacgtgagttcgcaggcaacgctgacacataatggaggtggaaacagtaactcgattgccaacatggtcacctggacgattagcgagtacggggcggatagcaagaaggtgtttgtgacgggttcgagttcgggggctatgatgacgaacgtaatggcagcaacctaccccgaactcttcgccgctggcaccgtctactccggcgtctcagccggctgcttctactcggacactaaccaagtggacggatggaattccacctgcgcacaaggagacgtcatcaccaccccggaacactgggctagtattgccgaggcaatgtatccagggtactcgggaagccggccaaagatgcagatctaccacggcagtgtggatacgacgctgtatccgcagaattattatgagacgtgcaagcaatgggctggagtgtttgggtacgattacagtgcaccggaatcgacggaggcgaatactccgcagacgaattatgagacgacgatttggggagataatctgcaggggatctttgcgacgggcgtgggtcatacggtgccaattcatggggataaggatatggagtggtttgggtttgcttga

SEQ ID NO: 297 - protein, 303 aa, Aspergillus niger
MLSTHLLFLATTLLTSLFHPIAAHVAKRSGSLQQITDFGDNPTGVGMYIYVPNNLASNPGIVVAIHYCTGTGPGYYSNSFYATLSEQYGFIVIYPSSPYSGGCWDVSSQATLTHNGGGNSNSIANMVTWTISEYGADSKKVFVTGSSSGAMMTNVMAATYPELFAAGTVYSGVSAGCFYSDTNQVDGWNSTCAQGDVITTPEHWASIAEAMYPGYSGSRPKMQIYHGSVDTTLYPQNYYETCKQWAGVFGYDYSAPESTEANTPQTNYETTIWGDNLQGIFATGVGHTVPIHGDKDMEWFGFA

SEQ ID NO: 298 - DNA, 879 bp, Neosartorya fischeri
atgttgttcacagcagtgactcttgctcttttaggccaagctttggctggcccagttgatcttgaagaacgccagaacagctgtcccaatatccatgtctttggtgctcgtgaaaccaccgccccccctggctatggttcgtcgtcgaccgttgtcaatctgatcctcaacgcctacccaggctccacctccgaggcaatcaactaccctgcttgtggaggtcagtcctcctgcggcggagtcagctatggcaattcggtggttgccggaatcaacgctgtcgcgagcgccgtgaactcattcaatcagagatgtccaagcactcaactggtccttgttggatactctcagggcggtcaaatcatggataacgctctctgcggaggtggagatcccaaccagggctaccccaacacggccgttccgttgtcctcatcggccgtcaacatgattaaagcggctatctttatgggcgatccccgctatatcgcgggtttgccgtacaatgtcggcacctgcagagcgggtggctttgatcctcgtcctgctggcttcagctgcccatctgcaagcaagattcagtcgtactgcgatgctgccgatccatactgttgcaatggaaacgatgccaacactcatcaaggctacggcacggagtacggacaggcagctcttacatttgtcaagagcaagctgagctcgagcggctcgggagggggttcgggaggtggttctggaggctctggaggttcgggtggctccggtggaaccgttgcccattacggtcagtgtggaggtcaaggatggactggcgccacctcatgccagagtccctatacctgtaaagtagtcagtcagtggtactctcagtgcctgtga

SEQ ID NO: 299 - protein, 292 aa, Neosartorya fischeri
MLFTAVTLALLGQALAGPVDLEERQNSCPNIHVFGARETTAPPGYGSSSTVVNLILNAYPGSTSEAINYPACGGQSSCGGVSYGNSVVAGINAVASAVNSFNQRCPSTQLVLVGYSQGGQIMDNALCGGGDPNQGYPNTAVPLSSSAVNMIKAAIFMGDPRYIAGLPYNVGTCRAGGFDPRPAGFSCPSASKIQSYCDAADPYCCNGNDANTHQGYGTEYGQAALTFVKSKLSSSGSGGGSGGGSGGSGGSGGSGGTVAHYGQCGGQGWTGATSCQSPYTCKVVSQWYSQCL

SEQ ID NO: 300 - DNA, 1765 bp, Aspergillus niger
aaatatgtcttttattaccttgttctgttgactggtgcattacttaaaactagaacagttgttcaaacacaagttggacctatacctgtcataactcgcctcgtcgcgttattcatcatgcaaaaactatccgttatcagcgccgggagtatactcccaagaagctcactcacatgcaaagaaatgtgccgattgcttaagctttaccccagattattccgtaaccatatatccattctggctgaataccggctatttgatgctgcatactctcacattccgcacagccgccagtgtgaagaatcaccagtggtccagccctgcagtggctctaacgggatctgttacggagttcggcccgcaacgtcgatctctaaccatttcgatctggagttcccactccgtgccgtctatcccagactcctcatgtcggagctgtcacggctgtcacattagccctgcttaatttccgtgatgaaatcagcctacactgtcatttctatgtctagaccactgccaaatacccactgaacccaatacttcccacaactatagaaacatactattactccataatgtttcaatttacccgctctctgcagcgctataaatcgtcttcaaatcctctggcgtctttcctactgcccaagctgcatctcttttcacctagcaggattcaagcgtagtgcctagcacggcagaagaaaccaccatgctactatcaacccacctcctcttcgtcatcaccaccttcttaacctccctcctccaccccatcgccgcccatgctgtcaagcgcagtggcagtcttcaacaggtcaccgatttcggtgacaaccctacaaatgtaggcatgtacatctacgtgcctaacaacttggcctcaaatccaggtatcgtggttgcaatccactactgtacgttcccccacatttctacaatataaaccacaatactaagcatggcataggcaccggtaccggccccggctactacagcgcctccccctacgccaccctctccgagcaatacggctttatcgtgatctacccgtccagcccatactccggtggctgttgggacgtgagttcacaggcaacgttaacacacaacgggggcggaaacagtaactccattgccaacatggtcacctggacgattagcgagtacggggccgatagtagcaaggtgttcgtgacgggatcgagttcgggggctatgttgacggtatttcctcttcccttccaaccgttccccctctctacaaattaaaatagtaaaagttgtgcatgctaataaaattagaacgtaatggcagcaacctaccccgaactcttcgccgccgccaccgtctactccggagtctcagccgggtgcttctactcgaacaccaaccaagtagatggatggaattccacttgcgcccagggtgatgtaatcaccacccccgagcactgggccagtattgcagaggcaatgtactcgggatactcaggaagtcgtccaaggatgcagatctaccacggtactctccatacgacgctgtatcctcagaactactatgagacgtgcaagcagtggtctggagtgtttggatatgattatagcgcaccggagaagacggaggcgaataccccacagacgaattacgagacgacgatttggggagatagtctgcagggaatcttcgcgacaggcgtgggtcatacggtgccgattcatggggataaggatatggagtggtttgggtttgcttgattggatg

SEQ ID NO: 301 - protein, 304 aa, Aspergillus niger
MLLSTHLLFVITTFLTSLLHPIAAHAVKRSGSLQQVTDFGDNPTNVGMYIYVPNNLASNPGIVVAIHYCTGTGPGYYSASPYATLSEQYGFIVIYPSSPYSGGCWDVSSQATLTHNGGGNSNSIANMVTWTISEYGADSSKVFVTGSSSGAMLTNVMAATYPELFAAATVYSGVSAGCFYSNTNQVDGWNSTCAQGDVITTPEHWASIAEAMYSGYSGSRPRMQIYHGTLHTTLYPQNYYETCKQWSGVFGYDYSAPEKTEANTPQTNYETTIWGDSLQGIFATGVGHTVPIHGDKDMEWFGFA

SEQ ID NO: 302 - DNA, 1662 bp, Didymella rabiei
tcgacgacagcaagtattgttgatcatgcagtaagaataaggtttcgtcgtctatcttagcataacgatgatcacaacttcgcatgaacgcactccaaacgatcatgcgccggtccctcccgtaccctgatccatgcacggcattgcacggtacttaccagctcccaagcgctgaaacgcggcgcctgtccacttcatcgtcattcctggctcgaggagacgacgaaccgtagaagggtatgcttgtggtcgatgacgacttcgtctaagctctcttggaatgggggattgaggcctgaacctttgttttcactaccactaccgagggcggggccaagtggggcgggatgatggtgtccgtgatgttgggtctggaggttgtagacattggataagtatagcttgaggattttccccgtttactctatcatggtcaagagtaacatcaaagggaaattcagcccacactcgctctcttcttaccttgttttgtccatatcatcgcctgcatcatgaagtttttcgctttctccatgcttattggcgaggcctcgccaatcgtactggccctgcggcggacaacgctggaagtccgccagctcgacccgatcatcaggtcagaactcgagcagggcagcagctcgagctgtccaaaggccatcttaatttttgcccggggcagcaccgagatcggcaatatggtatgcccctactcacctgcaccccaccacacatgcacgtcttctaacacttacaccagggggtctccgccgggccggccgtggccagcgccctcgaggcctatggcgccgaccaaatctgggtccaaggcgtcggcggcccctacactgcagatctcccctccaacttcctgcccggcggcacctcgcaatccgccatcaacgaagcggtgcgcctgttcaacgaagccaacaccaaatgcccctcgacccccatcgtggccggcggctacagccagggaacggccgtcatggccggcgcaatccccaaactcgacgccgtgcgcgccagggtcgtgggcacggtgctgtttgggtacacgcagaaccagcagaataacaaggggatcaaagattacccccaggaggatctgcaggtgtattgtgaagtgggcgatctggtttgtgacggtacgctgatcatcactgtgtcgcactttttgtacttggaggaggctgcgggaccggcgccggagtttctgaagagcaagattggggcttgagcttgagcttgagcttgagcttgagcttgagcctgagcttggggttagggttggggttgtctgaactcaagggctaggagatgacggtgggaggcaggagagttcggataggggcatgacggggttggatgggggctttctcttctcctctttagcgtcttcatttctataatatttactgactcatgacatgttgacgttggctggctagcctcaaacgccactttctacctgctccgtgtactgagttgatgttctgaaagaatggtaaagtgagaggttgagaacgattctacacagaccctaagactcatgtgttttgatgaatggaatttgactgtcaatctttgtagtctacgatcgagattgcaagctactagcttatcgtagtgagtcgcactcaaggaccatgttttgta

SEQ ID NO: 303 - protein, 223 aa, Didymella rabiei
MKFFAFSMLIGEASPIVLALRRTTLEVRQLDPIIRSELEQGSSSSCPKAILIFARGSTEIGNMGVSAGPAVASALEAYGADQIWVQGVGGPYTADLPSNFLPGGTSQSAINEAVRLFNEANTKCPSTPIVAGGYSQGTAVMAGAIPKLDAVRARVVGTVLFGYTQNQQNNKGIKDYPQEDLQVYCEVGDLVCDGTLIITVSHFLYLEEAAGPAPEFLKSKIGA

SEQ ID NO: 304 - DNA, 1858 bp, Penicillium purporogenum
atcatttgtggaactattcagtaacgttgagacacttatccacatcaggtaaggaacccgggccgaacacaccgatttgcggatcttgaacatctcaaaccagctcgtatggataaatatggggtttcttcacggtgtttgatccctgaatcctgcagattattacgccctgcagaattgccaatgcggggaaacgatggcccctggcagtttcagctactttaatttagcctggggggacctaaagacacgacacgaatcgcacagtgtaaccccgcgtcttccattcgtccgaagttccatgtaaaagcaactgaagcattcagccaaaattgaatgaagcttgaaacgtcacggaagaattgactatttctcatattagggaattctagagataaggtgaactccaccagctcaccatgttaaagacctggggatatcccgctattgatggcccaacggctcttgggttcattcaagcaataccgggttcatacaatctcttaacacgatgaagagcctgtctttctcctttcttgttaccttgttcctctatctcaccttgtcctccgctaggacactgggcaaggatgtcaacaagcgagtcaccgccggctcgctgcaacaagtgaccggctttggagataatgcctctggcactctgatgtacatctatgttccaaagaacttggccaccaaccccggaattgtcgtcgcgattcattattgtgagtggatcttttcccttctaggcctctcttgttgtgagtcctagcaataacaaacaatgatctaggcaccggtaccgcccaggcatactacaccggatctccctatgcacagctggcagagcaatatggcttcattgtcatctacccccaaagcccctacagcgggacctgctgggatgtcagctctcaggctgctctgacccataacggtggaggagacagcaactccatcgccaacatggtcacctggaccatcagtcaatacaatgcgaataccgccaaggtattcgtgactggctccagctctggtgccatgatgacggtgagtgaccccgattatctttatgttgctctacaaccttgactgacttccatcgacacagaacgtcatggcagccacctaccccgaacttttcgcagcggcgacagtctactccggggttggtgccggctgcttctactcctctagcaaccaagccgacgcgtggaacagcagctgtgccacgggcagcgtcatcagcactcctgccgtctggggcggcatcgccaaaaacatgtactctggatactctggctcacgacctcgaatgcagatctatcacggcagtgccgacacaacactctatccacaaaactactacgagacctgcaagcagtgggccggcgtctttggatacaactacgactctccccagtcaacccttgctaatacaccggacgccaactaccaaaccaccaactggggccctaatctccagggtatctacgcgacgggcgtcggccatacagtccccatccatggagcaaaggatatggaatggtttggcttctcgggtagtggctcgtcttctaccaccaccgcatcggccaccaagaccagcacgaccagcacgaccagcacaaaaacaacgagttcgacttcgagcaccacaacttcttcgaccggcgtggcggcgcattggggtcaatgtggaggctctgggtggactggccctactgtctgtgaatctggatatacctgcacttattccaatgcttggtattcgcagtgtctgtagatcgggttttggatggtgcaactgcaaggttgagagaccctctttctaggccgggctcgtcctgactta

SEQ ID NO: 305 - protein, 382 aa, Penicillium purporogenum
MKSLSFSFLVTLFLYLTLSSARTLGKDVNKRVTAGSLQQVTGFGDNASGTLMYIYVPKNLATNPGIVVAIHYCTGTAQAYYTGSPYAQLAEQYGFIVIYPQSPYSGTCWDVSSQAALTHNGGGDSNSIANMVTWTISQYNANTAKVFVTGSSSGAMMTNVMAATYPELFAAATVYSGVGAGCFYSSSNQADAWNSSCATGSVISTPAVWGGIAKNMYSGYSGSRPRMQIYHGSADTTLYPQNYYETCKQWAGVFGYNYDSPQSTLANTPDANYQTTNWGPNLQGIYATGVGHTVPIHGAKDMEWFGFSGSGSSSTTTASATKTSTTSTTSTKTTSSTSSTTTSSTGVAAHWGQCGGSGWTGPTVCESGYTCTYSNAWYSQCL

SEQ ID NO: 306 - DNA, 1037 bp, Aspergillus oryzae
atgatcctcttgtcatacctcctcacctatcttctctgtgccctcacctgcagtgccagagctatacacaatggcagatccctaatcccaagagcaggatcccttgaacaagtcaccgacttcggcgacaaccctagcaacgttaagatgtacatctacgtacccacgaacctggcctctaatcccgggataatagttgcaattcactactgtgcgcactcctctacctatacctgcatagcatactaacaatacccaaaggcacaggaaccgcccaagcatactaccaaggctccccttacgcgcaactagccgaaacacacggcttcatcgtcatctatcccgaaagcccttacgaaggaacatgctgggacgtcagctcccaagcaaccctcacccacaacggaggcggaaacagtaactccatcgccaacatggtaacctggacgaccaagcagtataatgccgattccagcaaggtgttcgtaacgggtactagttctggtgccatgatgaccgtatgttcaccgaccttctaaacccctagtcccttcatgcacagtactaaccgataatactagaatgtaatggcagcaacataccccaacctcttcgccgccggagtcgcctacgccggcgtcccagccggctgcttcctctcaaccgccgaccaacccgacgcctggaactcgacctgcgcgcagggccaatctatcaccactccggagcactgggctagtatcgccgaggccatgtatcccgactatagtggctcgcggcccaagatgcaaatctaccacggtaatgtcgataccaccttgtatccgcagaactacgaggaaacgtgtaagcaatgggcaggcgtcttcgggtataactatgatgctcccgaatcgactgagtcgaatactcccgaggcaaactggagcaggactacttgggggccgaatctccagggtattttggctggcggtgttggtcataatatacagattcatggggatgaggatatgaagtggtttgggtttacgaattag

SEQ ID NO: 307 - protein, 307 aa, Aspergillus oryzae
MILLSYLLTYLLCALTCSARAIHNGRSLIPRAGSLEQVTDFGDNPSNVKMYIYVPTNLASNPGIIVAIHYCTGTAQAYYQGSPYAQLAETHGFIVIYPESPYEGTCWDVSSQATLTHNGGGNSNSIANMVTWTTKQYNADSSKVFVTGTSSGAMMTNVMAATYPNLFAAGVAYAGVPAGCFLSTADQPDAWNSTCAQGQSITTPEHWASIAEAMYPDYSGSRPKMQIYHGNVDTTLYPQNYEETCKQWAGVFGYNYDAPESTESNTPEANWSRTTWGPNLQGILAGGVGHNIQIHGDEDMKWFGFTN

SEQ ID NO: 308 - DNA, 2009 bp, Fibrobacter succinogenes
gatccggacgataagacgattggtttgcgcggtgctaatttccgcttgccgaccgaagccgaaaattacagtgtcttcgacgtgaacggcgtgctcgtgggcaagttccttgctacgaccaaggccgatgtccagcgcatgaccaagagcgtggtgcgtcagaatggcatttactttgtgaagtctctcaagtccggcaatgcttaccgcatttctgtggcaaaataatttcatattcctaaaaacgggagccgagcaattggctcctgttttttttaagagtttgttaaaagggagatagatatgagtgtggaaatgagcttcaaaaagctgatgggcattgcaggtgttgctgctggcctctctatgtttgcggtaatgggtgcaaatgcggctccggacccgaacttccatatttacattgcttacgggcagtcgaacatggaaggcaacgcgaggaactttacggatgtcgataagaaggaacatcctcgcgtgaaaatgtttgcaacaacgtcttgcccgagtcttggccgccctacggtcggtgaaatgtacccggcagtgccgccaatgttcaagtgcggtgaaggcctttctgtcgctgactggtttggccgccacatggcagattccttgccgaacgtgacgattggcattattccggtggctcagggcggtacgagtatccgcttgtttgacccggacgattacaagaattacctcaattctgcggaaagctggctgaagaacggagccaaggcttacggtgacgatggcaatgccatgggccgcattattgaagtcgccaagaaggctcaggaaaagggcgtcatcaagggaatcatcttccaccagggtgaaaccgatggcggcatgagcaactgggagcagattgtcaagaagacttacgaatacatgctcaagcagctcggtttgaacgccgaggagactccgtttgtcgccggtgaaatggtcgatggcggttcgtgtgctggctttagcagtcgtgtgcgtgggctttccaagtacattgcgaattttggcgtggcaagttccaagggttacggctctaagggcgatggtctccactttactgtggaaggctaccgcggcatgggcctccgttatgcccagcaaatgctcaagctcatcaacgtggcgcctgttgaccctgtcccgcaggaaccgttcaagggtgctccgattgctattccgggcaaggtcgaagtcgaagattttgacaagccgggtatcggcaagaacgaagacggtacgagtaacgcctcttacagtgacgaagattccgaaaaccacggtgatagcgattaccgcaaggatacgggcgtagacttgtacaaggcgggcgatggcgttgctcttggttacacgcagactggcgaatggcttgaatacacggtagacgtgaaggctgatggcgaatacaatatcgatgcaagtgtcgctgccggtaattccacctctgcgttcaagctttacatcgacgaaaaagcaataacggatgatgtttccgtgccgcagactgccgacaattcctgggacacgtacaagacgatttccgtgaaggaaaaggtcaccttgaaggccggtaagcacgtgctcaagctcgaaatcaccgccaactacgtgaatatcgactggatccagttcagcgagccgaaaaaggaagacccgccgagcgcgattgcaaaggtccgttttgacatgactgaagccgaaagcaactttagcgtgtacagcatgcagggccaaaagctcgggacgtttaccgcgaagggaatggccgacgcgatgaacctcgtcaagacggatgccaagctccgcaagcaggcaaagggcgtgttctttgtgcgcaaggaaggcgcaaagctcatgagcaagaaggttgtcgttttcgaataattctagactccatgaagggtcctggcggatgctaggactctttttttacaaaatgcgttttttgagcgaatttcgcaattcattga

SEQ ID NO: 309 - protein, 539 aa, Fibrobacter succinogenes
MSVEMSFKKLMGIAGVAAGLSMFAVMGANAAPDPNFHIYIAYGQSNMEGNARNFTDVDKKEHPRVKMFATTSCPSLGRPTVGEMYPAVPPMFKCGEGLSVADWFGRHMADSLPNVTIGIIPVAQGGTSIRLFDPDDYKNYLNSAESWLKNGAKAYGDDGNAMGRIIEVAKKAQEKGVIKGIIFHQGETDGGMSNWEQIVKKTYEYMLKQLGLNAEETPFVAGEMVDGGSCAGFSSRVRGLSKYIANFGVASSKGYGSKGDGLHFTVEGYRGMGLRYAQQMLKLINVAPVDPVPQEPFKGAPIAIPGKVEVEDFDKPGIGKNEDGTSNASYSDEDSENHGDSDYRKDTGVDLYKAGDGVALGYTQTGEWLEYTVDVKADGEYNIDASVAAGNSTSAFKLYIDEKAITDDVSVPQTADNSWDTYKTISVKEKVTLKAGKHVLKLEITANYVNIDWIQFSEPKKEDPPSAIAKVRFDMTEAESNFSVYSMQGQKLGTFTAKGMADAMNLVKTDAKLRKQAKGVFFVRKEGAKLMSKKVVVFE

SEQ ID NO: 310 - DNA, 2321 bp, Aspergillus ficuum
ttctagaaacaagagagttaagctattgagcgtactggccaccgtgtaagtccaagcacgcactggaccacccacgccgtaacttcaagttcctcttcaccccctctaagctatttcccactttccttgcatcaagcaaaaggccgtgacagagttcaggctgtgcctgccaggctgttctgttcgccggtttaaatcatgcagaaactctccattgtcacggctgagagcatactccagaagctcacatggccaagacatgtgccgattgcttaatgctttaccccagattattccgcagccgaaatatccattctggctgaataccggctatttgatgctaccctgcagatagttacaacctgaagaatcaccagtggcccagccctgcagtggctctaacgggatctgttacggaattcggcccgcacgacgatctctaaccatttcgatctggagttcccactccgtgttgtctatcccagactcctcatgtcggagctgtcacggctgtcacagtcgccctgcttaatctccgcgatgaaatcagcctacactggtctttcctgagcctagactacgcaaaatacccactgaaaccgatacttcccacaactatagaaacatacaataactccatgatgtttcaatttatccgctccctgcaaagctataaatcgttgccagacccctctggcgcctttgctacaaacccaagccacatcttcgcaacctgacctccctgcctagcacggcagaagtaactcaccatgctatcaacccacctcctcttcctcgccaccaccctcctcacatccctcttccaccccatcgccgcccatgtcgccaagcgcagtggcagcctccaacaaatcaccgatttcggtgataaccccacaggtgtaggcatgtacatctacgtgcctaacaacctggcctcgaatccaggtatcgtggttgcaatccactactgtacgtccccttacttctctacattatctaccacacaccgtgcagacaacaatactaagtaaaggatataggcaccggcactggccccggctactacagcaactccccctacgccaccctctccgagcaatacggtttcatcgtgatctacccgtccagcccatactccggaggctgctgggacgtgagttcgcaggcgacgctgacacataatggaggtggaaacagtaactccattgccaacatggtcacctggacgattagcgagtacggggcggatagcaagaaggtgtatgtgacgggatcgagctcgggggctatgatgacggtatttccccattccttcttccaacctgtcccctctatacgcatcaacatagtagcgcagtgcatactgactgggaaaagaacgtaatggcagcaacctaccctgaactcttcgccgccggcaccgtctactccggtgtttcagccggctgcttctactcggacactaaccaagtggacggatggaattccacctgcgcacaaggagacgtcatcaccaccccggaacactgggctagtattgccgaggcaatgtatccagggtactcgggaagccggccaaagatgcagatctaccacggcagtgtggatacgacgctgtatccgcagaattattacgagacgtgcaagcaatgggctggagtgtttgggtacgattacagtgcaccggaatcgacggaggcgaatactccgcagacgaactatgagacgacgatttggggagataatctgcaggggatctttgcgacgggcgtgggtcatacggtgccaatccatggggataaggatatggagtggtttgggtttgcttgattcgggaatgaatcggtggggttgaggtctcttgagatgagtaactatgaagcttctgaagtatgataagtcagtggttttcgtctcaacaagcgatcatggcacgctggaagagtacttcagcctcgtctgtttcacctgcagatcgcatctcatcgaagtctgcctcatattgccgcagagtagacaagagttgagagtcgctggcactcgcttcattgatggtgtctcggtaggttcgaatatcgccgcgtagtgtagtgtttagcctggcgctgggctgctggctccagtccgctccgtatttggagcgcatcttttcgcatacactctcctccaggtccaattgtttggagcactggtctagctgcgcgagaatctccaccttgcgatcctgtagcccatcaaaggccttgataaatggttgatgacccgcgagctcctggcaccatcgtcgaaattcatcatccacagttaccttcttggtt

SEQ ID NO: 311 - protein, 303 aa, Aspergillus ficuum
MLSTHLLFLATTLLTSLFHPIAAHVAKRSGSLQQITDFGDNPTGVGMYIYVPNNLASNPGIVVAIHYCTGTGPGYYSNSPYATLSEQYGFIVIYPSSPYSGGCWDVSSQATLTHNGGGNSNSIANMVTWTISEYGADSKKVYVTGSSSGAMMTNVMAATYPELFAAGTVYSGVSAGCFYSDTNQVDGWNSTCAQGDVITTPEHWASIAEAMYPGYSGSRPKMQIYHGSVDTTLYPQNYYETCKQWAGVFGYDYSAPESTEANTPQTNYETTIWGDNLQGIFATGVGHTVPIHGDKDMEWFGFA

SEQ ID NO: 312 - DNA, 2260 bp, Bacillus pumilus
gaattcagtgtctctgcttgtgcccgtccggttcaccgcaatcacaaatgactgattctcaatggctcttgcgatgagcagactgcgccaatggtccactcttgctgacggccattgagcggtattaacaagcaccttcgcccctttgttcacgagcgtcctagaaagctgagggaagcggaggtcatagcagatcatcgcaccaatcttgacatcttcaccatagtcaaataaaccaagctgatcaccagcggttaaatagttatgctcatccattaagcggaataaatgaattttatcataatctaacaaaagctcaccttggcggttaaagacatacattgtattggtgatgttttcatcttctgtcctcttatttaaaacactgcctgcgatgagatacacttggtgcttgcgggcaaaggaagagaagagttgttttgttcgctcgccatctgcatcggcaagctcatccgcttgctctaacgcatagccggtattccacatttcaggtagaataatcaaatcaggctgttggcggatggcttcttctaaacatgcttctgctttctgaaagtttacatcaggttctcctatttgtacgtccatttgaatcagggcgatgttcatgtcggtcgtcctcctttattcgtttcatgcaatgaatggttcgggtgatattgcctgaagcatctagtcttcaagccagtttctttatcataaagctttccgccatctttgccaatagaaatgtcagaaggttttgttaaatgactttctcaatcaagaaatgagtggtatgatactcataactaataaaacaaaggggaatagtatgatatgcaattgttcgatttatcactagaagagctaaaaaaatataaaccaaagaaaacagcacgtcctgatttctcagacttttggaagaaatcgctcgaagaactgcgccaagtggaggcagagccaacacttgaatcttatgactatccagtgaaaggcgtcaaggtgtaccgcctgacgtatcaaagctttggacattctaaaattgaaggcttttatgctgtgcctgatcaaactggtccgcatccagcgctcgttcgttttcatggctataatgccagctatgacggcggcattcacgacatcgtcaactgggcgctgcacggctatgcaacatttggtatgctcgtccgcggtcaaggtggcagtgaagacacatcagtgacaccaggcgggcatgcattagggtggatgacaaaaggcattttatcgaaagatacgtactattatcgaggcgtttatctagatgctgttcgtgcacttgaagtcattcagtctttccccgaagtagatgaacaccgtatcggcgtgatcggtggaagtcaggggggtgcgttagcgattgcggccgcagccctttcagacattccaaaagtcgttgtggcagactatccttacttatcaaattttgagcgtgcagttgatgttgccttggagcagccttatttagaaatcaattcatactttcgcagaaacagtgatccgaaagtggaggaaaaggcatttgagacattaagctattttgatttaatcaatttagctggatgggtgaaacagccaacattgatggcgatcggtctgattgacaaaataaccccaccatctactgtgtttgcggcatacaaccatttagaaacagataaagacctgaaagtatatcgctattttggacacgagtttatccctgcttttcaaacagagaagctgtcctttttacaaaagcatttgcttctatcaacataagagcatgacaaagagctaaaatgacattcattttagctctttgtctttttcagctattggagcgatcagcttaataactggtgttctgtcttgttttttcatcaggcactaatgctgtaacgatcagggcaagggctgtgatgatgtgaaggatgaatccgagaatcggaatccatgcaaggcaggatgtgacaattccaatgatacttccaatcattggtccctgatctcgcttcgataagacgagtgtgataatatgcagaataagcatgaccatgagcggtgaatagccattgctgataacgaatagacctccgatcacagggatagcaaggcaagcttcaaaaatcccagtgatccatttcataatgcgagatatagacatcagatccaactcctttttcatatatgtcttattcgtattttcccaaatggtgaagaagtcatgcaggaattc

SEQ ID NO: 313 - protein, 320 aa, Bacillus pumilus
MQLFDLSLEELKKYKPKKTARPDFSDFWKKSLEELRQVEAEPTLESYDYPVKGVKVYRLTYQSFGHSKIEGFYAVPDQTGPHPALVRFHGYNASYDGGIHDIVNWALHGYATFGMLVRGQGGSEDTSVTPGGHALGWMTKGILSKDTYYYRGVYLDAVRALEVIQSFPEVDEHRIGVIGGSQGGALAIAAAALSDIPKVVVADYPYLSNFERAVDVALEQPYLEINSYFRRNSDPKVEEKAFETLSYFDLINLAGWVKQPTLMAIGLIDKITPPSTVFAAYNHLETDKDLKVYRYFGHEFIPAFQTEKLSFLQKHLLLST

SEQ ID NO: 314 - DNA, 1066 bp, Trichoderma reesei
cacgagtttccacataaataattcctcctgttacaagagccaaaatgccttcagtcaaagaaacacttactcttttgctgagccaagctttccttgccactggcagcccagtagatggagagaccgttgtgaagcgacaatgcccggctattcacgtcttcggcgcccgtgaaacgacagtgagtcagggatatggctcgtccgctaccgttgtaaacttggtcatccaagcccatcccggaaccacatccgaggcaattgtctacccggcgtgcggtggtcaggcttcatgtggcggcatcagctatgctaactcagttgtgaacggaaccaacgccgcggcggcggcaatcaacaactttcacaactcttgcccggacactcagctggtgttggtcggatactcgcagggtgctcaaatcttcgataatgccctctgcggaggaggcgatcctggtgaaggaattaccaacactgctgtccccctaactgcgggagcagtttccgctgttaaagcagcaatcttcatgggagaccctcgaaacattcatggcctgccctataacgtcggaacctgtactacccagggtttcgacgcccgtccggctggcttcgtctgtcccagcgcgtccaagatcaagtcttactgcgatgccgcagacccgtactgctgcaccggaaatgaccccaacgttcaccaaggttacggccaggagtacggccagcaggctctcgctttcatcaacagccagctctcctcaggcggttctcaacccccgggcggcggcccgaccagcacctccaggccaaccagcacaagaactggaagctctcctggcccaactcagactcattggggtcagtgcggaggccagggctggaccggtcctacgcaatgtgagagcggcacgacttgccaggttatcagccaatggtactctcagtgcttgtaaagagcatgaaggctgagattatgaggcgtttcgtagccagctgcagttaggactagcttggagaaatctacttatgatgaaattgaaaaaaaaaaaaaaaaaaaaaaaaaaaa

SEQ ID NO: 315 - protein, 302 aa, Trichoderma atraviride
MPSVKETLTLLLSQAFLATGSPVDGETVVKRQCPAIHVFGARETTVSQGYGSSATVVNLVIQAHPGTTSEAIVYPACGGQASCGGISYANSVVNGTNAAAAAINNFHNSCPDTQLVLVGYSQGAQIFDNALCGGGDPGEGITNTAVPLTAGAVSAVKAAIFMGDPRNIHGLPYNVGTCTTQGFDARPAGFVCPSASKIKSYCDAADPYCCTGNDPNVHQGYGQEYGQQALAFINSQLSSGGSQPPGGGPTSTSRPTSTRTGSSPGPTQTHWGQCGGQGWTGPTQCESGTTCQVISQWYSQCL

SEQ ID NO: 316 - DNA, 2760 bp, Thermoanaerobacterium sp. 'JW/SL YS 485'; identical to SEQ ID NO: 159

SEQ ID NO: 317 - protein, 500 aa, Thermoanaerobacterium sp. 'JW/SL YS 485'; identical to SEQ ID NO: 160

SEQ ID NO: 318 - protein, 320 aa, Thermoanaerobacterium sp. 'JW/SL YS 485'; identical to SEQ ID NO: 161

SEQ ID NO: 319 - DNA, 3173 bp, Streptomyces thermoviolaceus
ggatcccatgaccctcgatcggtgtcgaaactttcggggatcggacgcctcgccttgatcgcaatttcatgatgagtggatgcgggtcgcagtgctggtagtactgcaaagctcttgagctgcgactagccagccccagagggcttcttttgttacgcgaacctttcgaaataattaccgaaaccattgacagttgtcagggtcaggccaacactcacgtcgtcaccctcacgcacgcgcagcgaggaggaagcacgtccatgaacacgctcgtccatccgcagggccgcgcaggcggtctgcggctgctcgtcagagccgcgtgggcgctggccctggccgccctggccgcgatgatggtcgggggcaccgcccgggcggacacgatcacctcgaaccagaccggcacccacaacggctacttctactcgttctggaccgacgcccccggcaccgtcaccatgaacaccggcgccggcggaaactacagcacccagtggagcaacaccggcaacttcgtggcgggcaagggctgggccaccggcggccgccgcaccgtgacctactcgggcacgttcaacccgtccggcaacgcctacctggcgctgtacggctggtcccagaacccgctcgtcgagtactacatcgtcgacaactggggcacctaccggcccaccggcacctacaagggcaccgtcgacagcgacggcggcacgtacgacatctacatgaccacccgctacaacgccccctccatcgagggcaccaagaccttcaaccagtactggagcgtccggcagaacaagcgcaccggcggaaccatcaccaccggcaaccacttcgacgcctgggccgcgcacggcatgccgctcggcaccttcaactacatgatcctcgccaccgagggctaccagagcagcggcagctccaacatcacggtcggtgactccggcggcgacaacggcggcggtggtggcggtggcggcggcggtggcaacaccggtggctgcaccgcgacgctgtccgcgggtgagcagtggagcgaccgctacaacctgaacgtgtcggtgagcgggtcggacaactggacggtgacgatgcgggttcccgcgccggagaaggtcatggcgacctggaacgtcaccgcgagttatccggatgcgcagacgctggtggccaggccgaacggcaacggcaacaactggggtgtgaccatccagaagaacggcagcaccacctggcccacggtcagctgctccgtcggctgagcggcgtacggacaacgaaaggaggacaccgcacatgcgcatcccgtcacgccggccgctgcgctcgctgctcgccggcctggccggcggcgctgctggccaccgcgggtgtctgtaccgtggacgccggcaccgcacacgccgcggcctgcaccggctacgtcggcctgaccttcgacgacggcccgtccaacgaccacacccccgccctgctgaacgcgctgaagcagaacgggctgcgggccaccatgttcaacgagggtcagttcgccgccgcctacccggcccaggtgaaggcccaggtggacgccggcatgtgggtcggcaaccacagctacacccacccgcacctgacccagcagagccaggcgcagatcgactccgagatctcccgcacccagcaggccatcgcgaacgcgggcggcggcacacccacgctgttccgtccgcctacggcgagaccaacgccaccgtgcagtcggtcgaggccaagtacgggctgaaggagatcatctgggacgtcgactcgcaggactggaacggcgccagcaccgacgcgatcgtgcaggccgtggaccggctcaccgacgggcagatcatcctgatgcacgaatggcccgccaacaccctggccgccatcccgcgcatcgtgcagaccctggccgccaagggactgtgcgccggcatgatctcgccgcagaccggccgcgcggtcgcacccgacggaggctccggcggcggtggcggcggtggcaacaccggtggctgcacggcgacgctgtccgcgggtgagcagtggagcgaccgctacaacctgaacgtgtcggtgagcgggtcggacaactggacggtgacgatgcggattccggcgccggagagggtgatggcgacatggaacgtcacagcgagttatcaggatgagaagaagctggtgaccagcacgaacggaaacggcaacaactggggtgtgaccatccagaagaacggcagcaccacctggccaacggtcagctgctccgtcggctgagcggcgaccagacgtcccgcagcggacggcagcacgtgagggggccgacggctccggccgccgcgtcacctgtgcgtgacagccggacccaggtgtcagccgctcgggccggcagtcacaggtgcggcggcgaccggcccggccgcacacgtgtctcacacctgccggtcacccgggagaacttctcctcgggtatctcctggtgcagcgccgacatccagcacacggcgaacacctcgacactcaccccggtcacgaacatcaccgccaccagcaccggagccgtcaccgggatcgccagggccgcactcggggccgccaggggcagtaccgccagcacacctgtccgcagcaggccgcggcgcccagcgggtcatcagcagcccgcccagcaccgtgcccgcaccgaacgccgccagcgccgtcccccagggctgcgccccgcccagccgctcccggggcggcgcgtcctgccggtcgcaccgggcgcctcgaccgcgggccggggcttacggggagtcgagcgacgctgcgccgccggggtgctgtgcgacggcctccccggcctcgcccgcacccgactcgcccgcaccggcctcgcccgccccgacgccgtcgtcaccgccgtcgtcaccggcgtggtcatcggccgccgcagcgcgggccgccgggggccgcgccgccggctccgtacggcgcaccagacggcgcacgtccggcacgcacagcaccgccagcgtcagcgtcagcaccagcgccgagcaggcccacaagcgcgccgtccggcccaccgcgtcctgcaccgggccgcaccgccgtggccaggggcaccagcgccaccgatgccgagccatgtcgttggatggatcacccccggg

SEQ ID NO: 320 - protein, 335 aa, Streptomyces thermoviolaceus
MNTLVHPQGRAGGLRLLVRAAWALALAALAAMMVGGTARADTITSNQTGTHNGYFYSFWTDAPGTVTMNTGAGGNYSTQWSNTGNFVAGKGWATGGRRTVTYSGTFNPSGNAYLALYGWSQNPLVEYYIVDNWGTYRPTGTYKGTVDSDGGTYDIYMTTRYNAPSIEGTKTFNQYWSVRQNKRTGGTITTGNHFDAWAAHGMPLGTFNYMILATEGYQSSGSSNITVGDSGGDNGGGGGGGGGGGNTGGCTATLSAGEQWSDRYNLNVSVSGSDNWTVTMRVPAPEKVMATWNVTASYPDAQTLVARPNGNGNNWGVTIQKNGSTTWPTVSCSVG

SEQ ID NO: 321 - protein, 330 aa, Streptomyces thermoviolaceus
MRIPSRRPLRSLLAGLAGGAAGHRGCLYRGRRHRTRRGLHRLRRPDLRRRPVQRPHPRPAERAEAERAAGHHVQRGSVRRRLPGPGEGPGGRRHVGRQPQLHPPAPDPAEPGADRLRDLPHPAGHRERGRRHTHAVPSAYGETNATVQSVEAKYGLKEIIWDVDSQDWNGASTDAIVQAVDRLTDGQIILMHEWPANTLAAIPRIVQTLAAKGLCAGMISPQTGRAVAPDGGSGGGGGGGNTGGCTATLSAGEQWSDRYNLNVSVSGSDNWTVTMRIPAPERVMATWNVTASYQDEKKLVTSTNGNGNNWGVTIQKNGSTTWPTVSCSVG

SEQ ID NO: 322 - DNA, 3642 bp, Streptomyces thermoviolaceus; identical to SEQ ID NO: 242

SEQ ID NO: 323 - protein, 363 aa, Streptomyces thermoviolaceus; identical to SEQ ID NO: 243

SEQ ID NO: 324 - protein, 476 aa, Streptomyces thermoviolaceus; identical to SEQ ID NO: 244

SEQ ID NO: 325 - DNA, 4398 bp, Streptomyces lividans
agatctcgaactcgccgccgccctgcgcgccgcacacacggacctggcccgctgccccgacccgctggaggcgtagtcccgtctgccctggctgctcacggcgctggcccgccgccactccacggcccgcgcagcgaccgacgcggtccccggcgccggccgtgtcgcccgcgtcgtacgcgaccggctcgccgacgaactcctcgccccgccgtccctggcggccctcgccgcgacctcggcctgtcccgctaccaactcctgcgggccttccgcacgtcgacggggatgccgccgtacgcctggctcgcccagcaccgggtggccagggcgcgcgggctcctggacgcgggtctgcgccccgccgaggtggcggcgctggtgggcttcgcgaccagggcacctgacccgctggttccggcgggtcctcggggtgacccggccgcgtaccgcaacagcgttcaagaccgcaccgggtgaggcggccgagactcgccgcatgactgcacgcggctggttcctgttctcccctgatgggagtggtctggggcgtcccctacctgatgatcaaggtggcggtggacgaggtgtccccgtccggggtggtgtttcgcggtgctgctcggcagcggccctcctgctgcccttcgccctgcgcaagggagacctcctcggcaccgtacggcgccggtggaagccgatgctggccttcgccgtgatcgagatcatcggcccctggtggacctgacggacgccgaacggcacctgtccagctccaccgcagggctgctgatcgcgggcgtgccgatcgccgccgtcctcctggcccgcttcttcggcgccgaggaacgggtcggcgcccgccggatcaccggcctcggcctcggcctcgcgggcgtcgccgtcctcaccgtcccgcacctcaccggcggcgacgcccgctcgctggccgaggtgctggtgacggttcggtcgtacgccaccgcccccctgatcgccgcccgccacctcaaggacgtccccaccctccagctcatcaccccctgcctcatcctggccgccgtcgtctacgcccccgccgccttccttacccggcccgccaccctcccctcgggcgaggccctggcagccctggccggtctcggcctcgtctgcaccgcgatcgccttcgtggccttcctggagttgatcaaggaggtcgcccgacccgggccggcgtcatcacctacgtcaacccgcgatcgccgtcccgcgggcgccctcctcctgacgagagctgaccctcggcatcgcgtcgccttcaccctgatcctggccggctcggtcctcgcgaacggcggcggccggtccggggcgggaggctcgccgggtaccatggtcgacacggcagacgagccgggcgggcggccgcgtggagtccctcacgggacttcccgaggaacgtccgggctccacagggcagggtgatggctaacggccacccggggtgacccgcgggacagtgccacagaaagcagaccgccggaggcttcggcccccggtaagggtgaaacggtggtgtaagagaccaccagtgcccagggcgacctgggcagctaggtaaaccccacccggagcaaggtcaagaaggaagcgccccggtgcttctgcgcggacgttcgagggctgcccgcccgagtccgcgggtagaccgctggaggccggtggcaacgccggtcctagatggatggccgtcgccgacgggacccgcgaggccccgtcggaacagaacccggcgtacagcccgactcgtctgcgccccccccccccgcgcgttgccctgtgatcaggtggaagaggccccccagcagcgtccgtaggtcaactgcatgatgtcgcggacccgtatgcggccgccgcgaagaagagccagaggatgtgggtgcgctgcggctatccagagaccgtggcttcgaaaattttcggaagtgctgcctcttctttcccggcaggcacggtgagtggattccgggtgcgcgtgtcgacgcggattgagtggtgcatgagctgcaatttcctttcccgggcggcatcctctggaacgtcgaaggtttcgaaacttctaccgaaactgttgacgcttgatgggtgcaggtcaacactgtcgccgttgtccgaacccgcaggagaggaacaccccccatgaacctgctcgtccagccgaggcgtcgcagacgcggtccggtcaccttgctcgtcaggagcgcgtgggccgtcgcgctggcggcgctcgccgcgctgatgctgccgggcaccgcccaggccgacacggtcgtcacgaccaaccaggagggcaccaacaacggctactactactcgttctggaccgacagccagggcaccgtctccatgaacatgggctccggcggtcagtacagcacctcgtggcgcaacaccggcaacttcgtcgcgggcaagggctgggccaacggcggccgccggaccgtgcagtactcgggcagcttcaacccctccggcaacgcgtacctggcgctctacggatggacgtcgaacccgctcgtcgagtactacatcgtcgacaactggggcacctaccggcccacgggcgagtacaagggcaccgtcaccagcgacggcggcacctacgacatctacaagacgacccgcgtcaacaagccctccgtcgagggcacccgcaccttcgaccagtactggagcgtccggcagtcgaagcggaccggcggcaccatcacgaccggcaaccacttcgacgcgtgggcccgggccgggatgccgctcggcaacttcagctactacatgatcatggccaccgagggctaccagagcagcggcagctccagcatcaacgtcggcgggaccggcggcggtgacagcggcggcggcgacaacgggggcggtggcggcgggtgcaccgccacggtgtccgccgggcagaagtggggcgaccggtacaacctcgacgtctccgtcagcggcgccagcgactggacggtgacgatgaacgtgccgtccccggcgaaggtcctgtcgaactggaacgtcaacgccagctatcccagtgcgcagacgctgaccgccaggctgaacggcagcggcaacaactggggcgccaccatccaggccaacgcgaactggacctggcccagcgtgtcctgcagcgcgggctgacccaccccaccagcggagaggaggaatcactcgcatgcgtaccagtaccggaccacgcgcgtcctcgcgcaccctgcgcaccctggcttccggcgtcgccgtcaccgcgctcgccgccgcgggcacggtggcggccggcgccgccccggcccaggccgcggcctgcaacggttacgtcgggctcaccttcgacgacggcccctccggcagcacccagtccctgctcaacgcgctcaggcagaacgggctgcgggccaccatgttcaaccaggggcagtacgccgcccagaacccgtccctggtccgggcccaggtcgacgccggcatgtgggtcgccaaccacagctacacccacccgcacatgacccagctcggccaggcccagatggactcggagatctcccggacccagcaggccatcgcgggcgccggcggcgggacgcccaagctgttccggccgccgtacggcgagaccaacgcgacgctccggtcggtcgaggccaagtacgggctgaccgaggtgatctgggacgtcgactcgcaggactggaacaacgccagtaccgacgcgatcgtgcaggccgtctcacggctcggcaacggccaggtcatcctcatgcacgactggcccgccaacacgctcgcggccatcccgcgcatcgcgcagaccctggcgggcaaggggctgtgctccggcatgatctcgccgcagaccggccgcgcggtcgctcccgacggcagtggcggcgggggagacggcggcgggggaggcgggggcgcctgcaccgcgacgctgtccgccgggcagcggtggggggaccggtacaacctcaacgtctccgtcagcggtgccagtgactggacggtgacgatgaacgtgccgtccccggcgaaggtcctgtcgacctggaacgtcaacgccagttacccgagcgcgcagacgctgaccgccaagtccaacggcagcggcggcaactggggcgccaccatccaggccaacggcaactggacctggcccagcgtgtcctgtactgcgggctgaccgagcccggacccctcgggtgcctacccgtggacgaggcccacgggtacggaccttcggtcactcactcacccagcgaccgccccgccacccgcgccagatgccgcccgaagacctcgcgcgcctcgggtgtcagcgtccgcggccaccatcgcctgatcacgacg

SEQ ID NO: 326 - protein, 335 aa, Streptomyces lividans [sequence omitted]

SEQ ID NO: 327 - protein, 335 aa, Streptomyces lividans
MRTSTGPRASSRTLRTLASGVAVTALAAAGTVAAGAAPAQAAACNGYVGLTFDDGPSGSTQSLLNALRQNGLRATMFNQGQYAAQNPSLVRAQVDAGMWVANHSYTHPHMTQLGQAQMDSEISRTQQAIAGAGGGTPKLFRPPYGETNATLRSVEAKYGLTEVIWDVDSQDWNNASTDAIVQAVSRLGNGQVILMHDWPANTLAAIPRIAQTLAGKGLCSGMISPQTGRAVAPDGSGGGGDGGGGGGGACTATLSAGQRWGDRYNLNVSVSGASDWTVTMNVPSPAKVLSTWNVNASYPSAQTLTAKSNGSGGNWGATIQANGNWTWPSVSCTAG

SEQ ID NO: 328 - DNA, 3250 bp, Abiotrophia paraadiacens
  misc_feature (3192)..(3192): n is a, c, g, or t
ggtaccgttattattcacgatggtcggactcttcggcgacgttgtaacaacgcttagcggcgaatacaattacttcgacccagcgcttgttccgttcatgaacccacaggaaatcatcaataagttcttagcgttatctccaatggccattgcttatggtctgttaaatggattctacgaagagttcttcttccttgggttaatgacatcggtgaagaaagaacatcagtggaaggctttagcattctcaacactggttcgtttctcatttcatacgtaccaaggaatgttgtgggcaatcgttatcggagtcgtgtacggattgttctactacttcatgtacaagaaagtggtgaaaaacctattaccattcttcctcatgcacgcattggcagacatgtttggttcaaccttcatctatttgctaattgcatgggcatactaaactgtagcaaagcgcatcctgtacagggtgcgttttttgttgttgaaaagccgcaattaccatatatggtaattgcgtgttggagtggagtaaaacattgtaaaatcaagcttctttcttatgtgtgagggggagggttatggtatgatagcgctagtgatatcagtaaaagcgaggagactttcagatgtattatgtaaaaaatcaacgtaatggacaagaaatctacgatgcaacgacaaacttagccatcgaatatttcttattaaacgaaaagaaactcgatgaaccaattttgttattttatgttaacgaaaatgcgattatcatcgggaaaaaccaaaataccatcgaagaaatcaatcaagatggtgtagataaacttggcgtacaagtggttcgtcgtttctcaggcggtggagccgtgtatcacgatatgggaaatatctgcttctgcttcattacagaagatgacggcgatacttccgtgatttcggaaaattcacagaacccgtgattgaagccctccataaaatgggagcaacaggggcagagttacaaggccgtaacgaccttctcatcgacggtaagaaattctctggaaatgcgatgtactcaaacaatggccgtttaacagcgcacggaacattaatgctggatcttgatgtgagcattttgcctcaaattttacgtccaaaacaagagaaaatcgcgtcaaaaggaatcaagtccgttcgttcacgcgtgacgaatattaaaccgtacttagcgcctgaataccaagacttagatatcttacaattccgcgaagtgctcttgaaaaacatcttcaatgtggaagatacatctacgattaaagagtatgttctgacggatgaagactgggtgcgtgtagaagaattacgcagcaagtacttcaacaacccagattggaactacggaaagaatccaagaattcaaacaatcaaaacgtacaccagccggacaaatcgagttcagcttgaacgttgaaaagaatgccatcaaagacattaagattaacggagacttcttcggtcttggggaaatcagcgatgtagaaaaagcgcttgtgggcgtaggatacaaccgcgaagacttaacgaaagccttcgaagccatcgacatccgccgttacttcggtaatgtaacagtggacatcctggtaaacctattactaggggtagaagaataaaatataaaattcggctatagaggtcgaaggagtggagcctagcagtcatgctgggttctttttttgctttcgcgtatagtaaaagccgcggtggagcagtataatatagatgagttcaggaatccgtttttagggagaggggttgttggaaatgagtcaaaaagttagagaaattggtactatagtatttgggttcatcagtggcgtgaatgccatctatcagctactatttcgtcaagatatcgcgctgtttattgtgaatgcgatagttgctggtgctgccttttattcttggttgaatcgggataatccagaaaagctcaagaagatgaatcgcggaggggctgctattttgattttaatagtcgcttcaatcgcttttgccttaatcatgaatcattttgggtttgagcaatgggagtcgtggcaaaaattcgtcgttagattcacgtttttctttggcttagtgacggtagtgaatcgatatattaaaaaataatagtttaacggaggcgtcatatggcacttttacacgtttcatttttttcaaaaacattaatgagaaccatcccgctgtcagtctacttgcctagcgatgcggtggactttaataatcagtatctttcggaaggcccgtacaaagcgttggtgttacttcacggagtattgggcagtgaacaggactgggtcaatcagacgcgcattcttcgatacgcaaaagagaaaaatctcgccctcatcatgccttctggggaaaatcatttttacgtagaccaaccgtggaactatacgaactatggagaatttatcggagtggagcttccagaaatctcacgccgaatgtttcctatttccagaaaacgggaagacctaggcattgccgggctttcgatgggcggatacggggcgcttcgaaacggcatcaaatatcccgacacctttagcgtgattggggcgttctctagcgcgattaagaaacaggcacttccaccagaagagattccagaagcaccgttctttttaagaaaaagctttttggaggcggtcttcaaagatgaggagacctttgtggcggaaggcaatcagttgtatcatgccgtccaaacaatggagcataaggacgcgctctcgatttttatggcatgtggcactgaagattggcttttggaagacaaccgtagctacagcagctttttgaaagaacaaggagtgtcactaacgtatcaagaacacgctggtggacacgaatgggatttctgggactgggcgatgaagcagttcttagactggtggattccagaagatgccgatcaaggcgtgtctagcgggaacgtgaaatcgtaagacgagcgcgatattgttgcaagcacatcgccataatggtagaatattttgtatattagagcgatgaacaagaggagtaaaatgactttgtttatgagagagggaagacttggtgcaacttcctagcagattcatttgaaggtagcttgtgagcttactctacgaaaagaagtaatagagtacggagacngcacttcgttaccaacatcgaggcgtaatgaatttttacgcgaatattaggtggtacc

SEQ ID NO: 329 - protein, 274 aa, Abiotrophia paraadiacens
MALLHVSFFSKTLMRTIPLSVYLPSDAVDFNNQYLSEGPYKALVLLHGVLGSEQDWVNQTRILRYAKEKNLALIMPSGENHFYVDQPWNYTNYGEFIGVELPEISRRMFPISRKREDLGIAGLSMGGYGALRNGIKYPDTFSVIGAFSSAIKKQALPPEEIPEAPFFLRKSFLEAVFKDEETFVAEGNQLYHAVQTMEHKDALSIFMACGTEDWLLEDNRSYSSFLKEQGVSLTYQEHAGGHEWDFWDWAMKQFLDWWIPEDADQGVSSGNVKS

SEQ ID NO: 330 - DNA, 1067 bp, Orpinomyces sp. PC-2
aaaaattcaaaatgagaactagtgttgttattacctttttagctgctgctttaactgttatggctaagccacatgctaagccagatccaaacttccacatttacttagccttaggtcaatccaacatggaaggtcaaggtaatgttgaagctcaagatagagttgaagacaagcgtttcaaattaatcagtactgctgatgaatgtatgggtcgtgaacttggtgaatggtacccagctcttccaccaattgttaactgttatggtaacttaggtccagtcgattacttcggtcgtactcttactaagaagcttccaaaggaagttaaggttggtgtctgtgccgttgctgttgctggttgtgatattcaacttttcgaagaagaaaactacaagagttacgaaattccagattggatgcaaggtagaattgatcactacggtggtaatccattccgtcgtttagtcaatatcgccaagaaggcccaaaaggctggtgtcatcaagggtattcttcttcaccaaggtgaaaccaacaatggacaagaagactggccaaaacgtattaaggttgtctacgaaagacttcttaaggaattaaacttaaaggccgaagaagttccacttcttgctggtgaagttgttcgtgaagaatacgaaggtatgtgcagtcttcacaacactgttatcaagaagcttccagaagttatcccaactgctcacgtcatctctgctgaaggtttagatgatggaggtgatgaccttcacttcagcagtgctagctaccgtatcttaggtgaacgttatgctgacaagatgttagaacttcttaagaagccagccaagccagctgacaaaccacaaaagccacaaaagccagctaaatccgaagatgaacaagttgtttctgatgttgaagctgctgatgaagtcgattctgctgatgaagaataaatgatttcaacttaaaaatattataactacacacacatgtacagtaaatacttactaatataatataaaaaaaagaacaatgataatttaataattttatagactataaaaaaa

SEQ ID NO: 331 - protein, 313 aa, Orpinomyces sp. PC-2
MRTSVVITFLAAALTVMAKPHAKPDPNFHIYLALGQSNMEGQGNVEAQDRVEDKRFKLISTADECMGRELGEWYPALPPIVNCYGNLGPVDYFGRTLTKKLPKEVKVGVCAVAVAGCDIQLFEEENYKSYEIPDWMQGRIDHYGGNPFRRLVNIAKKAQKAGVIKGILLHQGETNNGQEDWPKRIKVVYERLLKELNLKAEEVPLLAGEVVREEYEGMCSLHNTVIKKLPEVIPTAHVISAEGLDDGGDDLHFSSASYRILGERYADKMLELLKKPAKPADKPQKPQKPAKSEDEQVVSDVEAADEVDSADEE

SEQ ID NO: 332 - DNA, 6067 bp, Caldocellum saccharolyticum
ggatccccgcaaagcctaaaataagtacatttagaatgatggcagaaaatggttatattacccttgaatttacgttaagtaaaaatgctgtggtgctttttgaggtaagcaaggttgtagatgagtcagatacttatataggacttgacgatagtaaaataccaggttattagttgctttataaaataaaaggaatgaggtgtttaattgtgtgcgaaaatttagagatgctaaacttatcattagcaaaaacatacaaagattactttaaaataggtgctgcagtaactgcgaaagatttagaaggagttcatagggatattcttttgaagcattttaatagcctcacaccagaaaatgccatgaagtttgaaaatattcatccagaagagcagagatataattttgaagaggttgccaggataaaagagtttgcaattaaaaatgacatgaagttaagaggacatacatttgtttggcataatcaaactccggggtgggtgtttttagataagaatggggaagaagcctcaaaagagttagttattgaaaggttaagagagcatataaaaactttgtgtgagagatacaaggatgtagtatatgcgtgggatgtggtgaacgaagcagtagaagataaaacagaaaagcttttgcgagaatcaaactggagaaaaattattggagatgattatattaaaattgcttttgagatagcaagagaatatgcaggagatgcaaagttattttataacgattataacaatgaaatgccttataaattagaaaaaacctacaaagttctaaaagagcttttagaaagaggtactccaatagatggaattggtatacaagcacactggaatatatgggataaaaatcttgttagtaatttaaaaaaggctatagaagtatatgcttccttaggtttagaaattcatattacagaacttgacatttcagtatttgagtttgaagataagaggactgacttgtttgaaccaaccccggaaatgcttgaactacaagcaaaagtatatgaagatgtatttgcagtttttcgagaatataaagatgtaataacttctgttacattatggggtattagcgacagacacacatggaaagataacttccctgtaaagggtcgaaaagattggcctctcttattcgacgtaaatggaaaaccaaaagaagccttgtacaggatattaagattttaaagattttttaacgaagaaaggggttcttttaatatggctatcatgcaaatcaacttttattcaaagatgttgaaaaagaacacaacaattttggccattttacccgtagataaaccagataagaaattccagaaagatgttgatagtgaaaatttgaaaaccttatatcttttgcatggttatgctggtaactacatggattggttgtgtggagcccgaattgttgaattatcaatgcgatataatgttgctgtgtttctgccatcaggtgaaaatagtttttatttagatgatgaagaaaaggaagaatattttggtgaatttgtgggaaatgaaattatagaatttacaagaagcgtttttcctattcctcaaaaaagggaaaaaacttttattggcggtttatcaatgggaggttacggtgctcttagaaatgggcttaaatataacaagaattttgtaggtataatagctttatcatcagcactaataattcataagattgcaggtattcctaaggattataggaatgcttatgcaagttataactattatagacgagtgtttggagacctaaactctttaataggtagcgataaagacataaatgccttagttactaagctaaaacaagaaaaaggtagtattccaaaaatatacatggcatgcggcagagatgactttttagttcaagaaaacagagatttatttaattttttgaaaaatgaaggtatagacgtggtttatgaggaagacgaaggtggacatgactgggatttttggaacaaatatattgcaaatgcttttgagtggatgagtaaggtttctgattaagtcttcacgtaccctgttttaagttttacaaatagatttgtggggtgaataggtttttttaacactattttattaaggaagaggatgaaaaataaaaaaagtggacaaatttcttgttaattgtaattacatgcattgcaatggttttcttttttacatcgtgtactattcagtctgctatagagcagaagaaaactgttgaggaaatcttgggaaaaataggtgagagtgaggacaaaacaaattcaagggggcaaccagcaacaatgaaagaggatgaagttgaagataatcctttaaaagatgtatataaagattatttcctggttggagcagcaattaatggctattctgttgaaactgctgctatcaatcatcctggtatggctgcaattttgaaaaaaactttaacagtacaaccctatctaatttgatgaaacaacaataccttttagattatgaagctacaaaagcaagtaaaaatggaatgccagtgtgtaaatttgacagctgcattcctgctttacaattttgtaaggaaaatggcataaaaatgagaggacatgtgttagtatggcataatcagacaccagaatggtttttccacaaagactatgatgtatcgaaaccacttgtagatgctgctactatggaacgccggttggaaagttatatcaaacaggtaattgaattttgtcaaaaaaattatcccggtgtagtctattgctgggatgttgttaacgaagctatacttgatgatggttcatggagagaaatcaataataattggtataccattatgaaagaaaagtatgtggaaaaggcattttattatgcaagaaaatatgccaaaaaagatgttgccctgttttacaatgattacaatgtttttctccctgcaaagagagaagcaatttataatcttgctcagaaacttaaagaaaaaggattgattgacgggttgggtcttcaacctacagtaggcttgaattatcctgaattagattctgatgatatagattcattcaaaacgacattagaaacatttgcaaaacttggcttacaaattcatattactgagttaaattttgaaataaagggagatgagagcaatcgtactcctgaaaatctcaaaaaacaagcagataggtattacgaaatgatgaagttattattgaaggaagatactgataatggtgggccttgcaacataacttgtgttactgtttttggtatctgtgacgattatccactatataaaaattttaagcagtgcatgtatctttgggataaaaattgcaatcctaaaccatgtttttattcatttctccaagcaggtttagactggaaagcatctttattaagcaaataagaatgaacaacacttatggagaggaggaaaataatgaaaataactattaattatggaaagagacttgggaaaataaacaaattttgggcaaaatgtgttggaagctgtcatgctacaactgcgttaagagaagactggcgaaagcaattaaaaaaatgtcgtgacgaacttggttttgagtatattcgatttcatggttggttgaatgatgatatgagtgtttgttttagaaatgatgatgggctactttcattctcattcttcaacatagattctataattgattttcttttggagataggtatgaaaccatttattgaactgagctttatgccagaagcgttagcgtcaggtacaaagacagttttccattacaaaggaaatataacaccgccgaaatcttatgaagaatggggtcagctgattgaggagttagcaaggcatcttattagcagatatgggaaaaatgaagtaagagaatggttttttgaggtatggaacgaaccaaatctaaaggatttcttctgggcaggaacaatggaagaatattttaagctttacaaatatgctgcttttgcaataaagaaagtggactctgaactaagggtaggtggaccagctactgcaatcgatgcatggatacctgaactaaaagatttttgtacaaaaaatggtgttccaatagattttatttcaacgcatcaatatccaacagatttagcattcagtacaagctcaaatatggaagaggctatggcaaaagcaaagagaggtgaattagcagagagggtaaaaaaggctttagaggaagcatatccattgcctgtttactacactgaatggaataactctccaagtcctcgagacccatatcacgacataccttacgatgctgcttttattgtaaaaacaataattgacattatagatttaccacttgggtgttattcttattggacatttacagatatctttgaagaatgtggacagagttctttaccttttcatgggggattcgggcttctaaatattcatggtataccaaaaccatcctatagagcatttcaaattttagataaactaaacggtgagaggattgagatagagtttgaagataaaagcccaaccattgattgtatagctgtccagaatgagagagagataatacttgtgatctcaaaccataatgttccgctgtctcctattgataccgaaaatataaaagttgttttaaaaggtattgagaattgccgagaagtttttgttgagagaatagatgaatataatgccaatccaaaaagagtatggcttgaaatgggcagtcctgcgtatctcaatagagaacagattgaggagttgataaaagcatcagaactaaagaaagagaaagtttcatgggggattgtgaataataatgaaattacatttgatttaagtgttttacctcactcagttgtggctgttacaattaagaatggttagtgaaatgttaagagagaaaagcaattttgtatatctcttttaatttttacctttgacacatcaaacaatctaaattaaaattaaagtatagtgttttgcatactcaacatagtataaattatataagggtaacattaataccctttttgtttttgtaagggggtgtttttgtggcaaagcacacgcaaaaaggtaaatcagctgccacagccgccgtgtcagacaaagaaaaagcaaggtttgttcctaaaaatattcaagctgagataaaagaaaagattaaagacactggtgaaaaagtagcaaaggctgagggtaaggacaaagcacttttacagttaaagctggagagcaacaaaaaggttgataagaaaaaattcaaaaaggatagaagtgttgagaggaataaaacttcattaaatagatttttaagtttagataaaattaaatccctatattcaaaagagatacataataaactttcacacatctttgaagatgcagtttctgaggtttatagaattttaatggggctaaagtatatcaaaaaggcgccaaattacaccgaaattgttctgaaggcaaagatattttcaaccttgattttgatgattgtaatattatttttaatcaacaaaatgccttctacatacaaaaaagcgtatgcagttgttttgaacaatcagattgtagggtatgtgaaggacaagactgaagcacaaaaccttcttacccagattaaaaaagaagtagaggaaagacacaatacagacagtttcattttacaaagtaagcttcaactaaagagcattgagcctggtcaatatcgtgagacaagggttgatgagctgaaaaatactatcatagaaaaggggaaggtccttgtaaaaaggtatgctatttttgttaattcaaaaccatattttgtatttgaaaatccacaaactccaaataatattcttaacaagctaaaaaaggtctattataatgacaaggcatcacaggcaaaattcttagagaaggtagaaataaaaccagtttatgtctcaccagctattaaagtagctgatgaagctactgccttaacaaagattatgtttgggaaagaccaggtaatagaatatacagtcaaggaaggagatactctttgggatcc

SEQ ID NO: 333 - protein, 342 aa, Caldocellum saccharolyticum
MRCLIVCENLEMLNLSLAKTYKDYFKIGAAVTAKDLEGVHRDILLKHFNSLTPENAMKFENIHPEEQRYNFEEVARIKEFAIKNDMKLRGHTFVWHNQTPGWVFLDKNGEEASKELVIERLREHIKTLCERYKDVVYAWDVVNEAVEDKTEKLLRESNWRKIIGDDYIKIAFEIAREYAGDAKLFYNDYNNEMPYKLEKTYKVLKELLERGTPIDGIGIQAHWNIWDKNLVSNLKKAIEVYASLGLEIHITELDISVFEFEDKRTDLFEPTPEMLELQAKVYEDVFAVFREYKDVITSVTLWGISDRHTWKDNFPVKGRKDWPLLFDVNGKPKEALYRILRF

SEQ ID NO: 334 - protein, 266 aa, Caldocellum saccharolyticum
MAIMQINFYSKMLKKNTTILAILPVDKPDKKFQKDVDSENLKTLYLLHGYAGNYMDWLCGARIVELSMRYNVAVFLPSGENSFYLDDEEKEEYFGEFVGNEIIEFTRSVFPIPQKREKTFIGGLSMGGYGALRNGLKYNKNFVGIIALSSALIIHKIAGIPKDYRNAYASYNYYRRVFGDLNSLIGSDKDINALVTKLKQEKGSIPKIYMACGRDDFLVQENRDLFNFLKNEGIDVVYEEDEGGHDWDFWNKYIANAFEWMSKVSD

SEQ ID NO: 335 - protein, 96 aa, Caldocellum saccharolyticum
MVFFFTSCTIQSAIEQKKTVEEILGKIGESEDKTNSRGQPATMKDEVEDNPLKDVYKDYFLVGAAINGYSVETAAINHPGMAAILKKTLTVQPYLI

SEQ ID NO: 336 - protein, 312 aa, Caldocellum saccharolyticum
MKQQYLLDYEATKASKNGMPVCKFDSCIPALQFCKENGIKMRGHVLVWHNQTPEWFFHKDYDVSKPLVDAATMERRLESYIKQVIEFCQKNYPGVVYCWDVVNEAILDDGSWREINNNWYTIMKEKYVEKAFYYARKYAKKDVALFYNDYNVFLPAKREAIYNLAQKLKEKGLIDGLGLQPTVGLNYPELDSDDIDSFKTTLETFAKLGLQIHITELNFEIKGDESNRTPENLKKQADRYYEMMKLLLKEDTDNGGPCNITCVTVFGICDDYPLYKNFKQCMYLWDKNCNPKPCFYSFLQAGLDWKASLLSK

SEQ ID NO: 337 - protein, 488 aa, Caldocellum saccharolyticum
MERRKIMKITINYGKRLGKINKFWAKCVGSCHATTALREDWRKQLKKCRDELGFEYIRFHGWLNDDMSVCFRNDDGLLSFSFFNIDSIIDFLLEIGMKPFIELSFMPEALASGTKTVFHYKGNITPPKSYEEWGQLIEELARHLISRYGKNEVREWFFEVWNEPNLKDFFWAGTMEEYFKLYKYAAFAIKKVDSELRVGGPATAIDAWIPELKDFCTKNGVPIDFISTHQYPTDLAFSTSSNMEEAMAKAKRGELAERVKKALEEAYPLPVYYTEWNNSPSPRDPYHDIPYDAAFIVKTIIDIIDLPLGCYSYWTFTDIFEECGQSSLPFHGGFGLLNIHGIPKPSYRAFQILDKLNGERIEIEFEDKSPTIDCIAVQNEREIILVISNHNVPLSPIDTENIKVVLKGIENCREVFVERIDEYNANPKRVWLEMGSPAYLNREQIEELIKASELKKEKVSWGIVNNNEITFDLSVLPHSVVAVTIKNG

SEQ ID NO: 338 - protein, 210 aa, Caldocellum saccharolyticum
MGLKYIKKAPNYTEIVLKAKIFSTLILMIVILFLINKMPSTYKKAYAVVLNNQIVGYVKDKTEAQNLLTQIKKEVEERHNTDSFILQSKLQLKSIEPGQYRETRVDELKNTIIEKGKVLVKRYAIFVNSKPYFVFENPQTPNNILNKLKKVYYNDKASQAKFLEKVEIKPVYVSPAIKVADEATALTKIMFGKDQVIEYTVKEGDTLWDP

SEQ ID NO: 339 - DNA, 2514 bp, Talaromyces emersonii
atgatgcgccgtctcttactgcttctgtcggccggcctcgtcgccgctgagaatggcctggatggctggctgcggtatgcgccattgcccggggccagtcgctatctgcacgatctcccctcctccatcgtcgctctcaacgcctccgagaccagtcctgtccttgtcgccggcaccgagctgcggagaggcttgcagggcatctttggcaagcacgtctccatcagccaccaggactgcaacgcctcatcgtcgatcgtcgtcggcactgttgatgaatactccaagctctgcggcagcaccgcggcgctgccggagctcgaccaggacggtttcttgctcaacaccaagggcaacaccgtccagatctcggccgtaacgagcgcggtgcgctctatggcgggcgccttcgagtatctgtccatgctggctcagggcaacttctcccaagtcgcctacgccagcaacccccgcgcgcccatccgctgggtgaaccagtgggacaatctggatggcagcatcgagcgtgggtatggtggtgcctccatcttcttcgagaacggcagcgtcgtcagtaacctgactcgcgccgcccaatacgcccgtctgctggcctccatcggcgtcaatgcggtcgtggtcaacaatgtgaacgccaacgcctccatcctgacggccgacaacatcgacggcttgggcaggatcgccgacgtcttccgcccctatggcgttcagctggccatctcgctcaactttgcttctccgaccatcattggcgggcttaacaccttcgatcccctcgatccctcggtcattgcatggtggacaaacgtcaccgacaactttacagcgcatcccgacatggccggttaccccgtcaaggccgactcggagggccagccaggcccattgacctacaaccggacgttggccaaggagccacctttttttgccaaagttttgcaaccccacgggggcatggtcatgttccgggcattggtctacaaccagctcaacgagtcggattggaaggcggaccgtgccaaggcggccgtggattttttccagggactggatggccagttcgacgacaatgtcgtcgttcagatcaaatacggccccatcgacttccaggtccgcgagccgacccctcccttgttcgcccacctgcgcaacaccagcacggccatcgagctggaggtcacgcaggagtacctggggcagcagtgccatttggtctacctgcccccgcttttggaagaccgtccttcggctttgacctccggcgtcaaccaagaaagccgtcggttggtgcgcaacatcatcacgggccaacgcttcaaccggacgctgggcggagcggcggccgtcgtcaatgtcggcaccaacaccacctggctcggaagccacctggccatgtccaatctgtatgcctacggtcgcttggcgtgggatcccgccagcgacgctgaacgcgtcctgcaggactggattcggctcacctttggtcaggaccgaagcgtcatcgacaccatcacccagatgtccatggagtcctggcccgcctatgagaactacagtggcaacctggggatccagacgttgaccgacatcttgtacacccacttcgggcccaatccggcctcccaggacaacaacggctgggggcaatggacccgtgcggatcacacgacgattggtatggatcgcaccgtgtggaacggcaccggatacacgggtcaatatccgcccgaggtggcggccatgtacgaaaacatcgacaccacgccggacgacctgctgctgtggttccaccatgtgaactacacccatcggctgcactcggggaagacggtcatccagcacttttacgacgcgcactaccgcggggccgagaccgcgcagacgttcctcaccatgtgggaggcgctcaagggcaagatcgacagtgagcggtacaacgacgtgcacttccgcctcacctaccaggccgggcattcgatcgtgtggcgagacgccatcaccaacttttacttcaatctgtccggcattcccgacgaggccgggcgcgttgaccatcacccctggcgcgtggaggcggagagcatgacgctgagcggctgcaagacgtacgccgtgagtccgttcgagacggcgttcaacacgacggccatcgtcacgagcaccaacagcactgtcggcacggcgaccaccaagctggactaccgtctgcacgtacgacctggccgtgaactgctacgacatgtacgggggcaagtccacttggcaggtgtcctcaacgaccgcaaatcggcgaatgggtcgggcaacaaggaggaacactttggccacacgccgtccatatacctggacggacattcggcgacgcgcatcaccttccgcggcgtcaagatcgggaagggcgacgagctgaagattgtgggcacgccggatggagtcgagccggcgccgttggactatgttgccgtccttccggggggcgtagtggattaa

SEQ ID NO: 340 - protein, 837 aa, Talaromyces emersonii
MMRRLLLLLSAGLVAAENGLDGWLRYAPLPGASRYLHDLPSSIVALNASETSPVLVAGTELRRGLQGIFGKHVSISHQDCNASSSIVVGTVDEYSKLCGSTAALPELDQDGFLLNTKGNTVQISAVTSAVRSMAGAFEYLSMLAQGNFSQVAYASNPRAPIRWVNQWDNLDGSIERGYGGASIFFENGSVVSNLTRAAQYARLLASIGVNAVVVNNVNANASILTADNIDGLGRIADVFRPYGVQLAISLNFASPTIIGGLNTFDPLDPSVIAWWTNVTDNFTAHPDMAGYPVKADSEGQPGPLTYNRTLAKEPPFFAKVLQPHGGMVMFRALVYNQLNESDWKADRAKAAVDFFQGLDGQFDDNVVVQIKYGPIDFQVREPTPPLFAHLRNTSTAIELEVTQEYLGQQCHLVYLPPLLEDRPSALTSGVNQESRRLVRNIITGQRFNRTLGGAAAVVNVGTNTTWLGSHLAMSNLYAYGRLAWDPASDAERVLQDWIRLTFGQDRSVIDTITQMSMESWPAYENYSGNLGIQTLTDILYTHFGPNPASQDNNGWGQWTRADHTTIGMDRTVWNGTGYTGQYPPEVAAMYENIDTTPDDLLLWFHHVNYTHRLHSGKTVIQHFYDAHYRGAETAQTFLTMWEALKGKIDSERYNDVHFRLTYQAGHSIVWRDAITNFYFNLSGIPDEAGRVDHHPWRVEAESMTLSGCKTYAVSPFETAFNTTAIVTSTNSTVGTATTKLDYRLHVRPGRELLRHVRGQVHLAGVLNDRKSANGSGNKEEHFGHTPSIYLDGHSATRITFRGVKIGKGDELKIVGTPDGVEPAPLDYVAVLPGGVVD

SEQ ID NO: 341 - DNA, 3080 bp, Aspergillus niger
aatatatcgatacttcttgcctggaacgtgacaacagtggctgtaccccggcaaaaggcttgcgagttaataaagtgccaaatgacaggcaagggagcgagtaaggcctccagtcatcttgggaaggcgccattcccgttcaggctagatcacacccgtttgggttagcgagtcccgtgacgcccactcatctcaccatgaccaggcctttcccgatcgggagggtcttgacgcttcacaaacaaacctggattcgatggtcacggagattctccgaggctaaactactaacacgggaactatcagtagaaatccaggaaagagctttccggcaaaagtcgcccttgctatgatgctgtcaaaccatacaatttaccccgagcggcaacaatagcctgaatacaaagtttagcatgaagtcctcccccgcgttcgtagcccgacaatgcggggagatcttgcagacaggccatgacgcgtgtatatatgaatgaataagagggctggtattccaggtgtctttgcgatggcatagccagaaggaacccgccaccatgagaggtttgaatctctttcaattaatactggctcttctgctgtccatggtagcagccgaggatgggtacgatggctggctccgatatgctcccgtgtcctgcgatctgcgttgtcgacaggctttaccgtctcatgttgtgttgttgaacagcaccaaaggaagcccaatcgagaccgccggacgagaattgaaagcgggattccaatcgattctttcgacgaacttgacatctcgtccatttcaatgcaatagctccacatcaattctggtggctactctggatgagtaccgccaaagatgccgggacattaatgtgcctgagctcgatcccgatggcttctggttacaatccgaaggggacacagttcggatcttaggcaaggatgccagaggagccttgtacggagcatacgaatatctagctatggtggcacagcgaaatttttctcgtgtcgcgtatgccacgagcccacatgcgccgatccgttgggtgaatcaatgggacaacatggacggaagcattgaacgaggatacggtggtgcgtcgatattcttcaaagatggcacggtggtggaagacatggctcctgttgagcaatatgctagactgcttgcatccatccggataaatgcaattgtcgtcaataatgtcaatgcgaacgcgacattactgctacccgagaatatgaaaggcctgggtcgtatagcagatgcatgtcgaccatacggcgttcaaattggcatatcgctgaactttgcttcacccgaagacttgggtggtttgaatacttatgatccactcgatccaggtgtcattgcatggtggcagaatatcactgatagtctctatacctatgtaccagacatggctgggtacctcgtcaaagccgactcagagggccagccaggtccagatacatacaatcgcacactctcacaaggggcaaatctgttcgctcgtgccctgcaaccgtatgggggtgtgcttatgtaccgtgctttcgtctatgatgacaacttgaacgaatcagactggaaggctgatcgtgctaaggcagcagtggagtatttcaaggacctggacggtcaattcgaggagaacgtcgtgatccaaataaagtacggcccgatcgacttccaagtgcgcgagcctacctcaccactttttgccaacctctaccacaccaacacagccatagagttggaggttagtcaggagtacctggggcagcaatgccatttggtgtacttacctccgctctggaagacggtcctggatttcgacttacgcgtagaccacaagccatcgatggtccgcgatatcatatccggtcagcgcttcaacagaacgctcggaggctgggcagctgtcgttaatgtgggcaccaacagaacatggctgggtagccaccttgctatgtccaatctgtacgcttacggtcgtttggcgtggagtccgacagacgaatctgagcagatcctcgaagactggactcgcctcacatttggacaaaatcaccatgtcattaacactatctccgatatgtcaatgacctcctggcctgcctatgaaaactataccggcaacctgggcatacagacactgacagacatcttgtatacccactatggtccaaatccagctacacaggataacaatggctggggtcaatggacacgtgctgatcatgattctgtcggtatggatcgcacaatacggaacggcaccggctataccggtcaatacccggaggaggttgctcgcgtatacgaatcactagaaagcacgccagatgacctagtattgtggtttcaccatgtaccatggacgcaccgtctgcactccggagtgactgttatccagcatttctacaacgctcactatgcgggcgcagaagctgcacacggattcgtcagacaatgggagtctttggaagggctcattgaccgggagcgatacgaagccatgcggtcgcgactggtctaccaggcgggacactccattgtctggcgagatgctatcaataatttctactacaacatgaccggaatcccagatgtggctggacgtgtgggtcaccatccgtggcgcattgaagccgagagtatgagattagatggataccagacgtatacggtcagtccgttcgaggctgcttctaatactacagcaattattaccacttctaattcaacgactgggacggcgaggactagcatcaaggccccatcaggagtatacgacattggggtgaactactacgatctctatggtggtcaatcgaagtggacactatctgtgggtgataaggtagtgggccaatggcttggggatatggagcataattccctaggccatacaccatctatatacttagatggtcactctgccactcggattacgttccatggggttggcattcggcagggtgatcagctgaagattgttggggaggcgaatggggtcgagcccgctcccctggattatatagtgctactgcccccaggcttagttgactga

SEQ ID NO: 342 - protein, 841 aa, Aspergillus niger
MRGLNLFQLILALLLSMVAAEDGYDGWLRYAPVSCDLRCRQALPSHVVLLNSTKGSPIETAGRELKAGFQSILSTNLTSRPFQCNSSTSILVATLDEYRQRCRDINVPELDPDGFWLQSEGDTVRILGKDARGALYGAYEYLAMVAQRNFSRVAYATSPHAPIRWVNQWDNMDGSIERGYGGASIFFKDGTVVEDMAPVEQYARLLASIRINAIVVNNVNANATLLLPENMKGLGRIADACRPYGVQIGISLNFASPEDLGGLNTYDPLDPGVIAWWQNITDSLYTYVPDMAGYLVKADSEGQPGPDTYNRTLSQGANLFARALQPYGGVLMYRAFVYDDNLNESDWKADRAKAAVEYFKDLDGQFEENVVIQIKYGPIDFQVREPTSPLFANLYHTNTAIELEVSQEYLGQQCHLVYLPPLWKTVLDFDLRVDHKPSMVRDIISGQRFNRTLGGWAAVVNVGTNRTWLGSHLAMSNLYAYGRLAWSPTDESEQILEDWTRLTFGQNHHVINTISDMSMTSWPAYENYTGNLGIQTLTDILYTHYGPNPATQDNNGWGQWTRADHDSVGMDRTIRNGTGYTGQYPEEVARVYESLESTPDDLVLWFHHVPWTHRLHSGVTVIQHFYNAHYAGAEAAHGFVRQWESLEGLIDRERYEAMRSRLVYQAGHSIVWRDAINNFYYNMTGIPDVAGRVGHHPWRIEAESMRLDGYQTYTVSPFEAASNTTAIITTSNSTTGTARTSIKAPSGVYDIGVNYYDLYGGQSKWTLSVGDKVVGQWLGDMEHNSLGHTPSIYLDGHSATRITFHGVGIRQGDQLKIVGEANGVEPAPLDYIVLLPPGLVD

SEQ ID NO: 343 - DNA, 2523 bp, Aspergillus fumigatus
atgtggagcggcattcctatattcgcgctcttatcctccatcggcattgcggccgcagagactggtctggatggttggctgcggtatgcatctgttccctgcaatggaaactgccagcgtgccctcccgtcgcacattgtgacactcaattctacacgatcgagtccggtgtatgtcgctggacaggaactccaagatggtctgcaccagatccttggaaagcatgcttccgtcaagtccaccggctgctcgaccgactcgtcgatcattgtcggcacggtcgaggcgtatcggcaggtctgcaacgctggccgccaggtaccgcaattcgacgtcgacgggttctggctcagcatcagggaaaagtcagtactgattgttggccagagtgagcgaggggctttgtacggtgcatacgagtacctttcgatgctggcgcaaggcaatttctcgcaggtctcgtatgccaccagtccgcatgcgcccatccgctgggtcaaccagtgggataacatggatggtagcatcgagcgaggctacggtggaccttcgatctttttcaaggatggcgtgattcgtcaggacctctctcgtgtccagcagtatgcccgtctgctggcttcggtacgcatcaacggcatcatcgtcaacaatgtcaatgcgaatgcctcacttctcatgccctcgaatatggacgggttggctcgaatcgccgatatcttccgtccctacgggattcgagtcggcatttctctcaacttcgcgtctccctcgactcttggcaatctcagcacctacgatcccttcgactcctccgtcatcgcttggtggggcaacgtcacggatcagctgtacgcgcgcatcccggatatggcagggtatctggtcaaagccaactccgaaggccagcccggcccaaccacatataatcgcacccttgccgacggggccaacatgtttgcacgcgccctcaagccgtacgggggtgtggtcatgttccgtgcctttgtgtacgaccaccatattagcgaagacaattggtacaacgaccgcgcgaacgcagcagtagactttttcaagccgcttgatggcaaatttgacgacaatgtggtagtgcagatcaagtacggacccattgacttccaggtccgcgagcccgcctcgcccctgtttgccaacctgtacaagaccaacacagcaatcgagttgcaagtgacgcaggagtatctcggacagcagtcacatctggtgtacttgcctccactctggcaaacgatcctggggtttgatctccgtgtcgaccagaaaccctccctggtgcgagacatcatctcgggacagcgatttgacagacccttgggcggctgggcggcagttgtcaatgtcggtaccaacagtacctggcttggcagtcatctggccatgtcgaatctgtacgcttatggtcggctggcctgggagccgacgctagattcggaggacatcgtccaggactggatccgcctcacgtttggcttggatcgccgcatcgtcgatactctcacgcaaatgtccatggagtcctggcctgcgtacgagaactactcgggcaacctcggcatccaaacgctgaccgacatcctgtacacacattacgggccgaacccagcctctcaggacggcaacggttggggccagtggacacgcgcggatcacctatccatcggaatggaccgcaccgttaaaaacgggacaaagttctcgggccagtaccccgccgaagtcgcagcgatgtacgaaaatatcgagaccacacccgacaacctgctgctctggttccaccacgtcaactacacccagcgtctgcactccggcaaaaccgtcatccagcacttctacgatgcgcattacaccggcgccgagacggctcaaaccttcgtctcacagtgggagtcgctcagagaacgcattgatgcagagcgctaccagcacgtcctcactcgcctcatctaccaagcggggcattcgatcgtctggcgtgacgccatcaacaacttctaccataatctctcggggatcgccgacgaaaagcagcgagtgggacaccacccctggcgtgtcgaagcggaggacatgcagctcgatggctacgtgccatacgccgttagtccgttcgagaccgcgtccaactacactgctatcgtcactgcatcaaatggcaccaccggaacagcgagcgctacgctggacttcaagacaggcacgtacgatttgggcatcaactactacgatatgtacgggggcaagtctcactggacggtgtatctgaatgatcgcgttgtgggacaatggcaggggaacagcgaggatgtgctgagccatacgccttcgatttatctggatggacactcggctacgcgcattaccttccgggacgtgaagatccacaagggggatcggctgaagattgtgggtaagccggatggagtggaaccggcgccgctggactatgtggtggtgctgccaccaggaattgtagattag

SEQ ID NO: 344 - protein, 840 aa, Aspergillus fumigatus
MWSGIPIFALLSSIGIAAAETGLDGWLRYASVPCNGNCQRALPSHIVTLNSTRSSPVYVAGQELQDGLHQILGKHASVKSTGCSTDSSIIVGTVEAYRQVCNAGRQVPQFDVDGFWLSIREKSVLIVGQSERGALYGAYEYLSMLAQGNFSQVSYATSPHAPIRWVNQWDNMDGSIERGYGGPSIFFKDGVIRQDLSRVQQYARLLASVRINGIIVNNVNANASLLMPSNMDGLARIADIFRPYGIRVGISLNFASPSTLGNLSTYDPFDSSVIAWWGNVTDQLYARIPDMAGYLVKANSEGQPGPTTYNRTLADGANMFARALKPYGGVVMFRAFVYDHHISEDNWYNDRANAAVDFFKPLDGKFDDNVVVQIKYGPIDFQVREPASPLFANLYKTNTAIELQVTQEYLGQQSHLVYLPPLWQTILGFDLRVDQKPSLVRDIISGQRFDRPLGGWAAVVNVGTNSTWLGSHLAMSNLYAYGRLAWEPTLDSEDIVQDWIRLTFGLDRRIVDTLTQMSMESWPAYENYSGNLGIQTLTDILYTHYGPNPASQDGNGWGQWTRADHLSIGMDRTVKNGTKFSGQYPAEVAAMYENIETTPDNLLLWFHHVNYTQRLHSGKTVIQHFYDAHYTGAETAQTFVSQWESLRERIDAERYQHVLTRLIYQAGHSIVWRDAINNFYHNLSGIADEKQRVGHHPWRVEAEDMQLDGYVPYAVSPFETASNYTAIVTASNGTTGTASATLDFKTGTYDLGINYYDMYGGKSHWTVYLNDRVVGQWQGNSEDVLSHTPSIYLDGHSATRITFRDVKIHKGDRLKIVGKPDGVEPAPLDYVVVLPPGIVD

SEQ ID NO: 345 - DNA, 5052 bp, Aspergillus niger
atgagaggcttgaatctctttcaattaatactggctcttctgctgtccatggtagcagccgaggatgggtacgatggctggctcagatatgctcccgtgtcctgcgatctgcattgtcaacaggctctaccgtctcatgttgtgttgttgaacagcaccaaaggaagcccaatcgagaccgccggacgagaattgaaagcgggattccaatcgattctttcgacgaacttgacatctcgtccatttcaatgcaatagctccgcatcaattctggtggctactctggatgagtaccgccaaagatgccgggacattaatgtgcctgagctcgatcccgatggcttctggttacaatccgaaggggacacagttcggatcttaggcaaggatgccagaggagccttgtacggagcatacgaatatctagctatggtggcacagcgaaatttttctcgtgtcgcgtatgccacgagcccacatgcgccgatccgttgggtgaatcaatgggacaacatggacggaagcattgaacgaggatacggtggtgcgtcgatattcttcaaagatggcacggtggtggaagacatggctcctgttgagcaatatgctagactgcttgcatccatccggataaatgcaattgtcgtcaataatgtcaatgcgaacgcaacactactgctacccgagaatatgaaaggcctgagtcgtatagcagatgcatgtcgaccatacggcgttcaaatcggcatatcgctgaactttgcttcacccgaagccttgggtggtttaaatacttatgatccactcgatcctggtgtcattgcatggtggcagaatatcactgatagtctctatacctatgtaccagacatggctgggtacctcgtcaaagccgactcagagggccagccaggtcctgatacatacaatcgcacactctcacaaggggcaaatctgttcgctcgtgccctgcaaccgtatgggggtgtgcttatgtaccgtgctttcgtctatgatgacaacttgaacgaatcagactggaaggctgatcgtgctaaggcagcagtggagtatttcaaggacctggacggtcaattcgaggagaacgtcgtgatccaaataaagtacggcccgatcgacttccaagtgcgcgagcctacctcaccactttttgccaacctctaccacaccaacacagccatagagttggaggttagtcaggagtacctggggcagcaatgccatttggtgtacttacctccgctctggaagacggtcctggatttcgacttacgcgtagaccacaagccatcgatggtccgcgatatcatatccggtcagcgcttcaacagaacgctcggaggctgggcagctgtcgttaatgtgggcaccaacagaacatggctgggtagccaccttgctatgtccaatctgtacgcttacggtcgtttggcgtggagtccgacagacgaatctgagcagatcctcgaagactggactcgcctcacatttggacaaaatcaccatgtcattaacactatctccgatatgtcaatgacctcctggcctgcctatgaaaactataccggcaacctgggcatacagacactgacagacatcttgtatacccactatggtccaaatccagctacacaggataacaatggctggggtcaatggacacgtgctgatcatgattctgtcggtatggatcgcacaatatggaacggcaccggctataccggtcaatacccggaggaggttgctcgcgtatacgaatcactagaaagcacgccagatgacctagtattgtggtttcaccatgtaccatggacgcaccgtctgcactccggagtgactgttatccagcatttctacaacgctcactatgcgggcgcagaagctgcacacggattcgtcagacaatgggagtctttggaagggctcattgaccgggagcgatacgaagccatgcggtcgcgactggtctaccaggcgggacactccattgtctggcgagatgctatcaataatttctactacaacatgaccggaatcccagatgtggctggacgtgtgggtcaccatccgtggcgcattgaagccgagagtatgggattagatggataccagacgtatacggtcagtccgttcgaggctgcttctaatactacagcaattattaccacttctaattcaacgactgggacggcgagaactagcatcaaggccccatcaggagtatacgacataggggtgaactactacgatctctatggcggtcaatcgaagtggacactatctgtgggtgataaggtagtgggccaatggcttggggatatggagcataattccctaggccatacaccatctatatacttgggtggtcactccgccactcggattacgtttcatggggtcggcattcggcagggtgatcagctgaagattgttggtgaggcgaatggggtcgagcccgctcccctggattatatagtgctactgcccccaggcttagttgactgaatgagaggcttgaatctctttcaattaatactggctcttctgctgtccatggtagcagccgaggatgggtacgatggctggctcagatatgctcccgtgtcctgcgatctgcattgtcaacaggctctaccgtctcatgttgtgttgttgaacagcaccaaaggaagcccaatcgagaccgccggacgagaattgaaagcgggattccaatcgattctttcgacgaacttgacatctcgtccatttcaatgcaatagctccgcatcaattctggtggctactctggatgagtaccgccaaagatgccgggacattaatgtgcctgagctcgatcccgatggcttctggttacaatccgaaggggacacagttcggatcttaggcaaggatgccagaggagccttgtacggagcatacgaatatctagctatggtggcacagcgaaatttttctcgtgtcgcgtatgccacgagcccacatgcgccgatccgttgggtgaatcaatgggacaacatggacggaagcattgaacgaggatacggtggtgcgtcgatattcttcaaagatggcacggtggtggaagacatggctcctgttgagcaatatgctagactgcttgcatccatccggataaatgcaattgtcgtcaataatgtcaatgcgaacgcaacactactgctacccgagaatatgaaaggcctgagtcgtatagcagatgcatgtcgaccatacggcgttcaaatcggcatatcgctgaactttgcttcacccgaagccttgggtggtttaaatacttatgatccactcgatcctggtgtcattgcatggtggcagaatatcactgatagtctctatacctatgtaccagacatggctgggtacctcgtcaaagccgactcagagggccagccaggtcctgatacatacaatcgcacactctcacaaggggcaaatctgttcgctcgtgccctgcaaccgtatgggggtgtgcttatgtaccgtgctttcgtctatgatgacaacttgaacgaatcagactggaaggctgatcgtgctaaggcagcagtggagtatttcaaggacctggacggtcaattcgaggagaacgtcgtgatccaaataaagtacggcccgatcgacttccaagtgcgcgagcctacctcaccactttttgccaacctctaccacaccaacacagccatagagttggaggttagtcaggagtacctggggcagcaatgccatttggtgtacttacctccgctctggaagacggtcctggatttcgacttacgcgtagaccacaagccatcgatggtccgcgatatcatatccggtcagcgcttcaacagaacgctcggaggctgggcagctgtcgttaatgtgggcaccaacagaacatggctgggtagccaccttgctatgtccaatctgtacgcttacggtcgtttggcgtggagtccgacagacgaatctgagcagatcctcgaagactggactcgcctcacatttggacaaaatcaccatgtcattaacactatctccgatatgtcaatgacctcctggcctgcctatgaaaactataccggcaacctgggcatacagacactgacagacatcttgtatacccactatggtccaaatccagctacacaggataacaatggctggggtcaatggacacgtgctgatcatgattctgtcggtatggatcgcacaatatggaacggcaccggctataccggtcaatacccggaggaggttgctcgcgtatacgaatcactagaaagcacgccagatgacctagtattgtggtttcaccatgtaccatggacgcaccgtctgcactccggagtgactgttatccagcatttctacaacgctcactatgcgggcgcagaagctgcacacggattcgtcagacaatgggagtctttggaagggctcattgaccgggagcgatacgaagccatgcggtcgcgactggtctaccaggcgggacactccattgtctggcgagatgctatcaataatttctactacaacatgaccggaatcccagatgtggctggacgtgtgggtcaccatccgtggcgcattgaagccgagagtatgggattagatggataccagacgtatacggtcagtccgttcgaggctgcttctaatactacagcaattattaccacttctaattcaacgactgggacggcgagaactagcatcaaggccccatcaggagtatacgacataggggtgaactactacgatctctatggcggtcaatcgaagtggacactatctgtgggtgataaggtagtgggccaatggcttggggatatggagcataattccctaggccatacaccatctatatacttgggtggtcactccgccactcggattacgtttcatggggtcggcattcggcagggtgatcagctgaagattgttggtgaggcgaatggggtcgagcccgctcccctggattatatagtgctactgcccccaggcttagttgactga

SEQ ID NO: 346 - protein, 841 aa, Aspergillus niger
MRGLNLFQLILALLLSMVAAEDGYDGWLRYAPVSCDLHCQQALPSHVVLLNSTKGSPIETAGRELKAGFQSILSTNLTSRPFQCNSSASILVATLDEYRQRCRDINVPELDPDGFWLQSEGDTVRILGKDARGALYGAYEYLAMVAQRNFSRVAYATSPHAPIRWVNQWDNMDGSIERGYGGASIFFKDGTVVEDMAPVEQYARLLASIRINAIVVNNVNANATLLLPENMKGLSRIADACRPYGVQIGISLNFASPEALGGLNTYDPLDPGVIAWWQNITDSLYTYVPDMAGYLVKADSEGQPGPDTYNRTLSQGANLFARALQPYGGVLMYRAFVYDDNLNESDWKADRAKAAVEYFKDLDGQFEENVVIQIKYGPIDFQVREPTSPLFANLYHTNTAIELEVSQEYLGQQCHLVYLPPLWKTVLDFDLRVDHKPSMVRDIISGQRFNRTLGGWAAVVNVGTNRTWLGSHLAMSNLYAYGRLAWSPTDESEQILEDWTRLTFGQNHHVINTISDMSMTSWPAYENYTGNLGIQTLTDILYTHYGPNPATQDNNGWGQWTRADHDSVGMDRTIWNGTGYTGQYPEEVARVYESLESTPDDLVLWFHHVPWTHRLHSGVTVIQHFYNAHYAGAEAAHGFVRQWESLEGLIDRERYEAMRSRLVYQAGHSIVWRDAINNFYYNMTGIPDVAGRVGHHPWRIEAESMGLDGYQTYTVSPFEAASNTTAIITTSNSTTGTARTSIKAPSGVYDIGVNYYDLYGGQSKWTLSVGDKVVGQWLGDMEHNSLGHTPSIYLGGHSATRITFHGVGIRQGDQLKIVGEANGVEPAPLDYIVLLPPGLVD

SEQ ID NO: 347 - DNA, 2523 bp, Aspergillus clavatus
atgcggagcgtcatcaccaccctgacgctggttgcctctgtcggcctggcagttgcagagaatggtttcgatggctggctgcgttatgctcctgttagctgccatggagcatgccagaagtcgcttccttctcatatcgtgaccctcgaccccaccgagtcaagtccaatttccgtcgccggtcaggagatccaggatggcttgcaaagaatgttcaaaatgcacgccacggtcgagcctaaaggctgctcaactcgatcctccgtcatcatcggtactctcgatgcgtataaccatgcatgcaaggatgccgatccggtccccgagcttgaagaggatggcttctggctcaacaccaaggacggaaaggtccagatcatcggtcagagcgagcgaggagctctctacggtgcgtatgaatacctgtcgatgctctcacagggcaacttcgctccggtatcctacaccaccagcccccatgcccccattcgctgggtaaatcagtgggacaacatggatggcagcatggaacacggctacggtggcctgtctatcttcttcaaggacggtgtcattcctcaagatctctcccgagtcaagcagtatgctcgtctgctggcctcgatccgcatcaacggtatcatcgtcaacaatgtcaacgcgaatgcatcgctcctcaagcccgagaacatggacggactggcgcgcattgcggacattttccgtccctacggcgtcaaggttggcatctccctcaacttcgcctccccgtcgaccctcggcggtctcaacacctacgatcccctcgacgagtccgtcatctcctggtggggcggcatcaccgatgagctctacaagcgtgtcccggatatggctggatatctggtcaaggccaactccgagggtcagcccggccccaccacctacaaccgtaccctcgcagaaggggccaatctgtttgcccgcgctctaaagcctcacggcggcatagtcatgttccgcgccttcgtgtacgaccaccacatcagcgaggagaactggtacaacgaccgcgccaacgctgccgtggacttcttcaagccgctcgatggcaagttcgaagagaacgtggtcgtgcaaattaagtacggtcccatcgattttcaggtccgcgagcctgtctcgccccttttcgccaacctgtacaagaccaacaccgcgatcgagctgcaggtaacacaggagtacctcggacagcagtcacatctggtctacttgccgcctctctggcaaacgattctcgggttcgacctccgtgttgacggaaagccctcgccaacccgcgacatcatctcggggcagcgtttcaaccgacccctcggcggctgggccgcggtcgtcaacgtcggcaccaacaccacctggctcggaagccacctcgccctgtccaatctgtatgcctacggtcgcctcgcttgggagcccacccttgactcgcaggatatccttcaggactggatccgcatgaccttcggcctcgaccgccgtgtgcttgacacgatcacaaagatgtccatggagtcgtggcctgcatacgaaaattactcgggcaacctgggtatccagaccctgaccgacattctgtacacccactacggacccaacccggcctcccaggacggcaatggctggggccaatggacccgtgcagaccacgaggcgatcggaatggaccgcaccatcaagaacgggaccaagttcacgggccagtatcccgccgaagttgctcaggtgtacgagaacattgagacgactcccgatgacctgctgctctggttccaccatgtcccctacacccagcgtctgcagtccggcaagacggtcatccagcacttctacgacgcgcactacgccggcgctgacaccgcgcagaccttcgtctcgcagtgggagtctctccggggcaagattgaccccgagcgctatgagcatgtcctcacccgcctcatctaccaggcgggccactccatcgtctggcgcgacgccatcaacgagttctaccacaacctctctggcattgcggacgagaagcagcgggtcggtcaccacccctggcgcatcgaagcagaggacatgaagctcgatggctacgtgccctacgacgtcaacccgttcgagacggcgtccaacaccaaggccatcgtcacggcgaccaactccaccacgggcacggccagcacccagctggacttcaagaccggcaaatacgatctgggcatcaactactacgatttctacggtggcaagtcacagtggaccgcctacctcaacgaccgcctcgtgggacagtggcagggcaacaacgaggatgtgctcagccatgaactctcggtgtatctggatggccactcggctacccgcatcaccttccgcgatgtgaagatccacaagggcgaccggctgaagattgtgggcaagcccgatggaatggaaccagcgcccttggattatgtggtgttgctgccacaggggattgtggattga

SEQ ID NO: 348 - protein, 840 aa, Aspergillus clavatus
MRSVITTLTLVASVGLAVAENGFDGWLRYAPVSCHGACQKSLPSHIVTLDPTESSPISVAGQEIQDGLQRMFKMHATVEPKGCSTRSSVIIGTLDAYNHACKDADPVPELEEDGFWLNTKDGKVQIIGQSERGALYGAYEYLSMLSQGNFAPVSYTTSPHAPIRWVNQWDNMDGSMEHGYGGLSIFFKDGVIPQDLSRVKQYARLLASIRINGIIVNNVNANASLLKPENMDGLARIADIFRPYGVKVGISLNFASPSTLGGLNTYDPLDESVISWWGGITDELYKRVPDMAGYLVKANSEGQPGPTTYNRTLAEGANLFARALKPHGGIVMFRAFVYDHHISEENWYNDRANAAVDFFKPLDGKFEENVVVQIKYGPIDFQVREPVSPLFANLYKTNTAIELQVTQEYLGQQSHLVYLPPLWQTILGFDLRVDGKPSPTRDIISGQRFNRPLGGWAAVVNVGTNTTWLGSHLALSNLYAYGRLAWEPTLDSQDILQDWIRMTFGLDRRVLDTITKMSMESWPAYENYSGNLGIQTLTDILYTHYGPNPASQDGNGWGQWTRADHEAIGMDRTIKNGTKFTGQYPAEVAQVYENIETTPDDLLLWFHHVPYTQRLQSGKTVIQHFYDAHYAGADTAQTFVSQWESLRGKIDPERYEHVLTRLIYQAGHSIVWRDAINEFYHNLSGIADEKQRVGHHPWRIEAEDMKLDGYVPYDVNPFETASNTKAIVTATNSTTGTASTQLDFKTGKYDLGINYYDFYGGKSQWTAYLNDRLVGQWQGNNEDVLSHELSVYLDGHSATRITFRDVKIHKGDRLKIVGKPDGMEPAPLDYVVLLPQGIVD

SEQ ID NO: 349 - DNA, 2523 bp, Neosartorya fischeri
atgtggagcggcattcctgtattcgcgctcttatcctccatcggcattgcggccgcagagaatggtctggatggctggctacggtatgcatccgttccctgcaatggaaactgccagcgtgccctcccgtcgcacattgtgacgctcaattctacaaaatcgagccaggtgtatgtcgctggacaggaactccaagatggtctgcaccagatcctcggaaagcatgcttccgtcaagtccaccggctgctcgaccgactcttcgatagttgtcggcacggtcgaggcgtatcggcaggtctgcaataccggcagccaggcaccggaactcgacgtcgacgggttctggctcagcatcagaggcaaatcagtacagattgttggccagactgagcgaggggctttgtacggtgcatacgagtatctttccatgctggcgcaaggcaatttttcacaggtctcgtatgccaccagtccgcacgcgccaatccgctgggtcaaccagtgggacaacatggatggtagcattgagcgaggctacggtggaccttcgatctttttcaaggatggcgtgattcctcaggacctctctcgtgtcaagcagtatgcccgtctgctggcttcggtacgcatcaacggcatcgttgttaacaatgtcaatgcgaatgcatcacttctcatgccctcgaatatggacggattggctcgcatcgccgatgtcttccgtccctacgggatccgggtcggcatttctctcaattttgcgtctccctcgacccttggcaatctcagcacctatgatcccttcgactcctccgtcatcgcttggtggggcaacgtcacggatcagctctacgcgcgcatcccggatatggcagggtatctggtaaaagccaattccgaaggccagcccggccctaccacatataatcgcaccctcgccgacggagccaacatgtttgcacgcgccctcaagccgcacggtggtgtggtcatgttccgggcctttgtgtacgaccaccatattagcgaagacaactggtacaacgaccgcgcgaacgcagcagtagactttttcaagccgcttgatggcaaatttgacgacaatgtggtagtacagatcaagtacggacccatcgacttccaggttcgcgagcccgcctcgcccctgtttgccaacctgtacaagaccaacacagcaatcgagttgcaagtgacgcaggagtatctcggacaacaatcacatcttgtgtacttgcctccactctggcaaacgatcctgaggtttgatcttcgtgtcgaccagaagccctccccagtgcgagacatcatctccggacagcgatttgaccgacccttgggcggctgggcggcagttgtcaatgtcggcaccaacactacctggcttggcagtcatttggccatgtcgaatttatacgcttatggtcggctggcctgggagccgacgctggattcggaggacatcgtccaggactggattcgcctcacgtttggcttggatcgccgcgtactcgataccctcacgcaaatgtccatggagtcctggcctgcgtatgagaactactccggcaacctcggcatccagacgctgacagacatcctgtacacacattacgggcccaacccagcctcccaggacggcaacggttggggccagtggacacgcgcagatcacctatccatcggaatggaccgcaccgttaagaacgggacaaagttctcgggccagtaccccgccgaagtcgcggcgatgtacgagaatatcgagaccacacccgacaacctgatgctctggttccaccacgtaaactacacccagcgtctgcactccggcaaaaccgtcatccagcacttctacgacgcgcactacgacggcgccgagacggcccaaaccttcgtctcgcggtgggagtcgctcagggaacgcattgacgcggagcgctaccagcacgtcctcgcccgcctcatctaccaagcggggcattctatcgtctggcgcgacgccatcaacaacttctaccgtaatctctcgggaatcgctgacgagaaggagcgagtgggataccacccctggcgtgtcgaagcggaggatatgcagctcgatggctacgtgccgtacgccgttagtccgttcgagaccgcgtccaacttcaccgctatcgtcactgcatcgaatggcaccacgggaacagcgagcgctacgctggacttcaagacaggcacgtacgatttgggcatcaactactacgatatgtacgggggcaagtctcactggacggtgtatctgaatgatcgcgttgtgggacaatggcaaggaaacagcgaggacgtgctgagccatacgccttcgatttatctggatggacactcagctacgcgcattaccttccgagacgtgaagatccacaagggggatcggctgaagattgtgggtgagccggatggagtggaaccggcgccgttggactatgcggtagtgctgccacgcggaattgtagattag

SEQ ID NO: 350 - protein, 840 aa, Neosartorya fischeri
MWSGIPVFALLSSIGIAAAENGLDGWLRYASVPCNGNCQRALPSHIVTLNSTKSSQVYVAGQELQDGLHQILGKHASVKSTGCSTDSSIVVGTVEAYRQVCNTGSQAPELDVDGFWLSIRGKSVQIVGQTERGALYGAYEYLSMLAQGNFSQVSYATSPHAPIRWVNQWDNMDGSIERGYGGPSIFFKDGVIPQDLSRVKQYARLLASVRINGIVVNNVNANASLLMPSNMDGLARIADVFRPYGIRVGISLNFASPSTLGNLSTYDPFDSSVIAWWGNVTDQLYARIPDMAGYLVKANSEGQPGPTTYNRTLADGANMFARALKPHGGVVMFRAFVYDHHISEDNWYNDRANAAVDFFKPLDGKFDDNVVVQIKYGPIDFQVREPASPLFANLYKTNTAIELQVTQEYLGQQSHLVYLPPLWQTILRFDLRVDQKPSPVRDIISGQRFDRPLGGWAAVVNVGTNTTWLGSHLAMSNLYAYGRLAWEPTLDSEDIVQDWIRLTFGLDRRVLDTLTQMSMESWPAYENYSGNLGIQTLTDILYTHYGPNPASQDGNGWGQWTRADHLSIGMDRTVKNGTKFSGQYPAEVAAMYENIETTPDNLMLWFHHVNYTQRLHSGKTVIQHFYDAHYDGAETAQTFVSRWESLRERIDAERYQHVLARLIYQAGHSIVWRDAINNFYRNLSGIADEKERVGYHPWRVEAEDMQLDGYVPYAVSPFETASNFTAIVTASNGTTGTASATLDFKTGTYDLGINYYDMYGGKSHWTVYLNDRVVGQWQGNSEDVLSHTPSIYLDGHSATRITFRDVKIHKGDRLKIVGEPDGVEPAPLDYAVVLPRGIVD

SEQ ID NO: 351 - DNA, 3168 bp, Neosartorya fischeri
atgaccctgtccgcagtccccgactacgaaaaccagcacatattccagcgcaatcggctcaaaccaagagcatatttccttcccgagacgtctatctcgctcaatggtcgctgggactttaactatgcagcctctcccgtgagcgccccggagccatcatggtccaagggcaccaagaacgccacgtccgaaccccgccgggatttaaaccaatccagctctgacggcgcagactccgagacagcttgggctcctatcaccgttcctggccattggcaattgcaaggttatggccgtccacactacacaaacgtcatttaccctttccccgtctgtccgccatttgtgccgacggagaatcctacgggcacctatcgtcggaccttccacgtgcctgccgagtgggatgcttcgtcccaattgcggctgaggtttgacggcgttgacagcgcgtatcatgtctgggtcaatggtgtcccgattgggtattctcaagggagccgtaacccggctgaattcgatgtgtcgcaagttgttgaccgcgacggcgccaatgaactgtttgtcagagtgtatcagtggtctgatggctcgtatatcgaggaccaggaccaatggtggttgtcaggcatttttcgcgatgtgaccctgctcgcattccctggccaggcgcgcattgaagacttcttcgtgcgcaccgaactggacaaggattacgtcgacgcgacattgcgtttgtcgttggatctagctcttgcaacagcagccatcgcgcaagtgactttgagcgatccttcgaccgacagtacgctgcagtcggagaagtatttccttcaagcaaagcaggacaagctcgaagctgagctttccgtctccaacccgaggaaatggacagcagagacacccaacctctacgatctgcgcatcgctctctatgtagacggtgccaaggagcccgtgcaggcaatcaaccaccgtgtcgggttccgtcaggttgagatcaagaatggcaatatcactgtgaacggcgtgccggtgatgttccgcggcgtcaaccggcacgaccaccatccacgcttcggccgagcggttcctctgtccttcctgcgggaggacctcttgatcatgaagcggcataacgtcaatgctctccgctgctcgcactacccgtcccatccccgtctatacgagctctgcgacgagctcggcctatgggtaatggacgaggcagacctggagtgtcacggtttttacgatgccatcgctcgccccctggatatccccgagtccatggactacgaggagcgcaagaagctcacctttgaccaggcggcgcagttcaccacggacaaccccgagtggaaagatgcatatgtagaccgaatggtacagatggtgcagcgcgataagaaccattcctgtatcatcatctggtcgctcggcaatgaggcattttatggctctaaccaccaagccatgtacgactatgtcaagcaggttgaccccagtcgtccggtgcactacgagggagacatggaggccaagacggtcgacatgtactcgtatatgtatccatcagtcgagcgacttgtcggtgttgctactgcagagggagatgagtttaaaaagccaattgtgctttgtgagtatgctcacgcgatgggtaacgcgcctggtggcttggaagagtatatggaagccttccggacccaccggcgtctgcaaggagggtggatctgggagtgggcaaaccacgggctctgggacgaggagaagggatggtatggctacggtggtgactttggcgatacgcctcacgatggcaactttgtgctggacgggctgctattcagtgaccacaccccaacgcctggtatcactgaactcaagaaggcgtatgcgccggttcgtgtgtggcctggtgaggatgggactctggttgtggcgaacgactacaattttgttgggttggaaggtctccaggcttcttacaagattgaggtattgggagatagcgggcgcattattgccacaggcaatataaaacttccgtctattcctgccggccaaaaagggactatcgagctgccatctgcgcctgctacaacaactcccggggaggtgtggctcaccgtcaacttctatgaaaaagcagagacagcatgggccggaagcaactatgaagtcgcttggtaccagcagtgcctcaagtcctcatctccgcgtccctcattggctgtacccgctcaggctttgacgctctcatccacgaagacgacacacaaaatctccggcgccacattcagcctggaattctcgagagaaacaggcagtctctacgcctggacatccgacggcctctccctcctcgaccagtcctcaacatttggtgccgtctctcccggattctggcgcccaccgaccgacaacgacatgtcccatgatctccttgaatggcggcgctatgggctcgacactctcacctctcagctgcgcaggatgcacgtcgtgcaacataaccccacgagcgtagaagtcactacggagacatacatctccgcgccaattctgggctggggattcttcgcctcgaccagttataccatcgctggcaatggtgccgtaaccgtcaacgtgcacctgaagtcccacggtcccatcccagcggacctgccccggctcggcctagacgtacttctctcagacgagctagacaacacatcctggttcggcctgggacccggcgaagcctacgcagacaagaagcgcgcgcaaaaggtgggcatttacaacgctaccacggcggaactgcataccccctacgaagtgccacaggaagggggcaaccggatggacacccggtggttacgtgtgcacgacagcaggggatggggtctccgggtgactcgcgtcaaggaagagagtgataagcagccgactgagctgttccagtggcttgctacgcggtacagccccgaggctatcgaggcggccaagcatgcgcctgaactggttgctgagaaacgggtcaggttgaggctggacgtggagagctgcggtgttggaacgggagcttgtggtcctcgtacccttgacaagtaccgggttaaatgtgaggagagaaagtttggctttactctgcagcctgttttggccgagacgtgttag

SEQ ID NO: 352 - protein, 1055 aa, Neosartorya fischeri
MTLSAVPDYENQHIFQRNRLKPRAYFLPETSISLNGRWDFNYAASPVSAPEPSWSKGTKNATSEPRRDLNQSSSDGADSETAWAPITVPGHWQLQGYGRPHYTNVIYPFPVCPPFVPTENPTGTYRRTFHVPAEWDASSQLRLRFDGVDSAYHVWVNGVPIGYSQGSRNPAEFDVSQVVDRDGANELFVRVYQWSDGSYIEDQDQWWLSGIFRDVTLLAFPGQARIEDFFVRTELDKDYVDATLRLSLDLALATAAIAQVTLSDPSTDSTLQSEKYFLQAKQDKLEAELSVSNPRKWTAETPNLYDLRIALYVDGAKEPVQAINHRVGFRQVEIKNGNITVNGVPVMFRGVNRHDHHPRFGRAVPLSFLREDLLIMKRHNVNALRCSHYPSHPRLYELCDELGLWVMDEADLECHGFYDAIARPLDIPESMDYEERKKLTFDQAAQFTTDNPEWKDAYVDRMVQMVQRDKNHSCIIIWSLGNEAFYGSNHQAMYDYVKQVDPSRPVHYEGDMEAKTVDMYSYMYPSVERLVGVATAEGDEFKKPIVLCEYAHAMGNAPGGLEEYMEAFRTHRRLQGGWIWEWANHGLWDEEKGWYGYGGDFGDTPHDGNFVLDGLLFSDHTPTPGITELKKAYAPVRVWPGEDGTLVVANDYNFVGLEGLQASYKIEVLGDSGRIIATGNIKLPSIPAGQKGTIELPSAPATTTPGEVWLTVNFYEKAETAWAGSNYEVAWYQQCLKSSSPRPSLAVPAQALTLSSTKTTHKISGATFSLEFSRETGSLYAWTSDGLSLLDQSSTFGAVSPGFWRPPTDNDMSHDLLEWRRYGLDTLTSQLRRMHVVQHNPTSVEVTTETYISAPILGWGFFASTSYTIAGNGAVTVNVHLKSHGPIPADLPRLGLDVLLSDELDNTSWFGLGPGEAYADKKRAQKVGIYNATTAELHTPYEVPQEGGNRMDTRWLRVHDSRGWGLRVTRVKEESDKQPTELFQWLATRYSPEAIEAAKHAPELVAEKRVRLRLDVESCGVGTGACGPRTLDKYRVKCEERKFGFTLQPVLAETC

SEQ ID NO: 353 - DNA, 2677 bp, Aureobasidium pullulans
gatctgcatccccacatcatcgaaaagtggtattccgcctgcgttatatcgccccgcatttgtggtatataatcgatggatatatccgcgaacctgggcaaagacttttatcgcatcgatatgcaacttctcacactctttgcgctcttcgggcttgctcttgcagagactggccttgacggctggctccgatatgccgcacttccatcttcgatatcatggccatcagttccaaagcacattgtcgtcctgaatactaccgaaacaagtcctgtctacacagcaggtcaagagctacagcgcggtatccaaagcattctcggtcagaactgccgcttttcgaccaataagcctgatgaatctatcatcgtgggcacgctcgacgcatatgtcgctgcttacggcaatttcagccagtctgtgaatctcaaggaagacggcttctggctgagtacggaaaacaataccgtccagattgtcggtcaaaacgaacgaggcgccctttatggagcctttgagtacttgtcgatgctggcacaagcgaacttttccactgttgcatatgtatctaatccagacgcccccattcgatgggtcaaccagtgggacaacctcgacggcagtatcgagcgaggatacggtggcgcttcgatattcttcgctaacggcaccatcgtcaatgatctcacccgtgtggctgagtatgcgcgtctacttgcctcggtgggtatcaatgccattgtcatcaacaatgtcaatgccaacgcatctatcctctcgccacagaacatcgacggtgttggaagaatcgccgacacaatgcggccatatggcgtgcagattggtctctcactctactttgcctctcccacttctggagttcaagggcaagccaatctcaccacctttgaccctctcgaccctggagttgtgacctggtggggaaacgttaccgatcagatctatgagcgtatcccggacatggctggctaccttgtcaaagccaactccgagggacagccaggaccgatcacgtataatcgcacgcttgcagaaggagctaatctgttcgcaagagctctgcaaccacatggtggcagagtactttttagagcctttgtctataaccagttgaatgagagtgactggagagcagatcgggcgaacgccgcggtcgacttcttcaaaccactggatggcaaattcgacgacaacgttgttgtgcagatcaaatacggaccgattgatttccaagtcagagagcctgcatcgccgcttttcgcgaacttgttccataccaacacggcgattgaactggaagttactcaggaatatctgggacagcagactcatttggtatatcttccgcccctgtgggatacggtccttggcttcgatatgcgcatcgacaacgagacatcgctggttcgagacatcatagctggtagaactttcaaccgctcacttggtggctacgctgcagttgtcaatgtgggaacaaaccagacatggctcggaagtcatctctccatgtcaaacttctacgcttacggtcgactcgcatggaaccctaccgaagacactaccaagatacacgaggactggacacgcttgacatttggtcttgaccagaatgtcgttgataccattactcatatggcactggagtcctggccagcatacgaaaactacagcggcaatctcggtatccaaactttgactgacatcttgtacacccatttcgggcccaacccgcaatcacaagataacaacggctggggtcaatggacacgagccgatcacacgacgatcggtatggacaggactgtctccaacggcacaggatatagcggaacctatccgcccgaggttgcagcgatgtatgaaaatatcgagactacaccagacaatctgctgttatggttccaccacgtgaactatacccaaaagctccactcaggcaagacagtcattcaacacttctacgatgctcactatgctggcgcagacaccgctcagacattccccgagcaatggcagacgctagcaggcaagattgacagccaacgtttcgatgagcagctgtatcgactcaagtaccaagctggccattcacttgtttggagagacgccatcgtcaatttctaccacaacatctctggcattgccgacgagaacggcagagttggcaaccatccataccgcatcgaagctgagagcatgactttgaatggctacgaaccatatgctgtcagtcccttcgagacagcatcagattattatgcagtcgtcactagcgataacagtacgactggctctgtatcaactagactgcatttcccagccggtacttacgatgtcggtgtcaatttctatgacatgtatggagggatatcaaagtatgagatgttgatcaataacaagactgttgcaacttgggctggagatagcgagaactatctcggtcacacgccttcgatttacttggatggacattcagcaagaaggatcacgtttacagatgtcacagtgaaggaaggcgatacactggaaattgttgggattccaaatggcattgagcctgctccgctggactatgtggtcttcttgccgaagggaatgattgattgacgatagcagtggatgacttttaatcagcaggaatcagagatactat

SEQ ID NO: 354 - protein, 836 aa, Aureobasidium pullulans
MQLLTLFALFGLALAETGLDGWLRYAALPSSISWPSVPKHIVVLNTTETSPVYTAGQELQRGIQSILGQNCRFSTNKPDESIIVGTLDAYVAAYGNFSQSVNLKEDGFWLSTENNTVQIVGQNERGALYGAFEYLSMLAQANFSTVAYVSNPDAPIRWVNQWDNLDGSIERGYGGASIFFANGTIVNDLTRVAEYARLLASVGINAIVINNVNANASILSPQNIDGVGRIADTMRPYGVQIGLSLYFASPTSGVQGQANLTTFDPLDPGVVTWWGNVTDQIYERIPDMAGYLVKANSEGQPGPITYNRTLAEGANLFARALQPHGGRVLFRAFVYNQLNESDWRADRANAAVDFFKPLDGKFDDNVVVQIKYGPIDFQVREPASPLFANLFHTNTAIELEVTQEYLGQQTHLVYLPPLWDTVLGFDMRIDNETSLVRDIIAGRTFNRSLGGYAAVVNVGTNQTWLGSHLSMSNFYAYGRLAWNPTEDTTKIHEDWTRLTFGLDQNVVDTITHMALESWPAYENYSGNLGIQTLTDILYTHFGPNPQSQDNNGWGQWTRADHTTIGMDRTVSNGTGYSGTYPPEVAAMYENIETTPDNLLLWFHHVNYTQKLHSGKTVIQHFYDAHYAGADTAQTFPEQWQTLAGKIDSQRFDEQLYRLKYQAGHSLVWRDAIVNFYHNISGIADENGRVGNHPYRIEAESMTLNGYEPYAVSPFETASDYYAVVTSDNSTTGSVSTRLHFPAGTYDVGVNFYDMYGGISKYEMLINNKTVATWAGDSENYLGHTPSIYLDGHSARRITFTDVTVKEGDTLEIVGIPNGIEPAPLDYVVFLPKGMID

SEQ ID NO: 355 - DNA, 2728 bp, Aspergillus tubingensis
aatgcggggagatcctgcaaacaggccatgacgtgtgtatatatgatgaagaagagggctggtactccatagttctttgcgatggcatagctggaaagaaacggccactatgagaggttcaaatctctttcaattgaccctggctcttttactgtccttggtagcagccgaggatgggtacaatggttggctccgatatgctcccgtgtcctgcgatctgcattgtcgacaggctttgccgtctcatattgtgttgttgaacagcaccaaaggaagcccgatcgagactgcaggacgagaattgaaagcaggattccaatcgattctttcgacgaacttaacatttcatccatttcaatgcgatagctccgcatcaattctggtggctaccctggatgagtatcgccaaaaatgccgggacatcaacttgcccgagcttgatcccgatggcttctggttacaatccgaaggggacacagttcgcatcttaggcaacaatgccagaggagccttgtacggagcatacgaatacctcgctatggtggcacaacgaaacttctctcgtgtcgcgtacaccaccaacccacatgcgccgatccgttgggtaaatcaatgggacaacatggacggaagtattgaacgaggctacggtggcgcgtccatattcttcaaagatggcacggtggtggaagacatggctcctgttgagcaatatgctaggctgctcgcatctatacggataaacgcaattgtcgttaataatgtcaatgcgaacgcaacactactgctacccgaaaatatgaaaggcctgggtcgcatagcagatgcctgtcgaccatacggcgttcaaattggcatatcgctgaactttgcttcaccagaaagcttgggcggcctagaaacttatgatccacttgatcctggtgtcattgcatggtggcagaatatcaccgatagcctctatacctatgtaccagacatggctgggtacctcgtcaaagcagactcggagggccagccaggtccagatacatataatcgcacactctcacaaggggcgaatcttttcgcccgtgccctgcaaccacatgggggtgtgcttatgtaccgcgccttcgtctacaacgacaacttgaacgaatcggactggaaggctgatcgtgccaaggcagcagtggaatacttcaaggacctggacggtcagttctacgagaacgtcgtggtacagataaagtacggcccaatcgactttcaagtacgcgagcctacctcaccccttttcgccaacctctaccaaaccaacacagccatagagttggaggttagtcaggagtacctggggcagcaatgtcatttggtgtacctacctccgctctggaagacggtcctggattttgacttacgcgtagatcacaagccttcgatggtccgcgatatactatccggacagcgcttcaacagaacgctcgggggctgggcagctgttgttaatgtgggcactaacagaacatggctgggtagccaccttgctatgtccaatctgtacgcttatggtcgtttggcctggagtccgacagacgattctgaacagatcctcaaagactggactcgcctcacatttggacaaaatcggcaagtcatcgacactattgctgatatgcccatgacctcctggcctgcctatgaaaactatacaggcaacctgggcatacagaccctgacagatatcttgtatactcactatggcccaaacccagctacacaggataacaatggctggggtcaatggacacgtgctgatcacaattcagttggaatggaccgaacaatatcgaatggcactgggtataccggccaatatccggaggaggttgctcgcttatacgagtcactagaaactacgccagatgatctcgtcttgtggtttcaccatgtaccatggactcatcgtttgcattccgggttgacagttattcagcatttctacaacgctcactatgctggctcagaagctgcacacggctttataagacaatgggagtctttaaaaggactaattgatcgggagcgatacgaggccatgcggtcacgccttgtctaccaggcgggacactccattgtctggcgcgatgctatcaacaatttctactacaacatgaccggaattccagatgtggctggccgtgtgggtcatcatccgtggcgcattgaagctgagagtatgagattggacggataccagacgtacactgtcagtccgttcgaggccgcttctaacactacggcaattattaccacctctaattcaacgactgggacagcaagaactaccatcaaagccccttcgggagtatatgatataggggtgaactactacgatctctatggcggtcaatccaagtggacattatctgtgggtgacaaggtagtgggtcaatggcttggggatatggagcatcaatccctaggccatacaccgtctatatacttggacggtcactcggccacccggataacgtttcatggggtcgtcgtccggcagggtgatcagctgaaaattgttggcgaggcgaatggggtcgagcctgctccagtggattatgtagtgctgctaccgccaggggtggttgactgatatctacaaggtcctatgcgctatgtaattgccgaatatatatgcagatgaaacttttagtggcgttctatatcattggcgttccagacaaga

SEQ ID NO: 356 - protein, 841 aa, Aspergillus tubingensis
MRGSNLFQLTLALLLSLVAAEDGYNGWLRYAPVSCDLHCRQALPSHIVLLNSTKGSPIETAGRELKAGFQSILSTNLTFHPFQCDSSASILVATLDEYRQKCRDINLPELDPDGFWLQSEGDTVRILGNNARGALYGAYEYLAMVAQRNFSRVAYTTNPHAPIRWVNQWDNMDGSIERGYGGASIFFKDGTVVEDMAPVEQYARLLASIRINAIVVNNVNANATLLLPENMKGLGRIADACRPYGVQIGISLNFASPESLGGLETYDPLDPGVIAWWQNITDSLYTYVPDMAGYLVKADSEGQPGPDTYNRTLSQGANLFARALQPHGGVLMYRAFVYNDNLNESDWKADRAKAAVEYFKDLDGQFYENVVVQIKYGPIDFQVREPTSPLFANLYQTNTAIELEVSQEYLGQQCHLVYLPPLWKTVLDFDLRVDHKPSMVRDILSGQRFNRTLGGWAAVVNVGTNRTWLGSHLAMSNLYAYGRLAWSPTDDSEQILKDWTRLTFGQNRQVIDTIADMPMTSWPAYENYTGNLGIQTLTDILYTHYGPNPATQDNNGWGQWTRADHNSVGMDRTISNGTGYTGQYPEEVARLYESLETTPDDLVLWFHHVPWTHRLHSGLTVIQHFYNAHYAGSEAAHGFIRQWESLKGLIDRERYEAMRSRLVYQAGHSIVWRDAINNFYYNMTGIPDVAGRVGHHPWRIEAESMRLDGYQTYTVSPFEAASNTTAIITTSNSTTGTARTTIKAPSGVYDIGVNYYDLYGGQSKWTLSVGDKVVGQWLGDMEHQSLGHTPSIYLDGHSATRITFHGVVVRQGDQLKIVGEANGVEPAPVDYVVLLPPGVVD

SEQ ID NO: 357 - DNA, 2411 bp, Thermotoga maritima
gagctcatggcagaagcgacgaagatccatagagaaaatctctggatgataggaaccgtcggagaagacctttcgcctgccatagcgaagaacaacttcagaaacgtaccggaattcctcgtaacggacgatgtgttgagaactcctctgaatgccatgccgatgcagttcttcatcgaacagaaatgaatctaagcccccggcaatcgccgggggttttcagaactttcagggagggaaatgctgtggactacaggatgtgctggctggagtacagaggtttaccagctgatgtcgccggaaaactcaaagactggttttcaagtgtttccattctggaacccggttcttcagttttgaaagacgagatcagaagattttctgaaagatcgattggcatcactcccagattttattccagacccttgaagaaagaaaaatacatcatggtgggacgtttggaatcccttcccatcaagcttgatgtgaatcttggtgaggaaggtttcatgctgagaacgattgagtggaatggttcgaaaattctgcttgtaactggcgaaacaaagaaggcgcttgtttacgggatttttgatttgatgaagagaataagacttggtgaagatatcgagaagatgaacgtcctggcgaagccgaaagcgaaatttcgtatgcttaaccactgggacaacctcgatggaacgatcgagagaggatacgcagggaactccatttttttcaaagacaacagaattatcataaatcagagaacgaaagactacgccagacttttagcctcaataggtataaacggtgttgttataaacaacgtgaacgtcaaaaagcgagaagtttacttgatagactctatctaccttaaaaaattgaaaaagttggctgatatcttcagagagtatggaattaagatctatctaagtataaacttcgcttctcctgtttatctgggagggctggatacggccgatcccctcgacgaaagagtggcgcgctggtggagagaaaaagcgaggggaatatacgattatattccagattttggaggatttcttgtcaaagccgattctgagttcaatcctggaccgcacatgtttggaagaacgcatgcagaaggggcaaacatgcttgcaagggctctggcaccgttcggtggagtagtaatatggagagcttttgtttacaactgcctccaggactggagagattacaagacggacagagcaaaggcggcttatgacaatttcaagcctcttgatgggcagttcgacgacaacgtgatcattcaaataaagtatggtcctatggattttcaggtgagagaacccgtcaatccgcttttcggaggaatggagaagacaaatcaaattcttgagcttcaaatcacgcaggaatacacaggtcagcagattcatctgtgttttttaggaaccctctggaaggagatactggaattcgacacgtttgcgaagggtgagggttcttacgtgaagagaatcgtggatggaactctctttgaccgtgaaaacaacggttttgccggagtatcaaacgttggtgacagtgtgaactggacgggccacgatctcgctcaggcgaatttatacgcgttcggaagacttgcgtggaatcccgatgaagaaatcgaaaggatagttgaagaatggataaaactcactttcggcgatgacgagaaggttctggaaaatgtttcatacatgttgatgaaatcccacaggacgtatgagaaatacaccactccgttcgggttgggatggatggtgaatcctggtcaccactacggtccaaatccggagggatacgaatattcgaaatggggtacttaccacagagccaactgggaagcgatcggtgtcgatagaacttccagaggcactggttacacccttcaataccattcaccgtggaaagagatatacgatgatatcaacacgtgtcccgaggatcttcttcttttcttccacagggtacgatacgatcatcgtttgaaatccggaaagacactccttcagacgatgtacgatctccactttgaaggggtggaggaagtagaagaattcataaagaaatgggaggaactgaaagacagggtatcaccagatatttttgagagagtgaaagagcgtcttcatatgcaactcgaacacgcgaaggagtggcgtgatgtaatcaacacatacttttacaggagaacgggtatccctgatgagaagggaagaaagatatatccgtgatcagattgctcctccttcttcttgatatatgacctcccattcgaaattgtctatgtagaagtcgagtgtggcgggtttcgaagcacaaacaccgagtagatatctttcgacattgccaatatcagggacggtcgtggtacc

SEQ ID NO: 358 - protein, 674 aa, Thermotoga maritima
MDYRMCWLEYRGLPADVAGKLKDWFSSVSILEPGSSVLKDEIRRFSERSIGITPRFYSRPLKKEKYIMVGRLESLPIKLDVNLGEEGFMLRTIEWNGSKILLVTGETKKALVYGIFDLMKRIRLGEDIEKMNVLAKPKAKFRMLNHWDNLDGTIERGYAGNSIFFKDNRIIINQRTKDYARLLASIGINGVVINNVNVKKREVYLIDSIYLKKLKKLADIFREYGIKIYLSINFASPVYLGGLDTADPLDERVARWWREKARGIYDYIPDFGGFLVKADSEFNPGPHMFGRTHAEGANMLARALAPFGGVVIWRAFVYNCLQDWRDYKTDRAKAAYDNFKPLDGQFDDNVIIQIKYGPMDFQVREPVNPLFGGMEKTNQILELQITQEYTGQQIHLCFLGTLWKEILEFDTFAKGEGSYVKRIVDGTLFDRENNGFAGVSNVGDSVNWTGHDLAQANLYAFGRLAWNPDEEIERIVEEWIKLTFGDDEKVLENVSYMLMKSHRTYEKYTTPFGLGWMVNPGHHYGPNPEGYEYSKWGTYHRANWEAIGVDRTSRGTGYTLQYHSPWKEIYDDINTCPEDLLLFFHRVRYDHRLKSGKTLLQTMYDLHFEGVEEVEEFIKKWEELKDRVSPDIFERVKERLHMQLEHAKEWRDVINTYFYRRTGIPDEKGRKIYP

SEQ ID NO: 359 - DNA, 2661 bp, Trichoderma reesei
tgcctcgagccacaagcagcgcagtcatggtgatacgcagtcttcttcttctgctgctggcggccattgtgcccgtctttgctgaaagcggcatcgacgcctggttgcgatatgctcgtcttccatcatctgcgacaagagggcatctcacgtcctttccggaccgcatcgtcgtcctcaacgcctccaagaacgggcctctggcgagcgcttcgtcagagctccacaagggcatcaagggcattctgggtctagatctggatgtaagctccaggggagggaagcattgttcgacccagaagagcatcgtcatttctactctagacacgtaccagtctgcctgtggcaagctctctccgaaactgaacctcaaggaagacggatactggctgagcaccaagggcgggtcggtccagatcattggccagaacgaacgaggcgctctctacggcgcctttcaatatctgtcttacctcggccagggcgacttttcaggaaaggcgtttgcgtcgaacccaagcgcgcctgttcgatggtccaaccagtgggacaacctcaatgcggcgactgcggcccacggaagcattgaaaggggctatggagggccgtccatcttcttcgagaatggactcatcaaggaggacctctcgcgagttcccctctatggccgtctgctggcttcggtgggcctcaacggcatcgtcatcaacaacgttaatgccgatgccaatctcctcaacgagacaaatctccaaggcctcaagagaattgccgatctgttccggccgtggggcgtcaacgtcggcatctcgctcaactttgcctcgccgcaggttctcggagatctgtccacgtttgatccccttgacgactccgttatcaagtggtggacggacaagacggataggatctaccagctcgtgcctgatctcgccggctacctggtcaaggccaattccgagggccagcccgggcccctgacgtacaaccgcacgctggcagagggggccaacctttttgcaaaggccgtgcagcctcacggcggcatagtcgtcttccgggcgtttgtctacgaccagctcaacgagacggactggaaggctgaccgagcgaatgccgccgtcgacttcttcaagagtctggacggccagtttgacgacaacgtcctcgtccagatcaagtacggccccattgacttccaggtccgagagcctgcgtctcccctatttgccaacttgcccaagacggccgtgtccatcgagctggaagtcacacaggagtatctcggccagcagtcgcacctggtctatctgccgccgctgtggcagacggtactgggcttcgacatgcgctacaacaaccgccagtcgtatgttcgtgatattatctccggtgaggtgtttggccacaagctcggcggatacgctggagtcatcaatgtcggcatggacgatacgtggctaggcagtcacctcgccatgtccaacatgtttgcgtatggacgacttgcctggaacccccgagcagactcccgagacattgtcgaggagtggacgcgtctgacgtttggactggatcgagacgtcgtttcgaccattgccgacatgtctctcaagtcatggcctgcgtatgaaggatacagcggcaacctcggcatccagaccctgaccgacatcctctacactcactacggtgccaatcccgcctctcaggacaacaacggctggggccagtggactcgtgccgacagcaagaccattggcatggatcgcactgtttcgaacggcacaggcaatgccgggcagtatcccaaggaagttgccgccaggtttgagcatactcaaaccacccctgacgacttgatgctgtggttccatcacgttccgtatacctttaggctgcactctggcaagtccgtcatccaacatttctacgacgctcactataccggtgctgcgacggtgcaaaggttcccggcggcgtggaagtcgctcaaaagcaagattgacaccgagagatacaacgccgtgttgtacaagctgcagtaccagactggccactcgctcgtttggcgtgatgccattaccgagttttatcgaaacctgtcgagcattccggaccagctcaaccgcgtccggaaccatccgcatcggatcgaagccgaagacatggacctctcgggcttcacggtcgtcaatgtctctcctaccgagtgcgcgtccaagtacaaggcgattgcgaccaacggtacaggcacggccacgacgaggctgaacgtcccgagcggaaagtatacggttgctgtcaattactacgacgtgatcaatgggaccgccagctacgatgtgctgctgaatggcaagtcgctcggcaagtggaagggcgactcggaaactcatcttgggcacgacttcagcacgtttctagactgccattcggcgatccgtatcacgtttgagggggtaaggatctcgagaggagataagctgaccatcagggggacgggcaatgctcaggagcaggcggcgatagactatgtgtctatcctacctcagggggtggtggattagttgtatatcggaaaatttgcttttgaacatggagggcaaatcttaagaaattgcaactataattactttctcaaaaaaaaaaaaaaaaaaa

SEQ ID NO: 360 - protein, 847 aa, Trichoderma atraviride
MVIRSLLLLLLAAIVPVFAESGIDAWLRYARLPSSATRGHLTSFPDRIVVLNASKNGPLASASSELHKGIKGILGLDLDVSSRGGKHCSTQKSIVISTLDTYQSACGKLSPKLNLKEDGYWLSTKGGSVQIIGQNERGALYGAFQYLSYLGQGDFSGKAFASNPSAPVRWSNQWDNLNAATAAHGSIERGYGGPSIFFENGLIKEDLSRVPLYGRLLASVGLNGIVINNVNADANLLNETNLQGLKRIADLFRPWGVNVGISLNFASPQVLGDLSTFDPLDDSVIKWWTDKTDRIYQLVPDLAGYLVKANSEGQPGPLTYNRTLAEGANLFAKAVQPHGGIVVFRAFVYDQLNETDWKADRANAAVDFFKSLDGQFDDNVLVQIKYGPIDFQVREPASPLFANLPKTAVSIELEVTQEYLGQQSHLVYLPPLWQTVLGFDMRYNNRQSYVRDIISGEVFGHKLGGYAGVINVGMDDTWLGSHLAMSNMFAYGRLAWNPRADSRDIVEEWTRLTFGLDRDVVSTIADMSLKSWPAYEGYSGNLGIQTLTDILYTHYGANPASQDNNGWGQWTRADSKTIGMDRTVSNGTGNAGQYPKEVAARFEHTQTTPDDLMLWFHHVPYTFRLHSGKSVIQHFYDAHYTGAATVQRFPAAWKSLKSKIDTERYNAVLYKLQYQTGHSLVWRDAITEFYRNLSSIPDQLNRVRNHPHRIEAEDMDLSGFTVVNVSPTECASKYKAIATNGTGTATTRLNVPSGKYTVAVNYYDVINGTASYDVLLNGKSLGKWKGDSETHLGHDFSTFLDCHSAIRITFEGVRISRGDKLTIRGTGNAQEQAAIDYVSILPQGVVD

SEQ ID NO: 361 - DNA, 2473 bp, CELLVIBRIO JAPONICUS
cagtaattgatttggtgttcttgtatactagtgttatatttcaattgaccataagtctagcgactatccgataataatcaaccaggggttgagttaagttatgtccacgtttgcccggttattcctttgccttgtgttttttgccagcctgcagccagccatggcccagactgaagatggttatgatatgtggttgcgttaccaacccattgcagaccagacgttgctgaaaacctaccaaaaacagattcgtcatctgcatgtggcgggcgatagtccaaccataaacgcggctgctgctgaattacagcgaggattatcgggcttgctgaacaaaccgattgttgcgcgcgatgaaaaactcaaggactacagtctggtcattggcacccccgacaattctcccctgattgcctcactgaatctcggtgagcgtttgcaagccctgggcgctgaaggctatttgctggagcagacccgcattaacaagcgccatgtagtgattgttgcggcgaattccgacgtgggtgtgctctatggcagttttcacctgctgcgcctgatccagacgcagcacgcgttggaaaaactatcactgtccagcgccccgcgcttgcagcatcgtgttgttaaccattgggataaccttaaccgtgtggtggagcgcggttatgccggtttgtctctgtgggattggggctccttgccgaattatttagcgccgcgctataccgactatgcgcgtatcaatgcgtccctgggtattaacggtacggtgatcaataatgttaacgccgacccgcgtgtattgagtgatcaatttttgcagaaaatcgcagcactcgccgatgcgttccgcccatacggcatcaagatgtatttatccattaatttcaattcaccgcgcgcgtttggcgacgtggatacggcggatccattagacccgcgtgtacagcagtggtggaaaacccgcgcccaaaaaatttattcctatatccccgattttggcggtttcctggtgaaggctgattctgaagggcaacccggcccacagggatatggccgcgaccatgccgagggtgccaacatgctcgctgccgcactgaagccgttcggcggtgtggttttctggcgcgcctttgtgtatcacccggatattgaagatcgtttccgcggtgcctatgacgaatttatgccgttggatggcaagtttgccgataacgttatcctgcaaattaaaaatggcccgattgatttccagccgcgtgaacccttctcggcattgtttgccggtatgtcgcgcaccaatatgatgatggagttccaaattacccaggaatatttcgggtttgcgacacacctggcctatcaagggcccttgtttgaagaatccctgaaaacagaaacccatgcccggggtgagggttctaccattggcaatatcctcgaaggcaaggtgtttaaaacccgccataccggtatggccggtgtgattaatccgggcacagaccgcaactggaccgggcatccctttgtgcaatccagctggtatgcgttcgggcgcatggcctgggatcaccagatcagtgctgccaccgctgccgatgaatggttgcgtatgaccttcagcaaccagccggcatttattgaaccggtaaaacaaatgatgctggtgtcgcgcgaggccggggttaactatcgttcaccacttgggttgacgcatttgtactcacagggcgatcactatggcccggcgccctggacggatgacttaccgcgcgcagactggacggcggtttattaccatcgcgccagtaaaaccggcataggattcaatcgcaccaaaaccggctccaatgccctggcacaatatcccgagcctatcgccaaggcctggggcgatcttaatagcgtacctgaggatttaatcctgtggttccatcacctgagttgggatcaccgcatgcaatccggtcgcaacctgtggcaagaattggtgcataaatattatcaaggtgttgaacaggttcgcgccatgcagcgcacctgggaccagcaagaggcttatgtggatgcagcgcgttttgcccaggtcaaagccttattacaggtgcaggagcgcgaggctgttcgctggcggaactcctgtgtgctctatttccaatcggtagccggtagacccattcctgccaactatgagcaaccggaacacgacctggaatattacaaaatgctggcgcgtactacgtacgtgcccgaaccctggcatccggcaagctccagtcgcgtgttgaaataatccccatattctctccactggttgcgcggggctcccccttgccgtgatggcaaagccggagccccggtgttttttccgttgggtttcgcaggcgcagcgatatactggttacttatacagttttggccagatgatgacctgattccaccatgccccaggcttttttactcaccc

SEQ ID NO: 362 - protein, 732 aa, CELLVIBRIO JAPONICUS
MSTFARLFLCLVFFASLQPAMAQTEDGYDMWLRYQPIADQTLLKTYQKQIRHLHVAGDSPTINAAAAELQRGLSGLLNKPIVARDEKLKDYSLVIGTPDNSPLIASLNLGERLQALGAEGYLLEQTRINKRHVVIVAANSDVGVLYGSFHLLRLIQTQHALEKLSLSSAPRLQHRVVNHWDNLNRVVERGYAGLSLWDWGSLPNYLAPRYTDYARINASLGINGTVINNVNADPRVLSDQFLQKIAALADAFRPYGIKMYLSINFNSPRAFGDVDTADPLDPRVQQWWKTRAQKIYSYIPDFGGFLVKADSEGQPGPQGYGRDHAEGANMLAAALKPFGGVVFWRAFVYHPDIEDRFRGAYDEFMPLDGKFADNVILQIKNGPIDFQPREPFSALFAGMSRTNMMMEFQITQEYFGFATHLAYQGPLFEESLKTETHARGEGSTIGNILEGKVFKTRHTGMAGVINPGTDRNWTGHPFVQSSWYAFGRMAWDHQISAATAADEWLRMTFSNQPAFIEPVKQMMLVSREAGVNYRSPLGLTHLYSQGDHYGPAPWTDDLPRADWTAVYYHRASKTGIGFNRTKTGSNALAQYPEPIAKAWGDLNSVPEDLILWFHHLSWDHRMQSGRNLWQELVHKYYQGVEQVRAMQRTWDQQEAYVDAARFAQVKALLQVQEREAVRWRNSCVLYFQSVAGRPIPANYEQPEHDLEYYKMLARTTYVPEPWHPASSSRVLK

SEQ ID NO: 363 - DNA, 2301 bp, Cellvibrio mixtus
acagcaaattaagaaacgtttacgaggggtgtggaagtgtttaaaacctgtatcaatacctatatcaatctctatatcaataagtacggttggttgtttttcttattacccctattggccgtaagtaatgcgcatgcggaggacggttatgaaatgtggctgcgctatcagccaattagcaatgagcaacaactcaaaacctatcgcaaacaaatcacccaggttgtggcgcagggcgactcggcaactatgcaaaaagccgctgcagaattacagcgctgcttgagtggtttgttagcaaaacctattgctagcgccactaaaaatcccgcgaaaaatgcgctggtgattggaacacccaataactctacactgattgcagcgctcgggctaaatactgaactcgcggcgttgggtgatgaaggttatttaattgccgagcaaaaaattaataaacgtactgcgctggtgattgcagccaataccgatgtaggtgtgctctacggcagttttcattttttacatttgctgcaaacacagcaatcgctggataacctgaacattggcagtgcacccaaattgcagcaccgcgtagtgaatcattgggataatttaaatcgcgtggaagagcgcggttatgccgggttatcgctctgggattggggcaccttacccgaccataaatctgaacgttatgaagactacgctcgcatcaacgcctcgctcggtattaacggcacagtgttgaataatgtgaatgccgacccgcgcattttgagtgatcaatttttagaaaaaattgccgcgctggcctacgtatttcgcccctaccgcataaaaatgtatttatcaattaactacaattcaccgcccgcctttggtgatttggaaactgccgatccgctcgatccgcgcgtgcaacaatggtggaaagaacgcaccgccagagtttataaatatatcccggatcttggtggctatttggtaaaagcgaattctgaaggtcaacctggcccgcaggattacaaccgcaatcacgctgacggtgcaaatatgctcgccgctggccaaaaacctttttggttgggtgtggtgttttggcgcgcgtttgtgtacagcccggacattggtgaccgctttcgctcttacgatgaattcagaccactcgatggcaaatttgcagacaacgtaatcctgcaagtcaaaaatggccccatcgatttccaaccgcgcgaaccttattccgcattattctccgcgatggaaaaaaccaacatgatgatggagtttcaagtcacgcaagaatatttcggtttcgctacccaccttgcgtatcaaggcccactgtttgaggaatcgctgcgcaccgaaacttatgcgaagggtgaaggctcaaccatcggtaacattcttgaagggaaagtatttaaaaccaaacgcactggcatggcagcagtcatcaaccctggcaccgatcgcaattggaccggtcacccctttgtacaatccagctggtatgcctttgggcgcatggcgtgggatcacgaaatcagtgcagaaacagccgccgaagaatggctgcgtatgactttctccaacgagcagaaatttatcgacccaatgaaagagctgatgatgacctcgcgcgaagccggtgtgaattaccgctcacctttagggctgactcatctctattcacaaggcgatcactacggccctgcaccctggacggaaaattctgagcgcccggattggaccgccatttattatcaccgtgccgcaaaagacggtttgggttttaaccgcaccaataccggctccaatgctatcgcgcaatacccggcacctttggcaaaaatttatggcgatgtaaacgcagtaccggaggaattgttactctggttccaccatgtcagttgggatcacaaaatgaaatccggccgcacgctgtgggaagaattagtgcacaaatactatgaaggcgtagagcaagtgcgcgcgatgcaaaccgcgtgggatgcacaagaagcttgggtcgacgctgcgcgttttgcgcaagtgaaagccctattaaaagtacaagagcgcgatgcaattatctggcgcgactcctgtgtactctatttccaaacctactccggcaaactgatccccgccggttatgaaaaacccaaacatgatttggaatattacaaaaccctcgcacgcacccgttatgtgcctgaaccatggcatcctgctgagtccagtgggttctcaagttaattcaagtatttaaatctttcccgctgttaatcctgt

SEQ ID NO: 364 - protein, 703 aa, Cellvibrio mixtus
MWLRYQPISNEQQLKTYRKQITQVVAQGDSATMQKAAAELQRCLSGLLAKPIASATKNPAKNALVIGTPNNSTLIAALGLNTELAALGDEGYLIAEQKINKRTALVIAANTDVGVLYGSFHFLHLLQTQQSLDNLNIGSAPKLQHRVVNHWDNLNRVEERGYAGLSLWDWGTLPDHKSERYEDYARINASLGINGTVLNNVNADPRILSDQFLEKIAALAYVFRPYRIKMYLSINYNSPPAFGDLETADPLDPRVQQWWKERTARVYKYIPDLGGYLVKANSEGQPGPQDYNRNHADGANMLAAGQKPFWLGVVFWRAFVYSPDIGDRFRSYDEFRPLDGKFADNVILQVKNGPIDFQPREPYSALFSAMEKTNMMMEFQVTQEYFGFATHLAYQGPLFEESLRTETYAKGEGSTIGNILEGKVFKTKRTGMAAVINPGTDRNWTGHPFVQSSWYAFGRMAWDHEISAETAAEEWLRMTFSNEQKFIDPMKELMMTSREAGVNYRSPLGLTHLYSQGDHYGPAPWTENSERPDWTAIYYHRAAKDGLGFNRTNTGSNAIAQYPAPLAKIYGDVNAVPEELLLWFHHVSWDHKMKSGRTLWEELVHKYYEGVEQVRAMQTAWDAQEAWVDAARFAQVKALLKVQERDAIIWRDSCVLYFQTYSGKLIPAGYEKPKHDLEYYKTLARTRYVPEPWHPAESSGFSS

SEQ ID NO: 365 - DNA, 2040 bp, Bacillus stearothermophilus
atgacggcgggatacgaaccttgttggctgcggtatgagcggaaggatcaatatagtcgattacggtttgaggagattgtggcgaaaagaacatcgccaatttttcaagcagccgtggaagaactccaaaaagggcttcgttcgatgatggagattgagccgcaagtggtgcaggaagtaaatgaaacagctaattcgatttggcttgggacgcttgaagatgaagagttcgagcgaccattagagggaacgcttgttcatcctgaagggtatgtgattcgatcggatgtcgacgatggcccgttccgtatctacattattgggaaaacagatgctggtgtgttgtatggtgtctttcatttcctccgattattgcaaatgggtgagaacatcgcccaactgtccatcatcgagcagccaaaaaaccggttgcgcatgatcaatcattgggacaatatggatggcagcattgagcgtggatatgctggtcggtcgattttctttgtcgatgaccagtttgtgaaacaaaaccaacggataaaagattatgcacgattgcttgcttctgtgggtattaacgccatctccatcaacaatgtcaatgtacacaaaaccgaaacgaaactcatcaccgatcactttttgcctgacgtggcggaagtagcggatatcttccgaacctacggaatcaaaacatttttaagtatcaactacgcaagcccgattgagattggcgggcttccaacagcagatccgcttgatcccgaggtgcgatggtggtggaaggaaacggcgaaacgtatttatcaatatattcctgattttggcggctttgtagtcaaagcggattccgagtttcgtcctggtccctttacgtatgggcgcgatcacgcggaaggggcaaatatgttggcagaggcgttggcgccgtttggggggctcgtcatttggagatgttttgtttataactgccagcaggattggcgcgatcggacgaccgatcgggcaaaagccgcatatgatcactttaagccattggatggacagtttcgcgagaatgtcatcttgcaaattaaaaacggcccaatggattttcaagtaagggagccggtttctccgttatttggcgctatgccgaaaaccaatcaaatgatggaggttcaaatcactcaggaatatacaggacagcaaaaacatttatgcttcttgattccacagtggaaagaggtgcttgattttgatacgtatgccaagggaaaagggtcggaagtaaaaaaggtaattgatggatcgctatttgactatcgatacagcgggatcgcaggggtatctaatattggcagtgacccaaactggactgggcatacgttggcccaagcaaacttgtatggatttgggcggctcgcttggaatccggatttgtctgccgaagaaattgctaacgaatgggttgtgcaaacgtttggggacgattcacaagtcgtcgagacgatcagttggatgcttctatcttcgtggagaatttatgaaaactacacctctccgcttggcgtcggctggatggtgaacccagggcaccattatggtcctaatgtggatggctatgaatattcgcattgggggacgtaccattatgccgaccgcgacgggatcggtgttgaccggacggttgctacgggaacaggatatacggcgcaatactttccggaaaatgcagcgatgtatgagtcgctcgacacttgtccggatgagctgctcttgtttttccatcacgttccgtacactcatcggctgcattcaggggaaacggtcattcaacatatttacaatactcattttgaaggggttgagcaggcgaaacagctgcggaaacgatgggaacaactgaaagggaaaatcgacgaaaaacggtatcatgatgtattggaacgattgacgatccaagtggaacatgctaaagaatggcgagatgtcatcaatacgtacttttaccggaagtcaggaatagacgaccaatacgggcggaaaatttatcggtga

SEQ ID NO: 366 - protein, 679 aa, Bacillus stearothermophilus
MTAGYEPCWLRYERKDQYSRLRFEEIVAKRTSPIFQAAVEELQKGLRSMMEIEPQVVQEVNETANSIWLGTLEDEEFERPLEGTLVHPEGYVIRSDVDDGPFRIYIIGKTDAGVLYGVFHFLRLLQMGENIAQLSIIEQPKNRLRMINHWDNMDGSIERGYAGRSIFFVDDQFVKQNQRIKDYARLLASVGINAISINNVNVHKTETKLITDHFLPDVAEVADIFRTYGIKTFLSINYASPIEIGGLPTADPLDPEVRWWWKETAKRIYQYIPDFGGFVVKADSEFRPGPFTYGRDHAEGANMLAEALAPFGGLVIWRCFVYNCQQDWRDRTTDRAKAAYDHFKPLDGQFRENVILQIKNGPMDFQVREPVSPLFGAMPKTNQMMEVQITQEYTGQQKHLCFLIPQWKEVLDFDTYAKGKGSEVKKVIDGSLFDYRYSGIAGVSNIGSDPNWTGHTLAQANLYGFGRLAWNPDLSAEEIANEWVVQTFGDDSQVVETISWMLLSSWRIYENYTSPLGVGWMVNPGHHYGPNVDGYEYSHWGTYHYADRDGIGVDRTVATGTGYTAQYFPENAAMYESLDTCPDELLLFFHHVPYTHRLHSGETVIQHIYNTHFEGVEQAKQLRKRWEQLKGKIDEKRYHDVLERLTIQVEHAKEWRDVINTYFYRKSGIDDQYGRKIYR

SEQ ID NO: 367 - DNA, 2495 bp, Bacillus stearothermophilus
ggatccgaccatgagcctggtgtcagatacatgggcagaacgaggcgcagagctcacgcaaattctgctggatgccaaagtccagtttatgatgggaaaaatcgatgagaacgaatggaaacggcaagtggagaagttcaagcaatctggcggagacaaagtggctgaagaatatgcgcaagcctttgccaaagctcatgaataagtgaaattacgggatgagtggaaatcgaaatcaagctttggaggggaaatcttatggaacttgaggcgaatcatcgtcaagcagatccttgctggctgcgctatgcgcctgtggatcatccggaaaggttagcgcaataccgaaaatggtgcaaggagctggtcacgccggcaaatcccagcccgcttctggccagcgcgatcttcgagcttcatcaggggatagagtccatgctgcatatgaaacctcagtgcgtcgctgttcccgccgaagcgtactccttatgcctgggcgtcaaaggacaatcggccctgatcgatgaagcgctggccccgctggctgatgcatccgaggacagttatgtgattagaacaatctctcaggacggaaggaaacacctgcttatggcaggtgtttctgagcggggagctttatgctcagcttttcatctgctgcgcctgatgcaaatgggggaatcgatggaagtgataaatatgcaggaatctcccgataacggactgcggatgatcaatcagtgggacaagctggatggcagcattgaacgcgggtatgcggggggatctattttttacaagaacaatgagattccatcacacttgactcgcgtgcacgagtacgcccggctgctggcctcaacgggaattaacgccattgcgatcaacaatgtgaatgtgcacgagcgtgaatcttggctaatcaagctgccaatgttatcccaggtagcgagaattgcggacatctttcggaactatgggatcaccgtctttctcagcgtcaacttcgccagtccaatcgtggtgggacatctcccaaccgcagacccgctcgacgaggatgtgatcgcttggtggaaacagaccgccgctgagatttacgaggtcgttcccgatttcggcggttttctggtcaaagcggactccgagtctcgtccgggcccgttcacttacggccggaatcacgtggacggtgccaatatgctggccgaagcgctgaagccctatggcggcctggtgatttggcgatgctttgtctacaactgcttccaggattggcgcgatcgcacaaccgaccgggctaaagcagcttatgatcattttaaaccgctggatggacagttcgaggataacgtgattttgcagatcaaaaacggtccgatagattttcaggtccaggagccggtatcgccgctgtttggtaccatgccggctacgaaccaaatgctggagctgcaaattacccaggagtatacgggtcaagccagacatgtctgttatttggttccgcaatggaaggaaattctcgcgtttgatacgtatgctcaaggcgaaggatctgaagttgccaaaatcgtatccggttcgctgtatggccggaaattaggcggtgttgcggcggtttccaatatcggcgatgatcggaattggacggggcatattctggctcaagccaatctatacgggtatggacgtttggtctggaattgcaacctatcagcggagcagatcgctcgagaatggattgcgcttacgtttggcagcgggtctactcaacgaacagaggtgatcctcaacctcttgatgacctcgtggctgacttatgagcaatataccgccccgcttggcgtgggatggatggtgaatccccatcatcactatgggccgaatgtggacggatatgaatactccagatgggggacgtaccattttgcagatcgggacgggatcggggtggaccgcacggtgaagtcaggcacgggctatacggcccaatatcgtgagccgaatgcgagccgctatgaatcgctggagacgtgcccggatgaactgctgttattttttcaccatatcccttatacccatcggcagcattccggcaaaacggtgatccagcacatttatgacacccggttcgctggcgcggagcaggcgcaacagtttctggacgcttggttgacgctggaagggcagatggatgaagaagcgtttgagaacggccggagccgtcttctggaacaagcggagcatgcccgggagtggcgggatcagatcaatacgtatttttaccgtaaatccgggattccggatgagcaggggagaacaatttattaaattcatgatgcaataagaaagcgagagcagatgggatgaactcaaaaattctttttaatgagggatggacttttgccaaaagaagtgtggaaccttccgaggtccaacaaacggcaatggcaactgaggttcaagagaccctgaatcgatcggagctgcag

SEQ ID NO: 368 - protein, 691 aa, Bacillus stearothermophilus
MELEANHRQADPCWLRYAPVDHPERLAQYRKWCKELVTPANPSPLLASAIFELHQGIESMLHMKPQCVAVPAEAYSLCLGVKGQSALIDEALAPLADASEDSYVIRTISQDGRKHLLMAGVSERGALCSAFHLLRLMQMGESMEVINMQESPDNGLRMINQWDKLDGSIERGYAGGSIFYKNNEIPSHLTRVHEYARLLASTGINAIAINNVNVHERESWLIKLPMLSQVARIADIFRNYGITVFLSVNFASPIVVGHLPTADPLDEDVIAWWKQTAAEIYEVVPDFGGFLVKADSESRPGPFTYGRNHVDGANMLAEALKPYGGLVIWRCFVYNCFQDWRDRTTDRAKAAYDHFKPLDGQFEDNVILQIKNGPIDFQVQEPVSPLFGTMPATNQMLELQITQEYTGQARHVCYLVPQWKEILAFDTYAQGEGSEVAKIVSGSLYGRKLGGVAAVSNIGDDRNWTGHILAQANLYGYGRLVWNCNLSAEQIAREWIALTFGSGSTQRTEVILNLLMTSWLTYEQYTAPLGVGWMVNPHHHYGPNVDGYEYSRWGTYHFADRDGIGVDRTVKSGTGYTAQYREPNASRYESLETCPDELLLFFHHIPYTHRQHSGKTVIQHIYDTRFAGAEQAQQFLDAWLTLEGQMDEEAFENGRSRLLEQAEHAREWRDQINTYFYRKSGIPDEQGRTIY

SEQ ID NO: 369 - DNA, 1427 bp, Bacillus sp. TS-3
agatctaggatgtatggaacctatgaaggctagggatttgtgggccaaagaggatctaggattagttaacatcaactggcatttgaattaggtccccatcagtcgatattggtgaaattatccccagctgtagggaaggggttatagactttgtttttttgattcttaaagaattgagaaactatggcatgttccatctcagcaatggtttgggcttaaaacaatatgttaataaagttctgaaaataatccaaattaaaaggagactaagcaaatggttcatttccacccctttggcaatgttaacttttacgaaatggattggagtcttaagggagatttatgggctcatgatccagtcatcgcaaaagagggaagtcgatggtatgtttttcacaccgggagcggcattcaaatcaaaacatctgaagatggggttcattgggagaatatgggccgggtatttccatcgttgccggattggtgcaagcagtatgttccagaaaaagacgaagatcatttatgggcgcccgatatatgtttttataacggaatttactatctgtattattcagtctctacctttggaaaaaacacatcggtgattggattggcgaccaatcggacccttgacccgcgagatcctgactatgaatggaaagacatgggtcccgttattcattcaacggcttccgataactataatgcgatagatccgaatgtagtttttgatcaggaggggcaaccttggttaagtttcggttctttttggtcgggaattcagttgattcagctcgacactgaaacaatgaaacctgccgcgcaggccgagttgctgacgattgccagcaggggtgaggagcctaatgcgatcgaagccccttttatcgtgtgccggaacggatattattatttgtttgtatcatttgatttttgctgccgcggtattgaaagcacgtataaaatcgccgttggtaggtcaaaggacattacagggccatacgtagacaaaaatggtgtatcgatgatgcagggaggcggcacgattcttgacgcagggaacgaccgttggataggaccagggcattgcgccgtttatttctcgggggtttccgccattcttgtaaaccatgcgtacgacgctctcaaaaacggagagccaacgttgcaaatccggcctttgtattgggatgatgaagggtggccgtatttgtaaaagtttcaaaaagcgaaaaggatatttcctcgtgatgctagttgaacgttagaacttaactagccctagtgtaaccagcgaataggctaacaatatgccgtcgagggctacctcaaatccaagatcgaactcgctcggttctcggtggtactgtattggtcgaccggaatcgggaatatcgtctcaatcactttgcgttttgattggatcc

SEQ ID NO: 370 - protein, 313 aa, Bacillus sp. TS-3
MVHFHPFGNVNFYEMDWSLKGDLWAHDPVIAKEGSRWYVFHTGSGIQIKTSEDGVHWENMGRVFPSLPDWCKQYVPEKDEDHLWAPDICFYNGIYYLYYSVSTFGKNTSVIGLATNRTLDPRDPDYEWKDMGPVIHSTASDNYNAIDPNVVFDQEGQPWLSFGSFWSGIQLIQLDTETMKPAAQAELLTIASRGEEPNAIEAPFIVCRNGYYYLFVSFDFCCRGIESTYKIAVGRSKDITGPYVDKNGVSMMQGGGTILDAGNDRWIGPGHCAVYFSGVSAILVNHAYDALKNGEPTLQIRPLYWDDEGWPYL

SEQ ID NO: 371 - DNA, 1475 bp, Bacillus subtilis
ctgcaccgtgacgattatgaaaacgctgtaaaattaattacagaagtcattaagaagttagaccggcaaacggttgatgagattacgtaccaataaagatacggaggaatccgcctgttgaggcgggttctgtttttttgtctgtacaaattgtggcagagtgactacaataaagaagataccgaaaatttcctgaactagatgatatacgatacgcagctcatttgtaaggaagggaggatcaaacaatattatttgtaagcgccttctaatttaaaggaggttggaaaatgttgaaaaataaaaaaacatggaaacgtttctttcacttatctagtgccgctctggctgcaggtttgatattcacttctgctgctcccgcagaggccgcattttggggtgcatctaacgagctgcttcacgacccgactatgatcaaagaggggagctcatggtatgcgttaggaacagggcttaatgaagaacggggactgcgggttttgaagtcttcggatgctaaaaactggaccgtccaaaaatctattttcagcacaccgctatcgtggtggtccaattatgtgccgaattacgagaaaaaccagtgggcgccggatatccaatactataacggaaagtactggctgtattattcagtttcctcttttggaaacaatacatctgccatcggactggcatcctcaacgagcatcagttcggggaactgggaagacgaaggcttggtcatccgttcgacaagctccaataattataacgcgattgatccggagttgacatttgacaaggatggcaacccgtggcttgcattcggctcgttttggagcggaattaagctgacaaagcttgataaaagtacgatgaagcctacaggctcgccctattcgattgcagccaggccgaataataacggggcgctggaagctcctactcttacgtatcaaaatggctattactatttaatggtttcatttgataaatgttgtaacggggtaaacagtacgtacaaaattgcttatggaagatctaaaagcattacagggccttatcttgataaaagcgggaaaagcatgcttgatggcgggggcaccattttggattccggcaacgaccaatggaaaggccctggcggtcaggatattgtaaacggaaacattcttgttcgtcatgcctatgacgccaatgacaacggcactccgaagcttctcatcaatgatttgaattggagttcgggctggccgtcctattaaacgaaaaagccgggagatctgtccccggctttttttaaaagaaaagattgacagtctaatagtcaattactataataaagttgctcgtacaaattaatagatatcaattaatttattgtcattagtacgtatcttttgttatgtttgaaagcgttttattttatagggaaaggggcagtttacatgcttcagacaaaggattatgaattc

SEQ ID NO: 372 - protein, 324 aa, Bacillus subtilis
MLKNKKTWKRFFHLSSAALAAGLIFTSAAPAEAAFWGASNELLHDPTMIKEGSSWYALGTGLNEERGLRVLKSSDAKNWTVQKSIFSTPLSWWSNYVPNYEKNQWAPDIQYYNGKYWLYYSVSSFGNNTSAIGLASSTSISSGNWEDEGLVIRSTSSNNYNAIDPELTFDKDGNPWLAFGSFWSGIKLTKLDKSTMKPTGSPYSIAARPNNNGALEAPTLTYQNGYYYLMVSFDKCCNGVNSTYKIAYGRSKSITGPYLDKSGKSMLDGGGTILDSGNDQWKGPGGQDIVNGNILVRHAYDANDNGTPKLLINDLNWSSGWPSY

SEQ ID NO: 373 - DNA, 3151 bp, Aspergillus niger
aagcttggtcgtgtccgcggtagtactacctccgtagagactctctctggatcttctcaaaagggggtttcgtgttctggtacagactcttctagttctcgcttacggctccacccattgctgaagaaccccactcctgctgtttcccatttatgttccggtctaacgatggcttctccaccaagaaatggaagtgtgctctcctctcaaaactctccaattctggtttgatcgatgtgagcttaccaagaaagagcgaagacttccatcttgtacttacggacccgattagctatgcttcctacacgtttaaagacgattgacatatgttggcaggcgttacttgtcagatggtctctgctacgctggcgggatgtggaccagattctcttcaaagttatgccaagattcgcatgggccaatcctgaaaagcgaaaagcgcaaggaggcgcagctgagacagaatcccctttctgcgagtcacatctcgagtcccttaaggccaccgtcgagtggtgggcgataaactccgcatatctgccacctgaaaaatatcggtcaatacatctatggcctaatgagaccagtggtcagaatacgcctaaggccggaaactactcccgcaaattgctgcgacgaagacgaggggggcgtagtcataaatttgcgtgtcgtgtgcctatgataatttcttggggtccgaagagcacgctagggatgtcagaacaactaatgttgcaggattggtctccatctcatccctgtcactgacatcatattacttcctagtatatcatgttcaccattgtatagagagacgcgcccatcgcaacgcacgtgttggtgagcacctccactaaaagtgtcactgttgtctacacaccactcgtttcacgctgatgtgccgaatcatactacatgcatcggccatcggcttataccaccaggtgcctccggaattttgctgtttcaaaatgttctttgtaactccctgaaacgaccaaagtatcacggaggtagctccggacaggcggaaaacacaaccactttgtccacgaatcgacacagtagtcttccggtgggtttagttgtcgcttcatgatagtatatatagtaatagtagatctggatgcttgggataagtcatccagtggtgacagcgcctacctaaatcgtcatgtatcaactcctatcagttgcctcggttcctctgctggccagcctcgtgcatggctatgctgaccccggagcatgctcgggtgtttgtaccacccatgaccccggtttgatccggagagagtcggacggtacatacttcctcttctctacaggaaacaaaatctcctacgtctctgcatcatccatcgaaggaccatggaccagcgttgggtctatgctgccggatggatcgtccatcgacctcgatggcaacgatgatctttgggtaactatgtcccactgcaaacatgattggcctgtctgacactagcccaggccccggatgtctcctatgtagatggtctctattatgtatactacgctgtgtcgacctttggatcccaagattccgccatcggacttgcaacgtccgagacgatggaatatggctcttggacggatcatggctccactggcattgcgtcttcctcagccaagatttataatgcgatcgaccccaacctgatctacgccgatggcacctactacatcaactttgggtcgttctgggatgacatttaccaagtcccgatgaagtcgaccccaacggcagctgcctcttcctcctacaatcttgcgtatgacccgtcgggtacccatgcggaggagggttcctatatgtttcagtacggtgactactactacctcttttactcggcaggtatctgctgtggatacgatacatccatgcccgcttccggagaggagtatcatatcaaggtctgccgttcgacttcgcccacgggtgatttcgtaagtatatccgacatttagagaaaatactaagtagggaaagctaacctggtgctaaggttgactccgacggtacggcgtgcacggatggcgggggcacgatggtgctcgaaagccatggagaagtctatggccctggcggacagtaagtgattctgcagctgccccaccgatatttatgcttatcatgttttaggggtgtgtatgacgatcccaaccttggtccggttctttactaccactacatgaacaccacgattggatacgcggattctgacgcgcagtttgggtggaacacgatcgacttctctagcggatggccggttgtataagcatcttggttggcgatggaaatggtgctgcctacgagagggtctacaagttgtatataggattgcggctatgaactcggccgagatatagttagttagtaactacatagtggaatcgttagtcactaatgcagcccgcatgagtgctctgcctgaggcttcagtactgtccctcaatttctgtttctgtttttagtttaagctctgcagctgctccccacccattcatccactcatttggtgaagacattcattcttcccttcaaccactctattagagcatttccatcttctcacactgatcatcgtaatgcagattcaagatcagtttggattgagatccctactgcatgcactgtgtgcgtgacagaagctggaactggtactcgctcgatccgtgcagcgcgagtcagtcacatccgccctgcgcttcagactagcctgccaatagtgactatcacaagggccgtactaagatcgaataacagctttcctaacaacatcgcgttaacgtgttactttcctccagcttacattttgctattgaagccatatacgatcccttcgatgcgctcggtttaacttctgccacgatcacccgttcatcgaagattctgggagtctgtcggtcttcatgccagcaaagatcgactcaaatacacacagtcagcaacatctgttgcttgttacggatggtgcctattataatgcatgaataggggaccaagcaattctccgctgtcggcgatgttgaattaaggagggataatatttgatcgaatgacaaagggaagaattgtgcgacacgagggaaccttatacttgtctacggcctagcagcaaagctt

SEQ ID NO: 374 - protein, 321 aa, Aspergillus niger
MYQLLSVASVPLLASLVHGYADPGACSGVCTTHDPGLIRRESDGTYFLFSTGNKISYVSASSIEGPWTSVGSMLPDGSSIDLDGNDDLWAPDVSYVDGLYYVYYAVSTFGSQDSAIGLATSETMEYGSWTDHGSTGIASSSAKIYNAIDPNLIYADGTYYINFGSFWDDIYQVPMKSTPTAAASSSYNLAYDPSGTHAEEGSYMFQYGDYYYLFYSAGICCGYDTSMPASGEEYHIKVCRSTSPTGDFVDSDGTACTDGGGTMVLESHGEVYGPGGQGVYDDPNLGPVLYYHYMNTTIGYADSDAQFGWNTIDFSSGWPVV

SEQ ID NO: 375 - DNA, 1868 bp, Piromonas communis
aaaaatattaatttatataaaaattaatattaaaaaaaaaaaaaataaaattaaaatattaaatactttgtataatatataaatttttaaataataatattttttttgaaaaaaaataattattttaaaatgaaaagtatattatctcttaccttatcatttttaggattgatttctaaaatgactacaactttggctgctcctgctcctgcttctgcatggaatggtagtcacgttgctatggactttaattatcacgattccaatcaatttgaaatgtcaagctggtctaacggtggaatgtttaattgtgtctggtctccaaataatgaccgtttcgaaaatggaaaattaaaacttactattgatagaaatggttcaggatatacatgcggtgaataccgtactaaaaattactatggatttggtatgtatcaagtcaatatgaaaccaataaagaatccaggtgttgtttcatcatttttcacttacactggtccaagtgacggtactaaatgggatgaaattgatattgaattccttggatatgatactacaaaggtacaatttaactattaccctaacggtgtcggtaatcatgaacacgttcattattttggttttgatgcttttcaaggcttccccacttatggatttttttggtttagaaattccattacttggtatgttgatggtactgctgtttataccgcttactccaacattccagataccccaggtaagattatgatgaatgcatggtgtggtacaggtgtagatgattggcttcgtgcttataatggaagaactccaattagtgcttattatgactggatttcatatgatgccccccgtaactaatttaaaaaaaaaatattaataaaaaattaataataaaaaaatttaaaaaaaaaaaaaaaaaaaaaaaaaaaaaaaaaatattaatttatataaaaattaatattaaaaaaaaaaaaaataaaattaaaatattaaatactttgtataatatataaatttttaaataataatattttttttgaaaaaaaataattattttaaaatgaaaagtatattatctcttaccttatcatttttaggattgatttctaaaatgactacaactttggctgctcctgctcctgcttctgcatggaatggtagtcacgttgctatggactttaattatcacgattccaatcaatttgaaatgtcaagctggtctaacggtggaatgtttaattgtgtctggtctccaaataatgaccgtttcgaaaatggaaaattaaaacttactattgatagaaatggttcaggatatacatgcggtgaataccgtactaaaaattactatggatttggtatgtatcaagtcaatatgaaaccaataaagaatccaggtgttgtttcatcatttttcacttacactggtccaagtgacggtactaaatgggatgaaattgatattgaattccttggatatgatactacaaaggtacaatttaactattaccctaacggtgtcggtaatcatgaacacgttcattattttggttttgatgcttttcaaggcttccccacttatggatttttttggtttagaaattccattacttggtatgttgatggtactgctgtttataccgcttactccaacattccagataccccaggtaagattatgatgaatgcatggtgtggtacaggtgtagatgattggcttcgtgcttataatggaagaactccaattagtgcttattatgactggatttcatatgatgccccccgtaactaatttaaaaaaaaaatattaataaaaaattaataataaaaaaatttaaaaaaaaaaaaaaaaaaaaaaaaaaaaa

SEQ ID NO: 376 - protein, 243 aa, Piromonas communis
MKSILSLTLSFLGLISKMTTTLAAPAPASAWNGSHVAMDFNYHDSNQFEMSSWSNGGMFNCVWSPNNDRFENGKLKLTIDRNGSGYTCGEYRTKNYYGFGMYQVNMKPIKNPGVVSSFFTYTGPSDGTKWDEIDIEFLGYDTTKVQFNYYPNGVGNHEHVHYFGFDAFQGFPTYGFFWFRNSITWYVDGTAVYTAYSNIPDTPGKIMMNAWCGTGVDDWLRAYNGRTPISAYYDWISYDAPRN

SEQ ID NO: 377 - DNA, 961 bp, Neocallimastix patriciarum
gaaagaattattttattttttattttaaattaattagcaagtataattaattaatcaatagataaatataacaatcataaaagattaattatatctttttaactaaaagaaaaaaaaaatattttatttgaaataaaattaattattaaataaaacaaaaaagtaaaaaatgaaaggtttattatctattgcattattagccttaggattatcaaaaactttggctgctccagctccagctccagctccagttccagctcaaggttggaatggtaatcatgaaactatggatcttgactaccatgattcaagtagatttcaacatgccgattggtctaatggtgatatgtttaactgtcgtttcactccaaacaataaccgttttgaaaacggaaaattgaagattaccattgatggaggttggaatggatacaattgtggtgaatatcgtactacaaaatattatggttttggtatgttccaagtcaatatgaaacccattaagaatcctggtgtagtttcttctttcttcacctatactggtccaagtgatggaactaaatgggatgaaattgatattgaattccttggttatgataccactaaagtacaatttaattattacaccaatggtgttggacatcatgaacatgttcattatcttggatttgatgcttctcaaggtttccatacttatggtttcttctgggatggaaatcatattacttggtatgttgatggtagagaagtctacactgcctatgataatattccagataccccaggtaaaattatggtgaatgcttggaatggtattggagtagatgactggctcagatctttcaatggacaaactaatattagtgcctattatgattggatttcctatgatgccccaagaaattaaaaataaataatttttatgaattacaaaaaaaaaaaaaaaaaaaaaaaaaaaaaa

SEQ ID NO: 378 - protein, 245 aa, Neocallimastix patriciarum
MKGLLSIALLALGLSKTLAAPAPAPAPVPAQGWNGNHETMDLDYHDSSRFQHADWSNGDMFNCRFTPNNNRFENGKLKITIDGGWNGYNCGEYRTTKYYGFGMFQVNMKPIKNPGVVSSFFTYTGPSDGTKWDEIDIEFLGYDTTKVQFNYYTNGVGHHEHVHYLGFDASQGFHTYGFFWDGNHITWYVDGREVYTAYDNIPDTPGKIMVNAWNGIGVDDWLRSFNGQTNISAYYDWISYDAPRN

SEQ ID NO: 379 - DNA, 1063 bp, Bacillus subtilis
gaaaatggcaggattgttactgataaagcaggcaaaacctaaattacaatgagtgcggatcatctctgtctgtgctgatggtaatttaggtttttacttttttcagagggaagatgatgatagttacaggattcaagtaagtaagattcggtattatcattattttggccgatgttcccttttaaaagaatcatgtaagatcaacatagaaaacgctttcaatgaaaggggaatgccaatatgccttatctgaaacgagtgttgctgcttcttgtcactggattgtttatgagtttgtttgcagtcacttctactgcctcggctcaaacaggtggatcgttttttgacccgtttaacggctataactccggtttttggcaaaaagcagatggttattcgaatggaaatatgttcaactgcacgtggcgggctaataacgtatcaatgacgtcattgggtgaaatgcgtttagcgctaacaagcccatcttataacaagtttgactgcggggaaaaccgttctgttcaaacatatggctatggactttatgaagtcagaatgaaaccagctaaaaacacagggatcgtttcatcgttcttcacttacacaggtccaacagatggaactccttgggatgagattgatatcgaatttttaggaaaagatacaacaaaggttcaatttaactattatacaaatggtgcaggaaaccatgagaagattgtggatctcgggtttgatgcagccaatgcctatcatacgtatgcattcgattggcagccaaactctattaaatggtatgtcgatgggcaattaaaacatactgcaacaaaccaaattccgacaacacctggaaagatcatgatgaacttatggaatggcacgggtgtcgatgaatggcttggctcctacaatggtgtaaatccgctatacgctcattatgattgggtgcgctatacaaaaaaataatgccaaaggtgaaagagcctgctgcaaatatagcaggctcttatgattgtaatgagaagttgttggcgtgaatcttctattcactcataatatc

SEQ ID NO: 380 - DNA, 1153 bp, Clostridium thermocellum
gacaatctgaagtttataggatataattaaatcgaattaacgcgtgttagtggcttaaaatacagggtttgacgtttatatatatttctttgaattgttacaggagctttgctgaagtgttaatttttaccgccgctaaagtataaaaatatattttatttatattattttacgggaggtattttttatgaaaaacagggtaatttcattattaatggcttccttgcttttggttttgtcggtaattgttgctcctttttacaaagcggaagccgcaactgtggtaaatacgccttttgttgcagtgttttcgaactttgactccagtcagtgggaaaaagcggattgggcgaacggttcggtgttcaactgtgtttggaagccttcacaggtgacattttcgaacggtaaaatgattttgacccttgacagggaatatggcggttcatatccgtataaaagcggtgaatatcgtacaaaatcatttttcggatacggttattatgaagtaagaatgaaagctgccaaaaacgtaggaattgtttcatctttcttcacttatacaggaccttcggacaacaatccatgggacgaaatcgatatcgagtttttaggaaaggacacaactaaagttcagttcaactggtacaaaaatggagtcggtggaaacgagtatttgcacaatcttggattcgatgcttcccaggattttcatacatatggatttgaatggaggccggattatatagacttctatgttgacggcaaaaaagtttatcgtggaaccaggaacatacctgttactcccggcaaaattatgatgaatttgtggccaggaataggagtggatgaatggttgggacgttacgacggaagaactcctttgcaggcggagtacgaatatgtaaaatactatcctaacggtgttccgcaagataatcctactcctactcctacgattgctccttctactccgactaaccctaatttacctcttaagggagacgtaaacggcgacggtcatgttaactcatcagactattcattatttaaaagatatttgctcagggttattgatagattccctgttggagatccacaggacgggtgtggtcgccatgatcgcgtagtcgatagtggctccaagtagcga

SEQ ID NO: 381 - protein, 320 aa, Clostridium thermocellum
MKNRVISLLMASLLLVLSVIVAPFYKAEAATVVNTPFVAVFSNFDSSQWEKADWANGSVFNCVWKPSQVTFSNGKMILTLDREYGGSYPYKSGEYRTKSFFGYGYYEVRMKAAKNVGIVSSFFTYTGPSDNNPWDEIDIEFLGKDTTKVQFNWYKNGVGGNEYLHNLGFDASQDFHTYGFEWRPDYIDFYVDGKKVYRGTRNIPVTPGKIMMNLWPGIGVDEWLGRYDGRTPLQAEYEYVKYYPNGVPQDNPTPTPTIAPSTPTNPNLPLKGDVNGDGHVNSSDYSLFKRYLLRVIDRFPVGDPQDGCGRHDRVVDSGSK

SEQ ID NO: 382 - DNA, 981 bp, Streptococcus equinus
tttgaagtaacagttactgaaaagaaaaagtgaatttaactacgattgattaggcgttttcaatctgtagtagaggagattagttcctttttctgacagaactcctttttaaaatgattaaaattgaggtattattatgtggaaaaaagttagttgtttaattgttctcttattggctttctttggttttcaacaaggtgttgatgcgcaaagcaaataccactatagtcaagaactaaattactataatggtaatgccatggaacttcgtaatggttctaatggtggtatgtttaactgtaattttgtccctggaaatgtcggctttaataacggcttgatgagtcttaaaattgacagtgatggtcgtggcggctacactgggggcgaatggcgtagtaaagaacgctttggctatggtcttttccaagtaaacatgaaacctattaaaaatccaggtgtcgtttcttcattctttacttatactggaccaagtgatggtacaaaatgggatgaaatcgacattgaatttttagggaaagatacaacaaaagttcaattcaactactacacaagcggtcaaggtaatcacgaatacctttacaatttaggatttgatgcatctcaaggcttccacacttatggttttgattggcaagctgatcacattacttggtatgttgatggaagagctgtttacactgcttacaacaatattcctagcacacctggtaagattatgatgaatgcttggcctggaactcatgaagtggattcttggttgggtgcttacaatggtcgaactcctttgtatgcatattatgactggattagctacgaccaattttaataaagctagacagtaaccaaataacaatttgtttttacttaactgattataactacactccccaaataaatcggttaaaatctctctcaacaaaataactctttaaaattctttctttttaaacgttgact

SEQ ID NO: 383 - protein, 237 aa, Streptococcus equinus
MWKKVSCLIVLLLAFFGFQQGVDAQSKYHYSQELNYYNGNAMELRNGSNGGMFNCNFVPGNVGFNNGLMSLKIDSDGRGGYTGGEWRSKERFGYGLFQVNMKPIKNPGVVSSFFTYTGPSDGTKWDEIDIEFLGKDTTKVQFNYYTSGQGNHEYLYNLGFDASQGFHTYGFDWQADHITWYVDGRAVYTAYNNIPSTPGKIMMNAWPGTHEVDSWLGAYNGRTPLYAYYDWISYDQF

SEQ ID NO: 384 - DNA, 1359 bp, Bacillus subtilis
gatcatctctgtctgtgctgatggtaatttaggtttttatttttttcagagggaagatgatgatagttacaggattcaagttagtaagattcgatattatcattattttgaccgatgttcccttttaaaagaatcatgtaagatcaacatagaaaacgctttcaatgaaaggggaatgccaatatgccttatctgaaacgagtgttgctgcttcttgtcactggattgtttatgagtttgtttgcagtcactgctactgcctcagctcaaacaggtggatcgttttttgacccttttaacggctataactccggtttttggcaaaaagcagatggttattcgaatggaaatatgttcaactgcacgtggcgggctaataacgtatcaatgacgtcattgggtgaaatgcgtttagcgctaacaagcccagcttataacaagtttgactgcggggaaaaccgttctgttcaaacatatggctatggactttatgaagtcagaatgaaaccagctaaaaacacagggatcgtttcatcgttcttcacttacacaggtccaacagatggaactccttgggatgagattgatatcgaatttttaggaaaagacacaacgaaggttcaatttaactattatacaaatggtgcaggaaaccatgagaagattgttgatctcgggtttgatgcagccaatgcctatcatacgtatgcattcgattggcagccaaactctattaaatggtatgtcgacgggcaattaaaacatactgcaacaaaccaaattccgacaacacctggaaagatcatgatgaacttgtggaatggcacgggtgtcgatgaatggcttggctcctacaatggtgtaaatccgctatacgctcattatgactgggtgcgctatacaaaaaaataatgccaaatgtgaaagagcctgctgcaatatagcaggctcttatgattgtaatgagaagttgttggcatgaatcttctattcactcataatatcctatttgatcttctcccctctgtaaatcacgtactcactcaatgctacgatcaagctcatacatttagaaagaaataatcccaatcaaaagcgccgcaatggtcatcacaatcgttgttcccacggcccatttaatagtgaatttttgatggtcgccaaagctgacgcctgccattcctaccaatagataggtggaaggcacaagcgggctgagcagatgcacaggctgccccagcaaggaggccctcccgatttcagcggcgtctattccgtaagcggaagcggcttcggcgatgatgggaaggacaccgaagtaaaaggcgtcattcgacatgaaaaaggtgaagggcatgc

SEQ ID NO: 385 - protein, 242 aa, Bacillus subtilis
MPYLKRVLLLLVTGLFMSLFAVTATASAQTGGSFFDPFNGYNSGFWQKADGYSNGNMFNCTWRANNVSMTSLGEMRLALTSPAYNKFDCGENRSVQTYGYGLYEVRMKPAKNTGIVSSFFTYTGPTDGTPWDEIDIEFLGKDTTKVQFNYYTNGAGNHEKIVDLGFDAANAYHTYAFDWQPNSIKWYVDGQLKHTATNQIPTTPGKIMMNLWNGTGVDEWLGSYNGVNPLYAHYDWVRYTKK

SEQ ID NO: 386 - DNA, 1416 bp, Bacillus sp.
actcagttgtaattaagcggattcaattatgtaactcatgtttataaaaacataattgagccttacttttcctattaatcttacgatactgttttgctgaagtctaaaatagaataggataagaaaagtttgttagttttaaattataactaaattaattggcagtttgtgaataagtaaactttattaattaaattattgtagtttatttccagttgttatataattctaaatgtaagcggatacaacaacttagaatagttaacaaatagaaaattaataaaagttaggagatggttctttcacttaatttatctattctacgagattggcctagtttttttttgaaattaattaacgcgcgttagtagggagggagaaggattaatgaaaaagaaattagttttattttctatgtgtttattattgtttagcggtcttatatctggattagttcaaagtccacaagttgctgaagcagcagaaagaccaattgggactgcatttgtcgaaacatttgaatcttatgactcagaacgttggtccaaagcgggagtttggtcaaatggacaaatgtttaatgcgacatggtatccagaacaagttactttttctaatggtaagatgaagttacaaattgaaaaagaagacaatgaaactgcaagcccgccatacaaagctggagaacttcgcacaaacgatttttatcattacgggttgtttgaagtgagtatgaaacctgcaaagtcaacgggaacagtctcttcatttttcacctatactggaccttgggattgggagaatgatccatgggatgaaattgatatcgaatttttaggtaaggatactactaaaatacaatttaattattttacaaacggagtaggcggaaatgagcattaccatgaattaggatttgatgcagcagatgattttaatacgtatgcttttgagtggagaccagaatctattcgttggtttgtaaatggtgaattggttcatacagcaacagaaaatataccacaaaccccacaaaaaataatgatgaacttatggcctggtattggagtagatggatggactggtagatttaatggagaagatactcctgtagttacacagtacgattgggtgaagtatacaccacttgaggaactgggctgttacaatgagaaaaataataaatacaagaaatgtaagaaaacgaaggtaaaatagtaaatcaattgatgaagtattgtgaaacatgacagataataatgaggttgtcgcaatgggtaaacactttgtggcaacctttttattaagaaatcaattgacttttaccatatcatttctttggaatggaaaaatcagaacattctttaataatcacgcaatcatactaaaataattgctataataagggaaaatatt

SEQ ID NO: 387 - protein, 276 aa, Bacillus sp.
MKKKLVLFSMCLLLFSGLISGLVQSPQVAEAAERPIGTAFVETFESYDSERWSKAGVWSNGQMFNATWYPEQVTFSNGKMKLQIEKEDNETASPPYKAGELRTNDFYHYGLFEVSMKPAKSTGTVSSFFTYTGPWDWENDPWDEIDIEFLGKDTTKIQFNYFTNGVGGNEHYHELGFDAADDFNTYAFEWRPESIRWFVNGELVHTATENIPQTPQKIMMNLWPGIGVDGWTGRFNGEDTPVVTQYDWVKYTPLEELGCYNEKNNKYKKCKKTKVK

SEQ ID NO: 388 - DNA, 1530 bp, Clostridium thermocellum
tggatatattgaaaataatttgaattttttgcaggtcaagaatttagaatgatattcttttttatctaggcttggttttagttgacaatctgaagtttataggatataattaaatcgaattaacgcgtgttagtggcttaaaatacagggtttgacgtttatatatatttctttgaattgttacaggagctttgctgaagtgttaatttttaccgccgctaaagtataaaaatatattttatttatattattttacgggaggtattttttatgaaaaacagggtaatttcattattaatggcttccttgcttttggttttgtcggtaattgttgctcctttttacaaagcggaagccgcaactgtggtaaatacgccttttgttgcagtgttttcgaactttgactccagtcagtgggaaaaagcggattgggcgaacggttcggtgttcaactgtgtttggaagccttcacaggtgacattttcgaacggtaaaatgattttgacccttgacagggaatatggcggttcatatccgtataaaagcggtgaatatcgtacaaaatcatttttcggatacggttattatgaagtaagaatgaaagctgccaaaaacgtaggaattgtttcatctttcttcacttatacaggaccttcggacaacaatccatgggacgaaatcgatatcgagtttttaggaaaggacacaactaaagttcagttcaactggtacaaaaatggagtcggtggaaacgagtatttgcacaatcttggattcgatgcttcccaggattttcatacatatggatttgaatggaggccggattatatagacttctatgttgacggcaaaaaagtttatcgtggaaccaggaacatacctgttactcccggcaaaattatgatgaatttgtggccaggaataggagtggatgaatggttgggacgttacgacggaagaactcctttgcaggcggagtacgaatatgtaaaatactatcctaacggtgttccgcaagataatcctactcctactcctacgattgctccttctactccgactaaccctaatttacctcttaagggagacgtaaacggcgacggtcatgttaactcatcagactattcattatttaaaagatatttgctcagggttattgatagattccctgttggagatcagagtgttgctgatgtaaacagggacggaaggattgactccacagaccttacaatgttaaagagatatctgatacgggcaattccgtcactttgaaattaattcttctcaaaaccccataaataaatcaaaccccattataaaaactctgtaatttatgaaaataaattacagagtttttatataattttattaagctttttatttataagtttatgttatccaaacacttctatttatgcgccattaatgataaaatatatatgtggatagttttttggctaatcccttatatattctttttgaattgtttatacagtttagatacaaaaatggaacctgcagcatgtg

SEQ ID NO: 389 - protein, 334 aa, Clostridium thermocellum
MKNRVISLLMASLLLVLSVIVAPFYKAEAATVVNTPFVAVFSNFDSSQWEKADWANGSVFNCVWKPSQVTFSNGKMILTLDREYGGSYPYKSGEYRTKSFFGYGYYEVRMKAAKNVGIVSSFFTYTGPSDNNPWDEIDIEFLGKDTTKVQFNWYKNGVGGNEYLHNLGFDASQDFHTYGFEWRPDYIDFYVDGKKVYRGTRNIPVTPGKIMMNLWPGIGVDEWLGRYDGRTPLQAEYEYVKYYPNGVPQDNPTPTPTIAPSTPTNPNLPLKGDVNGDGHVNSSDYSLFKRYLLRVIDRFPVGDQSVADVNRDGRIDSTDLTMLKRYLIRAIPSL

SEQ ID NO: 390 - DNA, 1985 bp, Bacillus circulans
gatccgaacaaaaacgtaaaatcatcggtaacgagtttatttacgtatttgacgaagagtccaagcagtttgatgattttgcattcctggcgcaaggtacactgtacacggatatcgtggaaagtggcacagcgacagctcaaaccatcaaatcccaccagcaatgtgggcggattgcctgaggacatgaacttcaagctgatcaaaacccatttggacctaaaaggagcgtaaatttatgagaaaaaataggggattttcgtttagcagcaaggctgttatgatgtgttgtctcgcttttcttctgattccggcgagctttgctttcgccgctccaaacaagccgttccctcagcacacgacatataccagcggctcgatcaagcctaaccatgttactcaaagtgcgatggacagctctgtgaaagcgaaatgggacagctggaaatcggcttatctgaaaacggcgggcacaggcaagtattatgtaaagtatcagtccaacggggataccgtatctgaggcacacgggtacggaatgctggcaacggttataatggccggttatgacggcaatgcgcagacctatttcgacggactttatcaatattataaagcgcatccgagcgccaacaattcgaaattgatggcatggaaacaaaacagcagcttccagaacattgaaggcgccgactcggccacggatggagacatggacattgcttattcgctcctgcttgcggacaagcagtggggtagcagcggcagtatcaactaccttcaggccggcaaggacatcatcaatgccatcatgcaaagtgacgtgaatcagtctcaatggacgctgcgtcttggcgactgggcaacagacaacacgttcaaaaatgctacccgtccatcggactttatgctgaatcacttgaaggcgttccaggcggcaactggtgatgccagatgggcgaacgtgatcgacaaaacctatactattatcaactccttatacagcggctacagctcatcaaccggattacttccagacttcgtcgttctgtcgggctcgacgtacaagccggcttcagccgattttctggaaggggcaaacgacggcagctacgattacaactcatgccgcacaccttggcggatcgcaacggattacctgatgaccggtgacagccgggcgctcaatcagctcaatcaaatgaatagctggatctcagccaaagtaagcggtaaccctagcaacgtaaaggatggttataaactcaacggcacggttacaggttccggcggcagcggcgcgttctatgcaccgtttggtgtcagcgctatgacctcgtccgtgaaccaaaactggctgaattccgtctggaccaaaacggccggcagctccaatgaaggctactatgaagacagcatcaagctgttctccatgatcgtgatgtccggtaactggtggacatactaagcaacttataatccgttgattgctcatatgcaagcaggcaggtagattagtgaagtgaccccttaaagttagacaaatatttttatgcaacttgtttggcatgagctcggtattgtaccgggctcatgccttttaattttgacttgatgcgtttgtgattgtagtaatccatgtatcgttctagttcttgcttgaagtgatctacgctttcaaactcatgaagataaagaaactctgacttcataatgccaaagaagtctccattactgcgttatcgtaacaattccctttgcgtgacatgctctgggtaatcgcttgtttctttaaagcctgtcgatactgcttcatctggtagtgccagccttgatccgaatgcaggaggagctgatcttcgctggataagcgtttaaaggctttatttagcatttcggagactaatgaatacgtagggcgagaccctactgtgtaagtgataatttcactgttaaacaagtccataacagtgataaataaagct

SEQ ID NO: 391 - protein, 409 aa, Bacillus circulans
MRKNRGFSFSSKAVMMCCLAFLLIPASFAFAAPNKPFPQHTTYTSGSIKPNHVTQSAMDSSVKAKWDSWKSAYLKTAGTGKYYVKYQSNGDTVSEAHGYGMLATVIMAGYDGNAQTYFDGLYQYYKAHPSANNSKLMAWKQNSSFQNIEGADSATDGDMDIAYSLLLADKQWGSSGSINYLQAGKDIINAIMQSDVNQSQWTLRLGDWATDNTFKNATRPSDFMLNHLKAFQAATGDARWANVIDKTYTIINSLYSGYSSSTGLLPDFVVLSGSTYKPASADFLEGANDGSYDYNSCRTPWRIATDYLMTGDSRALNQLNQMNSWISAKVSGNPSNVKDGYKLNGTVTGSGGSGAFYAPFGVSAMTSSVNQNWLNSVWTKTAGSSNEGYYEDSIKLFSMIVMSGNWWTY

SEQ ID NO: 392 - DNA, 988 bp, Anaeromyces sp.  W-98
ggggaaaaatattaatttaaataaaaattaatattaaaaaaaaaaaaaaaaaaaattaaaatattaatttaaaaaaagaattaatattaaaaaatattaaatgctttgtataatataaaaatttttaaataataatattttttttgaaaaaaaataaattattttaaaatgaaaagtattttatctcttaccttatcatttttaggattgatttctaaaatgactacaactttggctgctcctgctcctgcttctgcatggaatggtagtcatgttgccatggacttcaattatcccgattccaatccatttgaaatgtcaagctggtctaacggtggaatgtttaattgtgtctggtctccaaataatgaccgtttcgaaaatggaaaattaaaacttaccattgatagaaatggttcaggatatacatgcggtgaataccgtactaaaaattattatggatttggtatgtatcaagtcaatatgaaaccaataaagaatccaggtgttgtttcatcatttttcacttacactggtccaagtgacggtactaagtgggatgaaattgatattgaattccttggatatgatactacaaaggtacaatttaactattacactaacggtgtcggtaatcatgaacacgttcattatcttggtttcgatgcttctcaaggtttccacacttatggatttttctggtctagaaattccattacttggtatgttgatggtactgctgtttacaccgcttactccaacattccagacacaccaggtaagattatgatgaacgcatggtgtggtactggtgtaaatgattggcttcgtgcttataatggaagaactccaattagtgcttattatgactggatttcatatgatgccccacgtaactaatttaaaaaaaaatattaacaaaaaattaataataaaaaaattaaaaaaaaaaaataaaggaaaaaaaaaaaaaaaaaaaaaaaaaaaa

SEQ ID NO: 393 - protein, 243 aa, Anaeromyces sp.  W-98
MKSILSLTLSFLGLISKMTTTLAAPAPASAWNGSHVAMDFNYPDSNPFEMSSWSNGGMFNCVWSPNNDRFENGKLKLTIDRNGSGYTCGEYRTKNYYGFGMYQVNMKPIKNPGVVSSFFTYTGPSDGTKWDEIDIEFLGYDTTKVQFNYYTNGVGNHEHVHYLGFDASQGFHTYGFFWSRNSITWYVDGTAVYTAYSNIPDTPGKIMMNAWCGTGVNDWLRAYNGRTPISAYYDWISYDAPRN

SEQ ID NO: 394 - DNA, 732 bp, Bacillus licheniformis
atgtcttaccgtgtaaaacgagtgttgctgcttcttgtcaccggattgtttttgagtttgtctgcagtcacttctactgcctcggctcaagcaggcggatcgttttttgacccttttaacagctataactccggtgtatggcagaaggcaaatggttattcgaatggaggtgtgttcaactgcacttggcgtgcaaataacgtatcaatgacatcattaggtgaaatgcgtttggggctaacaagtccatcttataacaagtttgactgcggggaaaatcgctctgttcaaacatatggatatggactttatgaagtcggaatgaaaccagctaaaaacgtagggatcgtttcatcgttcttcacttacacaggtccaacggatggaactccttgggatgagattgatatcgaatttttaggaaaagacacaacaaaggttcagtttaactactatacgaatggtgtaggaaaccatgagaagcttgtgaatctcggatttgatgcatccaattcctatcatacgtatgcgttcgattggcagccaaactcgattaaatggtatgtcgatgggcaattaaaacataccgcgacgagccaaattccgactacgccaggaaagatcatgatgaacttgtggaatggtattggcgtcgatgactggctcggttcctacaacggtgtaacacctctatacgctcattacgactgggtgcgttacacaaaaagataa

SEQ ID NO: 395 - protein, 243 aa, Bacillus licheniformis
MSYRVKRVLLLLVTGLFLSLSAVTSTASAQAGGSFFDPFNSYNSGVWQKANGYSNGGVFNCTWRANNVSMTSLGEMRLGLTSPSYNKFDCGENRSVQTYGYGLYEVGMKPAKNVGIVSSFFTYTGPTDGTPWDEIDIEFLGKDTTKVQFNYYTNGVGNHEKLVNLGFDASNSYHTYAFDWQPNSIKWYVDGQLKHTATSQIPTTPGKIMMNLWNGIGVDDWLGSYNGVTPLYAHYDWVRYTKR

SEQ ID NO: 396 - DNA, 971 bp, Orpinomyces sp. PC-2
aataaaagaaaaaaaaaatatatattaaataataatatatattaaagtaaataaaaaaaaatttaagaaaatattttcattatataattaatattttttgataaaataaagattataataaaatgaaaagtataatttctattgctgctttatctgttttaggattgatttctaaaactatggctgctcctgctcccgctcctgttcctggtactgcttggaatggtagtcatgatgtcatggatttcaactatcatgaaagtaaccgttttgaaatgtcaaactggccaaatggtgaaatgtttaattgtagatggactccaaataatgacaaatttgaaaatggtaaattaaagcttactattgatagagatggttccggatatacttgtggtgaatatcgtactaaaaactattatggatatggtatgttccaagttaatatgaaaccaattaagaatccaggagttgtttcttccttctttacttacacaggaccaagtgatggaactaagtgggatgaaattgatatagaattccttggttatgatacaaccaaagttcaatttaactactacactaatggacaaggtcatcatgaacatattcattatcttggatttgatgcctctcaaggattccatacctatggtttcttctgggcgagaaattctattacatggtatgtagatggtacagccgtttacactgcttacgacaatattccagatacaccaggtaagattatgatgaatgcttggaatggtattggagttgatgactggcttagaccatttaatggaagaactaatattagtgcctactatgattgggtatcttatgatgcaccaagaaactaaattatttaaataaatatataatttttgttttaaaatttaaaaaaatatatatatatatattataaattaatatgaaaaataaaaataagatgtaaaaaaaaaaaaaaaaaa

SEQ ID NO: 397 - protein, 245 aa, Orpinomyces sp. PC-2
MKSIISIAALSVLGLISKTMAAPAPAPVPGTAWNGSHDVMDFNYHESNRFEMSNWPNGEMFNCRWTPNNDKFENGKLKLTIDRDGSGYTCGEYRTKNYYGYGMFQVNMKPIKNPGVVSSFFTYTGPSDGTKWDEIDIEFLGYDTTKVQFNYYTNGQGHHEHIHYLGFDASQGFHTYGFFWARNSITWYVDGTAVYTAYDNIPDTPGKIMMNAWNGIGVDDWLRPFNGRTNISAYYDWVSYDAPRN

SEQ ID NO: 398 - DNA, 1383 bp, Phanerochaete chrysosporium
atgttgaaaatcgggttcctcgctcttgcatttgcgctctcgccgctggcgcaggctcagacaacggtgtctgcatggggccagtgcggaggcatcaactacactggcagtaccacttgcgcgagtggctcggcatgtgtctacctgaacgactactactatcaatgcatcccaggggctaccgctagcacacctgcacactcgagcaccatcacgagcgtgtcctcacacacggtctcgagtacttctagctctgtcgtcagcagctccactccctcttcgccacctccgccgtcttcattcggtttcgtgaccacttcaggccagaagttcatgttgaatggccaagagtttactgttgttggcgaaaactcgtactgggtgggcctcatgggctacagcaccgcgaacatcaacaaggctgtccaggacattgccaatgctgggtctacagttgtccgcacgtggggcttcaacgaggtcaccccttccacacaacaaaactacccaatctactaccagtcttggtctggcgcgacgccgactgtcaacacgggcgcgaatggtctgcagaacttcgaccagattgtggcatccgcgaaggctaacgggctccgtctcatcgttgctctgacgaataactggtccgactatggcggcatggacgtctacgtcaagcaaatcttgggatctgccaaccatgacctcttctacacgaacgcccaggtcattgcggctttcaagaattacgtcaagacgtttgttggtcgctatgtgaatgaaccaacaatcatggcatgggagctgtcgaacgagccccgatgcgcgggcagcacaggcaccactactggaacgtgcacgacagcgacggtgacgaactggatctccgagatctcggcgtacatcaagtccattgacccgaaccacctcgttgctgtgggtgatgagggcttcttcaacgagcccggcaacccaagctacccgtaccagggtggtgaaggcatcgacttcaacgtgaacctcaacatctcgacgatcgacttcggaaccttccatctgtaccccgagagctggggacagagctcgaacccgagcagcagcgtgtggggcagccaatggatcagcgaccacgcgacgtcgcagaagagcgcgaacaagcccgtcatcatggaggagttcggcgtcacgagcgatcagacggacgtctacaaggcgtggttcagcaccgtgctctcttcggggctctccggcgatctcatctggcaagcgggctcgcacctctccaccggcgacacgccgcaggatggctatgccgaataccccgatggcgtggtgtaccctatcatccagcagcacgcagcggcgttgaaggcccgtgggtga

SEQ ID NO: 399 - protein, 460 aa, Phanerochaete chrysosporium
MLKIGFLALAFALSPLAQAQTTVSAWGQCGGINYTGSTTCASGSACVYLNDYYYQCIPGATASTPAHSSTITSVSSHTVSSTSSSVVSSSTPSSPPPPSSFGFVTTSGQKFMLNGQEFTVVGENSYWVGLMGYSTANINKAVQDIANAGSTVVRTWGFNEVTPSTQQNYPIYYQSWSGATPTVNTGANGLQNFDQIVASAKANGLRLIVALTNNWSDYGGMDVYVKQILGSANHDLFYTNAQVIAAFKNYVKTFVGRYVNEPTIMAWELSNEPRCAGSTGTTTGTCTTATVTNWISEISAYIKSIDPNHLVAVGDEGFFNEPGNPSYPYQGGEGIDFNVNLNISTIDFGTFHLYPESWGQSSNPSSSVWGSQWISDHATSQKSANKPVIMEEFGVTSDQTDVYKAWFSTVLSSGLSGDLIWQAGSHLSTGDTPQDGYAEYPDGVVYPIIQQHAAALKARG

SEQ ID NO: 400 - DNA, 2420 bp, Alicyclobacillus acidocaldarius
tccagcgaggcgaatacacaggcggccgatacgcgtacttcgacggcgcgtcgtctgcgcgagccgtgattgaactgctggaaaacgaccgccgttgaggcgccttggaggtgaactgggatgggacggatcgaaagcgcattcgatctcggcttcatccgaggcatgacctttggcttcgtcggccagcacgggacgtggggaaccgacgaggcgcgcgcatcgatgcgtgcgcttgccgaacagcccttcaactgggtgacgctcgccttcgcgggcctcatggagcaccccggcgatcccgccatcgcgtatgggcctccggtcaccgtgagcgacgacgagattgcgtcgatggcggagcttgcccacgcactcgggctcaaggtgtgcctgaagccgaccgtgaactgccgagacgggacgtggcgaggcgagatccggttcgagaaggaacacggcccggatctcgagtcctgggaagcgtggtttgggtcttattccgacatgatggcccactacgcgcatgtggcgaagcgcacgggttgcgagatgttctgcgtgggctgcgagatgacgactgccgagccacacgaagccatgtggcgcgagaccatcgcgcgcgtgcgaaccgagtacgacggcctcgtgacgtacaactgcaaccacgggcgcgaggagcacgtgcgcttctgggacgcggtcgatctcatctcgtcgagcgcctactatcccatcgaccggtggcgagatcgcgtgcctgtgctccgcgaggtggcagaggcgcatgaaaagccgctcttcttcatggaagtggggtgcccgagccgctccggctccggcgcctgcccgtgggactaccggcacccaggcgccgtctgtcttgacgagcaggcgcggttctacgaagccatgttcgccgccatgcccgacgagccgtggttcaagggttacatgctgtgggaatggccgtggaagctgtacccgcgcgaagcggcgtccgaggacggaagctactgcatctacggcaaaccggccgaggacgtcgtggcgcgggcgttctcggccatcgcaaatcgatgacgggcacgcggttcgtccgcgccatccggtcgacaggctacgcgtcacgcggtgacggccatggccgcccagcgcgcggcgccctgcgcggcctcctccggatgaggcgcgagccgcaagggagacctccagcgaggcgaatacacaggcggccgatacgcgtacttcgacggcgcgtcgtctgcgcgagccgtgattgaactgctggaaaacgaccgccgttgaggcgccttggaggtgaactgggatgggacggatcgaaagcgcattcgatctcggcttcatccgaggcatgacctttggcttcgtcggccagcacgggacgtggggaaccgacgaggcgcgcgcatcgatgcgtgcgcttgccgaacagcccttcaactgggtgacgctcgccttcgcgggcctcatggagcaccccggcgatcccgccatcgcgtatgggcctccggtcaccgtgagcgacgacgagattgcgtcgatggcggagcttgcccacgcactcgggctcaaggtgtgcctgaagccgaccgtgaactgccgagacgggacgtggcgaggcgagatccggttcgagaaggaacacggcccggatctcgagtcctgggaagcgtggtttgggtcttattccgacatgatggcccactacgcgcatgtggcgaagcgcacgggttgcgagatgttctgcgtgggctgcgagatgacgactgccgagccacacgaagccatgtggcgcgagaccatcgcgcgcgtgcgaaccgagtacgacggcctcgtgacgtacaactgcaaccacgggcgcgaggagcacgtgcgcttctgggacgcggtcgatctcatctcgtcgagcgcctactatcccatcgaccggtggcgagatcgcgtgcctgtgctccgcgaggtggcagaggcgcatgaaaagccgctcttcttcatggaagtggggtgcccgagccgctccggctccggcgcctgcccgtgggactaccggcacccaggcgccgtctgtcttgacgagcaggcgcggttctacgaagccatgttcgccgccatgcccgacgagccgtggttcaagggttacatgctgtgggaatggccgtggaagctgtacccgcgcgaagcggcgtccgaggacggaagctactgcatctacggcaaaccggccgaggacgtcgtggcgcgggcgttctcggccatcgcaaatcgatgacgggcacgcggttcgtccgcgccatccggtcgacaggctacgcgtcacgcggtgacggccatggccgcccagcgcgcggcgccctgcgcggcctcctccggatgaggcgcgagccgcaagggagacc

SEQ ID NO: 401 - protein, 320 aa, Alicyclobacillus acidocaldarius
MGRIESAFDLGFIRGMTFGFVGQHGTWGTDEARASMRALAEQPFNWVTLAFAGLMEHPGDPAIAYGPPVTVSDDEIASMAELAHALGLKVCLKPTVNCRDGTWRGEIRFEKEHGPDLESWEAWFGSYSDMMAHYAHVAKRTGCEMFCVGCEMTTAEPHEAMWRETIARVRTEYDGLVTYNCNHGREEHVRFWDAVDLISSSAYYPIDRWRDRVPVLREVAEAHEKPLFFMEVGCPSRSGSGACPWDYRHPGAVCLDEQARFYEAMFAAMPDEPWFKGYMLWEWPWKLYPREAASEDGSYCIYGKPAEDVVARAFSAIANR

SEQ ID NO: 402 - DNA, 5411 bp, Clostridium cellulolyticum
tcatccatttcattttttgttaatgtaattttagcatctttggccttagaaagttggattttaaaatctacgatgttatcaagagctattttttttgcatattccgatgccttcatatcgttaatctttgcattccaatcaacattgtaagaattaaaatagctttgtatcattgaaattgcatctctaaggaaaaagttgtattcttccttggaaatcttgtcagttcccacctttgcaacatgtgtttctggggtggctgtctttgcagttgctgcaaaagtatttgatgccggaataatcgacgttaataccattgcaactgtaataagtgcatttacaaacttcctatacatttttacctcctgttattaaccgctctgcggcaatataataatgttaaaaaaacccactatatataatttcacactatacttccaaaatcctttaatataaattaaaaaattactttttttatcaattgtaagaaccacaaaaatgtaataatatatgtatataaatctattttatgacatttatgtaaaatgacataaagtagttaaaaattaaattatagaaaggagggattaaaatggataaaaataattttttaaaggtcttcttagtattggcattggcagcactgatacctttaataccagctgcaaatgttcctgcaaatgccatgttggaagaaggcataaagtatgaatttgagaacggtgttcagaaaaatgctgaaattcatacggactatgtaggaaaaactgatgacggcctgacattcgacttgagcggtgcaacttgcagtttcattgggcagaaggggacaagcacttctgttaatgttgacattgaccagacaggactttacgagttagtagtgcggtatgcacagccatatgacaagaccaagaaggtacagtatctcaatgtcaacgactccaatcagggagaggttagctttccgtatactctcagctggagggaaatgtctgcagggattgtcaagctcaacaagggtacaaacaatattgaatttgaaggctactggggatacactttttttgactacctaattgttaagccggcagatgaaagtattacgagtctgaaagttgaaaaaaagctggtaaaccctgatgctacaaaagaagcaaaagcacttatgagctaccttgttgatatgtatggaaagcacataatttcaggtcagcaggagctatgcgggtctcacaactatgaagaatcagaggcagaatttacctatataaaggacaaaacaggtaaaatgcctgcattaagagggtttgatttcatgaactacagaggcaatggcttgtcatgggatgatctttgtgccgaacgtgtcattgactggtacaaaaataaaggtggcatacctacagtttgttggcactggttttcacctgcaaatatcggcaaaaaagctgataacagcttctacaccgaaagtacaactttcagtatatcaaaggctttgacaccgggaacagctgaaaataccgcattgcttaatgatattaaaactatgtcagagaaattcaaacagcttcaggatgcaggtgttccagtacttttcagaccacttcatgaggcagaaggaggatggttctggtggggtgctgaaggcccggagaattgtgtaaagctgtacagactgctattcgacaaatttactaatgaatataatttaaacaatatcatatgggtttggacatcctatacatatgatacatcttcaaaatggtaccctggtgacgatgttgttgatattcttggttatgataagtacaatgccaaggatggattgccaaacggaagtgctatttcttcaaccttctataatatggttaagctcaccaacggtaaaaagcttgttacaatgagcgaaaatgatacaattccgcaggtttcaaaccttacaaatgagatggccggatggttgtatttctgtccttggtacggatggcatcttacaggagaacagaataatccggtcgattggcttaaacaaatgtataccagcgattattgtattaccctggacgagcttccagatctagaaacataccctttcccgtcagacggtgatattcccacaatcatgtatggtgatttaaatgaagacaaattaatcgacgcaatagatcttgctttattaaaaaaatgtatacttgaaaataatcagagtttaaagtcagcagatgttgatggtaacggttctgtagatgctatagattttgtatatatgaagaaatttctgactggtgaaatttccggctttccggcaagtggaaagtaattgattttttaatttaaagaaaggaagatataatatgaaaaaaggaaggattttaaaggtaacaagagcttccataatgagcattgttattcttgctatgcttgcaacttcgttcactgtaatgaatgtaagtgcagcaggtacagaatataactatgcaaaattattacagtactcacaatatttttatgatgctaatatgtgcggtacaggggttggcgaaaataaccaatacacctggagaaatgactgtcatatatacgatgcaaaactcccgttggattcaaagaatacaaacatggcagatagctttatcaggcagaataagagtgtgcttgaccctgacggagatggaatggttgatgtttccggaggttttcatgatgcaggtgaccatgtaaaattcggaatgcctgaagcttactctggttcaacactgggatggggcttctatgaattcagggatcagtatgtaacaagcgggcaggacagccatattaaaacaattttaagatatttcaatgattattttatgaatagtacatttcttgattcaaccggaaaggctatagcattctgctatcaggttggcgacggagatgtggaccatgcatattggcaagcacctgaagttgatgaaatgttcagaagaggttggtttgcaactgatgaaatgccttcaacagactgcgttgcagcagctgcggcttcacttgctgtcaattacatgaatttcaaggatgaagaccctgcgtatgcagagaagagccttaaatatgcaaaagccttattccaatttgcagaaagatgtcccaccaaatcagtaaacatagacggacctaaaggatattatacatcctcaaaatggcaggacgattactgctgggctgcatcatggctgtatttggcaacaaaggatgatcattaccttgatgaaacactaaagaattttgattattatgcaccatcatgctggacacattgctggaacgacgtttgggcaggtacagcatgtatcattgctgaaataaatgatttaattgataaaaatgggcaagtcttggaagatagatacaaaacactaacaaataagagtccatatgaagaaattgatttttggagtcagatagcaaagttagtagatggttggatgacaggcaaaaatgttacactatcacctggtggatatgctttcttaaaccagtggggttctgcaagatacaatacggctacccagctaatagcacttgtttatgataagaatcatggtgatacaccatcaaagtacagccaatgggctaaatcacagatggattacctgttgggcaacaatccgttaaaccgttgttatgtagttggatacagcgataatgcggtaaaatatccacaccatagagcttcatcaggctatgccacggctgaaggaacaagtcctcaaaaatatgttctttacggtgcattagttggcggacctgatgccagtgaccaacataaagatgttacgtcagactacatatataatgaagtaacaatagactataatgctgcatttgttggagccagtgcaggtatttacagatactttggaaactcatcaatgctggttacacctaatttcccaccaccgccagctgaagatgatcctgaagacccctcaggttccgcgtactgggtggaaggtttctgtgtggatgtagctcaatctgacggaccaaaagcaactgaagttaccttatatgtaaaatcaaatgtttcaaaaacttcaaaaaatatatcagtaagatactactttgattctacaggtatgacatcacttgatcctaacaaaatagaaatgagacagttgtatgaccagacagctgccgaaaccgattatgctgctgaattttcggggccgcacctctacaaagataagatttattatgtagaagtaaaatggcctaattatgtaattgcaaattccaataagaaatatcagtttgctataggtacatatgcttggcagaattactggaatccgactgatgactggagtcatcagggattaaaggttgttgaggacagttggaaaggaacacctgaaaaaacagacaatatctgtgtttatgacaacggcgttctagttggtggtatcgagcctgatggaactacaccgggcggaaacactcccgatccaacaattaaactgggcgacctgaacaacgattcagcaattgatgctttggatttgacacttttaaaaatgcacttgttaggacttaaaatacttacaggagacgctctgaaagcggcagatatagatgctagcagcacagttgatgcaatcgattatgttcagttaaagaaaattatactgacacaagcagtataaataaaaggttgtaaaaggacactttaggattgttggggttatataatattttaggagcattcctgtaagtaagaaaaatggtctttgaagaaattaataccctcacgtaaaatatgaaatgtgctgaacaccacaaatgaaggcacaaatcaaataaacggagggtaactaatatgaattgtacacaaaacaataagttaatgcaaatcacacctgaaacaatggtggttggagtagatatcggtagcgaggtccacttcgccagggcttttgatttcagaggatttgaattttctaaaagagcatttaggtttgagaatacaagagagggtttcaatgcctttgatatttgggttacagacctgatgaagagaaatcaaaagacaaaaacattcgtaggaatggagcccaccgggcattactggtatgggtttggaagtcacttgcagaacatgggtgtagagtttggtatggttaatccttaccatgtaaaacgctcaaaggaactagatgataacaccccaagcaagcatgaccgtaaagatccaaaaacgattgcaatgctagtcaaggacggaagatatctaataccgtacatgcctgaaggtgtatatcgagaaataagaaatctgatggaattacgcaggcaaaatgttgtgcagttgattagcatacaaaatagagtaaaacgatggttagcaatatactttcctg

SEQ ID NO: 403 - protein, 577 aa, Clostridium cellulolyticum
MDKNNFLKVFLVLALAALIPLIPAANVPANAMLEEGIKYEFENGVQKNAEIHTDYVGKTDDGLTFDLSGATCSFIGQKGTSTSVNVDIDQTGLYELVVRYAQPYDKTKKVQYLNVNDSNQGEVSFPYTLSWREMSAGIVKLNKGTNNIEFEGYWGYTFFDYLIVKPADESITSLKVEKKLVNPDATKEAKALMSYLVDMYGKHIISGQQELCGSHNYEESEAEFTYIKDKTGKMPALRGFDFMNYRGNGLSWDDLCAERVIDWYKNKGGIPTVCWHWFSPANIGKKADNSFYTESTTFSISKALTPGTAENTALLNDIKTMSEKFKQLQDAGVPVLFRPLHEAEGGWFWWGAEGPENCVKLYRLLFDKFTNEYNLNNIIWVWTSYTYDTSSKWYPGDDVVDILGYDKYNAKDGLPNGSAISSTFYNMVKLTNGKKLVTMSENDTIPQVSNLTNEMAGWLYFCPWYGWHLTGEQNNPVDWLKQMYTSDYCITLDELPDLETYPFPSDGDIPTIMYGDLNEDKLIDAIDLALLKKCILENNQSLKSADVDGNGSVDAIDFVYMKKFLTGEISGFPASGK

SEQ ID NO: 404 - protein, 778 aa, Clostridium cellulolyticum
MKKGRILKVTRASIMSIVILAMLATSFTVMNVSAAGTEYNYAKLLQYSQYFYDANMCGTGVGENNQYTWRNDCHIYDAKLPLDSKNTNMADSFIRQNKSVLDPDGDGMVDVSGGFHDAGDHVKFGMPEAYSGSTLGWGFYEFRDQYVTSGQDSHIKTILRYFNDYFMNSTFLDSTGKAIAFCYQVGDGDVDHAYWQAPEVDEMFRRGWFATDEMPSTDCVAAAAASLAVNYMNFKDEDPAYAEKSLKYAKALFQFAERCPTKSVNIDGPKGYYTSSKWQDDYCWAASWLYLATKDDHYLDETLKNFDYYAPSCWTHCWNDVWAGTACIIAEINDLIDKNGQVLEDRYKTLTNKSPYEEIDFWSQIAKLVDGWMTGKNVTLSPGGYAFLNQWGSARYNTATQLIALVYDKNHGDTPSKYSQWAKSQMDYLLGNNPLNRCYVVGYSDNAVKYPHHRASSGYATAEGTSPQKYVLYGALVGGPDASDQHKDVTSDYIYNEVTIDYNAAFVGASAGIYRYFGNSSMLVTPNFPPPPAEDDPEDPSGSAYWVEGFCVDVAQSDGPKATEVTLYVKSNVSKTSKNISVRYYFDSTGMTSLDPNKIEMRQLYDQTAAETDYAAEFSGPHLYKDKIYYVEVKWPNYVIANSNKKYQFAIGTYAWQNYWNPTDDWSHQGLKVVEDSWKGTPEKTDNICVYDNGVLVGGIEPDGTTPGGNTPDPTIKLGDLNNDSAIDALDLTLLKMHLLGLKILTGDALKAADIDASSTVDAIDYVQLKKIILTQAV

SEQ ID NO: 405 - DNA, 1454 bp, Aspergillus sulphureus
aatacagccaagcaaaccaccacaatgaagctctccagctccctcctcaccctggccagcctggcgctggccaacctctccacggccctgcccaaagcctctcctgcaccaagcaccagcagcagcagcgcctccacctccttcgccagcacctcgggcctccaattcaccatcgacggcgaaaccggctacttcgccggaacgaacagttactggatcggtttcctgaccgacgactccgatgtcgacctggtgatgagccacctgaagtcatccggcctcaaaatcctccgcgtatggggcttcaacgacgtcaccacgcagccctcttccggcacagtctggtaccaactgcaccaggacggcaaatcaaccatcaacactggcgccgacggtctccagcgcctcgactacgtcgtctcctccgccgaacagcacggcatcaaactcatcatcaacttcgtcaactactggaccgactacggcggtatgtccgcgtacgtgagcgcatatggcggatccgacgagacggatttctataccagtgatacgatgcaatctgcgtatcagacgtatattaagacggtcgtggagcggtatagtaactcctctgcggtatttgcgtgggagttggcgaatgagccgagatgtcctagttgtgatactaccgtgttgtatgattggattgagaagacgagtaaatttattaaggggttggatgccgatcatatggtttgtattggtgatggtgagtgcccccaaaccttcgagactaagctaaagtggatgctaatgagaagtagagggcttcggcctcaacaccgactcggacggcagctacccgtaccaattcgccgagggtctcaacttcaccatgaacctcggtatcgatactattgactttgctaccctccacttgtatcctgatagctgtacgtactccccacctctctttacttccccgataaactaacaaaagattgaagggggcacctccgacgactggggcaacggatggatcagcgcacacggcgcggcatgcaaagcggccggcaagccctgtctactggaggaatacggagtcacctcgaaccactgtagtgtggagagcccgtggcagcagacggccctcaacacgactggcgtcagcgcagatctcttctggcagtatggtgatgatttgagcacgggcgagtcgccggatgatggaaataccatttactacgggacgagcgattatgagtgtttggtcacggatcatgtggctgctattgatagcgcctaagggatagggagatgtggatatatctagttgatacattatgaggggtgctgtacataagaatgcgccggagggagggtgtgaaggatgataactgatctttgagtttggataggatacaattcgagaggcaaatcatcccttcgattaccataaaaaaaaaaaaaaaaaa

SEQ ID NO: 406 - protein, 383 aa, Aspergillus sulphureus
MKLSSSLLTLASLALANLSTALPKASPAPSTSSSSASTSFASTSGLQFTIDGETGYFAGTNSYWIGFLTDDSDVDLVMSHLKSSGLKILRVWGFNDVTTQPSSGTVWYQLHQDGKSTINTGADGLQRLDYVVSSAEQHGIKLIINFVNYWTDYGGMSAYVSAYGGSDETDFYTSDTMQSAYQTYIKTVVERYSNSSAVFAWELANEPRCPSCDTTVLYDWIEKTSKFIKGLDADHMVCIGDEGFGLNTDSDGSYPYQFAEGLNFTMNLGIDTIDFATLHLYPDSWGTSDDWGNGWISAHGAACKAAGKPCLLEEYGVTSNHCSVESPWQQTALNTTGVSADLFWQYGDDLSTGESPDDGNTIYYGTSDYECLVTDHVAAIDSA

SEQ ID NO: 407 - DNA, 1439 bp, Phanerochaete chrysosporium
atgctacgagcatcccttctggctgcgatctgcgccgcagggctaccagcatgggctgcagtgcctatgtggggtcagtgtggaggcatgacctacacaggagacactgtctgtgccacgggtacaacgtgtgtatacttgaacgaatggttctcccaatgcattttggatgccccgaccagtacactcccgagcacaagttcgcgtccgactagcgttgcctcaagctccgtagctgcaagctctactgcttccgcctcctctccgtcgtcgacgggcttcgtaaccgtctcggggcagaagtttatgctagatggcgaagaatttactgtggtcggcgaaaatgcctattggattggtctcttcgactacggcgtcgcagacgtggacaaggcataccaagatattgtcaacgcgggatcaaccgttgttcgaacgctgggattcaacgatgtcacaccggctgacattgccgaataccccgtatactatcaatcttggtccaatggtactggcacaattaaccttggcccaaacggcttgcaaaacttcgaccaagttgtcgcccgtgccaaagcacatgggcttcgccttcttgtcaccctgacgaacaactggtcagactacggtggcatggacgtctacgtccagcagatcctaggatcaacctaccacgacctcttctacaccgacccgcaggtgatcgcggccttcaagaagtacattaacggcttcgtcagccgctacgtcgacgagcctaccattctcgcttgggagcttgcgaacgagccccgctgtgcgggaagcacgggcgtgaccacaggcaactgcacgaacccgacgattacgcagtggatcgccgagatctcagcgtacatcaagagcatcgacccaaaccacctcgttggcgtcggcgacgagggtttcatcaacgacccgggtaacccgagctacccgtaccagtacgtcgagggcacgctgggcatcgactttgaggctaacctgcagatcccgacgatcgactttgggacgttccacatgtacccagagagctggggccagaccaacgacccgagcgcagtcggatggggcaaccagtggatcaccgaccacgctgcgatgggccgcagcgcgggcaagcccgtgatcatggaggaattcggcgtgaccatcgcggaccaggcgttgacatacgcagagtggtatgacaccgtgatcagcacaggcttggcgggcgacctcatctggcaggcgggctcgcacctttcgggtggtgatacccctaacgatggctatgcggaataccccgatggcgacgtatacccgattatacagcaacatgcggcggcgttgaaggctcgtggctgagcacacggatagcggcgtgcctcgtgttgtaacgaggcttcgggacaactgctatggcacgatgtcgaatg

SEQ ID NO: 408 - protein, 455 aa, Phanerochaete chrysosporium
MLRASLLAAICAAGLPAWAAVPMWGQCGGMTYTGDTVCATGTTCVYLNEWFSQCILDAPTSTLPSTSSRPTSVASSSVAASSTASASSPSSTGFVTVSGQKFMLDGEEFTVVGENAYWIGLFDYGVADVDKAYQDIVNAGSTVVRTLGFNDVTPADIAEYPVYYQSWSNGTGTINLGPNGLQNFDQVVARAKAHGLRLLVTLTNNWSDYGGMDVYVQQILGSTYHDLFYTDPQVIAAFKKYINGFVSRYVDEPTILAWELANEPRCAGSTGVTTGNCTNPTITQWIAEISAYIKSIDPNHLVGVGDEGFINDPGNPSYPYQYVEGTLGIDFEANLQIPTIDFGTFHMYPESWGQTNDPSAVGWGNQWITDHAAMGRSAGKPVIMEEFGVTIADQALTYAEWYDTVISTGLAGDLIWQAGSHLSGGDTPNDGYAEYPDGDVYPIIQQHAAALKARG

SEQ ID NO: 409 - DNA, 1338 bp, Armillariella tabescens
atgcatctgctcgcttttctgtctctgagtacattcctgtgctctgcgttcgctgctgttcctgagtggggccaatgtggcggcattggatggacaggacagaccacttgcgttagtggtacagtatgcgcagctctcaatgactattattctcaatgtgtgcctggaacggccacaacaacggccgctcccacgactgctacatcaacaaccatttcttccacttctcgcacaactgctacgtcgaccacagcttccgcaccatcttctactggctttgtaactacctctggcacagagttccgcctcaacggtgccaaatttactatcttcggcgccaactcatactgggtcgggttgatgggctatagcactacagatatgaataaagccttcgcagacatcgcggctacaggtgccaccgtcgtccgcacatggggcttcaatgaggtaacgagtcctaacgggatttattaccagagttggtccggaagtacaccaactatcaacacaggttctacgggtcttcaaaactttgatgccgtcgtcgctgctgctgctgcacatggcttgaggcttattgttgccataacgaacaactggtccgactatggtggaatggatgtatacgttaaccaaattgtcgggtctggctctgcgcacgatttattctataccgactgtgaggttatatctacttacatgaactacgtcaagaccttcgtctcgcgctatgtgaacgaacctactattttaggttgggagcttgcaaatgaacctagatgcaaggggagtaccgggacgacctctggatcatgcactgcaacgactatcacaaaatgggccgcggcaatttcagcgtacatcaagtcgatcgatcccaaccatcttgtcgggataggagatgaagggttctacaatgaacctagcgcaccaacatatccatatcaaggtagcgaaggtatcgattttgatgcaaatttggccattagtagcattgatttcggtacattccattcctatcctatcagctggggtcaaaccactgatcctcagggatggggtacgcaatggatcgctgatcatgcaacgtcaatgacagctgcgggaaagcccgtaatcttagaggagtttggagtcaccactaatcaagcaactgtttatggcgcctggtatcaggaagttgtctcttcgggtcttactggtgctcttatttggcaagctggttcttatttatcatccggagctactccggacgacggatatgcaatttatcctgatgatcctgtatattccctggaaacctcctatgcggttacattgaaagcgcgggcgtag

SEQ ID NO: 410 - protein, 445 aa, Armillariella tabescens
MHLLAFLSLSTFLCSAFAAVPEWGQCGGIGWTGQTTCVSGTVCAALNDYYSQCVPGTATTTAAPTTATSTTISSTSRTTATSTTASAPSSTGFVTTSGTEFRLNGAKFTIFGANSYWVGLMGYSTTDMNKAFADIAATGATVVRTWGFNEVTSPNGIYYQSWSGSTPTINTGSTGLQNFDAVVAAAAAHGLRLIVAITNNWSDYGGMDVYVNQIVGSGSAHDLFYTDCEVISTYMNYVKTFVSRYVNEPTILGWELANEPRCKGSTGTTSGSCTATTITKWAAAISAYIKSIDPNHLVGIGDEGFYNEPSAPTYPYQGSEGIDFDANLAISSIDFGTFHSYPISWGQTTDPQGWGTQWIADHATSMTAAGKPVILEEFGVTTNQATVYGAWYQEVVSSGLTGALIWQAGSYLSSGATPDDGYAIYPDDPVYSLETSYAVTLKARA

SEQ ID NO: 411 - DNA, 2853 bp, Agaricus bisporus
cctgtcagtgctggagttcgcgtcgtgctgattctccgaagttgctgatatcaacaggatagcggcagttgttcaacttgtggtcaagagagatggtgtcatttacggtccgtcctatgcttcccctgttccttcttcgcggcccgtctcacgtgtttctcacgtatgttattcagccgcgagcgattccagaaagaatgggattgcggcgggctattagctttgtctgttcactcctgagaagagaaatttacaaccgatttaacgtaatgtatatattatctgcaattgcgctccttacgctgctattctcggcggcatttagacgttggcttcctgcgagtcggtcatgatttttccgcgatgcctgaaatagtttcacaatgttacttgtggcgttttgacttctttgaggcaacggaagaatttcgcatgaatgacccagaccaggtggacagcgagaaatccccggtatggcgtgtcaagtcgtttgtgtccgttataaaagacagactaggtgacatgactattgctctgcaaataccctcagaaaatgaagcctgcgattagattcattattttggctatttctatctctctagcgaccgcagatgttccagtctggggtcagtgcggtggcaggggttggacgggagagacaggtcagtaattcaactaactcaagtcatcctcgtaatcctgaaagaaagatagcttgtgcaagtggatcatcttgtgtcgtgcagaacgaatggtactcgcagtgcctccctggatcaacaactccaacaaaccctccccctaccactaccacctcccaaactaccgctcctcctaccacttcacacccagtgtcgaccggatttgtcaaagcttctggtaccagattcactctaaatggccaaaaatacaccgttgttgggtccgtattgtctctatcagtacgtgaagtgacttattgattttttgcgtttctagaggtaattcctactgggtcggtttaactgggctcagcaccagtgcaatgaatcaggctttctctgacatcgctaacgctggaggaacaaccgtccgaacatggtaaatatcgtcatggtgtttgcgactgagatgtcattaaagcccgaacttatgatatactaacaggggattcaatgaagtaacctcgccaaacggcaattattatcaatcctggtctggtgccagacctactataaacaccggagcgtctggtctacttaatttcggtaggtgatatttgattgcgaaaaggtacttggggtagatggcttaacacgttttctcagacaatgtgattgctgcggccaaggcaaatggaattcgcctgatagttgctctgtgggtttcttgcattatgatgcgatattgaagtatatattgactgatcctttgtttcggttaggacgaataattggtaagatgattttgtcctcgtacaacatccaccgaccaaggtaacctatttagggcggactatggtggcatggacgtctatgtcaaccagatggtgggcaatggccaaccacacgatcttttctacacaaacaccgcaatcaaggtggatagttcgcaaacgccttgatacttatcaattgaacatcctcttaggacgcgttcaaatcttatgtacggacgttcgtgagccgctatgccaatgaacctaccgtaatggcttgggagcttgcaaatgagccgaggtgcaaaggtagcaccgggtgagtttttttagaccataattcggcgtattaatcttaatttctggaactgacagcacgacttctggaacctgtacaactacgaccgtcacgaattgggccaaggagatgtcggcatttattaaaaccattgatagcaaccatctcgttgctattggcgatgaaggtttctataatcaacccggtgctccaacttatccataccagtaaagtatttcctccaatgctttttcagtgagtctaaacaaagtgacatagaggaagcgaaggtgttgatttcgaagctaatctcgctatctcctctgtcgactttgcgaccttccatgtaaggctttattcctatactagtatggtcccttctctgacgtcaagattcttcaagtcctatccggaaccgtggggacaaggcgccgatgcaaaagcctggggcactcaatggattacagatcatgctgccagtatgaagagggtcaacaaacccgttatccttgaagaattcggtgtaactactaatcaacctgatacttacgctgagtggttcaacgaggtagaatcatcagggttgactggtgatctcatttggtgcgtcggtttagtttagcacgaactttactgacagatgctccgtatgtaggcaagccggttctcacttgtctacgttggttttctctcttttcgtgcaaagttgtttgtaaactgatttcctgcaataggggagatacacacaatgacggttatgctgtctaccccgatggtccagtatacccgttaatgaagtcgcatgcaagtgcaatgaaaaaccgggcttgaattagtattgttgattgaattgtacttgtatttcatatccgtttttgttgaaagtagtacacatgcgtacataccagtaaacaaacactttgaattgtgatgcccaacgtgtcatctaatagcgctataccactggttcttgacatcccagtatgacgggggtaattgactgggagttattgtcatcgtacgctggtcttattggcttagcggtgctctcaatttatgccggctcgcacggctcgctaccggtattacagattgaattcatgcagtgacacatgttaatatcatgcgactttttcgt

SEQ ID NO: 412 - protein, 439 aa, Agaricus bisporus
MKPAIRFIILAISISLATADVPVWGQCGGRGWTGETACASGSSCVVQNEWYSQCLPGSTTPTNPPPTTTTSQTTAPPTTSHPVSTGFVKASGTRFTLNGQKYTVVGGNSYWVGLTGLSTSAMNQAFSDIANAGGTTVRTWGFNEVTSPNGNYYQSWSGARPTINTGASGLLNFDNVIAAAKANGIRLIVALTNNWADYGGMDVYVNQMVGNGQPHDLFYTNTAIKDAFKSYVRTFVSRYANEPTVMAWELANEPRCKGSTGTTSGTCTTTTVTNWAKEMSAFIKTIDSNHLVAIGDEGFYNQPGAPTYPYQGSEGVDFEANLAISSVDFATFHSYPEPWGQGADAKAWGTQWITDHAASMKRVNKPVILEEFGVTTNQPDTYAEWFNEVESSGLTGDLIWQAGSHLSTGDTHNDGYAVYPDGPVYPLMKSHASAMKNRA

SEQ ID NO: 413 - DNA, 2994 bp, Bacillus sp. JAMB750
atgaaaataatgaaaaaatgggcaacaactttgttagccactgctcttgtattttcttctactactgccgtgatggctgaaagtaaaatccctaaagatagtgaaggtcagtcctttaagttagttgattcaaatgcatcaacattaacaaaatcgttgtatgcttatttacaagatacaagcggaagacagattttatttggccatcagcatgctgttgatgaaggattaactttaacgaatagtggagaccgagtcggttcaacccaatcagaagtgaaaaatgctgttggggattatcccgcgatttttggttgggatacattaagtttagatggctatgaaaaaccaggaaatgaaaagaatagtcaagctcaaaatcgcgcaaatgttgttcagtcgatgagaacagtgcatgaacttggtggaattattgctttaagtatgcaccctgaaaactttgtgacaggtaatcaatataacgatacgagtggagatgtagttaaaaatattttacctgatggcagtcatcatgaggtgtttaatgcttggttagataacattgctgcctttgcacatgaattaaccgatcaaagtacaggtgaattaattcccgttattttcagacctttccatgaacaaaatggtggttggttttggtggggtgcgcaaacaacaacagcaagtgaatataaggcattatatcgttatacggttgactatttacgggatgtaaaaggtgtgaataattttttgtatgcgttctcaccgaacgctccttttgatggaaatctaactcaatatttaagaacatatcctggtgaccaatatgtcgatattttcggtttagatcaatatgataataaagcaaatgccggacaggcgacttttttaaatggactaacacaagacttagcgatgatctcaaagttagctgatgaaaaagggaaaatcgccgcatttacggaatatgggtacagtcctcaagggtttaatgaaacagggaactatctccaatggtatacagctgttttagaagcgataaaaaaagaccctaatgctagtcgaatcgcttatatgcaaacatgggccaactttggctatccaactaatatgtttgttccttatcgtgatgtaaacggtaatttaggaggagatcacgaactgcttccaaatttcgtcgaattttatgaagatgattatgctgcatttttaactgaagcgagtggttggaatctttatcaagatatttcgacgatcgagcaagagccattcatgcacatcgtgacaccaacggctaattcacaaataagtgaagcggttacgataagagcaagagtacttcatgatcagccatcacatgttgtatttgaagtaaatgattctggtgaagaaattccaatgagcctagatgaagatggatttttttatatgggaaaatggacaccagatgcggcagttaatcacacgactgtaaacattacagttagagcatacggagaaaatcaagtacaagaagaaacgttccctttagttgtgagagtttctgaaatgttgttaaaggaatatacgtttgatgagggaatagaaggcattcaaaataatggaacatacccagatacaattgaaacatcgtttgagcatcaggtgttgaacggagacgggaaattaaaaataaatgtagcgggccttcaagcgagtgatacgtggcaagagttgaagttagaattaaccaatttacatgatgttcaattgggtaatgtgaatcgggtgaaagtggatgtattcattcctaaagcagcagtaaaccaatctgcgacgatcagagggattgtccaacttcctcctgattgggatacaaagtatggaatgaccactacagagaaaaatctttcggatcttcagtcggtcgttattgatgaagaagaatatgtagaagggcaaataacgattgatttaacaagtcctgaggcgtcagctgctgcaacaggtttagctttatcattagtaggaaatgcgattgattttactggagcgatttatgttgataacattcaattaattggagtaagtgaagaagaagtcagtgatccagcaattgttgatgattttgaatcatatgtaggaaatgacgatttattacgcaatgcgtgggttgcagcaaatggaggaattgccatttcattagatcaagaagaaaagtcggcaggtgattatggacttgcttacgaatattcacttgctggtgccgggagctacacaggcatcactaaaatgttaggtaatcgtgattggtcgtcttataattcattgcaattttggatgaattcggatggaaatggtcaaaagttagtgatccaggctgaaataggtggagtccattttgaagcgtatccttcactcgaagcaaatgaagaaggacttgtcacaattggtttcaatgaatttacaccagccccatgggaatcagcttccaatctagaaaagcttgtaacagaggaagcattaaaaaatgtgacaaagttatctttatatattaatgcacaagatgaattagattcagcgctagtgagtacgctattttttgatgaaatcagagcggcttatgttgaagaagagccaggagaagaaggtgaaccaggagaagaaggaaagtcaggagaagaagggaagccaggagaagaaggtgaaccaggagaagaaggtgaaccaggagaagaagggaagccaggagaagaaggtgaactaggagaagaagggaagccaggagaagaaggtgaactaggagaagaagaagagccaggagaagaaggtgaactaggagaagaattagaagttgggcataaggagcaaggcaatcaatcgtcttcaggggcaaataagttgcctagtacagcaacgaatgtatttaactttttgctgattggtactctattagttatcggaagtactagtttgttatacatgagaagaaagaaaataaataacgagtga

SEQ ID NO: 414 - protein, 997 aa, Bacillus sp. JAMB750
MKIMKKWATTLLATALVFSSTTAVMAESKIPKDSEGQSFKLVDSNASTLTKSLYAYLQDTSGRQILFGHQHAVDEGLTLTNSGDRVGSTQSEVKNAVGDYPAIFGWDTLSLDGYEKPGNEKNSQAQNRANVVQSMRTVHELGGIIALSMHPENFVTGNQYNDTSGDVVKNILPDGSHHEVFNAWLDNIAAFAHELTDQSTGELIPVIFRPFHEQNGGWFWWGAQTTTASEYKALYRYTVDYLRDVKGVNNFLYAFSPNAPFDGNLTQYLRTYPGDQYVDIFGLDQYDNKANAGQATFLNGLTQDLAMISKLADEKGKIAAFTEYGYSPQGFNETGNYLQWYTAVLEAIKKDPNASRIAYMQTWANFGYPTNMFVPYRDVNGNLGGDHELLPNFVEFYEDDYAAFLTEASGWNLYQDISTIEQEPFMHIVTPTANSQISEAVTIRARVLHDQPSHVVFEVNDSGEEIPMSLDEDGFFYMGKWTPDAAVNHTTVNITVRAYGENQVQEETFPLVVRVSEMLLKEYTFDEGIEGIQNNGTYPDTIETSFEHQVLNGDGKLKINVAGLQASDTWQELKLELTNLHDVQLGNVNRVKVDVFIPKAAVNQSATIRGIVQLPPDWDTKYGMTTTEKNLSDLQSVVIDEEEYVEGQITIDLTSPEASAAATGLALSLVGNAIDFTGAIYVDNIQLIGVSEEEVSDPAIVDDFESYVGNDDLLRNAWVAANGGIAISLDQEEKSAGDYGLAYEYSLAGAGSYTGITKMLGNRDWSSYNSLQFWMNSDGNGQKLVIQAEIGGVHFEAYPSLEANEEGLVTIGFNEFTPAPWESASNLEKLVTEEALKNVTKLSLYINAQDELDSALVSTLFFDEIRAAYVEEEPGEEGEPGEEGKSGEEGKPGEEGEPGEEGEPGEEGKPGEEGELGEEGKPGEEGELGEEEEPGEEGELGEELEVGHKEQGNQSSSGANKLPSTATNVFNFLLIGTLLVIGSTSLLYMRRKKINNE

SEQ ID NO: 415 - DNA, 2201 bp, Clostridium thermocellum
gaattcctcaggcaatttaatgagtattcggccaaatatgccatagacggaaattaaaattttgtagagcttaaataaatatgaagaacttaaatggcaaaagagtaaaaagcactttacatggtacttttaaagtaaagtgctttttatattacaataattttagatacaaaatgacaacatcaggtaaaattaattgtaatgtgaagaaaaatatagtaagataaatataaagggagaaaacgtcttgcttctatatttattctacacagttctgtatgttgcattgtctgtttttcttgccacggttatatcgtgtcacattacagtaatgttacaacactgcataaaggaataatgaaactgaattaaaattttcatttatataaatttatgcagggaggaatctctatggagaacaaaacttcgataaaagttttcctggcattgatgcttgcggttcttatgccggtggtttcatgcatcaatgtgtcaaatgcagtgctttctgacggggataagtatgagtttgaagacggtatccataaaggtgcccagatttataccgactatgtcggccaaaatgaatacggcgaggtattcgaccttaccggaagcacatgcagctttattgcacaaaagggtacaagcacttcggtgaatgttgaggttgacaaggaaggactttatgaaatattcatctgctatgtgcagccttacgacaaaaacaaaaaagtgcagtatcttaatgtaaacggtgtcaatcagggagaaataagctttccgtttactcttaaatggagagagatttcagcaggaattgtaaagcttaatgcaggtatcaacaatattgaacttgaaagctactggggttatacctattttgattatctgattgtcaaacctgcggatgaaagcattgtagaacttaaggttccgaaaaaattggtaaatcccaatgccacaaaagaagctaaagcccttatgagttatctggttgatatttacggtaaacacatcctttcgggtcagcaggagatctgcggttcccacaactatccgggatctgaggcggagtttacatacatacaggaaaagaccgggaaactgcctgcggtaagaggttttgactttatgaactacagagggaacggtttgatgtgggacgaccagtgtgccgagcgtgttatcgaatggtacaaggaaaaaggcggtataccgacggtttgctggcactggttctcgcccggtgatattggaaaaaaagcggacaacagtttctatacagaaagtacgactttcagcatatcaagggctttgactcccggaacggaggaaaatattgcactgcttaacgatatcgacaccatcgccagaaagctcaagcaggttcaggatgccggagttccggtactgttcagaccgctccatgaggcggaaggtggatggttctggtggggagccgaaggtccggagccttgtgtcagactgtacaggctgctctatgacaaatttaccaatgaatatggtttgaacaatcttatctgggtttggacttcatatgattatgaaacctcggctgcatggtatccgggcgatgatgtggtggatatcatcggttacgacaaatataatgcaaaagacggaaaacccaatggaagtgcgatttcatccacattctacaatctggtgaaacttactaatggcaaaaagttggttgcgatgactgaaaatgatacaattccgagagtttcaaaccttgtaaatgaaaaagcaggatggctttatttctgtccgtggtacggctggtggctgacaagcgaacagaacaatcctgtggattggcttgttgaaatgtatcagagcgattactgcataactttggacgagcttcctgacttaaagaattatcctatatcggattatgaggattccaatccggatccgtctccgacacctacacagccgccgaaaattacctatggagatttgaacggagacggcaaagtcaattcaacggacctgacaattatgaaaagatatattctcaaaaactttgataagctagccgtccctgaagaagcggctgacctgaacggggacggaaggataaactcaacggacctttcgatactacacaggtatctgcgtcgcataataacgagttttcccgttgaacaacagtagtataaactgaattc

SEQ ID NO: 416 - protein, 591 aa, Clostridium thermocellum
MENKTSIKVFLALMLAVLMPVVSCINVSNAVLSDGDKYEFEDGIHKGAQIYTDYVGQNEYGEVFDLTGSTCSFIAQKGTSTSVNVEVDKEGLYEIFICYVQPYDKNKKVQYLNVNGVNQGEISFPFTLKWREISAGIVKLNAGINNIELESYWGYTYFDYLIVKPADESIVELKVPKKLVNPNATKEAKALMSYLVDIYGKHILSGQQEICGSHNYPGSEAEFTYIQEKTGKLPAVRGFDFMNYRGNGLMWDDQCAERVIEWYKEKGGIPTVCWHWFSPGDIGKKADNSFYTESTTFSISRALTPGTEENIALLNDIDTIARKLKQVQDAGVPVLFRPLHEAEGGWFWWGAEGPEPCVRLYRLLYDKFTNEYGLNNLIWVWTSYDYETSAAWYPGDDVVDIIGYDKYNAKDGKPNGSAISSTFYNLVKLTNGKKLVAMTENDTIPRVSNLVNEKAGWLYFCPWYGWWLTSEQNNPVDWLVEMYQSDYCITLDELPDLKNYPISDYEDSNPDPSPTPTQPPKITYGDLNGDGKVNSTDLTIMKRYILKNFDKLAVPEEAADLNGDGRINSTDLSILHRYLRRIITSFPVEQQ

SEQ ID NO: 417 - DNA, 2042 bp, Bacillus circulans
tgcctatcattgtgagtcgagattccccaagaatgatttccattcggactgtcagttcaaggaactggcaagaaaatgggacagcggcaagaaacatgtgaggaactagaggaactgaaggtagatcagccttgttaaaccattcattttgggatgggcgaacaagtgtggaaaatcgtgcgtgtaagaaatgtggatggagaacgtgtcattctggacaaagactatgtcagtcaacgtcttgttccgggattaaccaaagagatatgtaatgattccatttacgagtacattgaggatcagctcggattgtccatttcttttgccaagaaagagatcttggtggaagagcctaccgaagaagatcgaagactgatggatctggaaggcttccacaatgttgtcgttgtacgcagccaggtctacctggaggatgcgagtccttttcagttcacggaatcccggcaccgtccggacaaattcaggtttgttgattttgcaagacgaaaataattgtattggatcaaaaagaaatgcctgtccacttcttcatcattggacgggtatttctttttttccataaagagttaagaatgagttgactggtaagcgttttcattttattataatctcatgacttaaacgataaagtaaattataaacataatatttaaaattgtttattcttataactttatttattagttgataaatttgattttagttaacctgttgccttatgtagggttaattgaaatataaaaaactcaggaggttatatgccatggccaagttgcaaaagggtacaatcttaacagtcattgcagcactgatgtttgtcattttggggagcgcggcgcccaaagccgcagcagctacaggtttttacgtgaatggaggcaaattgtacgattctacgggtaaaccattttacatgaggggtatcaatcatgggcactcctggtttaaaaatgatttgaacacggctatccctgcgatcgcaaaaacgggtgccaatacggtacgaattgttttatcaaacggtacacaatacaccaaggatgatctgaattccgtaaaaaacatcattaatgtcgtaaatgcaaacaagatgattgctgtgcttgaagtacacgatgccactgggaaagatgacttcaactcgttggatgcagcggtcaactactggataagcatcaaagaagcactgatcgggaaggaagatcgggttattgtaaacattgcaaacgagtggtacggaacatggaacggaagcgcgtgggctgacgggtacaaaaaagctattccgaaattaagagatgcgggtattaaaaataccttgattgtagatgcagcaggctggggtcagtaccctcaatcgatcgtcgattacggacaaagcgtattcgccgcggattcacagaaaaatacggcgttttccattcacatgtatgagtatgcaggcaaggatgcggccaccgtcaaatccaatatggaaaatgtgctgaataaggggctggccttaatcattggtgagttcggaggatatcacaccaatggagatgtcgatgaatatgcaatcatgaaatatggtctggaaaaaggggtaggatggcttgcatggtcttggtacggtaatagctctggattaaactatcttgatttggcaacaggacctaacggcagtttgacgagctatggtaatacggttgtcaatgatacttacggaattaaaaatacgtcccaaaaagcgggaatcttttaaagctatacctatttcaatcgatattgttcggtaagcatgattggattttaaacggcatgttaaaattctactggttttcactgcattcttgacactctgacggcagcgtcagggtgtattttaattaaacgaattagcagggagatcaatcttttgaatatttccgtttatatttaaaatcttttgttttcaaaacaaaacaaagatgttaaactctgattaggaataaaacaaacattatcgaagggaaatgaatggtacagagtttatggaattc

SEQ ID NO: 418 - protein, 326 aa, Bacillus circulans
MAKLQKGTILTVIAALMFVILGSAAPKAAAATGFYVNGGKLYDSTGKPFYMRGINHGHSWFKNDLNTAIPAIAKTGANTVRIVLSNGTQYTKDDLNSVKNIINVVNANKMIAVLEVHDATGKDDFNSLDAAVNYWISIKEALIGKEDRVIVNIANEWYGTWNGSAWADGYKKAIPKLRDAGIKNTLIVDAAGWGQYPQSIVDYGQSVFAADSQKNTAFSIHMYEYAGKDAATVKSNMENVLNKGLALIIGEFGGYHTNGDVDEYAIMKYGLEKGVGWLAWSWYGNSSGLNYLDLATGPNGSLTSYGNTVVNDTYGIKNTSQKAGIF

SEQ ID NO: 419 - DNA, 3942 bp, Bacillus subtilis
gatccaattcttgaagttgaacatgtgggcttcttagataacggcattccatttgaatattccttttcacgtcatcggcatgacaagtttgttgtgacttctgtaaacatacggcgctgattgcggagacaacaaggaggccatctgcatgcttggcggtattgaagcaggcggcacaaagattgtttgtgctgtcggtaaggaagatggaacaatcattgaccgaatagaattccccacaaagatgccggatgaaacgatagagaaagtaattcaatattttcgccaattttcattaaaggcaatcggcatcggctcctttggtcccgttgataacgataaaaccagtcaaacatacggtaccattacggccacgccgaaagcgggctggagacactatccctttatgcaaaccgttaagaacgaaatgaagatcccagtcggatttagtacagatgtcaacgctgcggcgctgggtgaattccttttcggtgaagcgaagggtcttgacagctgcctgtatataacgattggcactggcatcggagcgggggctattgtagaggggaggctccttcaggggctgtcacacccagagatgggccatatttatatccggaggcacccggatgacgtataccaagggaagtgcccttatcatggagattgctttgaaggcttagcttcaggccccgctatcgaagcccgctgggggaaaaaagccgcggatttatcagatatagcacaagtctgggaactggaagggtactatattgcccaagcactggctcagtatattttgatccttgcacctaaaaaaatcattcttggcggcggcgtcatgcaacagaaacaagtgttttcttatatctatcaatatgtaccaaaaatcatgaacagctacttagatttttctgaattatcagatgatataagtgattatattgtacctccacgtttaggcagtaacgccggaatcatcggcacgctagttttggcgcatcaggccttacaagcagaggcagcatccggggaggtgcgatcatgacgcatcctttatttttagagcctgtctttaaagaaagactatggggagggacgaagcttcgtgacgcttttggctacgcaataccctcacaaaaaacaggtgagtgctgggccgtttctgcacatgccaatggcccgtcggctgtaaaaaatggcccgctggcaggaaagacacttgatcaagtatggcaagatcatccagagattttcggttttccggataggaaggtatttccgctgctggtaaagctgctggacgccaatatggatctctccgtgcaagtccatcctgatgatgattatgcaaaactgcacgaaaatggcgaccttggtaaaacggagtgctggtatatcattgattgcaaagatgacgccgaactgattttgggacatcatgcaagcacaaaggaagagttcaaacaacgaatagaaagcggtgattggaacgggctgctgaggcgaatcaaaatcaagcccggagatttcttttatgtgccaagcggtacactccatgctttatgtgagggaacccttgtccttgaaatccagcaaaactctgatacaacgtatcgcgtatacgattatgaccgctgtaatgaccagggccaaaaaagaactcttcatatagaaaaagccatggaagtcataacgataccgcatatcgataaagtgcatacaccggaagtgaaagaagttggtaacgccgagatcactgtttatgtgcaatcagattatttctcagtgtacaaatggaagattagcggccgagctgcttttccttcatatcaaacctatttgctggggagtgttctgagcggatcaggacgaatcataaataatggtagtcagtatgaatgcaatgcaggctcacactttgtcttgcctgcgcattttggcgagttttcaatagaaggaacatgtgaattcatgatatctcatccttaatgaatgggggagttgcatttgtttaagaaacatacgatctctttgctcattttatttttacttgcgtctgctgttttagcaaaaccaattgaagcgcatactgtgtcgcctgtgaatcctaatgcacagcagacaacaaaaacagtgatgaactggcttgcgcacctgccgaaccgaacggaaaacagagtcctttccggagcgttcggaggttacagtcatgacacattttctatggctgaggctgatagaatccgaagcgccaccgggcaatcgcctgctatttacggctgcgattatgccagaggatggcttgaaacagcaaatattgaagattcaatagatgtaagctgcaacagcgatttaatgtcgtattggaaaaatggtggaatccctcaaatcagcttgcacctggcgaatcctgcttttcagtcagggcattttaaaacaccgattacaaacgatcagtataaaaaaatactagattcttcaacagcagaagggaagcggctgaatgccatgctcagcaaaattgctgacggacttcaagagctggagaaccaaggtgtgcctgttttgttcaggccgctgcatgaaatgaacggtgaatggttttggtggggacttacatcatataaccaaaaggataatgaaagaatctctctatataaacagctctacaagaaaatctatcattatatgaccgacacaagaggacttgatcatttgatttgggtttactctcccgacgccaaccgagattttaaaactgatttttacccgggcgcgtcttacgtggatattgtcggattagatgcgtattttcaagatgcctactcgatcaatggatacgatcagctaacagcgcttaataaaccttttgcttttacagaagtcggcccgcaaacagcaaacggcagctttgattacagcctatttatcaacgcaataaaacaaagatatcctaaaaccatttactttctggcatggaatgatgaatggagcccagctgtaaacaagggggcttcagctttatatcatgacagctggacactcaataagggagaaatatggaatggcgattctttaacgccaatcgttgagtgaatccgtaatgtcacaattaagaaggtgctcaagaagtttcttgagcaccttcccactggattaagcattcatatcgcctaacccaggactgtgttcatttggtatttcaggaagcactggtacgggaaaacctgccggaggatctatgacttgtaactctccgccatttcggcttggagatttcccctgatagatttcaccgattctcgtttcatccaacctaaagttaaactgtgcattatggtagcctaattcgacatactttctgcactcaggatatttattaatgtcataattcggtacagggaggagcttcgcccactcaacgcccaatgtctcgagcgctttcgcgaatgcattctggtgagcattgtcgcgtacaatcagaaaagcaagtgtttcgcggaacgtctgattagagctcatttcataaattcttgttttttgcagcacacctgtcgactcaagaagcagattatcaagcaggtcagtaattaagtttccgtggttatacacccacgacccgttccacggattgccccctgcatcaacaggaagggaactttgcgctccaataatataatgatgaggattagcatgtttaaccgcttcatcaagtggcgcttgatctgcaccttgactgccgacaccttcaccgcctgattcatctaataaagcattgattgtgttttgaaccagttcaacgtgggcaatctcctccaaaaaaatgccgcgaagcagatcgcggtactgtttctgctttcctctgaaattagagctttggaaaaaaaactgcatcattgtacgcatttctccgtaatgaccgcctaatatctcctgcag

SEQ ID NO: 420 - protein, 315 aa, Bacillus subtilis
MTHPLFLEPVFKERLWGGTKLRDAFGYAIPSQKTGECWAVSAHANGPSAVKNGPLAGKTLDQVWQDHPEIFGFPDRKVFPLLVKLLDANMDLSVQVHPDDDYAKLHENGDLGKTECWYIIDCKDDAELILGHHASTKEEFKQRIESGDWNGLLRRIKIKPGDFFYVPSGTLHALCEGTLVLEIQQNSDTTYRVYDYDRCNDQGQKRTLHIEKAMEVITIPHIDKVHTPEVKEVGNAEITVYVQSDYFSVYKWKISGRAAFPSYQTYLLGSVLSGSGRIINNGSQYECNAGSHFVLPAHFGEFSIEGTCEFMISHP

SEQ ID NO: 421 - protein, 362 aa, Bacillus subtilis
MFKKHTISLLILFLLASAVLAKPIEAHTVSPVNPNAQQTTKTVMNWLAHLPNRTENRVLSGAFGGYSHDTFSMAEADRIRSATGQSPAIYGCDYARGWLETANIEDSIDVSCNSDLMSYWKNGGIPQISLHLANPAFQSGHFKTPITNDQYKKILDSSTAEGKRLNAMLSKIADGLQELENQGVPVLFRPLHEMNGEWFWWGLTSYNQKDNERISLYKQLYKKIYHYMTDTRGLDHLIWVYSPDANRDFKTDFYPGASYVDIVGLDAYFQDAYSINGYDQLTALNKPFAFTEVGPQTANGSFDYSLFINAIKQRYPKTIYFLAWNDEWSPAVNKGASALYHDSWTLNKGEIWNGDSLTPIVE

SEQ ID NO: 422 - DNA, 1083 bp, Bacillus subtilis
atgcttaaaaagttagcagtctgcctgtctatcgttttattactcttaggagccgccagtccgatatcggctcacaccgtttatcccgtcaacccaaatgcccagcagacgacaaaagatatcatgaactggctggcccacctgcccaaccgttcagaaaacagggtcatgtccggagcgttcggcgggtacagtgatgtcactttttcaatgacagaggaaaaccgcttgaaaaacgcgacgggacagtctcccgccatctacggctgtgactatgggagagggtggctggaaacagcggatatcaccgatactatcgattacagctgcaacagcagcttaatctcatactggaaaagcggcggcctccctcaggtcagcctgcatctcgcaaatccggcctttccatccggaaactataaaacggccatctcaaacagccagtacaaaaacatccttgacccttcaactgtggaaggaaaacggcttgaggcgctgctcagcaaaatcgccgacggccttactcagctgaaaaatcaaggcgtcaccgttctgttcagaccgctgcatgaaatgaacggcgagtggttctggtgggggctgacaggctacaaccaaaaagacaatgagagaatctcgctgtacaaagagctttacaagaagatataccgctatatgacagagacaagaggattggataaccttttgtgggtgtattcgccggatgccaacagagactttaaaacagacttctacccaggctcatcttatgtggatattaccggtctggacgcttacttcactgatccgtatgcgatatcaggctatgatgaaatgctgtctctgaaaaaaccgtttgcctttgccgaaaccggtccgtccggcaatatcggaagctttgattatgctgcttttattaatgcgatcaggcaaaaataccctcagaccgcgtactttttgacatgggatgaacaattaagtccggcggccaatcaaggcgcgcaaagcctttatcaaaacagctggacgctgaacaagggcgaaatatggaacggcgggtccttgacgccgatcgcggaataa

SEQ ID NO: 423 - protein, 360 aa, Bacillus subtilis
MLKKLAVCLSIVLLLLGAASPISAHTVYPVNPNAQQTTKDIMNWLAHLPNRSENRVMSGAFGGYSDVTFSMTEENRLKNATGQSPAIYGCDYGRGWLETADITDTIDYSCNSSLISYWKSGGLPQVSLHLANPAFPSGNYKTAISNSQYKNILDPSTVEGKRLEALLSKIADGLTQLKNQGVTVLFRPLHEMNGEWFWWGLTGYNQKDNERISLYKELYKKIYRYMTETRGLDNLLWVYSPDANRDFKTDFYPGSSYVDITGLDAYFTDPYAISGYDEMLSLKKPFAFAETGPSGNIGSFDYAAFINAIRQKYPQTAYFLTWDEQLSPAANQGAQSLYQNSWTLNKGEIWNGGSLTPIAE

SEQ ID NO: 424 - DNA, 1283 bp, Bacillus subtilis
ccttaatgaatggaggagttgcatttgtttaagaaacatacgatctctttgctcattttatttttacttgcgtctgctgttttagcaaaaccaattgaagcgcatactgtgtcgcctgtgaatcctaatgcacagcagacaacaaaagcagtgatgaactggcttgcgcacctgccgaaccgaacggaaaacagagtcctttccggagcgttcggaggttacagtcatgacacattttctatggctgaggctgatagaatccgaagcgccaccgggcaatcgcctgctatttacggctgcgattatgccagaggatggcttgaaacagcaaatattgaagattcaatagatgtaagctgcaacagcgatttaatgtcgtattggaaaaatgatggaatccctcaaatcagcttgcacctggcgaatcctgcttttcagtcagggcattttaaaacaccgattacaaacgatcagtataaaaaaatactagattcttcaacagcagaagggaagcggctgaataccatgctcagcaaaattgctgacggacttcaagagctggagaaccaaggtgtgcctgttttgttcaggccgctgcatgaaatgaacggtgaacggttttggtggggacttacatcatataaccaaaaggataatgaaagaatctctctatataaacagctctacaagaaaatctatcattatatgaccgacacaagaggacttgatcatttgatttgggtttactctcccgacgccaaccgagattttaaaactgatttttacccgggcgcgtcttacgtggatattgtcggattagatgcgtattttcaagatgcctactcgatcaatggatatgatcagctaacagcgcttaataaaccatttgcttttacagaagtcggcccgcaaacagcaaacggcagctttgattacagcctatttatcaatgcaataaaacatagatatcctaaaaccatttactttctggcatggaatgatgaatggagcccagcagtaaacaagggggcttcagctttatatcatgacagctggacactcaataagggagaaatatggaatggcgattctttaacgccaatcgttgagtgaatccgtaatgtcacaattaagaaggtgctcaagaagtttcttaagcaccttcccactggattaagcattcatatcgcctaacccaggactgtgttcatttggtatttcaggaagcactggtacgggaaagcctgccggaggatctattacttgtaactctccgccatttc

SEQ ID NO: 425 - protein, 367 aa, Bacillus subtilis
MEELHLFKKHTISLLILFLLASAVLAKPIEAHTVSPVNPNAQQTTKAVMNWLAHLPNRTENRVLSGAFGGYSHDTFSMAEADRIRSATGQSPAIYGCDYARGWLETANIEDSIDVSCNSDLMSYWKNDGIPQISLHLANPAFQSGHFKTPITNDQYKKILDSSTAEGKRLNTMLSKIADGLQELENQGVPVLFRPLHEMNGERFWWGLTSYNQKDNERISLYKQLYKKIYHYMTDTRGLDHLIWVYSPDANRDFKTDFYPGASYVDIVGLDAYFQDAYSINGYDQLTALNKPFAFTEVGPQTANGSFDYSLFINAIKHRYPKTIYFLAWNDEWSPAVNKGASALYHDSWTLNKGEIWNGDSLTPIVE

SEQ ID NO: 426 - DNA, 2079 bp, Bacillus circulans
atttcttgaacaggcaatcccgcctttggctgcttgttcatcaatctttaaatcggcgttcacttggccgtaaaacccgccgttggtttcgtccttcaatcctccccaaaaaggcaggatatgctccagccattcttttcggatttcagaacccagggtatgtaaagtcattgtcatataaagcctccgttattaagttatcgttaaccttaaaaaatattttaagaaagagtatcgttcgatgtcaacgaaatcttttacacgcaacattattataaacatatatacaccattgacaggtgaaggtgaggcatataaaattcggattattacttaaacgattacctaaataatctacacacttcggttttgattcatcatctagtgtcgaggctagaaatcaaatgatatgaatccagagggaggaagatgatgttgatatggatgcagggatggaagtctattctagtcgcgatcttggcgtgtgtgtcagtaggcggtgggcttcctagtccagaagcagccacaggattttatgtaaacggtaccaagctgtatgattcaacgggcaaggcctttgtgatgaggggtgtaaatcatccccacacctggtacaagaatgatctgaacgcggctattccggctatcgcgcaaacgggagccaataccgtacgagtcgtcttgtcgaacgggtcgcaatggaccaaggatgacctgaactccgtcaacagtatcatctcgctggtgtcgcagcatcaaatgatagccgttctggaggtgcatgatgcgacaggcaaagatgagtatgcttcccttgaagcggccgtcgactattggatcagcatcaaaggggcattgatcggaaaagaagaccgcgtcatcgtcaatattgctaatgaatggtatggaaattggaacagcagcggatgggccgatggttataagcaggccattcccaaattaagaaacgcgggcattaagaatacgttgatcgttgatgcagcgggatgggggcaatacccgcaatccatcgtggatgagggggccgcggtatttgcttccgatcaactgaagaatacggtattctccatccatatgtatgagtatgccggtaaggatgccgctacggtgaaaacgaatatggacgatgttttaaacaaaggattgcctttaatcattggggagttcggcggctatcatcaaggtgccgatgtcgatgagattgctattatgaagtacggacagcagaaggaagtgggctggctggcttggtcctggtacggaaacagcccggagctgaacgatttggatctggctgcagggccaagcggaaacctgaccggctggggaaacacggtggttcatggaaccgacgggattcagcaaacctccaagaaagcgggcatttattaaaatcgggktaaggtagatgagattgcatgttaacagcaagctcaaacatatggatgcatgcaggctgtcgaggaaccgtctcgacggcttttttctataggattttctgaatcgacatacagcctattcttgcatcctcttcgagacctatcgacaaagaagaggaacaacctttgtgcgatatcaatatgcttggctttggagaaacctgcatctagtgcggggttttgttttgatggtttaaatatatatttaattcctacttgacaggtggtattaattggtttaatctagccacaagcaaattcattcagtcctcattaaatgatcattcattatcttagtattgaacgatatatcagccgattggtctaccaaaggctcctgtttactcgatttcgttattttaacggaaggggaaatgggagcctttctgtattttccggacatcgttacggattatgacttggagtctgaggctatcgttccacaggaaggagcggcatggaagaaacggattgggcattaatggaagaggcggattggcattttcgcaaaatggtgcggagatttgtcaaggagcgtgacaaaatctcgatagaaggcgtatcgctgccaggtttgttgatcctgaacaccatattgcgggatggggagcagaagctt

SEQ ID NO: 427 - protein, 327 aa, Bacillus circulans
MMLIWMQGWKSILVAILACVSVGGGLPSPEAATGFYVNGTKLYDSTGKAFVMRGVNHPHTWYKNDLNAAIPAIAQTGANTVRVVLSNGSQWTKDDLNSVNSIISLVSQHQMIAVLEVHDATGKDEYASLEAAVDYWISIKGALIGKEDRVIVNIANEWYGNWNSSGWADGYKQAIPKLRNAGIKNTLIVDAAGWGQYPQSIVDEGAAVFASDQLKNTVFSIHMYEYAGKDAATVKTNMDDVLNKGLPLIIGEFGGYHQGADVDEIAIMKYGQQKEVGWLAWSWYGNSPELNDLDLAAGPSGNLTGWGNTVVHGTDGIQQTSKKAGIY

SEQ ID NO: 428 - DNA, 1473 bp, Bacillus sp. JAMB-602
ttgaataatggttttaaaaagatatttgccataacgttatcattactattagttagctctattctgttcgtttcaggaacttctacagctaatgcaaattcgggcttttatgtaagcggtaccactctttacgatgccaatggaaatccatttgtaatgagagggattaaccatgggcacgcatggtataaagaccaggcaacaacagcaattgaagggattgcaaataccggtgctaatacggtacggattgtattatctgatggtggacaatggacaaaagatgacattcaaacagtaaggaacctcatttctttagcggaagataataatttggttgctgttcttgaagttcatgatgctaccggttatgactccattgcttcactcaatcgtgctgttgattattggattgaaatgagaagtgctttaatagggaaggaagatactgtcataattaatattgcgaatgaatggtttggttcgtgggatggggcagcttgggcagacggatataaacaagcgatcccacgattgcgcaatgccggtctaaacaatactttgatgatagatgctgcggggtggggacaatttccacaatcgattcatgattatggaagagaagtttttaatgctgaccctcaacgaaatacaatgttttcaattcatatgtatgaatatgcagggggaaatgcatcgcaagttcgtactaatattgaccgagttcttaatcaggaccttgcattagtcattggtgaatttgggcaccgtcatacaaatggtgacgtagatgaatcaacgattatgagctattctgaacaaagaggagttgggtggttggcgtggtcatggaaagggaatggaccagaatgggaatatttagacctttcgaacgattgggcgggtaataaccttacagcttggggaaatacaatagtaaatggtccatatggtttaagagaaacttcgaaattaagcaccgtttttacaggtggaggatctgatggacgaacttctccaacaaccctttatgattttgaagaaagtactcaaggatggacaggaagtagcttgagccgaggtccttggactgtgacggagtggtcttctaaaggaaatcattctttaaaagcagatattcaaatgtcgtcaaattcacaacattacttacatgttattcaaaataggtctttacagcagaatagtaggatacaagctactgttaaacatgcaaattggggaagtgttggtaatggaatgactgcgcgtctttatgtgaaaacaggacatggttatacttggtactctggaagctttgtgccgattaatggttcatctgggacaacgctatctctagatttatcaaatgtccaaaatctttctcaagtaagggaaattggagttcagttccaatcagagagtaatagcagtggacaaacatcgatttatattgataatgtgatagtggaatag

SEQ ID NO: 429 - protein, 490 aa, Bacillus sp. JAMB-602
MNNGFKKIFAITLSLLLVSSILFVSGTSTANANSGFYVSGTTLYDANGNPFVMRGINHGHAWYKDQATTAIEGIANTGANTVRIVLSDGGQWTKDDIQTVRNLISLAEDNNLVAVLEVHDATGYDSIASLNRAVDYWIEMRSALIGKEDTVIINIANEWFGSWDGAAWADGYKQAIPRLRNAGLNNTLMIDAAGWGQFPQSIHDYGREVFNADPQRNTMFSIHMYEYAGGNASQVRTNIDRVLNQDLALVIGEFGHRHTNGDVDESTIMSYSEQRGVGWLAWSWKGNGPEWEYLDLSNDWAGNNLTAWGNTIVNGPYGLRETSKLSTVFTGGGSDGRTSPTTLYDFEESTQGWTGSSLSRGPWTVTEWSSKGNHSLKADIQMSSNSQHYLHVIQNRSLQQNSRIQATVKHANWGSVGNGMTARLYVKTGHGYTWYSGSFVPINGSSGTTLSLDLSNVQNLSQVREIGVQFQSESNSSGQTSIYIDNVIVE

SEQ ID NO: 430 - DNA, 1434 bp, Agaricus bisporus
agaaaatgaagcctgcgattagattcattattttggctatttctatctctctagcgaccgcagatgttccagtctggggtcagtgcggtggcagggattggacgggagagacagcttgtgcaagtggatcatcttgtgtcgtgcagaacgaatggtactcgcagtgcctccctggatcaacaactccaacaaaccctccccctgccactaccacctcccaaactaccgctcctcctaccacttcacacccagtgtcgaccggatttgtcaaagcttctggtaccagattcactctaaatggccaaaaatacaccgttgttggaggcaattcctactgggtcggtttaactgggctgagcaccagtgcaatgaatcaggctttctccgacatcgctaacgctggaggaacaaccgtccgaacatggggattcaatgaagtaacctcgccaaacggcaattattatcaatcctggtctggtgccagacctactataaacaccggagcgtctggtctacttaatttcgacaatgtgattgctgcggccaaggcaaatggaattcgtctgatagttgctctgacgaataattgggcggactatggtggcatggacgtctatgtcaaccagatggtgggcaatggccaaccacacgatcttttctacacaaacaccgcaatcaaggacgcgttcaaatcttatggccgggccttcgtgagccgctatgccaacgaacctaccgtaatggcttgggagcttgcaaatgagccgaggtgcaaaggtagcaccggcacgacttctggaacctgtacaactacgaccgtcacgaattgggccaaggagatgtcggcgtttattaaaaccattgatagcaaccatctcgttgctattggtgatgagggtttctataatcaacccggtgctccaacttatccataccaaggaagcgaaggtgttgatttcgaagctaatctcgctatctcctctgtcgactttgcgaccttccattcctatccggaaccgtggggacagggcgccgatgcaaaagcctggggcactcaatggattacagatcatgctgccagtatgaagagggtcaacaaacccgttatccttgaagaattcggtgtaactactaatcaacctgatacttacgctgagtggttcaacgagatagaatcatcagggttgactggtgatctcatttggcaagccggttctcacttgtctacgggagatacacccaatgacggttatgctgtctaccccgatggtccagtatacccgttagtgaagtcgcatgcaagtgcaatgaaaaaccgggcttgaattagtattgttgatcacgattgaattgtatgtacttgtattccatatccgtttttgttgaaagtagtacacatgcgtacataccggtaaataaacactttgaattgtg

SEQ ID NO: 431 - protein, 439 aa, Agaricus bisporus
MKPAIRFIILAISISLATADVPVWGQCGGRDWTGETACASGSSCVVQNEWYSQCLPGSTTPTNPPPATTTSQTTAPPTTSHPVSTGFVKASGTRFTLNGQKYTVVGGNSYWVGLTGLSTSAMNQAFSDIANAGGTTVRTWGFNEVTSPNGNYYQSWSGARPTINTGASGLLNFDNVIAAAKANGIRLIVALTNNWADYGGMDVYVNQMVGNGQPHDLFYTNTAIKDAFKSYGRAFVSRYANEPTVMAWELANEPRCKGSTGTTSGTCTTTTVTNWAKEMSAFIKTIDSNHLVAIGDEGFYNQPGAPTYPYQGSEGVDFEANLAISSVDFATFHSYPEPWGQGADAKAWGTQWITDHAASMKRVNKPVILEEFGVTTNQPDTYAEWFNEIESSGLTGDLIWQAGSHLSTGDTPNDGYAVYPDGPVYPLVKSHASAMKNRA

SEQ ID NO: 432 - DNA, 1862 bp, Piromyces sp.
atgttaactttaacactattgctatatctttctttcataactactgttttttctaaaaaagtaatttatgaagctgaaaatggtaaattagatggtgtttcaaagtataatgaattgcaaggttattcaggaacaggatatgttggtaggtttgaaagtgcaggaaattctgttaccgtaactgttgaagtttctcaaactggaatgtacgatatgtcgattatttattgtggaaatatgggacaaaaaattaattcacttaaaataaatggtaaaaattctggtgacattacatttccagaaaatagtagttttgaagagttgaacattggtgctgtttatttaaattctggagaaaatactgtaagtttagttgcgtcatggggttggatatggattgatgctttggttgttaatgatacaccaaatgttgctaaagatgtatctccacatattaatccaactttagttaatccaaaggctattcctgctgctaaaaaactttatgatttcttaagatctaattacggaaaaagaattctttctggtcaagttggtggtgctggtcaagctggtgatgaaggtcaggaaattcaacgtattcaaaaggctactggtaaattaccagctgtttggaatatggatttcatttttgaatcaaatgattgtacttggagaccagaaaatccagatataactgaaatggctattaattggtggaagaagtaccaaggaaaaggtattatggcggctcaatggcattggaacattgctggtaaaactggtgatttcgctttctataaaaaggatactactttcagtattgataatgctgttactgaaggtacatgggaatacgaaaagattattaaggatattgatcgtgttgccggtcacattaagaagttacaagctgtcaatatgcctttaatttggagaccacttcatgaaaacgatggagattggttctggtggggtaataatccaaaatcatgtgctaaattatggaaaatcttatatgaacgtatggtcaattaccatggtttaaacaatttaatttggctttggaatggtaaaaacgatgctaatactccagttgattacattgatataatcggtgttgatatttatgctaatgatcatggaccacaaactactgcttacaacactcattttgatttctatggaggtaaaaagatggttgttttatcagaaaatggacgtattccagatattcaacaatgtgttgatcaaaatgcttggtggggatacttccaaacttggaacagtgaattcattttacaagattcataccatactgatgctcaacttaaagaatactttactcataaaactgttatgaatatggatgaacttccatcattcaatgtaaatagttatgaataccaatcaggaaataacaataacaattctagcaataacaacaataacaataattcatcagaatgcttctcaattcctcttggctatccatgttgtaagggtaacacagttgtttacactgacaatgatggtgactggggtgttgaaaataatgaatggtgtggtattggaaatagttcttcagctgtcgtttgttggtctgaagctttaggatatccatgctgtgtttcttcatccgatgtttactatactgataatgatggtgaatggggtgttgaaaacggagattggtgtggtattatttaaataatttttatttaagtattcattcattcgaaatttataaataaagtattatatattatatataatgtatgtaaattaaattgaataagtaaaaataaatttaaataaaatataaataaaatataaataaaaaataaaaaaaaaaaaaaaaa

SEQ ID NO: 433 - protein, 569 aa, Piromyces sp.
MLTLTLLLYLSFITTVFSKKVIYEAENGKLDGVSKYNELQGYSGTGYVGRFESAGNSVTVTVEVSQTGMYDMSIIYCGNMGQKINSLKINGKNSGDITFPENSSFEELNIGAVYLNSGENTVSLVASWGWIWIDALVVNDTPNVAKDVSPHINPTLVNPKAIPAAKKLYDFLRSNYGKRILSGQVGGAGQAGDEGQEIQRIQKATGKLPAVWNMDFIFESNDCTWRPENPDITEMAINWWKKYQGKGIMAAQWHWNIAGKTGDFAFYKKDTTFSIDNAVTEGTWEYEKIIKDIDRVAGHIKKLQAVNMPLIWRPLHENDGDWFWWGNNPKSCAKLWKILYERMVNYHGLNNLIWLWNGKNDANTPVDYIDIIGVDIYANDHGPQTTAYNTHFDFYGGKKMVVLSENGRIPDIQQCVDQNAWWGYFQTWNSEFILQDSYHTDAQLKEYFTHKTVMNMDELPSFNVNSYEYQSGNNNNNSSNNNNNNNSSECFSIPLGYPCCKGNTVVYTDNDGDWGVENNEWCGIGNSSSAVVCWSEALGYPCCVSSSDVYYTDNDGEWGVENGDWCGII

SEQ ID NO: 434 - DNA, 2020 bp, Piromyces sp.
attaaaattataatttttttaaattattaaatatttaattagaattatattgatttatataacattgtgtattgattacataaatatttaaataataaaaaactataataataagctattaaaaaagttttattttcattttattgattaaaatgaattctttaagtcttttattattctgtatttttttcgttttttcgacttttgctaaaaaagtttactacgaagctgaaaatggtaaacttgatggcgtaactgtatacaaaagtgatcttactggtttttctggtactggttatgttggtagatttgaaaatccaggaaattctgttaccgtaactgttgaagttcctcaaactggtatgtatgatttaaccattgtttattgtgctaatatgggtcaaaagatcaattctcttactgttaatggtcaaagtgctggtgatattactttcactgaaaatactaaattcgaagatttaaatgttggtgccatttacttaaacaaaggaaagaatacaattggtcttgtttcttcatggggttggatgtgggttgatgcttttgttattaatgatgctccaaatgctgctaaagatgttacttcaaaacttaatccaactttaattaatccaaaggccatcccagctgctaaaaaactttatgatttcttaaagactaattatggtaagagaattctttctggtcaagttggtgctgctggtcaagctggtgatgaaggtcaagaaattcaacgtattcaaaaggctactggtaaattaccagctgtttggaatatggatttcatttttgaatcaaatgattgtacttggagaccacaaaatccagatattactgaaatggctattaactggtggaagaaataccaaggaaaaggtattatgtcagctcaatggcattggaacattgctggtaaaactggtgatttcgctttctataaaaaggatactactttcagtattgataatgctgttactgaaggtacatgggaatacgaaaagattattaaggatattgatcgtgttgccggtcacattaagaagttacaagctgtcaatatgcctttaatttggagaccacttcatgaaaacgatggagattggttctggtggggtaataatccaaaatcatgtgctaaattatggaaaatcttatatgaacgtatggtcaattaccatggtttaaacaatttaatttggctttggaatggtaaaaacgatgctaatactccagttgattacattgatataatcggtgttgatatttatgctaatgatcatggaccacaaactactgcttacaacactcattttgatttctatggaggtaaaaagatggttgttttatcagaaaatggacgtattccagatattcaacaatgtgttgatcaaaatgcttggtggggatacttccaaacttggaacagtgaattcattttacaagattcataccatactgatgctcaacttaaagaatactttactcataaaactgttatgaatatggatgaacttccatcattcaatgtaaatagttatgaataccaatcaggaaataacaataacaattctagcaataacaacaataacaataattcatcagaatgcttctcaattcctcttggctatccatgttgtaagggtaacacagttgtttacactgacaatgatggtgactggggtgttgaaaataatgaatggtgtggtattggaaatagttcttcagctgtcgtttgttggtctgaagctttaggatatccatgctgtgtttcttcatccgatgtttactatactgataatgatggtgaatggggtgttgaaaacggagattggtgtggtattatttaaataatttttatttaagtattcattcattcgaaatttataaataaagtattatatattatatataatgtatgtaaattaattgaataagtaaaaataaatttataatataaataatataaataaaatatactttaaaaaaaaaaaaaaaaaaa

SEQ ID NO: 435 - protein, 571 aa, Piromyces sp.
MNSLSLLLFCIFFVFSTFAKKVYYEAENGKLDGVTVYKSDLTGFSGTGYVGRFENPGNSVTVTVEVPQTGMYDLTIVYCANMGQKINSLTVNGQSAGDITFTENTKFEDLNVGAIYLNKGKNTIGLVSSWGWMWVDAFVINDAPNAAKDVTSKLNPTLINPKAIPAAKKLYDFLKTNYGKRILSGQVGAAGQAGDEGQEIQRIQKATGKLPAVWNMDFIFESNDCTWRPQNPDITEMAINWWKKYQGKGIMSAQWHWNIAGKTGDFAFYKKDTTFSIDNAVTEGTWEYEKIIKDIDRVAGHIKKLQAVNMPLIWRPLHENDGDWFWWGNNPKSCAKLWKILYERMVNYHGLNNLIWLWNGKNDANTPVDYIDIIGVDIYANDHGPQTTAYNTHFDFYGGKKMVVLSENGRIPDIQQCVDQNAWWGYFQTWNSEFILQDSYHTDAQLKEYFTHKTVMNMDELPSFNVNSYEYQSGNNNNNSSNNNNNNNSSECFSIPLGYPCCKGNTVVYTDNDGDWGVENNEWCGIGNSSSAVVCWSEALGYPCCVSSSDVYYTDNDGEWGVENGDWCGII

SEQ ID NO: 436 - DNA, 2336 bp, Piromyces sp.
tttatttcctacataaactttataataatatataataacatcaataaatataacaacaattatagaatcaatagtaaatctaattgtcaataaataagatatcaaaatataaataataataatatgaaatctttaaatgtaatattaaccttattatcattaataataagtgttttatcgaaaaaagtatactacgaagcggaagatggtaaactcaatggtattactgttttcaaagaactctcaggattttcaggaaaaggttatgttggtagattcgaaaatccaggaaattcagttactgtaactgttgatgcaccagcaactggtatgtacgatttatccattatttattgtgctaacatgggtcaaaaaattaattctcttactgtcaatgatcaaagtgttggagatattacttttacagaaaacactaagtttgaaactaaagatgttggtgctgtttacttaaataaaggaaaaaatacaattggtcttgtttcttcatggggttggatgtgggttgatgcttttgttattaatgatgctccaaatgctgctaaagatgtttcctcaaaacttaatccaactttagttaatccaaaagctattcctgccgctaaaaaactttatgatttcttaaaaactaattacggaaaaagaattctttctggtcaagttggtgctgctggtcaagctggtgatgaaggtcaagaaattcaacgtattcaaaaggctactggtaaattaccagctgtttggaatatggatttcatttttgaatcaaatgattgtacttggagaccacaaaatccagatataactgaaatggctattaattggtggaagaaatacgaaggaaaaggtattatggcggctcaatggcattggaacattgctggtaaaactggtgattttgctttctacagtaaagatacaacatttaaccttgaaaatgctgttacagaaggtacatgggaatatgaaaaaattattaaggatatcgatcgtgtttctggtcatattaaaaagttacaagctgttaatatgcctttaatctggagaccacttcatgaaaataatggagattggttctggtggggtaataatccaaaagcttgtgctaaattatggaaaatcttatatgaacgtatggtcaattaccatggtttaaacaacttaatttggctttggaatggtaataatgatgctaatactccagttgattacattgatattattggtgttgatatttatgctaatgatcatggaccacaaactactgcttacaacactcattttgatttctatggaggtaaaaaaatggttgttttatcagaaaatggacgtattccagatattcaacaatgtgttgatcaagatgtatggtggggttacttccaaacttggaacagtgaattcattttacaagactcataccatactgatgctcaacttaaagaatacttcaatcacaaaactgttatgaatatggatgaacttccatcctttaatgttgatagctataatggtgatagtggtagttctcataatggtaattctgaatctaattctaacacaggaaattcagatgaatgttggtcaattaatctcggttacccatgttgtattggtgattatgttgttaccactgatgaaaatggtgactggggtgttgaaaataatgaatggtgtggtattgttcataaatcttgttggtccgaacctttaggttacccatgttgtgttggaaacacagttattagtgctgatgaatctggtgattggggtgttgaaaataatgaatggtgtggtattgttcataaatcttgttgggccgaatttttaggttatccatgttgtgttggaaacactgttattagcactgatgaatttggtgattggggtgttgaaaacgacgattggtgtggtattttaaattaaatgaataaaatcgaataaaaaaaaacatccaatataacaacaacaaaatatagaatatatgaatatatataggaatatatataatatcatattaaacttgggtatataattactatagactttacataattgtatatattaaataataattttaaatttatataaataaaatctcattatatatatatatatatatatataaatctcttgtactcaaatttaattcttaatacacaatttacttctgacatctctttcatactatgattatttttatacatctttatcatatttatgacttaaatatatattactaataataaattaataataaaactataatataacaacaacaataataaaaaaaaatataaaaaaaaaaaaaaaaaaaa

SEQ ID NO: 437 - protein, 606 aa, Piromyces sp.
MKSLNVILTLLSLIISVLSKKVYYEAEDGKLNGITVFKELSGFSGKGYVGRFENPGNSVTVTVDAPATGMYDLSIIYCANMGQKINSLTVNDQSVGDITFTENTKFETKDVGAVYLNKGKNTIGLVSSWGWMWVDAFVINDAPNAAKDVSSKLNPTLVNPKAIPAAKKLYDFLKTNYGKRILSGQVGAAGQAGDEGQEIQRIQKATGKLPAVWNMDFIFESNDCTWRPQNPDITEMAINWWKKYEGKGIMAAQWHWNIAGKTGDFAFYSKDTTFNLENAVTEGTWEYEKIIKDIDRVSGHIKKLQAVNMPLIWRPLHENNGDWFWWGNNPKACAKLWKILYERMVNYHGLNNLIWLWNGNNDANTPVDYIDIIGVDIYANDHGPQTTAYNTHFDFYGGKKMVVLSENGRIPDIQQCVDQDVWWGYFQTWNSEFILQDSYHTDAQLKEYFNHKTVMNMDELPSFNVDSYNGDSGSSHNGNSESNSNTGNSDECWSINLGYPCCIGDYVVTTDENGDWGVENNEWCGIVHKSCWSEPLGYPCCVGNTVISADESGDWGVENNEWCGIVHKSCWAEFLGYPCCVGNTVISTDEFGDWGVENDDWCGILN

SEQ ID NO: 438 - DNA, 2015 bp, Clostridium thermocellum
ctatattaatccacacagtctgtatgttgcattgtctgtttttcttgccacggttatatcgtgtcacattacagtaatgttacaacactgcataaaggaataatgaaactgaattaaaattttcatttatataaatttatgcagggaggaatctctatggagaacaaaacttcgataaaagttttcctggcattgatgcttgcggttcttatgccggtggtttcatgcatcaatgtgtcaaatgcagtgctttctgacggggataagtatgagtttgaagacggtatccataaaggtgcccagatttataccgactatgtcggccaaaatgaatacggcgaggtattcgaccttaccggaagcacatgcagctttattgcacaaaagggtacaagcacttcggtgaatgttgaggttgacaaggaaggactttatgaaatattcatctgctatgtgcagccttacgacaaaaacaaaaaagtgcagtatcttaatgtaaacggtgtcaatcagggagaaataagctttccgtttactcttaaatggagagagatttcagcaggaattgtaaagcttaatgcaggtatcaacaatattgaacttgaaagctactggggttatacctattttgattatctgattgtcaaacctgcggatgaaagcattgtagaacttaaggttccgaaaaaattggtaaatcccaatgccacaaaagaagctaaagcccttatgagttatctggttgatatttacggtaaacacatcctttcgggtcagcaggagatctgcggttcccacaactatccgggatctgaggcggagtttacatacatacaggaaaagaccgggaaactgcctgcgataagaggttttgactttatgaactacagagggaacggtttgatgtgggacgaccagtgtgccgagcgtgttatcgaatggtacaaggaaaaaggcggtataccgacggtttgctggcactggttctcgcccggtgatattggaaaaaaagcggacaacagtttctatacagaaagtacgactttcagcatatcaagggctttgactcccggaacgaggaaaatattgcactgcttaacgatatcgacaccatggccagaagctcaagcaggttcaggatgcgagttcgtactgttcagaccgctccatgaggcggaaggtggatggttctggtggggagccgaaggtccggagccttgtgtcagactgtacaggctgctctatgacaaatataccaatgaatatggtttgaacaatcttatctgggtttggacttcatatgattatgaaacctcggctgcatggtatccgggcgatgatgtggtggatatcatcggttacgacaaatataatgcaaaagacggaaaacccaatggaagtgcgatttcatccacattctacaatctggtgaaacttactaatggcaaaaagttggttgcgatgactgaaaatgatacaattccgagagtttcaaaccttgtaaatgaaaaagcaggatggctttatttctgtccgtggtacggctggtggctgacaagcgaacagaacaatcctgtggattggcttgttgaaatgtatcagagcgattactgcataactttggacgagcttcctgacttaaagaattatcctatatcggattatgaggattccaatccggatccgtctccgacacctacacagccgccgaaaattacctatggagatttgaacggagacggcaaagtcaattcaacggacctgacaattatgaaaagatatattctcaaaaactttgataagctagccgtccctgaagaagcggctgacctgaacggggacggaaggataaactcaacggacctttcgatactacacaggtatctgcttcgcataataacgagttttcccgttgaacaacagtagtataaactgaattcgacttgtgattggggccggtgtcttaagatgccggcttttgttataaatatttaattagtgagcaaatcaattgt

SEQ ID NO: 439 - protein, 589 aa, Clostridium thermocellum
MENKTSIKVFLALMLAVLMPVVSCINVSNAVLSDGDKYEFEDGIHKGAQIYTDYVGQNEYGEVFDLTGSTCSFIAQKGTSTSVNVEVDKEGLYEIFICYVQPYDKNKKVQYLNVNGVNQGEISFPFTLKWREISAGIVKLNAGINNIELESYWGYTYFDYLIVKPADESIVELKVPKKLVNPNATKEAKALMSYLVDIYGKHILSGQQEICGSHNYPGSEAEFTYIQEKTGKLPAIRGFDFMNYRGNGLMWDDQCAERVIEWYKEKGGIPTVCWHWFSPGDIGKKADNSFYTESTTFSISRALTPGTRKILHCLTISTPWPEAQAGSGCEFVLFRPLHEAEGGWFWWGAEGPEPCVRLYRLLYDKYTNEYGLNNLIWVWTSYDYETSAAWYPGDDVVDIIGYDKYNAKDGKPNGSAISSTFYNLVKLTNGKKLVAMTENDTIPRVSNLVNEKAGWLYFCPWYGWWLTSEQNNPVDWLVEMYQSDYCITLDELPDLKNYPISDYEDSNPDPSPTPTQPPKITYGDLNGDGKVNSTDLTIMKRYILKNFDKLAVPEEAADLNGDGRINSTDLSILHRYLLRIITSFPVEQQ

SEQ ID NO: 440 - DNA, 1089 bp, Paecilomyces lilacinus
atgaggttctactctatcatttatcaggccctggctcttgccagtctgccacttgctctggctgccaactcgttttcggcgtcaaacttatactatgccgcgggtctgacggttgaccagcagcatacgctcttgtccggccttcaaagtgctggagtcaaggttctgcgagtgtggctcgatggacaatctgggaacgtcaagggaacacccattaacggtttcaatggccttcagggtgccagccccgacagttgggatgacaccgtcttgaaccgccttgatgacttcatgttcaacgctcatagctatggcatcaaattgcttgtctcgatacacagctacaatgctctcgcagcaaacgccgatttctacggcaaatggtacggcacaggagacttctacaccaacggtgatgcgatcaattacttcaagcaacgcatcgcccatgtcttggcgcatgtcaatcctcataacaacaagccatggagccaaagctcagagtatatctttgcttttgaagcgcagaatgaagccatgcacgatcaggaaaaccctagcgccttgcaatcttggcagtgcaccatggcacaggccattaaagacaatctgaaaggcagcactgccatcctagtcagtaccggtggcggtgcttggctggccaactcccttttggacggatacttctcctgttctgccctcgacgtgctcgccattcatgcctacggtaccggagacttcgcaacgagcgcgctgaagccatacgtgactcgggcacagcaggctggtaagaaactcatcatgcaagaatggggagcatgctacacgacagcctcgaacaacaactgcaacggtggaagtcctctcaattctggaacgcgcgacaataacatcaagtcttgggctgccagcatcaccgcagccgggatcccatggttctactggcagatcttgcccaacgaagacccgcatcagggatgggattacgaggtgggcatcaacggtgttaactggggcgctctgcaaacggcgggcctggcagctggaaaggcgcaggcggcatttgacttcagcaaatggcttctgtga

SEQ ID NO: 441 - protein, 362 aa, Paecilomyces lilacinus
MRFYSIIYQALALASLPLALAANSFSASNLYYAAGLTVDQQHTLLSGLQSAGVKVLRVWLDGQSGNVKGTPINGFNGLQGASPDSWDDTVLNRLDDFMFNAHSYGIKLLVSIHSYNALAANADFYGKWYGTGDFYTNGDAINYFKQRIAHVLAHVNPHNNKPWSQSSEYIFAFEAQNEAMHDQENPSALQSWQCTMAQAIKDNLKGSTAILVSTGGGAWLANSLLDGYFSCSALDVLAIHAYGTGDFATSALKPYVTRAQQAGKKLIMQEWGACYTTASNNNCNGGSPLNSGTRDNNIKSWAASITAAGIPWFYWQILPNEDPHQGWDYEVGINGVNWGALQTAGLAAGKAQAAFDFSKWLL

SEQ ID NO: 442 - DNA, 1150 bp, Bacillus circulans
cgagacgtggatgtagcggatgctttaggcgaattagcagacagtctccgtgcagagtttgatatggactaattttgtgaagagggaggacatggatcaaatgaaaagaaagcggttacaattgtttggaacactagtggtattggttttgttcgtgtacggtagcggttcggcatatgcacaaaacggatttcacgtatccggtacagagttgttggacaaaaatggcgatccttatgttatgcgtggcgtcaaccatggacactcttggtttaagcaagatctggaggaagcaatccctgccatagcagaaacaggggcgaacacggtgagaatggtcttatccaatggacagcaatgggaaaaagatgatgcctctgagcttgcccgtgtgctggctgccacagaaacatatggattgacaactgtgctggaagtccatgacgctacaggaagtgacgatcctgctgatttagagaaagcagtcgattattggatcgaaatggctgatgttctcaaggggacagaagaccgagtaatcattaacgttgccaatgaatggtatgggtcgtggaggagcgacgtttgggcagaagcatacgcacaagcgatcccgcgcttgcgcagcgctggcctctcccatacattaatggttgatgcggcaggttggggccagtaccctgcctcaatccacgagcggggagccgatgtgtttgcgtccgatccattaaaaaacacgatgttttcgatccatatgtacgaatatgcaggagctgatagggcgacaattgcctataacattgatcgtgtgcttgctgaaaatcttgctgtggggatcggtgaatttggccatagtcatcatgatggcgatgtcgatgaagatgcgattttggcctatacagcagagcggcaagtgggctggctggcctggtcatggtatggcaacagcgggggtgttgaatacctggatttagctgaaggcccatcaggcccattgacgagttggggcaaacgaattgtttatggtgaaaatgggcttaagagtgattaatcaatagaaaggactggttgctgcttttgcatctcagtcctttttgctgtattcgtgttggtgggcaaaagaaaatgggcgaatcggtacaattcgtga

SEQ ID NO: 443 - protein, 319 aa, Bacillus circulans
MDQMKRKRLQLFGTLVVLVLFVYGSGSAYAQNGFHVSGTELLDKNGDPYVMRGVNHGHSWFKQDLEEAIPAIAETGANTVRMVLSNGQQWEKDDASELARVLAATETYGLTTVLEVHDATGSDDPADLEKAVDYWIEMADVLKGTEDRVIINVANEWYGSWRSDVWAEAYAQAIPRLRSAGLSHTLMVDAAGWGQYPASIHERGADVFASDPLKNTMFSIHMYEYAGADRATIAYNIDRVLAENLAVGIGEFGHSHHDGDVDEDAILAYTAERQVGWLAWSWYGNSGGVEYLDLAEGPSGPLTSWGKRIVYGENGLKSD

SEQ ID NO: 444 - DNA, 1680 bp, Bacillus circulans
tactttattttggtgaccttttgttcgtgggcataaattttttgaaaaggggggtagactcttatttttacgtttatgaatcaaactattaaaaaaatgaggagtgatttatttgaataatggttttaaaaagattttttccataacattatcattactattacttagctctattcttttcgtttcaggaacttctacagctaatgcaaattccggattttatgtaagcggtaccactctatacgatgctaacgggaacccatttgtaatgagaggaattaaccatgggcacgcatggtataaagaccaggcaactactgcaattgaagggattgcaaataccgatgctaatacgattcggattgtgttatctgatgggggacaatggacaaaagatgacattcaaacagtaaggaacctcatttctttagcagaagaaaataatttagttgctgttcttgaagtccatgatgccacgggttatgactctattgcttcactcaatcgtgctgttgattattggattgaaatgagaagtgcattaattggtaaggaagataccgttattattaatattgcaaatgaatggtttggttcgtgggaaggggcagcttgggctgacgggtataaacaagcaatcccgcgattgcgtaacgccggtctaaaccatactttgatggtagatgctgcaggatgggggcaatttccgcaatcgattcatgatttcggaagagaagtttttaatgctgaccctcaacgaaatacaatgttttcaattcatatgtatgaatatgcaggggggaatgcatcgcaagttcgtactaatattgaccgagttcttaatcaagacctcgcattagtcattggtgaatttggacaccgtcatacaaatggcgacgtcgatgaggcaacgattatgagctactctgaacaaagaggagttggatggttggcgtggtcatggaaagggaacggcccagaatgggagtatttagacctttcgaacgattgggctgggaataaccttacagcttggggaaatacaatagtaaatggtccgtatggtttaagagaaacttcgagattgagcactgtttttacaggtggaggctctgatggtgggacttctccgacaactctttatgattttgaagaaagtacgcaaggatggacaggaagtagtttgagcggaggaccttgggctctgacagagtggtcttctaaaggaaatcattctttaaaagcagatattcaattgtcgtcaaattcacaacattacttacatgttattgaaaatacatcgttacaacagagtagtagaatacaagctacagttaaacacgcaaattggggaaatgttggtaatggaatgactgcgcgtctttatgtgaaaacaggacatggttatacatggtactctggaagctttgtgccgattaacggttcatccggaacaacactatctttagatttatcaaatgtccaaaatctttctcaagtaagggaaatgggtgttcagttccaatcatcgagtaatagcagcggacaaacatcgatttatattgataatgtgattgtagaatagaaagaaagagctgttccaaaagggaaatcacccttttggacagctttttttatctactgttcttcagtccctaagtttgcaattgcaccaagaat

SEQ ID NO: 445 - protein, 493 aa, Bacillus circulans
MIYLNNGFKKIFSITLSLLLLSSILFVSGTSTANANSGFYVSGTTLYDANGNPFVMRGINHGHAWYKDQATTAIEGIANTDANTIRIVLSDGGQWTKDDIQTVRNLISLAEENNLVAVLEVHDATGYDSIASLNRAVDYWIEMRSALIGKEDTVIINIANEWFGSWEGAAWADGYKQAIPRLRNAGLNHTLMVDAAGWGQFPQSIHDFGREVFNADPQRNTMFSIHMYEYAGGNASQVRTNIDRVLNQDLALVIGEFGHRHTNGDVDEATIMSYSEQRGVGWLAWSWKGNGPEWEYLDLSNDWAGNNLTAWGNTIVNGPYGLRETSRLSTVFTGGGSDGGTSPTTLYDFEESTQGWTGSSLSGGPWALTEWSSKGNHSLKADIQLSSNSQHYLHVIENTSLQQSSRIQATVKHANWGNVGNGMTARLYVKTGHGYTWYSGSFVPINGSSGTTLSLDLSNVQNLSQVREMGVQFQSSSNSSGQTSIYIDNVIVE

SEQ ID NO: 446 - DNA, 1423 bp, Dictyoglomus thermophilum
accaattttccctgggatatccaaggccaccaggagatgtggatggatttgataaggatggagattcttgtagtgtaactttgaagtaaaggagtctggaatgcacgaattaataattggatatgctgcaccctatggatataaggaaaattccctttatgtaaatggagaatttcaaaccaatgtcaaatttccccaatctcaaaaatttacaaccgtatatgctggtttaattcctttaaaaaatggaaaaaatacaataagtatagtaaaaagctggggatggtttcttcttgactactttaaaatcaaaaaggcagaaattcctaccatgaatcctacaaacaaattagtaacccctaatccatcaaaagaggcccaaaaattaatggactatttagtgagtatatatggaaagtatactctctcgggtcagatgggatataaagatgccttctggatttggaatattactgataagtttccagctatatgtggttttgacatgatggactactcaccttcaagggttgaaagaggagcatcttcaagagatgtggaagatgctatagattggtggaatatgggaggaatagttcaatttcaatggcactggaatgctccaaagggactttatgatactccaggaaaagaatggtggagaggcttttacactaatgctaccagttttgatatagaatatgctctcaaccaccctgaatctgaagattacaaacttataataagggatatagatgctattgcagtacaattaaaaagacttcaagaggcaaaagtccccatactatggagacctttacacgaggcagaaggtagatggttctggtggggagcaaaaggtcctgaagcttgtaaaaaactatggagactactttttgataggcttgtaaattatcataaaataaataatcttatatgggtttggactactacagactctcctgatgctctcaaatggtatcctggagatgaatatgtagatattgtaggagcagatatataccttaaagataaagattattctccatctacaggaatgttctataacattgtaaaactatttggtgggaaaaaactcgtagctctcacagaaaatggaattattccagatccagatttaatgaaagagcaaaaagcttattgggtatggtttatgacctggtcaggttttgaaaatgatccaaacaaaaacgaaatctctcatattaaaaaagtatttaatcatccctttgtaattacaaaagatgagctaccaaacttgaaagttgaagaataaaaaagaatcccccaaagccctttttttctaggctttgggggaatcatattcttacatcttagtttctggtattagagcttttaatagaggttttctccattcattttttacaggatcaaaggcgcc

SEQ ID NO: 447 - protein, 398 aa, Dictyoglomus thermophilum
MHELIIGYAAPYGYKENSLYVNGEFQTNVKFPQSQKFTTVYAGLIPLKNGKNTISIVKSWGWFLLDYFKIKKAEIPTMNPTNKLVTPNPSKEAQKLMDYLVSIYGKYTLSGQMGYKDAFWIWNITDKFPAICGFDMMDYSPSRVERGASSRDVEDAIDWWNMGGIVQFQWHWNAPKGLYDTPGKEWWRGFYTNATSFDIEYALNHPESEDYKLIIRDIDAIAVQLKRLQEAKVPILWRPLHEAEGRWFWWGAKGPEACKKLWRLLFDRLVNYHKINNLIWVWTTTDSPDALKWYPGDEYVDIVGADIYLKDKDYSPSTGMFYNIVKLFGGKKLVALTENGIIPDPDLMKEQKAYWVWFMTWSGFENDPNKNEISHIKKVFNHPFVITKDELPNLKVEE

SEQ ID NO: 448 - DNA, 1801 bp, CELLVIBRIO JAPONICUS
ggaagggccagtttttgccaggccatatttccgggtgttttttccccagggagctaagggcggacgaattgcgcctgtcatttgatctgggcatccgtgtgcgctaccacccctaagcgaaagcaagatgacgaataatgctaagaaatgtaagcaaataaatcctccaggcactggctgtgtataaagccggtcctggaatgccaaccttgtttggccaacctgataacaacagccgggaatgactgattaacaagatcgccgaatcttgatgtcttgggcgaatgtgccgattgagtgcaatcgcctgccagtaagtcgtaaaaaatcccgagaggacaacaatgaaaactattaccactgcacgccttccatgggctgcgcagagctttgccttgggcatttgcctgatagcgctgttgggttgtaatcacgccgctaataaatcatcggcatccagggcagatgtcaaacctgttacggtcaaactggtcgattcccaggcgaccatggaaacccgttccctgtttgcgtttatgcaggagcagcgcagacattccattatgtttgggcaccagcacgaaacaacccagggactcactattacccgcacagatggtacccaatccgatacctttaatgccgttggtgattttgcagcggtctatggttgggacacgctgtctattgttgcccctaaagcggagggcgatattgtcgcccaagtaaaaaaggcttatgcgcgcgggggcatcattacggtgagctcgcattttgataatccaaaaaccgatacccaaaagggcgtatggcccgttggcacttcctgggatcaaaccccggctgttgtggattccctgcctggaggcgcctataacccggtattaaatggctatctcgaccaggtggccgagtgggccaataacctgaaagacgagcaggggcggctgataccggtcatctttcgcctgtaccacgaaaataccggcagttggttctggtggggagataagcaatcaacccctgaacaatacaagcaattgttccgctattccgtcgagtatttgcgcgatgtgaaaggtgtgcgcaatttcctgtatgcctattcgcccaacaacttttgggacgtgaccgaggccaattacctggagcgttatccgggggatgagtgggtggatgtactgggatttgatacctatggcccggtggcggacaacgctgactggttccgcaatgtggtggccaatgcggccttggttgcccgcatggcggaagcgcggggcaaaataccggtgatctccgagataggtatacgcgctcccgacattgaagccgggctctatgataaccagtggtatcgcaagcttatctccggcctcaaggccgatccggatgcacgcgagattgccttcctgctggtatggcgcaatgccccgcagggagttcctggccccaatggcacccaggttccccattattgggtgcctgctaaccgcccggagaatatcaacaatggcaccctggaggacttccaggccttttatgccgatgaattcacagcgttcaatcgcgacatcgagcaggtctatcagcgtccgaccctgatagttaaatagtcttttctcttgactgattcgccgccccagcggttgccggggcggcgaatttgtcctgcttaactgatacccgggataaccgtaaaaataggttaaattgtaggacaataatatcttatggcctgtattctcccacggtttcacgtttgataaaaattccaattcgccctatagtgagtcgtatt

SEQ ID NO: 449 - protein, 423 aa, CELLVIBRIO JAPONICUS
MKTITTARLPWAAQSFALGICLIALLGCNHAANKSSASRADVKPVTVKLVDSQATMETRSLFAFMQEQRRHSIMFGHQHETTQGLTITRTDGTQSDTFNAVGDFAAVYGWDTLSIVAPKAEGDIVAQVKKAYARGGIITVSSHFDNPKTDTQKGVWPVGTSWDQTPAVVDSLPGGAYNPVLNGYLDQVAEWANNLKDEQGRLIPVIFRLYHENTGSWFWWGDKQSTPEQYKQLFRYSVEYLRDVKGVRNFLYAYSPNNFWDVTEANYLERYPGDEWVDVLGFDTYGPVADNADWFRNVVANAALVARMAEARGKIPVISEIGIRAPDIEAGLYDNQWYRKLISGLKADPDAREIAFLLVWRNAPQGVPGPNGTQVPHYWVPANRPENINNGTLEDFQAFYADEFTAFNRDIEQVYQRPTLIVK

SEQ ID NO: 450 - DNA, 2591 bp, Bacillus circulans
ggatcccgcagcctatcaagcttcttccgcagcttattacgaagcgctgaaaaaggccggacatcctgaagtgggcgaaggactggatcatatcctgaaatcccagaatacgcagccggttcgtttcctgtcgacgtgggctggcaaagcgtacccgttcattgaagcatcatggaaaaacattctgatgggcaaagccccgatcaccgaactggatgtgatggccgaaaaaatcaacaaagtgattacgaccggcaagtagtaaccggaaccgttaagctcatgaagccgatcatgaatggaacggatcggcttcgatttgaaaatagaggaggaacattcatgtcactaagatcaggtcaacttttcaggtttctggcggtgcctctggctatcgcgctcatgctcggttccatgccgggcatcggaacgtccaaagcctacgcctataccgcatcagatggggatacagcgatgaaagcttttaacgatacattttgggatccgaacgccaagatgttctggaaggactcgaagcgcgaaaagcatcaagacttctgggtggaggctgagctgtgggaattggtcatggatgcgtatcagcatacatccgatcctgctttgaaagccgagcttaaaacgcaaatcgacgatgtatatgacggcaccgtcgccaagtacgggcaagattggacgaataacccgttcaatgacgatattatgtggtgggcgatgggcagcgccagagcctatcaaatcaccggaaacccaagatatttggaagccgcgagggatcatttcgattttgtgtacgatacgcagtgggatgaagagttcgcaaacggcggcatttggtggctgaacagcgaccataataccaaaaatgcgtgcattaatttcccggcggcgcaagcggcgctttatctttacgatattacgaaagatgagcattatctaaacgcggcaaccaaaatattcagatggggcaaaacgatgcttacggacggaaacggaaaagtgttcgaccgcatcgaaattgaacatggcgcggttccggatgccactcactacaaccagggtacatacattgggtcggccgtcggattgtataaagcgaccggaaatgccgtttacctcgatgacgcggtcaaagccgctaaattcaccaaaaaccatctggtggattcaaacggggtgttgaattatgaaggtcccaacggggatctgaaaggcggcaaaacgatccttatgcgcaatctggcccatctgcaaaagacactggatgaaaccggccagtacccggaattcagtgctgaattcgacgaatggcttgcattcaatatcgaaatggcctggagtcatcggaattcggatcatatcgtggatggaaactgggcgggacaactgctgtccggaacctatgaatcctggtcatcggccgcagccgttcaagctttaaacggtatcaaaccgatggaagcggagcttcattatggtgttaaaaaccccttcgataaaatcgaagcggaacgctacaatatcgggtccggtttcgttctggaaggcgcgttcgaaggttcgctgcaattaggcggaatacagcatggctcttatgccgcttacaaaaatgtggacttcggatccgacggtgcgatcgggttcattgccagagcgtccagcggaacaggcggaggtaacattgagatccggcttgattccaaggatggccccaaagtcgggaccttgaacgtagagggaacgggcgactggaatcaatatatcgatgccgtcaccctccttaaagatgaccagggagcgccgagcacgataaccggcgtccatgatgtgtatcttgtcttcaccaagacgaacgacgattatttattcaatttgaactgggttaaattcacaacaacggacccgacggaaaccgacgcctatgccaagcttaaggccggaaattacgacagcagcgaaggacttagtaaacatgccgagttcggatatttggacgcaatccatcacaatgcctatgcctcttatgaaggaattgatttcggatcgataaataggcggcacctgcgagcgccatggcaacatagaggaaggtagatgcttttccgggtacattcagcgagaaggcaaagtaatacaccaagtagatcgggatcgatttgtaaacgaattggtaggcgatttgcccccattccttggccatcaaatgactgaacaagtgaacggggcgcatcaaatccagagagatatggccggttcgcacggcttggggaatgccgaggccattcgtgacgaaactggaaacccagagcgcagcttgcgtaaaggcgatataaccgaccattccctgcgttccgtattctccgagcgcgtagtctgcaccgagaccgatccagatacaggcatacatgaagccgaacatcgcgctggcgatattgtgcaccatgtgggcgccgcggtactgcaaattgcgggcataggctttggaagccagtgtgaaataaagcatgaagcacctccgataagcattttagatggcggacccatccacttcagacaaggcgaaaatgagagaa

SEQ ID NO: 451 - protein, 589 aa, Bacillus circulans
MSLRSGQLFRFLAVPLAIALMLGSMPGIGTSKAYAYTASDGDTAMKAFNDTFWDPNAKMFWKDSKREKHQDFWVEAELWELVMDAYQHTSDPALKAELKTQIDDVYDGTVAKYGQDWTNNPFNDDIMWWAMGSARAYQITGNPRYLEAARDHFDFVYDTQWDEEFANGGIWWLNSDHNTKNACINFPAAQAALYLYDITKDEHYLNAATKIFRWGKTMLTDGNGKVFDRIEIEHGAVPDATHYNQGTYIGSAVGLYKATGNAVYLDDAVKAAKFTKNHLVDSNGVLNYEGPNGDLKGGKTILMRNLAHLQKTLDETGQYPEFSAEFDEWLAFNIEMAWSHRNSDHIVDGNWAGQLLSGTYESWSSAAAVQALNGIKPMEAELHYGVKNPFDKIEAERYNIGSGFVLEGAFEGSLQLGGIQHGSYAAYKNVDFGSDGAIGFIARASSGTGGGNIEIRLDSKDGPKVGTLNVEGTGDWNQYIDAVTLLKDDQGAPSTITGVHDVYLVFTKTNDDYLFNLNWVKFTTTDPTETDAYAKLKAGNYDSSEGLSKHAEFGYLDAIHHNAYASYEGIDFGSINRRHLRAPWQHRGR

SEQ ID NO: 452 - DNA, 7686 bp, Bacillus stearothermophilus
tgatgatcatgacctagagacatgctgatgtcggcgatggttgacggcgacgacgatattatataagcatcacagagggtgtttccaaaagcaaaatgatggacacccttttttctgcgtctcgatcatcgtgaaggagcgttaaagaaaagacgaaaaagatccgatggcctttcatgaaaaggggcatcggatcttttacataaaatgttatatttttttaaatagcgtgacgttgtcgatataaataggacccttataagctaatttatttccgacgatgttaagaaacagctcgttaacattaggcatagcattaaattcaacattaacgtgtagcaatttgtattgttggttatggattgtaacagtggttaagtcatttacattgacatggtattggtcgacaccgattttgatccaacctggatttaaggcgatgtaaggacgtaaagcgccattgacatccacgcgaggcagaagcaagtcaaatgatatacgggatgtttcgcttaattcagagatagggcttatttttacctttacttcttcccagtctgcattcccaggaagatctacatttacacgcaggcatctcgttttcggcgtgctaatggcaggaattccaaagttggcttgccatgtgccatctgcatatacgttattcatatccgaatcaaaagaaaattgtttgatgatttcatatgcggaagcattttggatattgaccgtcacttcatcggatgcaatcgtttgtttgttcgttaaagtggcagttgcttttaaggtaactgtactgtcctctatttcttttgtggtatcccagtcaaattcgtaataatcgaatgaagcattatatttcatcgtataagcttcatcatggctgctaagttgcagctgtactttttgcactttgtgctggtcactcgccacttttacttttacacgataagtgccgcgaacatcttgtggttttgcagggaaggcaaaatatacttttggttctttttcgacatgtctatctccgttaaacaatttagcatatgtttttagcaggttagtaaccgagctatgatcattgacaatccggaatccgtcataatcaggatagtaaccattttcatccgcgctttcagggttgtcatcgatgccagtcagaagccaaaacattgcaccggtgccgccgtgttcgaacatcgtccgattccatgtatcatatatcatttcacggttttgcactcctgtggcgctaattccgtattcttcgagcacaactggttttttcgctttctttccggcagcaagatggtcaagaatatattgttctccccacttttcgacgttttccggcgaaattccccaatgttcaggatataaatggaatgtcccgtagtctatattttttaaagcaattaaccggtcccagtccaccccgttataaccagtgtacatataggaaccttcaccattgaatccacccgacgaacggcggaagaatccttcgtctcctactgcaacaaggtgatgagggtctattgatttaatatatgtgctcatttcatcggcccagcgaacaagcgtatcccctgttgggtcagagtcgttgcgaggttcgttagccaattcccatgccataatcgtcggttcatttttataaatgatgccggtatattggtttttccgattgattagataatgaacgtaatttttgtaagcggttttaattctttcatctgtatagaataaatcgtgattcgtttctccaatccagttgacatattgcatcatgccgccgaagttattccagttgtttgttaatacgatgactaagcgaattccttcctgcttggctttgtaaatggtgtagtctaaacgttcaaaaccgttttgcgccccttctaattctttaggaatgggtccttctcccatatacttgcccatttcatattgcatgtacgtgttatgcgcttggttttccgaagtcatcccgtcaaaaaatccccaaagacgaatcacttttattcccattttttttgctgattcaatgacgtcatcaatcatttgattggatttgtaatgaaggtaatagttattggttccgacaaagcgaaactctttgttgccaatcattaatttgtcacctttgcggtaaacaaattcattgtcttttgttggagtggcaggttccctctttgtttttgcatgtacgttgttttgggagaaaaagataggtactacagcacaaacgatactaacaagaagcgcgatgaaggtgtaactccattttttgttcatggattaaactcctccttcttttatgaatttctaagtgaaagatctgggcagtcaaaccatggtgtagtggagaatgaaaggtttgtaggaagacaggtaattaactcgtggtggatatagggaaaatatctggatgctgctaggtaaattttataaaacgttttctatgttgtcaacttaaatttaagtaatcgttaagtttaaaattataactaaatgaagttaatttagcaggaatataaaataaaaatggccgaatctataaacctatagatcgttgtattgtgttatttaagtagagaatttaagtagagaaaggatgaacgttcaccatgttcgatatgccgttagcacaattacagaaatacatggggacaaatccgaagccggctgattttgctgacttttggagtcgagcgttggaggaattatctgcccaatcgttgcattatgagctgattccggcaacatttcaaacgacagtggcgagttgctaccatttgtatttcacgggagtcggcggggctagagtccattgtcagttagtaaaaccgagagagcagaagcagaaaggcccggggttggtatggtttcatggctaccatacgaatagcggcgattgggtcgataaactggcatatgctgcggcaggttttactgtattggcgatggattgccgcggccaaggaggaaaatcagaggataatttgcaagtgaaaggcccaacattgaagggccatattattcgcggaattgaggatccaaatcctcatcatctttattatcgaaatgtttttttagatacagttcaggcggtaagaattttatgctctatggatcatattgatcgtgaacgaattggtgtatatggcgcttcccaaggaggagcgttggcattagcgtgtgctgctctggaaccatcggtggtgaaaaaagcggttgtgctctatccatttttatcggattataagcgggcgcaagagttggatatgaaaaataccgcgtatgaggaaattcattattattttcgatttttagatcccacacatgagcgggaagaagaagtattttacaaactaggctatattgatattcaactcttagccgatcggatttgtgccgatgttttatgggctgttgcgctagaagaccatatttgtcccccgtccacacaatttgctgtttataataaaattaagtcaaaaaaagacatggttttgttttacgagtatggtcatgagtatttaccgactatgggagaccgtgcttatctgtttttttgcccgatcttctttccaatccaaaagagaaacgttaagtaaatcttaaaaaattctatcattctttgaggacggggtcgaacatcgtgaaacaacgtgtaacgatgcgtgatatagccagaaaacttggagtgagcagcgtcactgtttcaaaagcactaaatgataaggaaggtgtcagtgaagagctgcggaaaaaaattaaggaaacggcccgggagatggggtatcgtttgaatacgctgaccaaagcgatgaaggaagggtattcgtataacgttggtgtcgtcattccggaacgatttattggagatacacaatcattttatttgcggttttaccagcatatcgccaaagcattagatcattacggctattgcagtatattacacattttgactgcggaagacgaggagcagttgcagctgccgcgggtgtataatgaacggaaagtagacggtttcattatgcttggacaagtaaataaagaatatgcctcgctttttcaacaaattgagctgcctgtcgtatttcttgatttctatcatgaccaagatgttgactgcgtgttaacggataacttttttggtatgtatgagttgactaatcatttaattcaatgtggccatcgggaaattgcttttgtcgggaatatttactctacaagcagcattcaagaccgttttttaggctactataaatcattgttggaacatcgtattcctttacgagaggaatatatcattagcgaccgtgatgaaaaagggaaatatattgatttgtattgccgaaaaacatgccgactgcttttgtatgcaactgtgatcaagtagcctatcatttggttcatacgctcaaagagttagggtaccgtgttcccgaagattgttctgttgtaggatttgataatgacatttatgccacattggcggagctaacttaacgactgtacaagtgaatatggaagaaatgtccgatttggctgtaaaaatgatcatcgagaaaagtaaagaccggaataaaaagtatggcagggttttagtgaaaggacaaattatttatcggactctgtccaacgtataaatgattgagatggcataacaaaaagcggagggggatagctgtgccgattcaagtaaatgaggaaacaaaagaatttcatttatttaatgagaatatcagttatatttttcgggtgctagaaaaaagcaaccaattggaacatttgtactatggaaagcgaatcaaacatcgtgattcttttcagcatctcattgaacgggaagtacggccgtcttgcaatatgtttgaaggcgactatacttcatcgcttgaacatattaaacaggaatatccaagctacggaacgacggactatcgctatccgtcctatgtgatcatgaatgatatcgggagcaccgtgacgaatttccaatatgatagttatcgaattattgctggaaagccgaaacttccttttctgccggctacatatgtggagaacccagaagaagcagatacattggaagtgacattaatcgacgatgtcctacagtgtaagttggttttaagctatacgatttatcgtcatcgcaatgttatttgtcgaaatgccaaattagtgaatgaaggggaaaaggcgttttatatccaccatgccatgagcagcagtgttgattttccggacagtgattttgaaatggtgcagttatcgggagcatgggcaagagagtttcatttggaaacaaaaaaaataacaaagggaatccagtctgtatatagtgttcgcggggcaagcagtcatattcataacccatttcttgctttaaaacgaccggatgcaacggaacataagggggaagtttacggttttagtcttgtctacagcggaaatttcttggcgcaagtcgaagtcgatacgtatgatgtgacccgcgtgctaatgggcattcatccatttcagtttcgttggaagctgtatccgaccgaatcgtttcaaacgcccgaatgtgtgatggtttattccgatcaaggattaaatggaatgagccaaacgtatcacgatttataccgtacccatttagtaagaggaccatggcgggatcgtcctcgccctattttaattaataactgggaagcgacctattttgattttaatgaagaaaaaattttgcaaatcgctaaaacggcaaaagaacttggaatagaattgttcgtgttggacgatggctggtttggcaatcggaatgatgatacaagctcgctgggcgactggtttgaaaatagggagaaactcccaagtggtattaaaggattatcggaaaaaattgaagcgttagggatgaagttcggtttatggtttgaaccagaaatggtttgtaaagacacaaaactgttccaagaacatcccgattgggtgattgctacaccgaaccgccgcatgtcccatggcagaaatcaatttgttttggatttttccaaacaggaagtggtagattatattttcggcttaatgagtcacgtaatagaaaatgcaaagatctcttatattaagtgggatatgaatcggtatataactgaaccatactccaatggattgcctgccgaccgacaaggggaagtattccatcgttatatattaggagtttaccaattatacgaacgattgttggaagcgtttcctcacattttatttgaatcctgtgcgggtggtggcggaaggtttgatccagggatgctatattacgcaccgcaagcatggacgagtgatgacaccgatgcggtggaacggctgaaaattcaatatggtgcttccctcgtatacccgttaagttcgattggcagccatgtttcagctgttccaaatcatcaagttggacggataactccgcttgacacaagagctaatgttgcttatttcggaacgtttggatatgagttggatattacgaaattaacggacgaagaaaaagaaaaggtgaagcagcaagtcaccttttttaaagaaaagagacaacttattcatcacggccgtttttatcggctgcttgacccgttccactcgaatgaagtggcatggatggttgtatcagaagaccaaaaagaagccatcgtaggctattatcaagtactggccaaaccaaatgatcgttatcaccgtctcaagttaaagggattgcatccggatttcctttatgttgtagaaggaaaagggactacccattacggcgatgagctgatgaacgttgggatgatttttgctgagaattacacagaccgtgcccatgaatattggcagcgtgagaagaaaggcgattttgcttcgcaagttttcgtgttgaaggcaatatcttaagtttatacggaagggacaccgtcatttttgctttcgttgtggaaaaacggaaagaaaccgtttcgcttcgatgaatgataatgaatcaggtagcacgggggtggggatacgatgaaacattatatggtatttgatattggcggcacccatgtaaaacatgccgtcatgaatgagacaggcagttttttagaaaagggaagttacccttccgaacgaaatgattttgagaaatttaaagaagatttgctggctgtcgtacggcaggcaaaggagcgttatgaagtggtgggaattgcaatgagctgcctggcggagtggatagtgacagcggtgtgatcggagggagcagtgctcttccttgcattcatggcccgaattttaaagaagtatttgggagtgaaaccggtcttccggtggaattggaaaatgagccgaattgcgcggcccttggggagctttggaaaggagcggcaaacataatcgagatgttttatttgtcgtagtaggaacgggaatcggcggagcggttgtcaaagaccgaaaaattcataaaggtgcccacctgcatggcggggagtttggttatatgattatggatgtccgcaacgaaaacgggaatatagaatgcaaaacatggagcgacattggtgcgacccggagcgcttgatagccgtgttgctagaagaaaaagagagttagcgtccatgagctaaacggtaaaaggtttttgcgatgatggaacaaggggacctgcag

SEQ ID NO: 453 - protein, 682 aa, Bacillus stearothermophilus
MNKKWSYTFIALLVSIVCAVVPIFFSQNNVHAKTKREPATPTKDNEFVYRKGDKLMIGNKEFRFVGTNNYYLHYKSNQMIDDVIESAKKMGIKVIRLWGFFDGMTSENQAHNTYMQYEMGKYMGEGPIPKELEGAQNGFERLDYTIYKAKQEGIRLVIVLTNNWNNFGGMMQYVNWIGETNHDLFYTDERIKTAYKNYVHYLINRKNQYTGIIYKNEPTIMAWELANEPRNDSDPTGDTLVRWADEMSTYIKSIDPHHLVAVGDEGFFRRSSGGFNGEGSYMYTGYNGVDWDRLIALKNIDYGTFHLYPEHWGISPENVEKWGEQYILDHLAAGKKAKKPVVLEEYGISATGVQNREMIYDTWNRTMFEHGGTGAMFWLLTGIDDNPESADENGYYPDYDGFRIVNDHSSVTNLLKTYAKLFNGDRHVEKEPKVYFAFPAKPQDVRGTYRVKVKVASDQHKVQKVQLQLSSHDEAYTMKYNASFDYYEFDWDTTKEIEDSTVTLKATATLTNKQTIASDEVTVNIQNASAYEIIKQFSFDSDMNNVYADGTWQANFGIPAISTPKTRCLRVNVDLPGNADWEEVKVKISPISELSETSRISFDLLLPRVDVNGALRPYIALNPGWIKIGVDQYHVNVNDLTTVTIHNQQYKLLHVNVEFNAMPNVNELFLNIVGNKLAYKGP

SEQ ID NO: 454 - protein, 329 aa, Bacillus stearothermophilus
MFDMPLAQLQKYMGTNPKPADFADFWSRALEELSAQSLHYELIPATFQTTVASCYHLYFTGVGGARVHCQLVKPREQKQKGPGLVWFHGYHTNSGDWVDKLAYAAAGFTVLAMDCRGQGGKSEDNLQVKGPTLKGHIIRGIEDPNPHHLYYRNVFLDTVQAVRILCSMDHIDRERIGVYGASQGGALALACAALEPSVVKKAVVLYPFLSDYKRAQELDMKNTAYEEIHYYFRFLDPTHEREEEVFYKLGYIDIQLLADRICADVLWAVALEDHICPPSTQFAVYNKIKSKKDMVLFYEYGHEYLPTMGDRAYLFFCPIFFPIQKRNVK

SEQ ID NO: 455 - protein, 242 aa, Bacillus stearothermophilus
MRDIARKLGVSSVTVSKALNDKEGVSEELRKKIKETAREMGYRLNTLTKAMKEGYSYNVGVVIPERFIGDTQSFYLRFYQHIAKALDHYGYCSILHILTAEDEEQLQLPRVYNERKVDGFIMLGQVNKEYASLFQQIELPVVFLDFYHDQDVDCVLTDNFFGMYELTNHLIQCGHREIAFVGNIYSTSSIQDRFLGYYKSLLEHRIPLREEYIISDRDEKGKYIDLYCRKTCRLLLYATVIK

SEQ ID NO: 456 - protein, 743 aa, Bacillus stearothermophilus
MPIQVNEETKEFHLFNENISYIFRVLEKSNQLEHLYYGKRIKHRDSFQHLIEREVRPSCNMFEGDYTSSLEHIKQEYPSYGTTDYRYPSYVIMNDIGSTVTNFQYDSYRIIAGKPKLPFLPATYVENPEEADTLEVTLIDDVLQCKLVLSYTIYRHRNVICRNAKLVNEGEKAFYIHHAMSSSVDFPDSDFEMVQLSGAWAREFHLETKKITKGIQSVYSVRGASSHIHNPFLALKRPDATEHKGEVYGFSLVYSGNFLAQVEVDTYDVTRVLMGIHPFQFRWKLYPTESFQTPECVMVYSDQGLNGMSQTYHDLYRTHLVRGPWRDRPRPILINNWEATYFDFNEEKILQIAKTAKELGIELFVLDDGWFGNRNDDTSSLGDWFENREKLPSGIKGLSEKIEALGMKFGLWFEPEMVCKDTKLFQEHPDWVIATPNRRMSHGRNQFVLDFSKQEVVDYIFGLMSHVIENAKISYIKWDMNRYITEPYSNGLPADRQGEVFHRYILGVYQLYERLLEAFPHILFESCAGGGGRFDPGMLYYAPQAWTSDDTDAVERLKIQYGASLVYPLSSIGSHVSAVPNHQVGRITPLDTRANVAYFGTFGYELDITKLTDEEKEKVKQQVTFFKEKRQLIHHGRFYRLLDPFHSNEVAWMVVSEDQKEAIVGYYQVLAKPNDRYHRLKLKGLHPDFLYVVEGKGTTHYGDELMNVGMIFAENYTDRAHEYWQREKKGDFASQVFVLKAIS

SEQ ID NO: 457 - DNA, 1924 bp, Orpinomyces sp. PC-2
aatttgttaatttataaaaataatctttaaatttaacaaccatacaataatataaaaaaaaaatataatataaagtaaattaatataattataaaaatttaaaaaaaaaaataaaaaaataaaaaaaaaaaagaaaatgcatttcaataaagttagtgcattattacttactttagctacctctgttgcaggtcaatttagagaaggttttgttcaaacagatggaaccaattttgtagttgatggctgtaaacgttatttctccggttctaatacttattatttaatggtttccaatcatgaaagagtcgatttagctcttgaaacttatgctagacataatcttaatgttgttagagcatgggcattttgtgatgaatgtgaggatgccacaagattagttgatttctctggtccagaagttactcttaatggagaaaatatggaaaaagttgattattatcttgcagctgccgctcaaagaaatattcgtgttgttttaactcttactaataattggactgattatggtggtatggatgtttgggttaagcaatttggtggaaaatatcacgatgaattctatacaaataaagatattatcaaaggttataagcaatacattaaagctatgattaaccgtgttaatacttatactggacaattatataaagatgatccaactattttttcatggcaacttgctaatgaagctcgttgtaataacggtccacatggtcttccagttaaaaattgtaatactgatacaattactaaatggatggatgaaattgctacattcattcatcaagaagatccaaaccatttagtttcttctggtattgaaggtattggtcttacaccaccagcaggcgttgataaaaacacctacgtttatacttatactgaaggtacggattatgaagctattagtgctcttgactctattgattataatactgttcatatgtatccagttggttggggattaaaggattatgcaaaggatggtgtcacttggattaaagctcatgctgatgtggataaaaagtttaataagccaaccgttgtagaagaatggggtcttagtacttcggctgataacgttccaattgaacaacgtgatccaatttacactcaatggatgaacgaagttttagctaatgataatattggtatgaatatgttctggtatgtttgtggtgaagattattatggtacagatggttatttattagaagaagatgaaatcactgcagtcatcgatccatttacaaaaaaattatatgctaaccaaacttgtgaaaatcttgatactatctctattgttcatacggatttagttgatgtttactatgaagttgaaggttgtcaaccaaaatatggaacttgtactggtggaaaatgttgtgctcatggtactagatgtgaaggtagtgaatactatggtcaatgccgtccaattactgaaccaccatatcgtggtgctacatcaccagttgaaggttatgttttaccaggtgcaaaaagtacttccaaaaagaacaatactactaaaaagaccactacgaaaactactacttcagctaaatcagaaccaacttcttcttcttctgatgaatgtttctccattgctttaggtttcccatgttgcagtgataatactgttgtttattctgataatgatggtgattggggtgtagaaaatggtgaatggtgtggtattggaggtactattgttgataatgactcatgctttgctaaaagtttaggatattcatgctgttcttcatgtgatgttgtctataccgataatgatggtaactggggtgttgaaaatggtgaatggtgtggtattaaagattcttgttaagaaaaaaaattgaaatgaacttaacttttaatattattctattaatattaa

SEQ ID NO: 458 - protein, 578 aa, Orpinomyces sp. PC-2
MHFNKVSALLLTLATSVAGQFREGFVQTDGTNFVVDGCKRYFSGSNTYYLMVSNHERVDLALETYARHNLNVVRAWAFCDECEDATRLVDFSGPEVTLNGENMEKVDYYLAAAAQRNIRVVLTLTNNWTDYGGMDVWVKQFGGKYHDEFYTNKDIIKGYKQYIKAMINRVNTYTGQLYKDDPTIFSWQLANEARCNNGPHGLPVKNCNTDTITKWMDEIATFIHQEDPNHLVSSGIEGIGLTPPAGVDKNTYVYTYTEGTDYEAISALDSIDYNTVHMYPVGWGLKDYAKDGVTWIKAHADVDKKFNKPTVVEEWGLSTSADNVPIEQRDPIYTQWMNEVLANDNIGMNMFWYVCGEDYYGTDGYLLEEDEITAVIDPFTKKLYANQTCENLDTISIVHTDLVDVYYEVEGCQPKYGTCTGGKCCAHGTRCEGSEYYGQCRPITEPPYRGATSPVEGYVLPGAKSTSKKNNTTKKTTTKTTTSAKSEPTSSSSDECFSIALGFPCCSDNTVVYSDNDGDWGVENGEWCGIGGTIVDNDSCFAKSLGYSCCSSCDVVYTDNDGNWGVENGEWCGIKDSC

SEQ ID NO: 459 - DNA, 2924 bp, Bacillus subtilis
tccttgcacctaaaaaaatcattcttggcggcggcgtcatgcaacagaaacaagtgttttcttatatctatcaatatgtaccaaaaatcatgaacagctacttagatttttctgaattatcagatgatataagtgattatattgtacctccacgtttaggcagtaacgccggaatcatcggcacgctagttttggcgcatcaggccttacaagcagaggcagcatccggggaggtgcgatcatgacgcatcctttatttttagagcctgtctttaaagaaagactatggggagggacgaagcttcgtgacgcttttggctacgcaataccctcacaaaaaacaggtgagtgctgggccgtttctgcacatgccaatggcccgtcggctgtaaaaaatggcccgctggcaggaaagacacttgatcaagtatggcaagatcatccagagattttcggttttccggataggaaggtatttccgctgctggtaaagctgctggacgccaatatggatctctccgtgcaagtccatcctgatgatgattatgcaaaactgcacgaaaatggcgaccttggtaaaacggagtgctggtatatcattgattgcaaagatgacgccgaactgattttgggacatcatgcaagcacaaaggaagagttcaaacaacgaatagaaagcggtgattggaacgggctgctgaggcgaatcaaaatcaagcccggagatttcttttatgtgccaagcggtacactccatgctttatgtgagggaacccttgtccttgaaatccagcaaaactctgatacaacgtatcgcgtatacgattatgaccgctgtaatgaccagggccaaaaaagaactcttcatatagaaaaagccatggaagtcataacgataccgcatatcgataaagtgcatacaccggaagtgaaagaagttggtaacgccgagatcactgtttatgtgcaatcagattatttctcagtgtacaaatggaagattagcggccgagctgcttttccttcatatcaaacctatttgctggggagtgttctgagcggatcaggacgaatcataaataatggtagtcagtatgaatgcaatgcaggctcacactttgtcttgcctgcgcattttggcgagttttcaatagaaggaacatgtgaattcatgatatctcatccttaatgaatgggggagttgcatttgtttaagaaacatacgatgtctttgctcattttatttttacttgcgtctgctgttttagcaaaaccaattgaagcgcatactgtgtcgcctgtgaatcctaatgcacagcagacaacaaaagvagtgattaactggcttgcgcacctgccgaaccgaacggaaaacagagtcctttccggagcgttcggaggttacagccatgacacattttctatggctgaggctgatagaatccgaagcgccaccgggcaatcgcctgctatttacggctgcgattatgccagaggatggcttgaaacagcaaatattgaagatacaatagatgtaagctgcaacagcaatttaatatcgtattggaaaaatggtggaatcccgcaaatcagcttgcacctggcgaatcctgcttttcagtcagggcattttaaaacaccgattacaaatgatcagtataaaaaaatactagattcttcaacagtagaaggaaagcggctaaatgccatgctcagcaaaattgctgacggacttcaagagttggagaaccaaggtgtgcctgttctgttcaggccgctgcatgaaatgaacggcgaatggttttcctggggactcacatcatataaccaaaaggataatgaaagaatctctctatataaacagctctacaagaaaatctatcattatatgaccgacacaagaggacttgatcatttgatttgggtttactctcccgacgccaaccgagattttaaaactgatttttacccgggcgcgtcttacgtggatattgtcggattagatgcgtattttcaagatgcctactcgatcaatggatacgatcagctaacagcgcttaataaaccttttgcttttacagaagtcggcccgcaaacagcaaacggcagctttgattacagcctatttatcaacgcaataaaacaaagatatcctaaaaccatttactttctggcatggaatgatgaatggagcccagctgtaaacaagggggcttcagctttatatcatgacagctggacactcaataagggagaaatatggaatggcgattctttaacgccaatcgttgagtgaatccgtaatgtcacaattaagaaggtgctcaagaagtttcttgagcaccttcccactggattaagcattcatatcgcctaacccaggactgtgttcatttggtatttcaggaagcactggtacgggaaaacctgccggaggatctatgacttgtaactctccgccatttcggcttggagatttcccctgatagatttcaccgattctcgtttcatccaacctaaagttaaactgtgcattatggtagcctaattcgacatactttctgcactcaggatatttattaatgtcataattcggtacagggaggagcttcgcccactcaacgcccaatgtctcgagcgctttcgcgaatgcattctggtgagcattgtcgcgtacaatcagaaaagcaagtgtttcgcggaacgtctgattagagctcatttcataaattcttgttttttgcagcacacctgtcgactcaagaagcaggttatccagcaggtcagtaattaagtttccgtggttatacacccacgacccgttccacggattgccccctgcatcaacaggaagggaactttgcgctccaataatataatgatgaggattagcatgtttaaccgcttcatcaagtggcgcttga

SEQ ID NO: 460 - protein, 315 aa, Bacillus subtilis; identical to SEQ ID NO: 420

SEQ ID NO: 461 - protein, 367 aa, Bacillus subtilis
  misc_feature (47)..(47): Xaa can be any naturally occurring amino acid
MGELHLFKKHTMSLLILFLLASAVLAKPIEAHTVSPVNPNAQQTTKXVINWLAHLPNRTENRVLSGAFGGYSHDTFSMAEADRIRSATGQSPAIYGCDYARGWLETANIEDTIDVSCNSNLISYWKNGGIPQISLHLANPAFQSGHFKTPITNDQYKKILDSSTVEGKRLNAMLSKIADGLQELENQGVPVLFRPLHEMNGEWFSWGLTSYNQKDNERISLYKQLYKKIYHYMTDTRGLDHLIWVYSPDANRDFKTDFYPGASYVDIVGLDAYFQDAYSINGYDQLTALNKPFAFTEVGPQTANGSFDYSLFINAIKQRYPKTIYFLAWNDEWSPAVNKGASALYHDSWTLNKGEIWNGDSLTPIVE

SEQ ID NO: 462 - DNA, 4831 bp, Rhodothermus marinus
gtccgggctattttgtgttcagcgctgcttctttggctccagcaacggacgtatcaactccagcgggatcgggaagacgatcgtcgtattgttttcggagccgacttccacgagcgtctgcagaaagcgcatctgcatggccatggggtgcgcctcgagcatggcggccgcctgagccagttgctcggccgcctgcagctcgccctgcgcgtgaatcaccttggcgcggcgttcccgctcgctttcggcctgcttggccatggcccgcttcatgtgctcgggcagatccacgtgcttgacttccaccagcgacactttgatgccccagggatccgtctgctggtcgatgacttcctgcaaccggcggttgatcttttcacgctcggccagcagttcgtccagttccacctggcccacaatgctccggagcgaagtctgggaaagctgggtagtggcatagcggtaatcttccacctccagcacggccttcatgggatcgaccacgcggaaatagaccacggcattcacgcgcaccgacacgttgtcgcgcgtgatcacgtcctgctcgggcacgtcgtgcacgaacgtgcgcagactgacgcgcaccatgcggtcgatcggccagaacaccagcacgatgcccggacccttcggctcggggagggcccggcccatccgaaagatgaccccgcgctgatactcgtacagaatgcgaatgcagctgatgaaatacagcacaatcagtccgatgacgatgcctgtcgacgaaagcatggccgcacctccggctggttggttttcaggtggacacaatcggtgaaacccagaggcggagtccctcccggcgttcgatacggacgggctggccggcccgcaccggagccgtgctgcaggcccgccaccattcgccgtggacgaacacgtagccctggaaatggtcgccttccggggtgaagtcttcgcgggccacggcctgctggccgatcagcgtctcatcgcccacacgggccggccggcgctgaatgcgcagcgcattacccagcagaaacagcgcgatcagtgccgtggccagcgccaccggcaccaccagggcggccgaaaccttcggaaagcccatcggactttccacgagcatcaatccacccaggatcaggcacacgacgccccccacggtcagcaggccaaaactgggcacgaaggcctcggccacgagcatgcccaggcccagcaccagcagggccagtccaacgtagttgaccggcaggatggagagcccgtagaagcccagcatcagaaagatggcgcccagcgtgccgggaatgccccagccgggcgtgtagagctcgaacagcagcccgtagaagcccagcatcagcagcaggaaggcgatgttcggattggaaagcgccgccagaatgcgttcgccccaccagcgctcgatcatgtgcacggtggccccggccgtctgcagcgtcacggtctggccgtcgagcgccacgttccggccgtccagcagcaccagcagcgagtccagcgagggcgccagcagatcgaccacgttctgggccacggcctcccgggccgtcagcgtctggctttccgagacggcccgcgccgcccagtcggcgttgcgtccccggtactgggccagcgcccgtgcccaggccaccgcatcgttcagaatcttttccgacatgggatcgacccgtgccgtgtcgggcggtgccgccggtccccctccgagctgcacgggatgggctgcgccgatgtgcgtgcccggggccatggccgccacatgcgcggccagcgtgatgaacaccccggccgaggccgcccgtgcgcccggcggcgtcacgtagacgacgaccgggatcggactccgcaggaaaagctgtacgatgtcgcgcgtggcctcgacgagcccgcccggcgtgtccatttcgacgacgaggcagaccgctccgttttccgtggcctcgcgcaacccgcgccggatgaaccggaaggtcgccggcgtgatcggctcgtcctccagcgccagtcggtaaaccaccggcgcgggcgtctgagccggcatcggcagcagcatcagccacagcagcagaggccacatggcaatcaggcttttttaggaaaatatgaaaaacggcgccggaagcctacggcctgtctcaaaagcttgagacgctttcccgataaagatgcgccggtgttatattttgtcaatcaattagaaaaaacgaaaagacgcatgacgctgctgctggtctggctgattttcaccggcgtggccggagagatccggctcgaagccgaagacggggaattgctgggcgttgcggtcgactcgaccctgacgggctattcaggacgtggttacgtcaccggtttcgacgcccccgaagacagcgtgcgtttttccttcgaggcgccccgcggggtctatcgcgtggttttcggggtgtccttctcctcacgctttgcttcctatgcgttgcgggtggacgactggcaccagaccggttcactgatcaagcggggcgggggcttttttgaggcctccatcggcgagatctggctggacgagggggcacacacgatggcgtttcagctcatgaacggagccctggactacgtacgcctggagccggtctcgtacgggccgcctgcgcggcccccggcgcagctcagcgattcgcaggcgaccgcctcggcgcaggcgctctttgcctttctgctttcggagtacggccggcacatcctggccgggcagcaacagaatccctaccgacgcgacttcgacgcgatcaactacgttcgtaatgtaaccggcaaagagcccgccctggtgtcgttcgacctgatcgactactcgcccacgcgggaagcacacggggtcgtgcactaccagacgccggaagactggattgcctgggcaggccgggacggcatcgtttcgctcatgtggcactggaacgcccccaccgacctgatcgaggatccctcgcaggactgctactggtggtacggcttctacacccgatgcacaacgttcgacgtggccgcggcgctggccgacacgagttcggagcgctaccggctgctgcttcgagacatcgacgtgattgccgcccagcttcagaaattccagcaggccgatattcccgtgctctggcggccgttgcacgaggccgctggcggctggttctggtggggcgcgaagggtcccgagcccttcaaacagctctggcgcctgctctacgagcgtctggtgcaccatcacgggctgcacaacctgatctgggtgtacacgcacgagccgggtgcggccgagtggtatccgggcgatgcctacgtggacatcgtggggcgggacgtgtacgccgacgaccccgacgcgctcatgcgcagcgactggaacgagctgcagacgctcttcggcgggcgtaaactggtggcgctgaccgaaacgggcaccttgccggatgtagaagtcatcaccgactatggcatctggtggagctggttttcgatctggaccgatccgtttctgcgcgatgtcgatccggatcgcctgacgcgcgtctatcacagcgagcgcgtgctgacgcgggacgaattgcccgactggcgcagctacgtgctgcatgcgacgaccgtgcagcccgcgggcgatctggcgctggccgtgtatcccaacccgggtgccggccggttgcacgtggaagtcggattgcccgtggccgcgccggtggtcgtggaggtgttcaacctgctgggccagcgggtcttccagtatcaggcgggcatgcagccggccggcctctggcggcgggcattcgagctggcgctggcgcccggcgtctatctggtccaggtgcgggccgggaatctggtggcccgtcggcgctgggtaagcgttcgctgaccggccggaacccgtcggcgaaatcctcgttagccgtgcccccgatggatccggcaggtccgttctgtcgtaagacggagcggaaacggtgacgtggccgagtggctaggcaggggcctgcaaagccccgtacggcggttcgaatccgcccgtcacctcaaaaagaagccccggcgcccaatgcgtcggggctttttccgttcagaaaggcgcttcgtcgggaggcccggaaggcaggatggtctcatccggcgtctcgggcaggggcgttccgggctccggctggtacatcgtcaggttctcgaagcgggcatactggttgatgaaagccagccgcacggtgccggtcggaccgttgcgctgcttgccgataatgatctcggcgataccctcggtagggttgccgttttcgtccaccgtaatgccgtagcgctcgggtcggtagataaacagcacgacgtcggcatcctgctcgatgctgttatgagcgataatgtcgttggccacgaagttgtgcggtccgggaacggtcagatcgaatacctcctcgacgccgtccggctcgatcgaaacgataggatcccagtagacatcgctctgagccagctggcgaagttctggacaggcagcagcttcggcaagacgcagggcgcgtgcgcgactcaggttctgacggaaaagagtcattccaccgtaagccattcccaggttggcgtgtaactgacggtggctgatgccgcgctgatacatggcttcacgcaccagttcataccagagtgcaacgggaataatgtcccgattgggattccctgttctcacagacagataatcatatacagatgcaagagcagcccgctgacgagctcctactgcaccgattttttctacaaagcgcaaaagatc

SEQ ID NO: 463 - protein, 1021 aa, Rhodothermus marinus
MAGPHRSRAAGPPPFAVDEHVALEMVAFRGEVFAGHGLLADQRLIAHTGRPALNAQRITQQKQRDQCRGQRHRHHQGGRNLRKAHRTFHEHQSTQDQAHDAPHGQQAKTGHEGLGHEHAQAQHQQGQSNVVDRQDGEPVEAQHQKDGAQRAGNAPAGRVELEQQPVEAQHQQQEGDVRIGKRRQNAFAPPALDHVHGGPGRLQRHGLAVERHVPAVQQHQQRVQRGRQQIDHVLGHGLPGRQRLAFRDGPRRPVGVASPVLGQRPCPGHRIVQNLFRHGIDPCRVGRCRRSPSELHGMGCADVRARGHGRHMRGQRDEHPGRGRPCARRRHVDDDRDRTPQEKLYDVARGLDEPARRVHFDDEADRSVFRGLAQPAPDEPEGRRRDRLVLQRQSVNHRRGRLSRHRQQHQPQQQRPHGNQAFLGKYEKRRRKPTACLKSLRRFPDKDAPVLYFVNQLEKTKRRMTLLLVWLIFTGVAGEIRLEAEDGELLGVAVDSTLTGYSGRGYVTGFDAPEDSVRFSFEAPRGVYRVVFGVSFSSRFASYALRVDDWHQTGSLIKRGGGFFEASIGEIWLDEGAHTMAFQLMNGALDYVRLEPVSYGPPARPPAQLSDSQATASAQALFAFLLSEYGRHILAGQQQNPYRRDFDAINYVRNVTGKEPALVSFDLIDYSPTREAHGVVHYQTPEDWIAWAGRDGIVSLMWHWNAPTDLIEDPSQDCYWWYGFYTRCTTFDVAAALADTSSERYRLLLRDIDVIAAQLQKFQQADIPVLWRPLHEAAGGWFWWGAKGPEPFKQLWRLLYERLVHHHGLHNLIWVYTHEPGAAEWYPGDAYVDIVGRDVYADDPDALMRSDWNELQTLFGGRKLVALTETGTLPDVEVITDYGIWWSWFSIWTDPFLRDVDPDRLTRVYHSERVLTRDELPDWRSYVLHATTVQPAGDLALAVYPNPGAGRLHVEVGLPVAAPVVVEVFNLLGQRVFQYQAGMQPAGLWRRAFELALAPGVYLVQVRAGNLVARRRWVSVR

SEQ ID NO: 464 - DNA, 1769 bp, Bacillus subtilis
gcatgcaagcttgcatgcttacctgccagtttgtattttttcagtgaggcgatcagtttttcttccatacccggatatgtttcaggcgcctttgtctcaatataatagtttgcatgtctgccgaaccgttttaacacgtcatcaagtgtgggaacgcgaagtccggcgtagtgcggttttgctttttccggataggccttattgaaccaagaaccggcgtcgagcttttgaatctcggctaatgtatgatccttcacccagccttgtccgtttgtggtgcggttcagcttttcatcatgcatgacgatcagcttgccgtcttttgtcatttgtaaatccagctcaatatagtcagccttcattttttgcgcagtttcataagaaaggatcactttatcgtgccggcggattccggagattttgttatagaaggagattgtgaggttatcgtttcacatccttcatcatcttaaaaatcaggaggtcttttatatgcttaaaaagttagcagtctgcctgtctatcgttttattactcttaggagccgccagtccgatatcggctcacaccgtttatcccgtcaacccaaatgcccagcagacgacaaaagatatcatgaactggctggcccacctgcccaaccgttcagaaaacagggtcatgtccggagcgttcggcgggtacagcgatgtcactttttcaatgacagaggaaaaccgcttgaaaaacgcgacgggacagtctcccgccatctacggctgtgactatgggagaggatggctggaaacagcggatatcaccgatactatcgattactgctgcaacagcagcttaatctcatactggaaaagcggcggcctccctcaggtcagcctgcatctcgcaaatccggcctttccatccggaaactataaaacggccatctcaaacagccagtacaaaaacatccttgacccttcaactgtggaaggaaaacggcttgaggcgctgctcagcaaaattgccgacggccttactcagctgaaaaatcaaggcgtcaccgttctgttcagaccgctgcatgaaatgaacggcgagtggttctggtgggggctgacaggctacaaccaaaaagacaatgagagaatctcgctgtacaaagagctttacaagaaaatataccgctatatgacagaaacaagaggattggataaccttttgtgggtgtattcgccggatgccaacagagactttaaaacagacttctacccaggctcatcttatgtagatattaccggtctggacgcttacttcactgatccgtatgcgatatcaggctatgatgaaatgctgtctctgaaaaaaccgtttgcctttgccgaaaccggtccgtccggcaatatcggaagctttgattatgctgcttttattaatgcgatcaggcaaaaataccctcagaccacgtactttttgacatgggatgaacaattaagtccggcggccaatcaaggcgcgcaaagcctttatcaaaacagctggacgctgaacaagggcgaaatatggaacggcgggtccttgacgccgatcgcggaataaccgcttcttttgaaaatcggttttaaaaaacggctctgctgggcatattgttaccgttcaaaaaggagggttcaacaatggaaaataacaaaaacagcgaagaaacgctttccagtaagacgaccggtaaggcgagtcagaagacacgctgacaaaccggcgggccatccggtcactgacaaccagaatgtcag

SEQ ID NO: 465 - protein, 360 aa, Bacillus subtilis
MLKKLAVCLSIVLLLLGAASPISAHTVYPVNPNAQQTTKDIMNWLAHLPNRSENRVMSGAFGGYSDVTFSMTEENRLKNATGQSPAIYGCDYGRGWLETADITDTIDYCCNSSLISYWKSGGLPQVSLHLANPAFPSGNYKTAISNSQYKNILDPSTVEGKRLEALLSKIADGLTQLKNQGVTVLFRPLHEMNGEWFWWGLTGYNQKDNERISLYKELYKKIYRYMTETRGLDNLLWVYSPDANRDFKTDFYPGSSYVDITGLDAYFTDPYAISGYDEMLSLKKPFAFAETGPSGNIGSFDYAAFINAIRQKYPQTTYFLTWDEQLSPAANQGAQSLYQNSWTLNKGEIWNGGSLTPIAE

SEQ ID NO: 466 - DNA, 2055 bp, Thermotoga maritima
gtgaaaagaatcgacctgaatggtttctggagcgttagggataacgaagggagattttcgtttgaagggactgtgccaggggttgtccaggcagatctggtcagaaaaggtcttcttccacacccgtacgttgggatgaacgaagatctcttcaaggaaatagaagacagagagtggatctacgagagggagttcgagttcaaagaagatgtgaaagagggggaacgtgtcgatctcgtttttgagggcgtcgacacgctgtcggatgtttatctgaacggtgtttaccttggaagcaccgaagacatgttcatcgagtatcgcttcgatgtcacgaacgtgttgaaagaaaagaatcacctgaaggtgtacataaaatctcccatcagagttccgaaaactctcgagcagaactacggggtcctcggcggtcctgaagatcccatcagaggatacataagaaaagcccagtattcgtacggatgggactggggtgccagaatcgttacaagcggtatttggaaacccgtctacctcgaggtgtacagggcacgtcttcaggattcaacggcttatctgttggaacttgaggggaaagatgcccttgtgagggtgaacggtttcgtacacggggaaggaaatctcattgtggaagtttatgtaaacggtgaaaagataggggagtttcctgttcttgaaaagaacggagaaaagctcttcgatggagtgttccacctgaaagatgtgaaactatggtatccgtggaacgtggggaaaccgtacctgtacgatttcgttttcgtgttgaaagacttaaacggagagatctacagagaagaaaagaaaatcggtttgagaagagtcagaatcgttcaggagcccgatgaagaaggaaaaactttcatattcgaaatcaacggtgagaaagtcttcgctaagggtgctaactggattccctcagaaaacatcctcacgtggttgaaggaggaagattacgaaaagctcgtcaaaatggcaaggagtgccaatatgaacatgctcagggtctggggaggaggaatctacgagagagagatcttctacagactctgtgatgaactcggtatcatggtgtggcaggatttcatgtacgcgtgtcttgaatatccggatcatcttccgtggttcagaaaactcgcgaacgaagaggcaagaaagattgtgagaaaactcagataccatccctccattgttctctggtgcggaaacaacgaaaacaactggggattcgatgaatggggaaatatggccagaaaagtggatggtatcaacctcggaaacaggctctacctcttcgattttcctgagatttgtgccgaagaagacccgtccactccctattggccatccagtccatacggcggtgaaaaagcgaacagcgaaaaggaaggagacaggcacgtctggtacgtgtggagtggctggatgaactacgaaaactacgaaaaagacaccggaaggttcatcagcgagtttggatttcagggtgctccccatccagagacgatagagttcttttcaaaacccgaggaaagagagatattccatcccgtcatgctgaagcacaacaaacaggtggaaggacaggaaagattgatcaggttcatattcggaaattttggaaagtgtaaagatttcgacagttttgtgtatctgtcccagctcaaccaggcggaggcgatcaagttcggtgttgaacactggcgaagcaggaagtacaaaacggccggcgctctcttctggcagttcaacgacagctggccggtcttcagctggtccgcagtcgattacttcaaaaggcccaaagctctctactactatgcgagaagattcttcgctgaagttctacccgttttgaagaagagagacaacaaaatagaactgctggtgggtgagcgatctgagggagacaaaagaagtctctctcaggcttgcagcctacgagaagaagggagaaaaggtattcgaaaagacttacagaacggtactcccagcagacggtgtgagtttggttga

SEQ ID NO: 467 - protein, 684 aa, Thermotoga maritima
MKRIDLNGFWSVRDNEGRFSFEGTVPGVVQADLVRKGLLPHPYVGMNEDLFKEIEDREWIYEREFEFKEDVKEGERVDLVFEGVDTLSDVYLNGVYLGSTEDMFIEYRFDVTNVLKEKNHLKVYIKSPIRVPKTLEQNYGVLGGPEDPIRGYIRKAQYSYGWDWGARIVTSGIWKPVYLEVYRARLQDSTAYLLELEGKDALVRVNGFVHGEGNLIVEVYVNGEKIGEFPVLEKNGEKLFDGVFHLKDVKLWYPWNVGKPYLYDFVFVLKDLNGEIYREEKKIGLRRVRIVQEPDEEGKTFIFEINGEKVFAKGANWIPSENILTWLKEEDYEKLVKMARSANMNMLRVWGGGIYEREIFYRLCDELGIMVWQDFMYACLEYPDHLPWFRKLANEEARKIVRKLRYHPSIVLWCGNNENNWGFDEWGNMARKVDGINLGNRLYLFDFPEICAEEDPSTPYWPSSPYGGEKANSEKEGDRHVWYVWSGWMNYENYEKDTGRFISEFGFQGAPHPETIEFFSKPEEREIFHPVMLKHNKQVEGQERLIRFIFGNFGKCKDFDSFVYLSQLNQAEAIKFGVEHWRSRKYKTAGALFWQFNDSWPVFSWSAVDYFKRPKALYYYARRFFAEVLPVLKKRDNKIELLVGERSEGDKRSLSQACSLREEGRKGIRKDLQNGTPSRRCEFG

SEQ ID NO: 468 - DNA, 3033 bp, Cellulomonas fimi
atgacgaaccgcagccgtccgcgcgggcgcacggcgggccacgtgctcgccgccaccgccgcggcgctggccctgaccggcctgtcggcgcttcccgcccagtccgcaccggcgcccgcagcgcccgtcgcgggggcgctgcccaccgcacccgccgacgagaccatcgcgatcgtcgacgccgacgcgaccgccgagacccggtcgctgctctcctacctcgacggcgtgcgcggcgagggcatcctgttcggccaccagcacacgacgtcgttcgggctcaccaccggacccaccgacggcacgacctccgacgtcaagaacgtcacgggcgactttcccgcggtcttcggctgggacacgctcatcatcgagggcaacgagcgccccgggctcgccgagaacacgcgcgacgagaacatcgcgctgttcgccgactacatccgcaaggccgacgcgatcggcggcgtcaacaccgtgagcgcgcacgtcgagaacttcgtcaccggcggctcgttctacgacacctcgggcgacacgctgcgcgccgtgctgccgggcggctcgcaccacgccgagctcgtcgcctacctcgacgacatcgcggagctcgccgacgcgtcgcgccgcgacgacggcacgctcatcccgatcgtcttccggccgtggcacgagaacgccggctcgtggttctggtggggcgccgcgtacggctcacccggcgagtaccaggagctctaccggttcaccgtggagtacctgcgcgacgtcaagggcgtctccaacttcctctacgcgtggggtccgggcggcggcttcggcggcaaccgcgacgtctacctgcgcacctaccccggcgacgcgttcgtcgacgtgctcggcctcgacacctacgacagcaccggttcggacgcgttcctcgccgggctcgtcgccgacctgcggatgatcgccgagatcgccgacgagaagggcaaggtgtcggcgttcaccgagttcggcgtgagcggcggcgtgggcacgaacggctcgtcgcccgcgcagtggttcaccaaggtgctcgccgcgatcaaggccgaccccgtcgcgagccgcaacgcctacatggagacgtgggccaacttcgacgccggccagcacttcgtccccgtgcccggcgacgcgctgctcgaggacttccaggcgtacgccgccgacccgttcacgctgttcgcgtccgaggtcacgggcgcgttcgaccggaccgtcgccgcagcgcccgcgcagccggtcgtgcacatcgcctctccggccgacggcgcgcgcgtcgcgtccgccccgaccaccgtgcgggtgcgggtcggcggcaccgacgtgcagtccgtgaccgtcgaggtcgcccagggcggcaccgtcgtcgacactctggacctcgcgtacgacggcgccctgtggtggacggccccctggtcgccgaccagcgcgcagctcgacaacagcacctacaccgtcaccgcgacggcgacgaccgccgccgggacgctcgacgtcacgaacgaggtcgtcctcgggccgaggccgacgttccccgcgggcgtcgtcgacgacttcgagggctacggcgacgacaccgcgctgcgtgccgagtacgtgacctacggcgccaacacgatctcgctcgagacggggtccgtcgggggcggcgcgaaggcgctgcggctcgactacgacttcgcgacgcagacctacaccggcgtcggcaagcagctgtccggcgactggtccgacttcaacgagctcgcgatctgggtcgaccccgacggctcgaacaacaggatggtcctgcagctcaacgccggtggtgtcgcctacgaggcgtacccgtcgctcgcgggcgacgagccgcagctcgtgacgatcccgttcgtcgactggcgcccggcaccgtgggacaccgcgcacgccgaccgccgcatgtccgacgacgacctgcgcgcgctcacgtcgttcaacgtctacgtcaacagcgccgagggcggtgccgcgtcgggctcgctcgtcgtcgacgacatcgccgcccaccccggcgtcgagccgccgccgctgttctccgacgtcccgaagggccacccctacgagacggagatcctgtggctgcacgcgcaggggctcgacgacggctacgacgacggcaccttccggcccgccaggcaggtcaagcggcaggacgtcgcgcggctgctgcacgcctacgagaaggcggtcttcacgccgccgacgacaccgtcgttcctcgacgtccgccggagccaccccgcctacaccgcgatcgagtggctcgtcgccgaggggctcgtggacgacgggcgcgtcttcctgccgagcgccccgctcgaccgggccaccgccgccgagctgctgtggcggctcgccgggtcccccgagcccgaggggacggaggcgttccgcgacgtccccacgtggcaccggtaccgcaccgcgatcacgtgggcgaccgaggtgggcgtcgtcgagcccgtgtcggcgtcgacgttcggggtgctcaaggccgtgcagcggcaggagctcgcgcggtacctgtaccggttcgacgccctcccgtcgccgctcgagcccgtcgtgctgtcggacttcgccgacggcgcgcagggctgggggccgctcgacgccggtccgggctccgcgaccgcgtccggcggcacgctcacgatcgaggccgccgcgcccgacggcgggtggttctcgttcaccccgtccgtcgccgactggaccgggcggacggcgctcgccctcgacgtggtctccaccaccgggttcgacaccaaggcggccctgcaggtcggctcgacctggcagtggtgcgagaccgcgcaggccgggtgggtgtccgggccgcgcaccggagacgacgcgctcgtgctcgacctcacgacgttgtacgcggggtgcggcgcccagctcgccgacgtcaagcgcgtgaacctctacctcaacgcaggcacccacgtgatcgacgacgtcgagctgcgctga

SEQ ID NO: 469 - protein, 1010 aa, Cellulomonas fimi
MTNRSRPRGRTAGHVLAATAAALALTGLSALPAQSAPAPAAPVAGALPTAPADETIAIVDADATAETRSLLSYLDGVRGEGILFGHQHTTSFGLTTGPTDGTTSDVKNVTGDFPAVFGWDTLIIEGNERPGLAENTRDENIALFADYIRKADAIGGVNTVSAHVENFVTGGSFYDTSGDTLRAVLPGGSHHAELVAYLDDIAELADASRRDDGTLIPIVFRPWHENAGSWFWWGAAYGSPGEYQELYRFTVEYLRDVKGVSNFLYAWGPGGGFGGNRDVYLRTYPGDAFVDVLGLDTYDSTGSDAFLAGLVADLRMIAEIADEKGKVSAFTEFGVSGGVGTNGSSPAQWFTKVLAAIKADPVASRNAYMETWANFDAGQHFVPVPGDALLEDFQAYAADPFTLFASEVTGAFDRTVAAAPAQPVVHIASPADGARVASAPTTVRVRVGGTDVQSVTVEVAQGGTVVDTLDLAYDGALWWTAPWSPTSAQLDNSTYTVTATATTAAGTLDVTNEVVLGPRPTFPAGVVDDFEGYGDDTALRAEYVTYGANTISLETGSVGGGAKALRLDYDFATQTYTGVGKQLSGDWSDFNELAIWVDPDGSNNRMVLQLNAGGVAYEAYPSLAGDEPQLVTIPFVDWRPAPWDTAHADRRMSDDDLRALTSFNVYVNSAEGGAASGSLVVDDIAAHPGVEPPPLFSDVPKGHPYETEILWLHAQGLDDGYDDGTFRPARQVKRQDVARLLHAYEKAVFTPPTTPSFLDVRRSHPAYTAIEWLVAEGLVDDGRVFLPSAPLDRATAAELLWRLAGSPEPEGTEAFRDVPTWHRYRTAITWATEVGVVEPVSASTFGVLKAVQRQELARYLYRFDALPSPLEPVVLSDFADGAQGWGPLDAGPGSATASGGTLTIEAAAPDGGWFSFTPSVADWTGRTALALDVVSTTGFDTKAALQVGSTWQWCETAQAGWVSGPRTGDDALVLDLTTLYAGCGAQLADVKRVNLYLNAGTHVIDDVELR

SEQ ID NO: 470 - DNA, 1881 bp, Streptomyces lividans
caatactacgtgggcgccccctctttttactaaacccgtaaacgcgctgaccagagtgtgaagcccgcgtatccaggtcgttcacctgcgtcaactgcccctgcatgacggattgacaggcctgccaggtgtccctacggtccctatcggttaaccggtaaatgtcgccccgaggtgcgggataacgttgtcaggtgcatgctcgcccgccatcgaaggagacacatgcgtaacgcaagaagcacgctgatcacgaccgcggggatggcgttcgccgttctgggcctgctgttcgcactcgccggtccttccgccggaagggcggaggccgcggccggtggcatccacgtcagcaacggacgtgtcgtcgagggcaacggcagcgcgttcgtcatgcgcggggtcaaccacgcctacacctggtatcccgaccgcaccggctccatcgccgacatcgcggccaagggagccaacaccgtccgcgtcgtgctcagcagcggcggccgctggacgaagacgagcgcgtccgaggtctcggcgctcatcggccagtgcaaggccaacaaggtcatctgtgtccttgaggtgcacgacaccaccggctacggcaaggacggcgcgaccagcctggaccaggccggcgactactgggtcggtgtgaagagcgccgcctggagggcccaggaggactacgtcgtcgtcaacatcggcaacgaacccttcggcaacaccaactacgccgcgtggaccgacgcgaccaagtcggccatcggcaagctccgcggcgccggtctcggccacgccctgatggtcgacgcgcccaactggggccaggactggtccggcacgatgcggtccaacgcggcctcggtcttcgcctccgaccccgaccgcaacaccgtcttctccatccacatgtacggggtctacgacaccgccgccgaggtgcgggactacctgaacgccttcgtcggcaacggactgcccatcgtcgtcggcgagttcggcgaccagcacagtgacggcaaccccgacgaggacgccatcatggcgacggcccagtccctcggcgtcggctacctcggctggtcctggagcggcaacggcggcggcgtcgagtacctcgacatggtcaacggcttcgacccgaactcgctgacgagctggggcaaccgcatcctctacggcagcaacggcatcgccgcgacgtccaggacggccaccgtgtacggcggtggtggcggcagcacgggcggcaccgcgcccaacggttacccgtactgcgtgaacggcggtgcgtccgacccggacggtgacgggtggggctgggagaacagccggtcctgcgtcgtccggggcagcgcggcggaccactgacccgaccgacggcgacgccccaccctggggttccggggtccggggccgtttccagtgattcgggcccacgccgtggggagacggcgagctggtgccgtgcggcgccttcgagtcgcggatgtggatcgcgtccgggcgggccgccacctcgacacagtcgccgtcaccgctgctgctgtagctcgacttgtgccaggacagggcgatttccacgcagtcgccgtcgccaccgctgctgtacgagcttttgaaccaggccagttccgtcgtgttcatgaggctcctcgcatccgccgcaacaggcccagggagtcgtcgagggagaggggcctgtgatctcgtcgaaggcggcgggggcgccggacgcggccgggttcccggggacctcgggggtgtggtgcccccgatcgtccgcgcgggcggcgggaagggcgaccagcgggacaccggcggcgacgacggctgcggcgccgagcgcgcgacgacgggtgagttccggcatgc

SEQ ID NO: 471 - protein, 383 aa, Streptomyces lividans
MRNARSTLITTAGMAFAVLGLLFALAGPSAGRAEAAAGGIHVSNGRVVEGNGSAFVMRGVNHAYTWYPDRTGSIADIAAKGANTVRVVLSSGGRWTKTSASEVSALIGQCKANKVICVLEVHDTTGYGKDGATSLDQAGDYWVGVKSAAWRAQEDYVVVNIGNEPFGNTNYAAWTDATKSAIGKLRGAGLGHALMVDAPNWGQDWSGTMRSNAASVFASDPDRNTVFSIHMYGVYDTAAEVRDYLNAFVGNGLPIVVGEFGDQHSDGNPDEDAIMATAQSLGVGYLGWSWSGNGGGVEYLDMVNGFDPNSLTSWGNRILYGSNGIAATSRTATVYGGGGGSTGGTAPNGYPYCVNGGASDPDGDGWGWENSRSCVVRGSAADH

SEQ ID NO: 472 - DNA, 3900 bp, Caldicellulosiruptor saccharolyticus
gatccgggtattaagagaagaccaaaatacctgcaggattttaatactcagcttgcaaagtattcattctatccggggtcaccggactctgttttgggtaatttggtatgggatataaatggtgcgcttttcaatgcagcatctgtttcttcagcattggctggtttaaaaccacaggcagaacaggcagtgagagaggcaaatgctcaacctgaaaaaccagtattcagaccatttaagccatttacaattgactttgaaaatggaaagattgacatgttcacagtacttgacacaacaaagaaaacagtcaaactttcacttgtatctggcaaagaggctataaagggcaagtctttaaaggttacatgcgactctaaaaaagatggtgagtggattgacgcactctatacactgccaagcaaggtaaaaatttatggttggcatgattacaaggtgagctttgatgtaaaacttcttaagaacccaccaaaaccgggtgacacgtatatctatgcgcagattataaacagcaacaaatctggttataagtcatatggatggataaccttcaagcttgacaaggcaaacacagtatatcatgtagaaggtacaattgctggtattcctgacaactcaacaacaatgggcttaaagattggtatccactggggtgctgattttttaattaataacatcaaagtagaagaggtaactcagtaaaaggcactggaatctggtgggcaggcatatccacattgccacaagaaattttatttttgacctgtccaccaggtttcaaataaaaaaccaataaaatgggggtatgtttagatatgtggagaaattggagagtgctttttgttcttgttacaatcatatttttatttagtctcattcccactgggatatttggtgctgttgagtcgtctgtaaatccagtagtgctggactttgaagatggcactgtaatgagctttggtgaagcttggggggattcattaaagtgcataaaaaaggtttctgtttcgcaggaccttcaaagaccagggaacaaatatgcattaaggcttgatgttgagtttaacccaaacaatggctgggaccaaggcgaccttggtacctggtttggcggtgttgtagaaggtcagtttgactttacaggctacaaatctgttgagtttgagatgttcattccatacgatgagttttctaaatcccaaggcggttttccttacaaagttgtcataaatgacgggtggaaagagcttggaagtgagtttaacataactgcaaatgcaggcaaaaaggttaagataaatggcaaagattacacagtcattcacaaggcatttgcaatcccagaagattttagaaccaaaaaacgtgcacagcttgtcttccagtttgcagggcaaaattcaaactacaaaggacctatctatcttgacaatgtaagaataagacctgaggatgcttcaaatctgtcaaaagaggactatggagaacaggctgaagaaggagtagcagttgaagatttcttcacaggtgtgaaactcgtatatcctgaacagggtaagtcttttgtttacaactttgaaattgacacaatgggattttataagtacagcggcgatggtttcaacaaaaagacaaaatccttagaatattcacaggatttaaagagaagtgggaataacggcgcgctgaaagtcaacgcaagccttgctggtactgcctttgatgagatgaacattgctataaagctcacagacaaagacgataaaaaatttgattttagcaagtattctactttggagtacactctctatattccaaaccctgataagatttctggcaagcttatggttgcaagtgcaatagataatccatggcagattattaaagacttcacagctattaattacaaggataagaacgccattcaaaagataaatggaaaagactatgcggtaattaaatgttcagacaatctttacaatgtaaatacaaaggcaaatgttttggttttaagaattgcagggtcatatgtcaaatatacaggacctatttacattgacaatgtaaaacttgtggcaggaaagaaggttgctccaaaagtgaaaacaacaagcagtattccaaatatcaagaactattacagggtaaaaattgaagcggaaacagctaaggatgggtgggcatacagtattgaaaaagaaaatgcaaagtattctggaaaaggatatattcttttgtttgggaacaatatgggcaatactctctatgatttaaagataccgaaaacaggatactatatattcacaatcagcagctctacgcttggtatggtaaactatggtagtgttgatatatggatagatggtgaattaaagggagcagcaaaggttccaaatgttaaaggtaaattccaggaagttgtggtaatgaaaaagatatatcttacacaaggtgaacatactctgtcacttcaaaaatccggtggatatacgattgcaatagactactttacaattgaagagcttgttttggcaaacaagaataaaataagtgttgatacaaagcttgtaacaccaaatccacatcctaatgcgcaaaagcttatgaaatacctggcaagcatatatggtgaaaagattctctctgggcaacagagcagtggtgatggaaaagaaattcaaatgatatttgatgttacaaaaagatatcctgctgtcaggggctttgactttatggactactcaccaagcagggtagagcatggcacaaaaggtactgatgtagaagaggcaataaaatggtggaagagcggtggaattgttgctttctgctggcattggaatgcaccaacagggcttattgaccagccgggcaaagaatggtggagaggattttacacagaagcaacaacatttgatataaagaaggctatggacaatcctaattcaactgagtataagctcattttgagagatatagacgcaattgctgagcagctcaagaggcttcagaaagaaggagtcccagttcttttcagaccgctgcacgaagcttcaggtggctggttctggtggggggcaaaaggacccgagccctatatcaaactctggaaacttatgtttgataggcttgtaaattatcacaagttaaacaacctcatctgggtatggaacggtcaggatgcagcatggtatccgggggacaactatgttgatataattggcgaagacatttatgaggaaaaagctcaatattccccctatgcagacaggtttgcaaaggcattgaagtacacaaatgcaagaaagatgatagcacttactgagtgtggaacaattccagacccagcagtattaaaacaggaaggtatttcatggagctggttctctgtctgggcaggaaactttgtcatgacaggcagcaagtataatgatgagtggaatgacaatcatatgctaagaaagatttacaatagcgactatgtaataacaaaagacgaacttcctgatattaagaacataccattaaagtaagattaaaaaattgagtagaaacaaagatggagtttttataagaggagagggaggagttttgttaggttgatagctttcttctttctcttttattttttaagttattatatagaaaagtcaaaacaatatttgcctttgacatatcaaccaatgtaaattaaaattaaggtatagtgttttgcatactcaacataatatatcattaatatcctttttgttttttgcaagggggtgtttttgtggcggggcacagtaaaaaaagcagccacagtgccacagccataataacaagggaagaaaaagcccgatttgttcccaaaagcagcaatgtgcataataaaagctt

SEQ ID NO: 473 - protein, 911 aa, Caldicellulosiruptor saccharolyticus
MGVCLDMWRNWRVLFVLVTIIFLFSLIPTGIFGAVESSVNPVVLDFEDGTVMSFGEAWGDSLKCIKKVSVSQDLQRPGNKYALRLDVEFNPNNGWDQGDLGTWFGGVVEGQFDFTGYKSVEFEMFIPYDEFSKSQGGFPYKVVINDGWKELGSEFNITANAGKKVKINGKDYTVIHKAFAIPEDFRTKKRAQLVFQFAGQNSNYKGPIYLDNVRIRPEDASNLSKEDYGEQAEEGVAVEDFFTGVKLVYPEQGKSFVYNFEIDTMGFYKYSGDGFNKKTKSLEYSQDLKRSGNNGALKVNASLAGTAFDEMNIAIKLTDKDDKKFDFSKYSTLEYTLYIPNPDKISGKLMVASAIDNPWQIIKDFTAINYKDKNAIQKINGKDYAVIKCSDNLYNVNTKANVLVLRIAGSYVKYTGPIYIDNVKLVAGKKVAPKVKTTSSIPNIKNYYRVKIEAETAKDGWAYSIEKENAKYSGKGYILLFGNNMGNTLYDLKIPKTGYYIFTISSSTLGMVNYGSVDIWIDGELKGAAKVPNVKGKFQEVVVMKKIYLTQGEHTLSLQKSGGYTIAIDYFTIEELVLANKNKISVDTKLVTPNPHPNAQKLMKYLASIYGEKILSGQQSSGDGKEIQMIFDVTKRYPAVRGFDFMDYSPSRVEHGTKGTDVEEAIKWWKSGGIVAFCWHWNAPTGLIDQPGKEWWRGFYTEATTFDIKKAMDNPNSTEYKLILRDIDAIAEQLKRLQKEGVPVLFRPLHEASGGWFWWGAKGPEPYIKLWKLMFDRLVNYHKLNNLIWVWNGQDAAWYPGDNYVDIIGEDIYEEKAQYSPYADRFAKALKYTNARKMIALTECGTIPDPAVLKQEGISWSWFSVWAGNFVMTGSKYNDEWNDNHMLRKIYNSDYVITKDELPDIKNIPLK

SEQ ID NO: 474 - DNA, 1630 bp, Bacillus sp.
gatcaagtttgacagttctgtctgtgtcgctttcacttttaccatatcaaactcattgtctgtcaaaccaaagccggcattctgcccaaaaaacgagtaatcaattgatccttcagtgtcatgccattctgatggtaataagcgattccgcccaaaccggtcagcacagcgccgactgccgacaaaatcatccagcccattccgattctgcgcgctcttttgatctctcacccttaatgaatggaggagttggatatggttaagaaatatacgatctctttgctcattttatttttgcttgcgtctgctgttttagcaaaaccaattgaagcgcatactgtgtctcctgtaaatcctaatgcacagcagacaacaaaggcagtgatgaattggcttgctcatctgccgaaccgaacggaaaacagagttctttctggcgcgttcggaggttatagtcatgacacattttctatggctgaggctgatagaatccgaagcgccgccgggcaatcgcctgctatatacggctgtgattatgccagagggtggcttgaaacagcaaatattgaagattcaatagatgtaagctgcaacagcgatttaatttcgtattggaaaaatggcggaattccgcaaatcagtttgcacctggcgaaccctgcttttcagtcagggcattttaaaacagcgattacaaatgatcagtataaaaaaatactagactcttcaacagtagaagggaagcggctaaatgccatgctcagcaaaattgctgacggacttcaagagctggagaaccaaggtgtgccagttctattcaggccgctgcatgaaatgaacggtgaatggttttggtggggacttacatcatataatcaaaaggataatgaaagaatctctctatataaacagctctacaagaaaatctatcattatatgaccgacacaagaggacttgatcatttgctttgggtttactctcccgacgccaatcgagatttcaaaaccgatttttaccctggtgcgtcttacgtggatattgtcggactagatgcgtatttccaagacgcctattcgataaaaggatatgatcagctaacggcgcttaataaaccatttgcttttacagaagtgggcccgcaaacagcaaacggcagcttcgattacagcctgttcatcaatgcaataaaacaaaaatatcctaaaaccatttactttctcgcatggaatgatgaatggagcccagcggtaaacaagggtgcttcagctttatatcatgacagctggacgcttaataagggagaaatatggaatggcgattctttaacgccaatcgttgaatgaatgattttcacaaattagaaggtgctcaagaagtttcattgagcaccttcccgccttgattaggcattcatatcgcctaaccccggactaccctgccgaaggtctatgacttgtaactctccgccatttcggctggagatctcccttgatagatttccccgattctcgtttcatccaacctgaaggtaaactgtgcatcatggtaattcaacatactctctgcactgttaatatcataatttggaacaggggagagctttgccaactcaacgcccaatgtctcgag

SEQ ID NO: 475 - protein, 362 aa, Bacillus sp.
MVKKYTISLLILFLLASAVLAKPIEAHTVSPVNPNAQQTTKAVMNWLAHLPNRTENRVLSGAFGGYSHDTFSMAEADRIRSAAGQSPAIYGCDYARGWLETANIEDSIDVSCNSDLISYWKNGGIPQISLHLANPAFQSGHFKTAITNDQYKKILDSSTVEGKRLNAMLSKIADGLQELENQGVPVLFRPLHEMNGEWFWWGLTSYNQKDNERISLYKQLYKKIYHYMTDTRGLDHLLWVYSPDANRDFKTDFYPGASYVDIVGLDAYFQDAYSIKGYDQLTALNKPFAFTEVGPQTANGSFDYSLFINAIKQKYPKTIYFLAWNDEWSPAVNKGASALYHDSWTLNKGEIWNGDSLTPIVE

SEQ ID NO: 476 - DNA, 1551 bp, Bacillus circulans
atggggtggtttttagtgattttacgcaagtggttgattgcttttgtcgcatttttactgatgttctcgtggactggacaacttacgaacaaagcacatgctgcaagcggattttatgtaagcggtaccaaattattggatgctacaggacaaccatttgtgatgcgaggagtcaatcatgcgcacacatggtataaagatcaactatccaccgcaataccagccattgctaaaacaggtgccaacacgatacgtattgtactggcgaatggacacaaatggacgcttgatgatgtaaacaccgtcaacaatattctcaccctctgtgaacaaaacaaactaattgccgttttggaagtacatgacgctacaggaagcgatagtctttccgatttagacaacgccgttaattactggattggtattaaaagcgcgttgatcggcaaggaagaccgtgtaatcattaatatagctaacgagtggtacggaacatgggatggagtcgcctgggctaatggttataagcaagccatacccaaactgcgtaatgctggtctaactcatacgctgattgttgactccgctggatggggacaatatccagattcggtcaaaaattatgggacagaagtactgaatgcagacccgttaaaaaacacagtattctctatccatatgtatgaatatgctgggggcaatgcaagtaccgtcaaatccaatattgacggtgtgctgaacaagaatcttgcactgattatcggcgaatttggtggacaacatacaaacggtgatgtggatgaagccaccattatgagttattcccaagagaagggagtcggctggttggcttggtcctggaagggaaatagcagtgatttggcttatctcgatatgacaaatgattgggctggtaactccctcacctcgttcggtaataccgtagtgaatggcagtaacggcattaaagcaacttctgtgttatccggcatttttggaggtgttacgccaacctcaagccctacttctacacctacatctacgccaacctcaactcctactcctacgccaagtccgaccccgagtccaggtaataacgggacgatcttatatgatttcgaaacaggaactcaaggctggtcgggaaacaatatttcgggaggcccatgggtcaccaatgaatggaaagcaacgggagcgcaaactctcaaagccgatgtctccttacaatccaattccacgcatagtctatatataacctctaatcaaaatctgtctggaaaaagcagtctgaaagcaacggttaagcatgcgaactggggcaatatcggcaacgggatttatgcaaaactatacgtaaagaccgggtccgggtggacatggtacgattccggagagaatctgattcagtcaaacgacggtaccattttgacactatccctcagcggcatttcgaatttgtcctcagtcaaagaaattggggtagaattccgcgcctcctcaaacagtagtggccaatcagctatttatgtagatagtgttagtctgcaatga

SEQ ID NO: 477 - protein, 516 aa, Bacillus circulans
MGWFLVILRKWLIAFVAFLLMFSWTGQLTNKAHAASGFYVSGTKLLDATGQPFVMRGVNHAHTWYKDQLSTAIPAIAKTGANTIRIVLANGHKWTLDDVNTVNNILTLCEQNKLIAVLEVHDATGSDSLSDLDNAVNYWIGIKSALIGKEDRVIINIANEWYGTWDGVAWANGYKQAIPKLRNAGLTHTLIVDSAGWGQYPDSVKNYGTEVLNADPLKNTVFSIHMYEYAGGNASTVKSNIDGVLNKNLALIIGEFGGQHTNGDVDEATIMSYSQEKGVGWLAWSWKGNSSDLAYLDMTNDWAGNSLTSFGNTVVNGSNGIKATSVLSGIFGGVTPTSSPTSTPTSTPTSTPTPTPSPTPSPGNNGTILYDFETGTQGWSGNNISGGPWVTNEWKATGAQTLKADVSLQSNSTHSLYITSNQNLSGKSSLKATVKHANWGNIGNGIYAKLYVKTGSGWTWYDSGENLIQSNDGTILTLSLSGISNLSSVKEIGVEFRASSNSSGQSAIYVDSVSLQ

SEQ ID NO: 478 - DNA, 2155 bp, Caldicellulosiruptor saccharolyticus
gggtagcaatacatggtttggattccaggcatggtcgatgcagagggtagcggagtattactatgtgacaggagataaagatgcaggggcactgcttgagaagtgggtaagctggataaagagtgtagtgaagttgaatagtgatggtacatttgcgataccatcgacgcttgattggagtgggcagccagacacatggaatgggacatatacaggtaatccgaacttgcatgtgaaggtagtagattatgggacggatttaggaataacggcatcacttgcgaatgcactactttattacagtgcagggacgaagaagtatggggtatttgatgaggaagcgaagaatttagcgaaggaattgctggacaggatgtggaagttatacagggatgagaaaggtttatcggcgccagagaagagagcggactacaagaggttctttgagcaagaggtatacattccggcaggatggacagggaagatgccgaatggagatgtaataaagagcggagttaagtttatagacataaggagcaagtacaaacaagatcctgattggccgaagttagaggcggcatacaagtcagggcaggtaccggagttcagatatcacaggttctgggcacagtgtgacatagcaattgttaatgcaacatatgaaattctgttcggtaatcaataatgagtaggtaaatggaaatttagcggggtggcacatctataagtttggtgtgctgcctcgctaaaatcctgtatggaagtgttcgaaaaatagtacaaaaaaatggcgaggtaaaatggcaaaaatgcataaaaaagagggggttaggttttaagatgagactaaaaacaaaaataagaaagaaatggttgagtgtactatgtacagttgtttttttattgaacattttgtttatagcaaatgtaacgattttacccaaagttggtgcggctacatctaatgatggagtagtgaagatagatacgagtacgttaataggaaccaatcacgcacattgctggtacagagatagacttgatacggcattgcgtggaattaggtcatggggtatgaactctgtgagggtagtgctgagtaatggttaccgatggacgaagataccagcaagtgaagtggcaaatattatatcattgtcaagaagtcttggtttcaaagctattatattagaagtgcacgacacaacaggatatggagaagatggggcagcatgttcattggcacaagcagtggaatattggaaggagataaagagcgtattagacggtaacgaagattttgtaattataaacattggtaatgagccgtatgggaacaataactatcaaaactgggttaatgacacgaagaacgctataaaagcacttagagatgcaggattcaagcacacgataatggtggatgcgccgaactggggtcaggattggtctaatactatgagagataatgcccagagcataatggaagcagatccgctgcgcaatttggtattttcgattcatatgtatggcgtatacaatacagcaagcaaggtcgaagagtacatcaaatcatttgttgataaggggttaccattggttattggagaatttggacatcagcacacagatggtgaccctgatgaagaagctattgtcaggtatgcaaaacagtacaagataggattatttagttggtcgtggtgtggaaattcgagctatgttgggtatttggacatggtaaacaactgggaccccaataatccaactccatggggacaatggtataaaactaatgcaattggtacatcttctacaccaacacctacgtcgacagtaacgccaacgccacccccacgccaacaccaacaccgacagtaacagcgacaccaacaccaacacctacacctgttagcacacctgcgacaagtgggcagataaaggtactgtatgctaacaaggagacaaacagcactacaaacacgataaggccgtggttgaaggtagtgaatagtggtagcagtagcatagatttgagcagggtaacgataaggtactggtacacggtagatggtgagagggcacagactggatatcagactgggcacagataggagcaagcaatgtcaacattcaagtttgtgaagctgagagt

SEQ ID NO: 479 - protein, 227 aa, Caldicellulosiruptor saccharolyticus
GSNTWFGFQAWSMQRVAEYYYVTGDKDAGALLEKWVSWIKSVVKLNSDGTFAIPSTLDWSGQPDTWNGTYTGNPNLHVKVVDYGTDLGITASLANALLYYSAGTKKYGVFDEEAKNLAKELLDRMWKLYRDEKGLSAPEKRADYKRFFEQEVYIPAGWTGKMPNGDVIKSGVKFIDIRSKYKQDPDWPKLEAAYKSGQVPEFRYHRFWAQCDIAIVNATYEILFGNQ

SEQ ID NO: 480 - protein, 346 aa, Caldicellulosiruptor saccharolyticus
MRLKTKIRKKWLSVLCTVVFLLNILFIANVTILPKVGAATSNDGVVKIDTSTLIGTNHAHCWYRDRLDTALRGIRSWGMNSVRVVLSNGYRWTKIPASEVANIISLSRSLGFKAIILEVHDTTGYGEDGAACSLAQAVEYWKEIKSVLDGNEDFVIINIGNEPYGNNNYQNWVNDTKNAIKALRDAGFKHTIMVDAPNWGQDWSNTMRDNAQSIMEADPLRNLVFSIHMYGVYNTASKVEEYIKSFVDKGLPLVIGEFGHQHTDGDPDEEAIVRYAKQYKIGLFSWSWCGNSSYVGYLDMVNNWDPNNPTPWGQWYKTNAIGTSSTPTPTSTVTPTPPPRQHQHRQ

SEQ ID NO: 481 - DNA, 4977 bp, Caldicellulosiruptor saccharolyticus
gggtagcaatacatggtttggattccaggcatggtcgatgcagagggtagcggagtattactatgtgacaggagataaagatgcaggggcactgcttgagaagtgggtaagctggataaagagtgtagtgaagttgaatagtgatggtacatttgcgataccatcgacgcttgattggagtgggcagccagacacatggaatgggacatatacaggtaatccgaacttgcatgtgaaggtagtagattatgggacggatttaggaataacggcatcacttgcgaatgcactactttattacagtgcagggacgaagaagtatggggtatttgatgaggaagcgaagaatttagcgaaggaattgctggacaggatgtggaagttatacagggatgagaaaggtttatcggcgccagagaagagagcggactacaagaggttctttgagcaagaggtatacattccggcaggatggacagggaagatgccgaatggagatgtaataaagagcggagttaagtttatagacataaggagcaagtacaaacaagatcctgattggccgaagttagaggcggcatacaagtcagggcaggtaccggagttcagatatcacaggttctgggcacagtgtgacatagcaattgttaatgcaacatatgaaattctgttcggtaatcaataatgagtaggtaaatggaaatttagcggggtggcacatctataagtttggtgtgctgcctcgctaaaatcctgtatggaagtgttcgaaaaatagtacaaaaaaatggcgaggtaaaatggcaaaaatgcataaaaaagagggggttaggttttaagatgagactaaaaacaaaaataagaaagaaatggttgagtgtactatgtacagttgtttttttattgaacattttgtttatagcaaatgtaacgattttacccaaagttggtgcggctacatctaatgatggagtagtgaagatagatacgagtacgttaataggaaccaatcacgcacattgctggtacagagatagacttgatacggcattgcgtggaattaggtcatggggtatgaactctgtgagggtagtgctgagtaatggttaccgatggacgaagataccagcaagtgaagtggcaaatattatatcattgtcaagaagtcttggtttcaaagctattatattagaagtgcacgacacaacaggatatggagaagatggggcagcatgttcattggcacaagcagtggaatattggaaggagataaagagcgtattagacggtaacgaagattttgtaattataaacattggtaatgagccgtatgggaacaataactatcaaaactgggttaatgacacgaagaacgctataaaagcacttagagatgcaggattcaagcacacgataatggtggatgcgccgaactggggtcaggattggtctaatactatgagagataatgcccagagcataatggaagcagatccgctgcgcaatttggtattttcgattcatatgtatggcgtatacaatacagcaagcaaggtcgaagagtacatcaaatcatttgttgataaggggttaccattggttattggagaatttggacatcagcacacagatggtgaccctgatgaagaagctattgtcaggtatgcaaaacagtacaagataggattatttagttggtcgtggtgtggaaattcgagctatgttgggtatttggacatggtaaacaactgggaccccaataatccaactccatggggacaatggtataaaactaatgcaattggtacatcttctacaccaacacctacgtcgacagtaacgccaacgcccacccccacgccaacaccaacaccgacagtaacagcgacaccaacaccaacacctacacctgttagcacacctgcgacaagtgggcagataaaggtactgtatgctaacaaggagacaaacagcactacaaacacgataaggccgtggttgaaggtagtgaatagtggtagcagtagcatagatttgagcagggtaacgataaggtactggtacacggtagatggtgagagggcacagagtgcgatatcagactgggcacagataggagcaagcaatgtaacattcaagtttgtgaagctgagcagtagtgtaagtggagcggactattacttggagataggatttaagagtggagcagggcagttacagcctgggaaggatacaggagagatacagatgaggtttaacaaggatgactggagcaattacaatcaggggaatgactggtcatggatacagagcatgacgagttatggagagaatgagaaggtaacagcgtatatagatggtgtgctggtatggggacaggagccgagtggagcgacacctgcgccagccccgacagcgacgccgacacctacaccaacagtaacaccgacgccgacagtgacacctacgccgacagtaacagcaaccccgactccaacaccgaccccgacgccaacacctgttagcacacctgcgacaggtgggcagataaaggtactgtatgctaacaaggagacaaacagcacgacaaacacgataaggccatggttgaaggtagtgaacagtggtagcagtagcatagatttgagcagggtaacgataaggtactggtacacggtagatggtgagagggcacagagtgcgatatcagactgggcacagataggagcaagcaatgtaacattcaagtttgtgaagctgagcagtagtgtaagtggagcggactattacttggagataggatttaagagtggagcagggcagttgcagcctgggaaggacacaggagagatacagataagatttaataagagtgactggagcaattacaatcaggggaatgactggtcatggatacagagcatgacgagttatggagagaatgagaaggtaacggcgtatatagatggtgtgctggtatggggacaggagccgagtggaacaacaccttcgccgacgtcaacaccgacagtaacggtaacaccaacaccgacacccacaccaacacctacacctacaccaacagtaacaccgacaccgacagttacacctacgccgacagtaacagcaacgccaaccccgacaccgacacctataccaacagtaacaccattaccgacaatatcgccatctccatctgttgttgaaattacaataaatacaaatgcaggaagaacgcaaattagcccgtatatatatggtgcaaaccaagatattgaaggggttgtgcactcagcaagaagattaggtggaaatagactaacaggatataattgggaaaacaatttctcaaatgcagggaacgattggtatcattcaagtgatgactatttgtgctggagtatggggatttctggtgaagatgcaaaggttccagcggcagtggtatctaaatttcatgagtattcccttaaaaataatgcttattctgctgtaactttgcaaatggcaggatatgtgtcaaaagataattatggcacagttagtgaaaatgaaacagcaccatctaataggtgggcagaggtgaaatttaagaaagatgctcctctatctttgaatccagacttgaatgataactttgtttatatggatgagttcataaattatttgataaacaaatacggaatggcttcttcacctaccgggataaaaggatatatacttgataatgagcctgatttgtgggcatcaacacatccacgtatacatcctaataaagtcacatgcaaagagttgattgaaaaatctgttgaactggcaaaagttataaaaacccttgatccttcagctgaagtttttggatatgcatcatacgggtttatgggttattatagtcttcaagatgcacctgattggaatcaagttaaaggtgaacacagatggtttattagctggtatcttgaacagatgaaaaaggcatcagacagttttggtaaaagactattagatgtgcttgatctacactggtatcccgaggcaaggggtggaaatattcgcgtatgctttgatggtgaaaatgacacatcaaaagaagttgttatagctaggatgcaggctccgagaacactatgggatccgacctataaaacatcagtgaaaggacaaattacagctggtgagaacagctggataaaccagtggttttcagattatttgcctataattccaaacgtaaaagcggacatagagaaatattatcctggtacaaaacttgctattagcgaattcgactatggcggtcgaaatcatatttcaggtggtattgcattagctgatgttcttggtatatttggtaaatatggagtgaactttgcggcaagatggggcgattctggtagttatgcagcagctgcatataacatttatcttaattatgatggaaaaggctcaaaatatggcaatacaaatgtaagtgcaaatacgagtgatgttgaaaatatgccagtttatgcctcaataaatggacaggatgattctgaacttcatattatactaataaacagaaactatgatcaaaaattacaagtcaaaataaacataacaagcacgccgaaatatacaaaagcggaaatatatggatttgacagtaacagcccagaatataagaaaatgggaaatatagataatattgagagcaatgtatttacacttgaggttcccaaatttaacggtgtatcacatagtattacgttagatttcaatgtaagcataaaaattatacaaaatgaggttataaaattcataaggaatttggtttttatgagggctctggtgtaatgccaaagtggcaattgataatgtaacttggacgtaagaattgtgtcaaatatgttgatagtatttttgcaacagaggttgaaatattttcaaaatgagcattgttaatttaaatagactgagagcacaaatgtgaagctt

SEQ ID NO: 482 - protein, 1331 aa, Caldicellulosiruptor saccharolyticus
MRLKTKIRKKWLSVLCTVVFLLNILFIANVTILPKVGAATSNDGVVKIDTSTLIGTNHAHCWYRDRLDTALRGIRSWGMNSVRVVLSNGYRWTKIPASEVANIISLSRSLGFKAIILEVHDTTGYGEDGAACSLAQAVEYWKEIKSVLDGNEDFVIINIGNEPYGNNNYQNWVNDTKNAIKALRDAGFKHTIMVDAPNWGQDWSNTMRDNAQSIMEADPLRNLVFSIHMYGVYNTASKVEEYIKSFVDKGLPLVIGEFGHQHTDGDPDEEAIVRYAKQYKIGLFSWSWCGNSSYVGYLDMVNNWDPNNPTPWGQWYKTNAIGTSSTPTPTSTVTPTPTPTPTPTPTVTATPTPTPTPVSTPATSGQIKVLYANKETNSTTNTIRPWLKVVNSGSSSIDLSRVTIRYWYTVDGERAQSAISDWAQIGASNVTFKFVKLSSSVSGADYYLEIGFKSGAGQLQPGKDTGEIQMRFNKDDWSNYNQGNDWSWIQSMTSYGENEKVTAYIDGVLVWGQEPSGATPAPAPTATPTPTPTVTPTPTVTPTPTVTATPTPTPTPTPTPVSTPATGGQIKVLYANKETNSTTNTIRPWLKVVNSGSSSIDLSRVTIRYWYTVDGERAQSAISDWAQIGASNVTFKFVKLSSSVSGADYYLEIGFKSGAGQLQPGKDTGEIQIRFNKSDWSNYNQGNDWSWIQSMTSYGENEKVTAYIDGVLVWGQEPSGTTPSPTSTPTVTVTPTPTPTPTPTPTPTVTPTPTVTPTPTVTATPTPTPTPIPTVTPLPTISPSPSVVEITINTNAGRTQISPYIYGANQDIEGVVHSARRLGGNRLTGYNWENNFSNAGNDWYHSSDDYLCWSMGISGEDAKVPAAVVSKFHEYSLKNNAYSAVTLQMAGYVSKDNYGTVSENETAPSNRWAEVKFKKDAPLSLNPDLNDNFVYMDEFINYLINKYGMASSPTGIKGYILDNEPDLWASTHPRIHPNKVTCKELIEKSVELAKVIKTLDPSAEVFGYASYGFMGYYSLQDAPDWNQVKGEHRWFISWYLEQMKKASDSFGKRLLDVLDLHWYPEARGGNIRVCFDGENDTSKEVVIARMQAPRTLWDPTYKTSVKGQITAGENSWINQWFSDYLPIIPNVKADIEKYYPGTKLAISEFDYGGRNHISGGIALADVLGIFGKYGVNFAARWGDSGSYAAAAYNIYLNYDGKGSKYGNTNVSANTSDVENMPVYASINGQDDSELHIILINRNYDQKLQVKINITSTPKYTKAEIYGFDSNSPEYKKMGNIDNIESNVFTLEVPKFNGVSHSITLDFNVSIKIIQNEVIKFIRNLVFMRALV

SEQ ID NO: 483 - DNA, 1265 bp, Aspergillus aculeatus
ctcgacaccaccacacaaccaagatgaagctttctcacatgctcctcagcctcgccagcctgggggtggcgacggctcttccccggacgccgaaccacaacgcggccaccaccgccttccccagcacctcggggctgcacttcacgattgacggcaagacgggctactttgccgggaccaactcgtactggatcgggttcctgaccaacaacgacgacgtggacctcgtcatgagccagctggcggcatccgacctcaagatcctgcgggtctgggggttcaacgacgtcaacaccaagcccaccgacgggacggtgtggtaccagctgcacgcgaacggcacctcgaccatcaacacgggcgcggacgggctccagcgcctcgactacgtggtgacctcggccgagaagtacggcgtcaagctgatcatcaacttcgtcaacgagtggaccgactacggcggcatgcaggcctacgtcacggcctacggcgccgccgcccagacggacttctacaccaacaccgccatccaggccgcctacaagaactacatcaaggcggtcgtctcgcggtacagcagctccgccgccatcttcgcctgggagctggccaacgagccccgctgccagggctgcgatacctcggtcctgtacaactggatctcggacacgtccaagtatatcaagtcgctggactccaagcacctggtcacgattggcgatgagggcttcggtctcgacgtcgactccgacggcagctacccctacacctacggcgagggattgaacttcaccaagaacctgggcatctcgaccatcgacttcggtactctgcatctgtaccccgatagctggggcacctcctacgactggggcaacggctggatcacggcccacgcggccgcctgcaaggcggtgggcaagccgtgcctgctggaagagtacggagtgacctccaaccactgtgccgtcgagagcccctggcagcagacggccggcaacgcgacgggcatctccggcgatttgtactggcagtatggcaccacgttcagctggggccagtccccgaacgatgggaacaccttctactacaacaccagcgacttcacgtgcctggtgacggatcatgtggcggccatcaatgcgcagtcgaagtagactgttggcgtggtggaaggaacaagtagccttagtatagggttagcaaatgattgcggtggagagaacaaataaaatggtggtcaatgattatcgcgaaaaaaaaaa

SEQ ID NO: 484 - protein, 377 aa, Aspergillus aculeatus
MKLSHMLLSLASLGVATALPRTPNHNAATTAFPSTSGLHFTIDGKTGYFAGTNSYWIGFLTNNDDVDLVMSQLAASDLKILRVWGFNDVNTKPTDGTVWYQLHANGTSTINTGADGLQRLDYVVTSAEKYGVKLIINFVNEWTDYGGMQAYVTAYGAAAQTDFYTNTAIQAAYKNYIKAVVSRYSSSAAIFAWELANEPRCQGCDTSVLYNWISDTSKYIKSLDSKHLVTIGDEGFGLDVDSDGSYPYTYGEGLNFTKNLGISTIDFGTLHLYPDSWGTSYDWGNGWITAHAAACKAVGKPCLLEEYGVTSNHCAVESPWQQTAGNATGISGDLYWQYGTTFSWGQSPNDGNTFYYNTSDFTCLVTDHVAAINAQSK

SEQ ID NO: 485 - DNA, 1419 bp, Trichoderma reesei
gcatgatgatgctctcaaagagtctcctttccgctgcaactgcagcctcagcgctggccgcggtactgcagcctgttccacgtgcttcgagctttgtaaccatatccggcacccaattcaacatcgatggcaaagtaggctactttgcgggcaccaactgctactggtgctcgttcctgaccaaccacgccgacgttgattccacctttagccacatctcttcctctggcctcaaggtagtccgtgtatggggcttcaacgacgtcaacacgcagccctctcccggccagatctggttccagaagctgtccgctacggggtctacgatcaacacgggagctgatgggctgcagactctcgactacgtagtccagtcagccgagcagcacaacctcaagctcatcatcccgttcgtcaacaactggagcgactacggcgggataaacgcctatgtcaacgcctttggcggcaatgcgaccacctggtacactaacacggccgcgcaaactcagtaccgcaagtacgtccaggccgtcgtcagccgctacgcaaactcgacggccatctttgcgtgggagctgggcaacgagcctcgctgcaacgggtgcagtactgatgtgattgttcagtgggcgacgagtgtgtcccaatatgtcaagtcacttgattcgaaccatctcgtgacgcttggagacgaggggctcggtctcagtactggagacggcgcttatccgtatacttatggcgagggcactgattttgccaagaatgtacaaatcaagtcgcttgactttggtactttccacctctatccggactcttggggaacaaactacacttggggcaatggctggattcagactcatgccgccgcttgtttagcagcaggcaaaccttgcgtgtttgaagaatacggcgcacagcaaaacccctgcaccaacgaggcaccctggcaaacaacctctctcacgactcgcggcatgggtggcgacatgttttggcagtggggagacacttttgccaacggtgcccagtcgaacagtgacccgtacaccgtctggtacaactcatcgaactggcaatgcttggtcaagaaccacgttgatgctattaacggcggtacaaccactcctcctcccgtatcatcgacgacgacaacctcgtctaggacctcgtcgacgcctccaccgcctgggggcagctgctcgcccttgtatggccagtgtggaggttctggatacactggtcccacgtgctgtgcgcagggaacttgtatatattccaactactggtactcgcaatgcctgaatacatgaacggcctggagaaccaggtgtatcagacagacggagaaggagaaggccctcttatataggatgtcggtagcttccaccaactcttaagtcctgtttgtctaga

SEQ ID NO: 486 - protein, 437 aa, Trichoderma reesei
MMMLSKSLLSAATAASALAAVLQPVPRASSFVTISGTQFNIDGKVGYFAGTNCYWCSFLTNHADVDSTFSHISSSGLKVVRVWGFNDVNTQPSPGQIWFQKLSATGSTINTGADGLQTLDYVVQSAEQHNLKLIIPFVNNWSDYGGINAYVNAFGGNATTWYTNTAAQTQYRKYVQAVVSRYANSTAIFAWELGNEPRCNGCSTDVIVQWATSVSQYVKSLDSNHLVTLGDEGLGLSTGDGAYPYTYGEGTDFAKNVQIKSLDFGTFHLYPDSWGTNYTWGNGWIQTHAAACLAAGKPCVFEEYGAQQNPCTNEAPWQTTSLTTRGMGGDMFWQWGDTFANGAQSNSDPYTVWYNSSNWQCLVKNHVDAINGGTTTPPPVSSTTTTSSRTSSTPPPPGGSCSPLYGQCGGSGYTGPTCCAQGTCIYSNYWYSQCLNT

SEQ ID NO: 487 - DNA, 1939 bp, Bacillus sp.
tctagactccaaaggttactatcaacctgtctatttatttaactgtacagtagatggggtagaatcaaaccatcatcatccctgccatctaaattcattatatgaactcctcaatagagaacaacaaatcataatccaaccatatttttctaatcaatcactatgttaagataaaaaatgtaatcgcttacaattaaaaggatagaggaggattatgtaatgaaggtgtacaagaaggtggcttttgttatggcttttattatgtttttttcggtcctgccgacgatctcaatgtcgtcagaagcaaacggtgctgcattatcgaatcctaatgcgaaccaaacgacaaaaaacgtgtatagttggttagccaatctaccaaacaagagtaataaacgtgtggtgtcgggacacttcggagggtacagtgattctaccttagcctggatcaaacaatgcgcaagggagctgacaggaaaaatgccaggaatattatcttgtgattataagaattggcagacgcgattgtatgtagccgatcaaattagctatggctgcaatcaagaattaataaacttttggaaccaaggaggtttggtcacgatcagtgtacacatgccaaatccagggtttcattcgggggaaaactacaaaacaattttgcctacttcacagttccaaaatctaaccaatcacaggacaacagagggtagaaggtggaaggatatgctggataagatggcagatgggttggacgagctacagaacaatggagtgacggttcttttccgtcctttacatgaaatgaatggagaatggttctggtggggagcagaaggttacaatcaatttgatcaaacacgtgccaatgcctatatcagcgcatggagagatatgtatcaatattttactcatgagcgtaagctgaataaccttatttgggtttactcacctgatgtttacagagatcatgtaacaagttactacccaggagcaaattatgtagatattgtggctcttgattcctaccatcctgatccacatagccttactgaccaatataatcgaatgatcgctttagataaaccttttgcttttgctgaaatcggtcctcctgaaagcatggctggttcctttgattattcaaattatattcaagcaattaaacaaaaatatccacgtactgtctatttcctagcttggaatgataaatggagtccacataacaacagaggagcatgggatctatttaatgattcatgggttgtaaataggggagagattgattatggtcaatcaaatccagccactgttctctatgattttgaaaacaatacgctatcgtggtccgggtgtgaatttacggacggaggaccatggacttcgaatgaatggtcggcaaatggtactcaatcgttgaaagcagatgtcgttctgggcaataatagctaccatttgcaaaaaacagtgaatcgaaatcttagttcattcaaaaacctagaaattaaagtgagccattcttcgtggggaaatgtaggaagtggcatgacagcaagagttttcgtcaaaacagggagtgcttggagatggaatgcaggtgaattttgtcagtttgcaggcaaacgaacaaccgcactatctattgatttgacgaaagtaagtaatctgcatgatgttcgagagataggtgtagagtataaagcaccagcaaatagcaacgggaagacggcgatttacttagatcatgtgaccgtaagataatacaaaaaaaagtggttgaaagcggtaacatatctagcatatgatgatagggactagataataatagactgtcagactaggaggtaagtcataatgaaaaaaagtctgatcctcttgctcggacttttattagctttctccatgctattaatagcctatctatcattcacccctgcag

SEQ ID NO: 488 - protein, 513 aa, Bacillus sp.
MKVYKKVAFVMAFIMFFSVLPTISMSSEANGAALSNPNANQTTKNVYSWLANLPNKSNKRVVSGHFGGYSDSTLAWIKQCARELTGKMPGILSCDYKNWQTRLYVADQISYGCNQELINFWNQGGLVTISVHMPNPGFHSGENYKTILPTSQFQNLTNHRTTEGRRWKDMLDKMADGLDELQNNGVTVLFRPLHEMNGEWFWWGAEGYNQFDQTRANAYISAWRDMYQYFTHERKLNNLIWVYSPDVYRDHVTSYYPGANYVDIVALDSYHPDPHSLTDQYNRMIALDKPFAFAEIGPPESMAGSFDYSNYIQAIKQKYPRTVYFLAWNDKWSPHNNRGAWDLFNDSWVVNRGEIDYGQSNPATVLYDFENNTLSWSGCEFTDGGPWTSNEWSANGTQSLKADVVLGNNSYHLQKTVNRNLSSFKNLEIKVSHSSWGNVGSGMTARVFVKTGSAWRWNAGEFCQFAGKRTTALSIDLTKVSNLHDVREIGVEYKAPANSNGKTAIYLDHVTVR

SEQ ID NO: 489 - DNA, 2796 bp, Aspergillus niger
atgcgccacagcatcggattggcagcggccctactggcaccaaccctacctgtagcgttgggtcaatatattcgagacttaagcaccgagaaatggactctcagtagtcgagccttgaatcggacagtacctgctcaatttccatcgcaggttcacttagatctactaagggccggagtgattggtgaataccatggtttgaacgatttcaatcttcgctggatcgctgctgccaactggacttataccagtcaacccatcaaaggcctcctggacaattacgactcaacttggctcgtgtttgacggactggacactttcgcaacaatctcattctgtgggcagcaaatcgcatccacggacaatcagtttcgccagtatgcgttcgatgtatccaccgcactagggtcctgcaaaggagatcctgttctgagcatcaactttggaagcgcaccgaatattgttgatgctatcgcacaggactctaattcgcaaaaatggcccgatgacgtccaactcacctacgagtacccaaatcggtggtttatgcgcaaagaacaatcggacttcggatgggattggggtccagcatttgcccctgcaggtccatggaagcctgcatatattgttcagctagacaagaaagaaagtgtctatgtcctgaacacggatttggatatataccgaaagggccaaattaactaccttccgccagaccagagccaaccttgggtcgtcaacgctagcattgacattttgggtccactacctaccaaaccaaccatgtcgattgaagtgcgcgatactcattctggcacgattcttacttcgcggactctgaacaatgtcagtgtggctggtaatgccataactggtgtcaccgttctcgacgggctgaccccgaaactgtggtggccgcaaggcctcggtgatcagaacctctacaatgtttctatcactgtccaaagtagaggaaaccagaccgtggccagtgtgaacaaacggacgggcttccgcaccatttttctcaaccagcgcaacattactgaagcacagcgtgcgcaaggaatcgcccctggagcaaactggcactttgaagtcaacggtcatgagttctacgcaaaaggatcgaaccttatcccaccagacagtttctggacccgtgttacagaagagaagatgtcacggctattcgatgcagtggtcgttggaaaccagaatatgctccgtgtctggtcctccggcgcgtacctgcatgactacatctatgatctggccgatgaaaagggcattctcttatggagcgagttcgagttcagtgacgctttatatccctccgacgacgctttcctcgagaacgttgctgctgagatagtatacaatgttcgacgagtgaaccaccatccctccttggctctatgggctggcggaaatgaaatcgaatccttgatgctcccacgtgtcaaagatgcagccccatcttcatattcctactatgtgggcgagtatgagaagatgtacattagcctcttcttgcctctggtctacgagaacacgcgttccatctcatactcccccagcagcacaaccgaaggctacctgtacattgacctttctgcccctgtcccaatggctgaacgttacgacaacactacctccggctcatactacggcgatacagaccactacgactacgacactagcgtggcgtttgactacggttcctatccggtaggccgctttgccaacgaattcggcttccacagcatgcccagcctccagacatggcaacaagctgtcgacactgaggatctttacttcaacagcagcgtcgtcatgctgcgcaaccaccacgatcccgcaggtggtctcatgacggacaactacgcgaactcggccactggcatgggcgaaatgaccatgggcgtggtaagctactatccgataccgagtaaatccgaccacatctccaacttcagcgcctggtgccatgccacccagctctttcaggcagacatgtacaaaagtcagatccagttctaccgtcgtggaagtggcatgcccgagcgccagcttggctccttgtattggcagctcgaagatatctggcaagcgccatcatgggcaggcattgagtacggtggtagatggaaggtccttcaccacgttatgagagatatctatcagcctgttattgtttcacctttttggaactatactaccggctcgttggatgtctatgttacttccgatctgtggagccctgcagcaggtactgtcgacttgacctggttggacctgtccggccgccctattgcgggtaacgcgggcacgccaaaatctgttccctttaccgtgggaggtctcaacagcactcgcatctatgggacgaatgtttcttctctgggcttgccggatactaaagatgctgttctgatcctctcgctctcggctcacggccgtcttccgaactcagaccggaccaccaacttgactcatgagaattacgctacgctttcttggcccaaggatttgaagattgttgacccgggacttaagataggacacagctcaaagaagacaaccgttacggtggaagctacatccggtgtttcattgtacacctggctcgactacccagagggtgtggtgggatactttgaagagaatgccttcgtcttagcaccaggcgagaagaaagagattagttttactgttctagaggacactactgacggggcttgggtccgtaacatcaccgtccagagtctctgggaccaaaaggttcgcggttga

SEQ ID NO: 490 - protein, 931 aa, Aspergillus niger
MRHSIGLAAALLAPTLPVALGQYIRDLSTEKWTLSSRALNRTVPAQFPSQVHLDLLRAGVIGEYHGLNDFNLRWIAAANWTYTSQPIKGLLDNYDSTWLVFDGLDTFATISFCGQQIASTDNQFRQYAFDVSTALGSCKGDPVLSINFGSAPNIVDAIAQDSNSQKWPDDVQLTYEYPNRWFMRKEQSDFGWDWGPAFAPAGPWKPAYIVQLDKKESVYVLNTDLDIYRKGQINYLPPDQSQPWVVNASIDILGPLPTKPTMSIEVRDTHSGTILTSRTLNNVSVAGNAITGVTVLDGLTPKLWWPQGLGDQNLYNVSITVQSRGNQTVASVNKRTGFRTIFLNQRNITEAQRAQGIAPGANWHFEVNGHEFYAKGSNLIPPDSFWTRVTEEKMSRLFDAVVVGNQNMLRVWSSGAYLHDYIYDLADEKGILLWSEFEFSDALYPSDDAFLENVAAEIVYNVRRVNHHPSLALWAGGNEIESLMLPRVKDAAPSSYSYYVGEYEKMYISLFLPLVYENTRSISYSPSSTTEGYLYIDLSAPVPMAERYDNTTSGSYYGDTDHYDYDTSVAFDYGSYPVGRFANEFGFHSMPSLQTWQQAVDTEDLYFNSSVVMLRNHHDPAGGLMTDNYANSATGMGEMTMGVVSYYPIPSKSDHISNFSAWCHATQLFQADMYKSQIQFYRRGSGMPERQLGSLYWQLEDIWQAPSWAGIEYGGRWKVLHHVMRDIYQPVIVSPFWNYTTGSLDVYVTSDLWSPAAGTVDLTWLDLSGRPIAGNAGTPKSVPFTVGGLNSTRIYGTNVSSLGLPDTKDAVLILSLSAHGRLPNSDRTTNLTHENYATLSWPKDLKIVDPGLKIGHSSKKTTVTVEATSGVSLYTWLDYPEGVVGYFEENAFVLAPGEKKEISFTVLEDTTDGAWVRNITVQSLWDQKVRG

SEQ ID NO: 491 - DNA, 3024 bp, Aspergillus niger
atgaagctttcctccgcttgtgctattgccttgctggcggcacaggctgctggggcgtccattaagcatcgaatcaatggctttacccttacggagcattctgacccggccaagcgggaactgttgcagaaatacgtcacttgggatgacaagtccctttttatcaatggcgaaaggatcatgatcttcagtggcgaatttcatccattccgtctacctgtaaaagaacttcagcttgacatcttccagaaggtcaaagctctagggtttaactgtgtgtctttctacgtcgattgggccctcgttgaaggaaaaccgggggaatacagggcagacggcatctttgatttggagccgttcttcgacgcggcttcggaagcaggtatctacctgcttgcccgtccaggcccgtacatcaacgcagagagttccggcggtggatttccggggtggttgcagagagtcaatggtactcttcgctcaagcgacaaggcttacctggatgctacagataattacgtctctcacgtcgctgcaacaattgccaagtaccagattaccaatggcggtccgatcatcctgtatcagcccgaaaatgagtacactagtggctgctgcggtgttgaattccccgatccagtgtacatgcagtatgttgaagaccaggctcgtaacgccggtgtcgtcattccattgatcaataacgatgcctcggcttccgggaacaatgctcctggaaccgggaagggagcagtcgatatttacggccatgatagctacccgcttgggttcgactgcgcgaaccctacggtatggccctcgggtgacctacctaccaatttccgtacccttcatcttgagcaaagcccgaccacaccatatgcgatagtcgagttccaaggcggttcgtacgacccttggggaggaccgggattcgctgcgtgctccgaactcctgaacaatgagttcgagagagtgttctataagaacgactttagcttccagattgccattatgaacctctacatgatctttggtggaactaactggggtaacctcggttatcctaatggatacacctcctacgactatggttcggctgtgacagaatctcgcaacatcacccgcgagaaatacagtgaactcaagctacttggcaactttgccaaagtatctccgggctatttgacggctagtcctggcaatttgacaacttccggttacgctgataccacagacctgactgtaacgcctttgctcggaaacagcactggctctttcttcgtggtcagacattcggactacagcagcgaagagtcaacatcatacaagcttcgtcttcctaccagtgccggtagcgtgactatccctcagcttggtggtacactcacacttaatggacgcgattcaaagatacacgtgaccgactacaatgtctctggaaccaatatcatctactccacggccgaggtctttacctggaagaagttcgccgacggaaaggtcctcgtgctctacggaggtgctggtgagcaccacgaacttgccatttcaaccaagtcgaatgtcacggtgattgaaggatccgagtctggcatctcgtcaaagcagacctcttcgtcagttgtggtcggctgggatgtgtcgaccactcgtcgtatcatccaagttggggacctgaaaattctccttcttgacaggaactctgcctataactactgggtgcctcaacttgccacagacggcacttcaccaggttttagcaccccagagaaggtcgcatcatccatcatcgtcaaagcgggctaccttgttcggactgcgtacctgaagggcagcggtctttacctcaccgcagacttcaacgctaccacttccgttgaagtcattggcgtcccctccactgctaagaatctgttcatcaatggagataagacatcgcacaccgtcgacaagaacggcatctggtcagctacagtcgactacaatgcccctgatatctcgcttcccagcctgaaggacttggactggaagtacgtggacactcttccggagatccagtcctcctacgatgattctctctggcccgccgcagacctcaagcagaccaagaatacgcttcgttctctgacgacccctacctctctgtactcatccgattacggcttccacaccggatacctgctttaccgcggacacttcaccgccacgggcaacgagagcacctttgctatcgatacgcaaggtggatcagcatttggaagctctgtctggctgaacggaacatacctcggttcctggactggcctttatgccaactccgactacaatgccacttacaatctgcctcagctccaggcaggcaagacgtatgtgatcaccgttgtgatcgacaacatgggccttgaggagaactggactgttggtgaggacctaatgaagaccccgcgtggtattctcaacttcctgcttgccggacggccaagcagcgcaattagctggaagttgaccggaaaccttggcggcgaggactacgaagacaaggtccgaggtcctctgaacgagggtggtctctacgctgagcgccaaggatttcaccagcccgagcctcccagccagaactggaagtcttccagccctctggagggtctctctgaggcaggcattggtttctacagcgccagttttgaccttgacctgccgaagggatgggatgtcccactgttcctcaacatcggtaacagcactacgccatccccgtaccgcgtgcaggtctacgtcaacggatatcagtatgcgaaatacataagcaacatcggacctcagaccagcttccctgtccccgagggaatcctgaactatcgcggaacgaactggttggcggtgaccctgtgggctctcgactctgccggcggcaagttggaaagcttggagttgagttacaccactccagtgctgactgcccttggggaggtcgagtcggttgaccagcccaagtacaagaagcggaagggtgcatactag

SEQ ID NO: 492 - protein, 1007 aa, Aspergillus niger
MKLSSACAIALLAAQAAGASIKHRINGFTLTEHSDPAKRELLQKYVTWDDKSLFINGERIMIFSGEFHPFRLPVKELQLDIFQKVKALGFNCVSFYVDWALVEGKPGEYRADGIFDLEPFFDAASEAGIYLLARPGPYINAESSGGGFPGWLQRVNGTLRSSDKAYLDATDNYVSHVAATIAKYQITNGGPIILYQPENEYTSGCCGVEFPDPVYMQYVEDQARNAGVVIPLINNDASASGNNAPGTGKGAVDIYGHDSYPLGFDCANPTVWPSGDLPTNFRTLHLEQSPTTPYAIVEFQGGSYDPWGGPGFAACSELLNNEFERVFYKNDFSFQIAIMNLYMIFGGTNWGNLGYPNGYTSYDYGSAVTESRNITREKYSELKLLGNFAKVSPGYLTASPGNLTTSGYADTTDLTVTPLLGNSTGSFFVVRHSDYSSEESTSYKLRLPTSAGSVTIPQLGGTLTLNGRDSKIHVTDYNVSGTNIIYSTAEVFTWKKFADGKVLVLYGGAGEHHELAISTKSNVTVIEGSESGISSKQTSSSVVVGWDVSTTRRIIQVGDLKILLLDRNSAYNYWVPQLATDGTSPGFSTPEKVASSIIVKAGYLVRTAYLKGSGLYLTADFNATTSVEVIGVPSTAKNLFINGDKTSHTVDKNGIWSATVDYNAPDISLPSLKDLDWKYVDTLPEIQSSYDDSLWPAADLKQTKNTLRSLTTPTSLYSSDYGFHTGYLLYRGHFTATGNESTFAIDTQGGSAFGSSVWLNGTYLGSWTGLYANSDYNATYNLPQLQAGKTYVITVVIDNMGLEENWTVGEDLMKTPRGILNFLLAGRPSSAISWKLTGNLGGEDYEDKVRGPLNEGGLYAERQGFHQPEPPSQNWKSSSPLEGLSEAGIGFYSASFDLDLPKGWDVPLFLNIGNSTTPSPYRVQVYVNGYQYAKYISNIGPQTSFPVPEGILNYRGTNWLAVTLWALDSAGGKLESLELSYTTPVLTALGEVESVDQPKYKKRKGAY

SEQ ID NO: 493 - DNA, 2799 bp, Aspergillus clavatus
atgcgcatcagggaacagacaatcctagcgttgctttccccagggctgcctccagtgaccggtcagcatgtcctggatctgagtgaacctggttggacagtcagcagcaaagccttgaaccgaaccgtacctggtcgtcttccttcccaggtacatttggatttattcgaggctggcgttattgctaccatgggctcaatgattttgaccttcgctggattgcggatgccaactggacgtacaccagcgaccctattactgggctgtgaactgactgatcacgagtctacctggcttgtttttgatggtctcgacacttttacaaccatcacattttgtgatcagataatcggctcaacttataaccagtttcggcagtaccattttgacgtgtcccaggttctcaaagagtgtaaacaagaaggaccagtcctaagtatcaatttcgggagtgcccccaacattgcaaatgcgatagcaaatggcccgagcgcagaagagtggcccgccggtgtacagatcactaacgaataccccaaccgatggtatatccgcaaagagcagtcggactttgggtgggactggggccctgcttttgccccggctggaccttggaaaccagcgtatattgtgcagaataaaaatcccgatcgcctctatgtcttgaatactgatttggacatctaccggagaggccagatcaatcacctaccgccagatcagagccagtcttgggttgttaatgcgagtatcgatgttttaggatctgtgccccagtggccatctatgtcggtagagatcaaggacgcatattccggagttgtcctttcttccggattactcgagaatgtaacggtgtccggaaactcagtgacaggtgtgacagtcgtcgatggacgtaccccaaaattatggtggccaaacggcatgggcgatcaaagcctgtacaatgtgaccatagcagtacacaaccatcggaatcaagtcgtggctgaagtcatgaagaggactggcttccgaaccatttttctcaaccagaggaacatcactgaggagcagctcgcacaaggggttgcccctggggcaaactggcacttcgagattaacggtcgtgagttctacgccaaaggatctaacatcataccaccggatgccttttggcctcgagtgacgccaagtcggatggaaaggctcttcgatgcagtcacggcaggaaaccagaacatgctccgcgtctgggcttctggggcttacctccatgacttcatctacgatctggctgacgaaaagggcatcttgctctggagtgagtttcagttcagcgacgccttgtatcctgtcgatgatgcattcctggagaatgtagctgctgaagtggtttataatgtccggcgtgtaaaccaccacccatcacttgctctttgggcagggggcaatgaaattgagagcttgatgctccccatggtcagaagagcagaccacaagggatatgccaagtacgtcggggagtatgagaagctgtatatcagccttatattgcctctcgtgtatgagaacacacggtcgatcacatacagccccagcagtacgacagagggctatctgcacgttaatttgtcagcacctgtccccatgacggagcgatattcaaacaccactccagggtcatactatggcgacacggactactataactatgacacgagtgtctccttcaactaccataagtaccccgtgggtcgttttgcgaacgagtttggcttccacagcatgcccagcctgcagacctggcagcaagctgtggaccccaaagacctttatttcaacagcagtgtggtggtgcttcggaaccatcactacaccgcgggcggtttgtttactgacaactaccaaaactcgtctcgaggtatgggcgagatgactatgggggtagaaagctactatcccataccgagcaagtccgatcccgtcgccaatttcagtgcctggtgccacgcaacccagctcttccaagcagacatgtacaaagctcagattcaattctaccgccgaggaagcggaatgccagagcgccagctgggatctctttactggcagttggaggatacctggcaggcgccaacttgggcaggaatcgagtatgatggtcgatggaagatgctgcactatgttgcaagagacatttacgagcccatcatcgtgtccccgttctggaactacacgaccggtgatctggaagtctatgtgacctcggatttatgggagcctgcgcagggcaccgtgaatcttacctgggtcgatctttctggtaaatctattgctggcaatgctggcacgcctgagtcaattccattcagtgtcggtgctctgaacgcgaccgacgtctattctgcaaacgtggccgatctatctccaccagatctgactgactcgatcctcatcttgtctctcgctggggagggatatctcccaaatgcaagaaccagatcagaatttaggcacgagaaccagttcacccctgtctttcccaaggacctggcgctgagagatcccaaactcgagctggcctacaacccggacaccaggacgtttacagtcgaggctacagcgggggtttcgctgtacacctggctcgactatccagcaggcgtagtgggctacttcgagcagaatggatttgtcctgctcccaggaatgaagaaggagattgggtttgtggtgcaggagggaagtgttgatgaagactggatgcgaagtgtgacggtgacgagtctctgggaccagaaagtgagagagtag

SEQ ID NO: 494 - protein, 932 aa, Aspergillus clavatus
MRIREQTILALLSPGLPPVTGQHVLDLSEPGWTVSSKALNRTVPGRLPSQVHLDLFEAGVIATMGSMILTFAGLRMPTGRTPATLLLGCELTDHESTWLVFDGLDTFTTITFCDQIIGSTYNQFRQYHFDVSQVLKECKQEGPVLSINFGSAPNIANAIANGPSAEEWPAGVQITNEYPNRWYIRKEQSDFGWDWGPAFAPAGPWKPAYIVQNKNPDRLYVLNTDLDIYRRGQINHLPPDQSQSWVVNASIDVLGSVPQWPSMSVEIKDAYSGVVLSSGLLENVTVSGNSVTGVTVVDGRTPKLWWPNGMGDQSLYNVTIAVHNHRNQVVAEVMKRTGFRTIFLNQRNITEEQLAQGVAPGANWHFEINGREFYAKGSNIIPPDAFWPRVTPSRMERLFDAVTAGNQNMLRVWASGAYLHDFIYDLADEKGILLWSEFQFSDALYPVDDAFLENVAAEVVYNVRRVNHHPSLALWAGGNEIESLMLPMVRRADHKGYAKYVGEYEKLYISLILPLVYENTRSITYSPSSTTEGYLHVNLSAPVPMTERYSNTTPGSYYGDTDYYNYDTSVSFNYHKYPVGRFANEFGFHSMPSLQTWQQAVDPKDLYFNSSVVVLRNHHYTAGGLFTDNYQNSSRGMGEMTMGVESYYPIPSKSDPVANFSAWCHATQLFQADMYKAQIQFYRRGSGMPERQLGSLYWQLEDTWQAPTWAGIEYDGRWKMLHYVARDIYEPIIVSPFWNYTTGDLEVYVTSDLWEPAQGTVNLTWVDLSGKSIAGNAGTPESIPFSVGALNATDVYSANVADLSPPDLTDSILILSLAGEGYLPNARTRSEFRHENQFTPVFPKDLALRDPKLELAYNPDTRTFTVEATAGVSLYTWLDYPAGVVGYFEQNGFVLLPGMKKEIGFVVQEGSVDEDWMRSVTVTSLWDQKVRE

SEQ ID NO: 495 - DNA, 2868 bp, Neosartorya fischeri
atgagagagtccattctttcagtccttattttcttctctctcctgctcattgcccaagcaagagatgatggccgtatgaaatacaacttcaactctgggtggaaagtactcgtgggcaatcctgcgtctgcacagtcgccttccttcaacgacaacggttggaaggacgcaacactcccccactcgtggaatgaagatgatgctttccgcgtggacattgccaacctgtccaccggaattgcctggtaccggaaacactttgacctgcccgccacgagccggaataagaaagtctttctcgagttcgaaggcatccgccacgccggggagttttaccttaatggcaagtggatcggtcgcagcgagaacggggtcatggcctttggctttgatgtcagcgatgtcacgctctacaatcaaaccaacgtcctcgcggctcaaattgacaatagctggacgtacagggagaaggcaaccagtacgccataccagtggagcgacaagaatttctatgccaactacggcgggatcaacaagaacgttttcctgcatgttacggatcgactgtaccagactctaccgttgtactccaatctgcagaccaccggggtttacatctatgccaccgacctggatataccccgcaagagcgctacgatcaacatagaatcgcaagttcgcaacgagtatccacaagccaggacattccagtaccaagttgaaatccacgatgccgtgcagggtaagaaactcaaaacaatcaccggcggccggtacaccctccaagcaaacgagacccggaccatccgcaccgcaacacacctctccgacataaacttctggagctggggatacggctacctctacgacgtccggacctcgctactcctcaacaaccacgccatcgactccgtcaaaacccgtaccggcttccgcaagaccgagttcactcacggcgcgttcaagctcaacgaccgcaccctccacctaaaaggctacgcccaacgcacaacaaacgaatggcccgccctcggctgcgccgtcccaccctggctctccgatttctcgaacagcctcgtcctcgccagtaacgccgcccttatccgctggatgcacgtcaccccatggaaacaagacgtcgagtccctcgaccgcctgggcctgctccaggccctgccggcgggcgactccgaaggcgacgcaacaggccggcgctgggcgcagcgcacggagctcatgcgcgacgcaatcatctacaaccggaacaaccccagcgtcatcttctacgaagccggcaaccacggggtctcggaggcgcacatgagcgagatgaaggctctgcgggatacgtacgatccgcatgggggccgcgcggcgggatcgcgcgagatgctgaatagctccgtggcggagtacgggggcgaaatgctgtatatcaataagggggcgcgcatccccctctggcagatggagtatagtcgtgacgaggggttgaggaagtactgggatgactggtcgccgccgtatcatgtggacggggcggggccgccgtacaagggggaggatgcgagcgagtacaaccgcaaccaggactcgcatgcggtggagaatgtgcggcgatggtttgattatttcgaacagcggcccgggacggggacgagggttaatgccggtggggtgaatattatattttctgactcgaatacacaccatcgaggagcggagagttaccgacggtccggcgaggtggatgctgtccggctgccgaaggatgggtggtacgcgcacaaggtgatgtgggatagctgggttgatgtcgagcgtttggcaggacatatcatcgggcattggaactacaacgatagtacggtcaaggatgtctatgttgtttccacggcggaagaggtggagctgtttctgaatggcaagtctgtgggcaagggcgagcagagcagccgattcctcttcactttcgccaatgtaacttggcagtctggcacgatcagggccgtaggacagttgggcgctcgtggatccgtgctggacacgaagacgactgctggcgagcccgccagtatccggttgacgcctcataccgggccatctggatttgtggctgacggtgcggatattgccttggtggatgttgaggtggtcgatgcagagggccaaaggaaccccattgctctgagcatcattgactttgctctttctggcgaggcttcctggcgtggcggaattgcgcagtgtgccgacaactgcatcctgtcaactaccctcccagtcgaaaacggaatcaaccgggtcatgctgcggtctacaacaagagccggcaaggtgactctgactgctacatccgacgggctcaaaccagccacgatcatcctcaacaccaagccatttgccagtaagggcgggttgagcaccgttattcccgggtcagatcttccttttgttctctctcgtggtccgacaccgtcgagtgaatcatacaccatctctcgcaaagctgtggaggttctgaacgtcactgctggatgtgacacggaggacatgatcagttcctacgacgatgacgaggaaacagagtggtcctgtgacgggaacaaaaacagcacctggatcaagtactcttgggacggcccagtcaatgtgtcgcagatggttatgaagctgcacagcttccgaacgacaaagtatccagttcagatcagtgtggacgacaacgtagtctatgaagggagcaccccgacttctctgggttatgtgacgttggatctcaatgctactgttggccagagtgtgacggtggcttcagaggacggcgatctgggaattatcgaggcggagatctacgcaccggcataa

SEQ ID NO: 496 - protein, 955 aa, Neosartorya fischeri
MRESILSVLIFFSLLLIAQARDDGRMKYNFNSGWKVLVGNPASAQSPSFNDNGWKDATLPHSWNEDDAFRVDIANLSTGIAWYRKHFDLPATSRNKKVFLEFEGIRHAGEFYLNGKWIGRSENGVMAFGFDVSDVTLYNQTNVLAAQIDNSWTYREKATSTPYQWSDKNFYANYGGINKNVFLHVTDRLYQTLPLYSNLQTTGVYIYATDLDIPRKSATINIESQVRNEYPQARTFQYQVEIHDAVQGKKLKTITGGRYTLQANETRTIRTATHLSDINFWSWGYGYLYDVRTSLLLNNHAIDSVKTRTGFRKTEFTHGAFKLNDRTLHLKGYAQRTTNEWPALGCAVPPWLSDFSNSLVLASNAALIRWMHVTPWKQDVESLDRLGLLQALPAGDSEGDATGRRWAQRTELMRDAIIYNRNNPSVIFYEAGNHGVSEAHMSEMKALRDTYDPHGGRAAGSREMLNSSVAEYGGEMLYINKGARIPLWQMEYSRDEGLRKYWDDWSPPYHVDGAGPPYKGEDASEYNRNQDSHAVENVRRWFDYFEQRPGTGTRVNAGGVNIIFSDSNTHHRGAESYRRSGEVDAVRLPKDGWYAHKVMWDSWVDVERLAGHIIGHWNYNDSTVKDVYVVSTAEEVELFLNGKSVGKGEQSSRFLFTFANVTWQSGTIRAVGQLGARGSVLDTKTTAGEPASIRLTPHTGPSGFVADGADIALVDVEVVDAEGQRNPIALSIIDFALSGEASWRGGIAQCADNCILSTTLPVENGINRVMLRSTTRAGKVTLTATSDGLKPATIILNTKPFASKGGLSTVIPGSDLPFVLSRGPTPSSESYTISRKAVEVLNVTAGCDTEDMISSYDDDEETEWSCDGNKNSTWIKYSWDGPVNVSQMVMKLHSFRTTKYPVQISVDDNVVYEGSTPTSLGYVTLDLNATVGQSVTVASEDGDLGIIEAEIYAPA

SEQ ID NO: 497 - DNA, 3168 bp, Neosartorya fischeri; identical to SEQ ID NO: 351

SEQ ID NO: 498 - protein, 1055 aa, Neosartorya fischeri; identical to SEQ ID NO: 352

SEQ ID NO: 499 - DNA, 3066 bp, Aspergillus niger
aattctttctttcccagagcaaaacgcgttttcccttctagctgtacgccatgcgccacagcatcggattggcagcggccctactggcaccaaccctacctgtagcgttgggtcaacatattcgagacttaagcagcgagaaatggactctcagtagtcgagccttgaatcggacagttcctgctcaatttccatcgcaggttcacttagatctactaagggccggagtaattggtgagtactatttagaagtcaagtcctgtgaatatacaaccgctaacagcctcaatagatgatccgtaagtcacttcatcttccatggatgagaatgaatcgtactaaatattgctggagataccatggtttgaacgatttcaatcttcgctggatcgccgctgccaactggacttataccagtcaacccatcaaaggcctgtgagtcactgttaagttcgtgtaatgtcgttcgacaatactaagaaccaatagcctggacaattacggctcaacctggctcgtatttgacggactggacactttcgcaaccatctccattctgtggacagcaaatcgcattcacggacaatcagtttcgccagtttcgggttcgatgtatctaccagcactagaggcctgccaaaggaggatcctaattcgcaaagtaagtttcagaggtggcgtgactgccgaggttaatacatgctatttgcatatagaatggcccgatgacgtccaactcacctacgagtacccaaatcggtggtttatgcgcaaagaacaatcggacttcggatgggattggggtccagcatttgcccctgcaggtccatggaagcctgcatatattgttcagctggacaagaaagaaagtgtctatgtcctgaacacggatctggatatataccgaaagaaccaaattaactaccttccgccagaccagagccaaccttgggtcgtcaacgctagcattgacatcctgggtccactacctgccaaaccaaccatgtcgattgaagtgcgcgatactcattctggcacgatccttacttcacggactctgaacaatgtcagtgtggctggtaatgccataactggtgtcaccgttcttgacgggctgaacccgaaactgtggtggccgcaaagctcggtgatcagaacctctacaatgtttctatcactatccaaggtagagggaaccagaccgtggccagtgtggacaaacggacgggcttccgcaccattttttctcaaccagcgcaacattactgaggtacagcgtgcacaaggaatcgcccctggagcaaattggcactttgaagtcaacggtcatgaattctacgccaaaggatcgaaccttatcccaccagacagtttctggacccgtgttacagaagagaggatatcacggctattcgatgcagtcgtggttggaaaccagaatatgctccgtgtctggtcctccggcgcgtacctgcatgactacatctatgatctggccgatgaaaagggcattctcttatggagcgagttcgagttcagtgacgctttatatccctccgacgacgctttcctcgagaacgttgctgctgagatagtatacaatgttcgacgagtgaaccaccatccctccttggctctatgggctggcggaaatgaaatcgaatccttgatgctcccacgtgtcaaagatgcagccccatcttcatattcctactatgtgggcgagtatgagaagatgtacatcagcctcttcttgcctttggtctacgagaacacgcgttccatctcatactcccctagcagcacaaccgaaggctacctgtacattgacctttctgcccctgtcccaatggctgaacgttacgacaacactacctccggctcatactacggcgatacagaccactacgactacgacactagcgtggcgtttgactacggttcctatccggtaggccgctttgccaacgaattcggcttccacagcatgcccagcctccagacatggcaacaagctgttgacactgaggatctttacttcaacagcagcgtcgtcatgctgcgtaaccaccacgatcccgcaggcggcctcatgacggacaactacgcaaactcggccactggcatgggcgaaatgaccatgggcgtgataagctactacccgataccgagtaaatccgaccacatctccaactttagcgcctggtgccatgccacccagctcttccaggcagacatgtacaaaagtcagatccaattctaccgtcgtggaagtggcatgcccgagcgccagcttggctccttgtattggcagcttgaagacatctggcaagcgccatcatgggcaggcattgagtacggtggtagatggaaggtccttcaccacgttatgagagatatttatcagcctgttattgtttcacctttttggaactatactacaggctcgttggatgtctatgttacttctgatctgtggagccctgcagcaggtactgtcgatttgacctggttggacctgtccggccgccctattgcgggtaacgcgggcacgccaaaatctgttccttttaccgtgggagggctcaacagcactcgcatctatggcacgaatgtttcttctttgggcttgccggatactaaagatgctgttctaatcctctcgctctcggctcacggccgtcttccgaactcagaccggaccaccaacttgactcatgagaattacgctacgctttcttggcccaaggatttgaagattgttgacccgggacttaagctgggatacagctcaaagaagacaactgttacagtggaagctacatctggcgtttcactatatacatggctcgactatcctgaaggcgtagtgggatactttgaagagaatgcgttcgtcttagcaccaggcgagaagaaagagattggttttactgttctagacgacacgacaaatggggcttgggtccgtaacatcaccgtccagagtctctgggaccagaaggttcgcggatgattatcaatagcattcgcatagccacagacgacaaatggggcttgggtccg

SEQ ID NO: 500 - protein, 931 aa, Aspergillus niger
MRHSIGLAAALLAPTLPVALGQHIRDLSSEKWTLSSRALNRTVPAQFPSQVHLDLLRAGVIGEYHGLNDFNLRWIAAANWTYTSQPIKGLLDNYGSTWLVFDGLDTFATISILWTANRIHGQSVSPVSGSMYLPALEACQRRILIRKVSFRGGVTAEVNTCYLHIEWPDDVQLTYEYPNRWFMRKEQSDFGWDWGPAFAPAGPWKPAYIVQLDKKESVYVLNTDLDIYRKNQINYLPPDQSQPWVVNASIDILGPLPAKPTMSIEVRDTHSGTILTSRTLNNVSVAGNAITGVTVLDGLNPKLWWPQSSVIRTSTMFLSLSKVEGTRPWPVWTNGRASAPFFLNQRNITEVQRAQGIAPGANWHFEVNGHEFYAKGSNLIPPDSFWTRVTEERISRLFDAVVVGNQNMLRVWSSGAYLHDYIYDLADEKGILLWSEFEFSDALYPSDDAFLENVAAEIVYNVRRVNHHPSLALWAGGNEIESLMLPRVKDAAPSSYSYYVGEYEKMYISLFLPLVYENTRSISYSPSSTTEGYLYIDLSAPVPMAERYDNTTSGSYYGDTDHYDYDTSVAFDYGSYPVGRFANEFGFHSMPSLQTWQQAVDTEDLYFNSSVVMLRNHHDPAGGLMTDNYANSATGMGEMTMGVISYYPIPSKSDHISNFSAWCHATQLFQADMYKSQIQFYRRGSGMPERQLGSLYWQLEDIWQAPSWAGIEYGGRWKVLHHVMRDIYQPVIVSPFWNYTTGSLDVYVTSDLWSPAAGTVDLTWLDLSGRPIAGNAGTPKSVPFTVGGLNSTRIYGTNVSSLGLPDTKDAVLILSLSAHGRLPNSDRTTNLTHENYATLSWPKDLKIVDPGLKLGYSSKKTTVTVEATSGVSLYTWLDYPEGVVGYFEENAFVLAPGEKKEIGFTVLDDTTNGAWVRNITVQSLWDQKVRG

SEQ ID NO: 501 - DNA, 2374 bp, Aspergillus niger
atgatcgggtcttctcatgccgtggtggccctgggcctttttacgttatacggtcattctgcagcagcacccgcaattggggcttcgaattcacagagtatgtatgtcctgatgggggggagggatgctactgcaacgcttgatcttcattcggaatgtaagctgaccaaacagcgatcgttacgaatggcactagtttcgcattgaacggcgacaatgtctcatatcgattccatgtcaacagtagcaccggcgacttgatttctgatcattttggtggtgtcgtctccggcacaatcccttcgccagtggaacctgctgtcaacggctgggtcggcatgcctggtcgaatccgccgggagttccccgaccaaggccgtggggatttccgcattcccgccgttcgtattcgggaatcggcaggttatactgttagcgatctccaatatgtgtcgcacgaggtgatcgaaggtaaatatgctttgcctggcctgcctgccacatttggcgatgcgcaggacgccaccactttggtagtccatctgtatgacaactatagctccgtcgcggccgacttgtcatactccatatttccgaaatatgatgcgatcgtgaggagtgtcaatgtgaccaaccagggcccaggtaatatcactatcgaggcccttgcaagcataagtatcgatttcccctatgaagacctcgacatggtcagcctccgaggcgactgggccagagaggcaaatgttcagagaagcaaagtgcagtatggcgtccaggggtaagtcagcatagcataaaaccgacatggtgaccttactgacgggagagtagatttggaagcagtactggatattcctctcaccttcataatcccttccttgccatagtagatccagctactaccgaatcgcaaggcgaggcatggggtttcaaccttgtatataccggctctttctcggcgcaagtagagaaaggatcgcaaggtttcacccgggcgctgctcggcttcaacccggaccaattatcgtggaaccttggccctggcgagactttaacctcccccgagtgtgttgcagtctactcggacaaaggccttggctcagtgtctcgcaaattccaccggctatatcgcaaccacctcatgaagagcaagttcgccacgtccgaccggccggttctgctgaatagctgggaaggtgtttatttcgactacaatcaaagcagcatcgaaactcttgccgaagagtccgctgccctgggtgtccacctctttgtcatggacgacggctggtttggggacaagtaccctcgagtgtccgataacgccggactgggcgactggatgcccaatccagcgcgcttcccggacgggttgaccccggtcgtgcaagacatcacaaatctcaccgtcaatggcacagagtccacaaaacttcgctttggtatttgggtggagcccgagatggtcaaccccaattccactctctaccacgaacacccggagtgggcgcttcatgccgggccttacccccgtaccgagcgtcggaaccagctcgtcctcaacctggcgcttccggctgtgcaggacttcatcatagacttcatgacgaacctgttacaagataccggcatttcctacgtcaaatgggacaacaaccgggggatacacgagacgccctctccgtcgactgaccatcagtacatgcttggcctctaccgggtgttcgacacactgaccacccgttttccggatgtcctgtgggaaggatgtgcctcgggcggcggccgctttgatgctggcatgctgcagtatgtcccccagatctggacttccgacaacaccgacgccatcgaccgaatcaccatccaatttgggacctcgcttgcctacccgccatcagcaatgggagcccacctctccgcggtccctaatgcacagaccggtcgcactgtgccctttactttccgcgcacacgttgctatgatgggtggttctttcggcttggagctggatccggcgacggtggaaggggacgaaatagttcccgagctccttgcgctggcggaaaaggtgaaccctatcattttgaacggagatctgtatcggctacgcctacctcaagactcccagtggcctgccgcactctttgtgtctcaggatggcgcacaggctgttctgttctacttccaggtccagccgaatgtcaaccatgccgtgccgtgggtcaggctgcaggggttggaccctaaggcggactataccgtcgatggggatcagacgtattctggagcaacactaatgaatctggggttgcagtatagttttgacaccgagtatggaagcaaggtagttttcctggagaggcaatga

SEQ ID NO: 502 - protein, 747 aa, Aspergillus niger
MIGSSHAVVALGLFTLYGHSAAAPAIGASNSQTIVTNGTSFALNGDNVSYRFHVNSSTGDLISDHFGGVVSGTIPSPVEPAVNGWVGMPGRIRREFPDQGRGDFRIPAVRIRESAGYTVSDLQYVSHEVIEGKYALPGLPATFGDAQDATTLVVHLYDNYSSVAADLSYSIFPKYDAIVRSVNVTNQGPGNITIEALASISIDFPYEDLDMVSLRGDWAREANVQRSKVQYGVQGFGSSTGYSSHLHNPFLAIVDPATTESQGEAWGFNLVYTGSFSAQVEKGSQGFTRALLGFNPDQLSWNLGPGETLTSPECVAVYSDKGLGSVSRKFHRLYRNHLMKSKFATSDRPVLLNSWEGVYFDYNQSSIETLAEESAALGVHLFVMDDGWFGDKYPRVSDNAGLGDWMPNPARFPDGLTPVVQDITNLTVNGTESTKLRFGIWVEPEMVNPNSTLYHEHPEWALHAGPYPRTERRNQLVLNLALPAVQDFIIDFMTNLLQDTGISYVKWDNNRGIHETPSPSTDHQYMLGLYRVFDTLTTRFPDVLWEGCASGGGRFDAGMLQYVPQIWTSDNTDAIDRITIQFGTSLAYPPSAMGAHLSAVPNAQTGRTVPFTFRAHVAMMGGSFGLELDPATVEGDEIVPELLALAEKVNPIILNGDLYRLRLPQDSQWPAALFVSQDGAQAVLFYFQVQPNVNHAVPWVRLQGLDPKADYTVDGDQTYSGATLMNLGLQYSFDTEYGSKVVFLERQ

SEQ ID NO: 503 - DNA, 1974 bp, Aspergillus terreus
atgctgaagccccgacaaacacctttcagagatctgatctctctcgacgggctttggaagtttgctctcgactccggtgataatgcaacagccgcaccctggacgggtccattgaccacagatctcgagtgtcccgttccagcctcttataatgacatcttcgtcgatcgtcagatccgtgaccatgtcggatgggtttactaccagcgcgaggctatcgtccccagagcctggtcacagcagcaatatctcgtaagggttgatgccgccacgcaccaaggccgcatctatatcaacgacaatctggtcgccgagcacaggggaggctacacccctttcgaagcagatattacgggtcttgtctctgctggtgacagcttccgcttgaccattgccgtcaacaatgagctgacccacgagactatcccaccaggcaggatcgaggtggaggagtatacaggtaaaagagtacaggtctaccagcatgatttctttaattacgctgggcttgcgcgctccgtctggctgtattctgttccgcaacagcacatccaggacatcaaagtcgtcactcatgtgaaaggctctgcagggctcatcaattacctcgtcacggtctccaactcgacgacaggccgcgtcaagatcgacgtgatcgataaagatggcacgacagttgccgaagcatcaggcgcacgtggctctgtcacaatagactccgtcaagctgtggcagccgggtgaggcgtatctttaccaatttagagccagcatagtggggttgaacgacagtgtagtcgacacctactgtgttgagacgggtgtgcgcacagtcaaggtcagtgggaacaggttcctcataaacgacaagccattttacttcactggctttgggaagcacgaggacagtgctgtgcgcggaaaaggctacgacccagcatacatggttcacgatttccagctgatggattggatgggagccaactcgttccgcacctcccactacccctacgctgaagaggtcatggaatttgcggaccggcacggaatcgtcgtcattgacgagacgcccgccgtcggcctggcattctccattgggtctggagtttccagcgaagacagtccgcagactttcaccccggaagggatcaacaataacacccgcgaagctcacaagcaggcgatccgggagctcattgctcgggataagaatcacgccagcgtcgtcatgtggtcgattgcgaatgagcctgcgtcgcaggaggtgggagcccgtgagtatttcgcgccgctggttgacctggcccacgagctcgacccaagtcgccctgtttgttttgcaaattatggagacgccacgtatgaggtggatcggatctcggatatgtttgatgtcctctgcctcaaccgctatttcgggtggtattcccaaaccggggaggttgaggaggccgaggcggctctcgaaaaggaactattgggctgggaagggaaatacggcaaacctatcgtcataacagaatacggagctgacaccatggccggcctccattctgtgcttgctcttccatggagtgaggaattccaggtccaactactcgatatgtatcatcgggtgtttgaccgcattgactcagtggtaggagagcacgtctggaactttgctgatttccagacggctgtagggattattagggtggatggaaacaagaagggtgtctttaccagggaaaggaaaccaaaggctgcagctcatacattgaaaacacggtggagtgccggcttcgcagctatgtgtcttgagcatcgtgagaagaacttcggattagccctggtaaaggcaaggcgcaggcggggcgcaggcgggacgcgccgttcactcttccgtccatcagagctggcagggccgacaacacctgccggcataagttacatacggcctaggcgcccactatacttcctatttggcgcttaa

SEQ ID NO: 504 - protein, 657 aa, Aspergillus terreus
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSAGFAAMCLEHREKNFGLALVKARRRRGAGGTRRSLFRPSELAGPTTPAGISYIRPRRPLYFLFGA

SEQ ID NO: 505 - DNA, 2532 bp, Emericella nidulans
atgggtgccttcacacaacacgttctttcagagggttggagctttaaggacagcggtgatcagtccccagatgcctggttgtcggttcccactgttccttctgtcgtccatcaagacttacaggcaaatggcaaattagatgatccgttcattggcctcaacgaattgagtgcaagatgggtcaacgagaagtcatggacctaccgaaacgtcttccagaagccaaccgttcctgctggatcttcaatctttttagtctttgacggactggatactttcgccaaggtcaaactcgatggccaggtcattctagagagcgataacatgtttcttgctcaccgggtggatatcacaaaagccctagatgtggaaggcgagcatacactcgagattgatttcgattgtgccttacttcgtgctcgagaacttcgaaagcagcacccagatcataaatgggttggtttcaatggagacactgcgagattgagcgtcagaaaagctcagtatcattggggttgggactgggggccagtcctgatgacagcaggcatttggaaagaagtgcgacttgaagtttattccgcgaaaatttcagatctctggacagaggtgcacctagccgaggaccactccaaggctcgcattaccgctgccgcagaggttgagacccaagggaccggcaactcgtacaaagctacttttacgttgagccttcaagggcagcagatcggcaaagaggtagctactctggacggcaatgtcgctaagacgacgttcgatgttcaagaaccgtcgctttggtggccgaatggatacggagaccaaactttatatgagatctcggtgtctctggaaaaggaagaagaacaagcccatcaggtctcgaaaaagtttggcattcggactgcggaggtcatccagcggccggacaagcatggaaaatccttcttcttccgcattaacggtgttgatattttctgcggcggtgcatgttggattcccgctgatagtcttctgaccaatatcacacccgatcgttatcgcaaatggatcgagttaatggctgtcggccatcaggtgatgattcgtgtttggggtggcggcatctacgaggatgagagcttctaccaggcctgtgatgaggtcggtgtaatggtatggcaagattttatgttcggctgcggtaactatccgacgtggcctgagattcttgagtcgatcgaaaaagaggccgaatataacctgcggagattgcgccaccacccttccatcgttatctgggttggaaacaacgaggactatcaggtacaggagcagcaagggctcacttacaattatgcagacaaggatccggagagttggctcaagacggatttcccggcccgctatatctacgagcatcttctaccaaaggccgtccaaaaaataattccatcggcatattaccatcctggcagcccgtggggcgatggcaaaatcacttctgacccgaccgtaggggatatgcatcagtggaatgtatggcacggtacacaggagaaataccaaatcttcgatactcttggcggccgctttaacagcgagttcggaatggaagcgttccctcacatgtccaccatcgaccacttcgtcacaaatgaagccgacaaatacccccagtcacacgtcctggatttccacaataaggcagacggtcacgagcggaggattgccacgtacctcgttgagaatctacgaacggcaacagacttagaaacctatatttaccttacacaagtcgtccaagcagaaacgatgatgtttggttaccgcggatggcgccgccagtggggagatgagagacattgtggaggtgcactgctctggcaattgaacgactgctggccaaccatctcctgggccattgtagactactttctgcgccccaaacctgcgttctatgccgtcagccgtgttttgaagccgcttgccattggtgtgcgccgggagcaccacgattggagtgtctcccacgcacaaccgcctaagactagcaagtacgagctatgggtcgtcagcagtctgctgaaggaggtgatcggaaaggtcgaacttaggtttatatccatcaagactggtcttgctattcacgagtctatcgtccgcgagaatgtcaccattgtacccaatggcactactaacatcttggacggagtcatcgatcacgcagtcgacgagccgcatgtccttgctgccagactctgggtggatggcgagcttgtggctagagatgttgattggccgcagccgttcaagtaccttgatctctctgaccgaggactagagattacgaggatttccaagaccgaaagcgagcaggtacttgaattgagcgccaggaagccagtcaaatgcttggtctttgaggaacgagacaatgtccgagtcagcgacagtgctattgacatcgtgccgggcgatgagcagtttgttactattaagggcttaaagcgtagtgatgcgccgctgaagtacaaattccttggacagtag

SEQ ID NO: 506 - protein, 843 aa, Emericella nidulans
MGAFTQHVLSEGWSFKDSGDQSPDAWLSVPTVPSVVHQDLQANGKLDDPFIGLNELSARWVNEKSWTYRNVFQKPTVPAGSSIFLVFDGLDTFAKVKLDGQVILESDNMFLAHRVDITKALDVEGEHTLEIDFDCALLRARELRKQHPDHKWVGFNGDTARLSVRKAQYHWGWDWGPVLMTAGIWKEVRLEVYSAKISDLWTEVHLAEDHSKARITAAAEVETQGTGNSYKATFTLSLQGQQIGKEVATLDGNVAKTTFDVQEPSLWWPNGYGDQTLYEISVSLEKEEEQAHQVSKKFGIRTAEVIQRPDKHGKSFFFRINGVDIFCGGACWIPADSLLTNITPDRYRKWIELMAVGHQVMIRVWGGGIYEDESFYQACDEVGVMVWQDFMFGCGNYPTWPEILESIEKEAEYNLRRLRHHPSIVIWVGNNEDYQVQEQQGLTYNYADKDPESWLKTDFPARYIYEHLLPKAVQKIIPSAYYHPGSPWGDGKITSDPTVGDMHQWNVWHGTQEKYQIFDTLGGRFNSEFGMEAFPHMSTIDHFVTNEADKYPQSHVLDFHNKADGHERRIATYLVENLRTATDLETYIYLTQVVQAETMMFGYRGWRRQWGDERHCGGALLWQLNDCWPTISWAIVDYFLRPKPAFYAVSRVLKPLAIGVRREHHDWSVSHAQPPKTSKYELWVVSSLLKEVIGKVELRFISIKTGLAIHESIVRENVTIVPNGTTNILDGVIDHAVDEPHVLAARLWVDGELVARDVDWPQPFKYLDLSDRGLEITRISKTESEQVLELSARKPVKCLVFEERDNVRVSDSAIDIVPGDEQFVTIKGLKRSDAPLKYKFLGQ

SEQ ID NO: 507 - DNA, 2466 bp, Thermotoga neapolitana
gtgggggccgccttatgcgaacggatactggggagacagcagggttcaggtcaatcccatcatcagaaacctgtggctgaaggaaatcaaaaaatccatatgggaacacggcgaatgaggagggaaagttatggaactgtacaggacccatcacaaccagtcgaggtgagggtgaaagatcttctttcgaggatgactctggaagagaaaattgctcaactcggttctgtctggggatacgagttgatagatgagagaggaaagttcaaaagagaaaaggcaaaagatcttctaaaaaacggcatcggccaaatcacgcgtcctggaggctccacgaaccttgagccacaagaagctgcagaacttgtgaacgaaatacagcgctttcttgtggaggaaacacgtcttggaatacctgcgatgatacacgaagagtgtctcaccggatacatgggtcttggtggaaccaacttcccacaggcaatagcgatggcgagcacctgggatccagatctcatagagaaaatgacagcggccatcagagaggacatgaggaagttaggagcgcaccagggactcgctcctgttctggacgtggcaagagatccaaggtggggaagaacggaggaaacgttcggggagtctccttaccttgtcgcaaggatgggtgtttcctacgtgaaaggactccagggtgaaaacataaaagaaggcgttgtcgctacggtgaaacactttgcaggatacagcgcttctgaaggcggaaagaactgggcaccgacgaacattcctgaaagagagttcagagaagtctttcttttcccatttgaagctgcggtcaaagaagcaagagtgctttctgtgatgaactcctacagtgaaatagacggtgtgccctgtgcagcaaacagaaggcttctcaccgatattctgagaaaagactggggattcgagggtatcgttgtttccgactactttgcggtgaacatgctcggagaataccacaggatagcgaaagacaaatctgaatctgcaagactcgccctcgaagcgggaatagacgttgaacttccaaagacagactgttatcagcaccttaaggatctcgtcgaaaagggaattgtgcccgaatcgctgatcgacgaggccgtttccagggtactgaaactcaagttcatgctcggtctcttcgagaatccgtacgtcgatgtggaaaaggcaaagatagaaagccacagagaccttgccctcgaaatcgcaagaaaatccatcatcctcctcaaaaacgacggaacgctgcccctccagaaaaacaaaaaagtcgctctgataggaccgaacgcgggtgaggtgaggaaccttcttggcgactacatgtaccttgcccacataagggcactcctcgacaacatagacgatgtctttggaaatccgcagattccaagggaaaactacgaaagattgaaaaagagtatagaagagcacatgaagagcattccaagcgttctcgatgccttcaaagaagagggtattgatttcgagtatgcgaagggatgcgaagtgacaggagaagacagaagcgggttcaaagaagcgatcgaagttgcaaaaagatcagacgttgccatcgttgtggtcggagacagatccggcctcaccctcgactgcacaacgggtgaatccagagacatggcaaacctgaaactccccggcgtacaggaagaactcgtcctcgaaattgcaaaaacaggaaaacctgtcgttcttgtcctcatcacaggaagaccctactcactcaaaaacctggtcgacagggtgaacgctattcttcaggtgtggctccctggagaggcaggtggaagagcgatcgtcgatgtcatctacggaaaggtgaatccctctggaaagctcccgatcagtttcccaaggagtgcaggccagatccccgtctttcactacgtcaaaccctctggaggaaggtctcactggcatggagactatgtggacgagagcacaaagcccctctttcccttcggacacggcctgtcctacacgaggtttgagtacagcaacctgaggatagagccgaaggaggtaccatctgcaggagaggttgtgataaaggtcgatgtagaaaacgtgggagatatggatggtgacgaggtggttcagctttacatcggtcgtgagtttgcaagtgtcacaaggcctgtgaaggagttgaaggggttcaagagggtttctttgaaggcaaaagagaagaagacggttgtgttcagacttcacacggatgttctcgcatattacgacagggacatgaagcttgttgtggaacccggtgagttcagggtgatggtgggtagttcctctgaggacatcagactcaccggttctttctccgtcaccggaagcaaaagagaagtcgtaggaaagagaaagtttttcacagaggtctacgaggagtga

SEQ ID NO: 508 - protein, 821 aa, Thermotoga neapolitana
MGAALCERILGRQQGSGQSHHQKPVAEGNQKIHMGTRRMRRESYGTVQDPSQPVEVRVKDLLSRMTLEEKIAQLGSVWGYELIDERGKFKREKAKDLLKNGIGQITRPGGSTNLEPQEAAELVNEIQRFLVEETRLGIPAMIHEECLTGYMGLGGTNFPQAIAMASTWDPDLIEKMTAAIREDMRKLGAHQGLAPVLDVARDPRWGRTEETFGESPYLVARMGVSYVKGLQGENIKEGVVATVKHFAGYSASEGGKNWAPTNIPEREFREVFLFPFEAAVKEARVLSVMNSYSEIDGVPCAANRRLLTDILRKDWGFEGIVVSDYFAVNMLGEYHRIAKDKSESARLALEAGIDVELPKTDCYQHLKDLVEKGIVPESLIDEAVSRVLKLKFMLGLFENPYVDVEKAKIESHRDLALEIARKSIILLKNDGTLPLQKNKKVALIGPNAGEVRNLLGDYMYLAHIRALLDNIDDVFGNPQIPRENYERLKKSIEEHMKSIPSVLDAFKEEGIDFEYAKGCEVTGEDRSGFKEAIEVAKRSDVAIVVVGDRSGLTLDCTTGESRDMANLKLPGVQEELVLEIAKTGKPVVLVLITGRPYSLKNLVDRVNAILQVWLPGEAGGRAIVDVIYGKVNPSGKLPISFPRSAGQIPVFHYVKPSGGRSHWHGDYVDESTKPLFPFGHGLSYTRFEYSNLRIEPKEVPSAGEVVIKVDVENVGDMDGDEVVQLYIGREFASVTRPVKELKGFKRVSLKAKEKKTVVFRLHTDVLAYYDRDMKLVVEPGEFRVMVGSSSEDIRLTGSFSVTGSKREVVGKRKFFTEVYEE

SEQ ID NO: 509 - DNA, 2001 bp, Thermotoga neapolitana
atgagaaaacttgtgttctcatttttgattgtgacattgcccatcgtcctctttgcaaacagtgatttcgtgaaagtggaaaacggcaggttcatactgaacggagaagagttcagattcgttggaagcaacaactactacatgcactacaagagcaatcgaatgatagacagtgtccttgaaagtgcaaaagccatgggggtgaaggtgctcagaatttggggattcctcgatggtgagagttactgccgtgacaagaacacctacatgcaccccgcaccgggagtatttggattgccagagggtacgaacgctcaggacggttttgaaagactcgactacacggtagcgaaagcaaaagaactgggcataaagctcataatcgttcttgtgaacaactgggacgacttcggtggaatgaatcaatacgtgagatggtttgggggcatccatcacgatgacttctacaggaacgagaagatcaaagaagaatacaaaaagtacgtgtctttcctcataaacagggtgaacacctacacgggtgttccttacagggaagagcccaccatcatggcatgggaactggcgaacgagcccaggtgtgaaacggacaagtctggtaacacactcgttgaatgggtagaggagatgagtgcttacataaagagtctggatccaaaccacctggttgccgtgggagacgagggattcttcaacaactacgaaggcttcagaccttacggtggagaggctgagtgggcctacaacggatggtccggtgttgactggaagagacttctggagatagagacggtggattttggtacgttccatctctacccctcccactggggtgtgagccctgaaaactacgcacagtggggggcaaagtggatagaagatcacataaagatcgcaaaagaggttggaaaacccgtcgttctggaagagtacggtattcccaaaagtgccccggtcaacagggttgccatttacaaattgtggaacgatctggtctacaacctcggtggaaacggtgccatgttctggatgctcgcaggaatcggtgaaggatgggacagagacgaaaagggttactaccccgattacgacggcttcagaatagtgaacgatgaaagtgaagaggcaaagttgatcagagagtacgcgaaactgttcagcacgggtgaggatacgagggaagatacctgcatgttcatcacaccaaaggatggtcaggagatcaaaaagactgtgaaggtgagagtgggtgtcttcgactacagcaacacgttcaaaggaatttccgtcggggttgaaaatctgctctttgaagatgagataaaacatctcggatatggagtttacggattcgaatttgacacaacgcggatttcagacggagaacacgagatgttccttgaggcacatttcaggggagaaacggtgaaagacacaatcagggtgaaagttgtgaacagagcgcagtatgtactcgcagaagaagtggatttttccagacccgaagaagtcaagaactggtggaacagcggaacatggcaggctgagttcaaaacacccgatatagagtggaacggtgaggtggggaacggtgctctccagatgaacgtggtgcttcccggaaagggtgactgggaagaggtgagggtggtcaggaaattcgatcaactccccgtgtgtgagatcctcgagtacgatatctacataccagacgttgaagggcttacaggaaggctcagaccgtacgcggtgctgaatcccggctgggtgaagatagggctcgacatgaacaacacctcgattgacagcggagaacttgtcagtttcgatggcaaaaagtacagaaagttccatgtgaggatcgagttcgacaagacacctggagtgaacgagctccacataggtgtagttggagaccacctggagtatgatgggccgattttcatcgataatgtgaggctctataaaaaatcttcttga

SEQ ID NO: 510 - protein, 666 aa, Thermotoga neapolitana
MRKLVFSFLIVTLPIVLFANSDFVKVENGRFILNGEEFRFVGSNNYYMHYKSNRMIDSVLESAKAMGVKVLRIWGFLDGESYCRDKNTYMHPAPGVFGLPEGTNAQDGFERLDYTVAKAKELGIKLIIVLVNNWDDFGGMNQYVRWFGGIHHDDFYRNEKIKEEYKKYVSFLINRVNTYTGVPYREEPTIMAWELANEPRCETDKSGNTLVEWVEEMSAYIKSLDPNHLVAVGDEGFFNNYEGFRPYGGEAEWAYNGWSGVDWKRLLEIETVDFGTFHLYPSHWGVSPENYAQWGAKWIEDHIKIAKEVGKPVVLEEYGIPKSAPVNRVAIYKLWNDLVYNLGGNGAMFWMLAGIGEGWDRDEKGYYPDYDGFRIVNDESEEAKLIREYAKLFSTGEDTREDTCMFITPKDGQEIKKTVKVRVGVFDYSNTFKGISVGVENLLFEDEIKHLGYGVYGFEFDTTRISDGEHEMFLEAHFRGETVKDTIRVKVVNRAQYVLAEEVDFSRPEEVKNWWNSGTWQAEFKTPDIEWNGEVGNGALQMNVVLPGKGDWEEVRVVRKFDQLPVCEILEYDIYIPDVEGLTGRLRPYAVLNPGWVKIGLDMNNTSIDSGELVSFDGKKYRKFHVRIEFDKTPGVNELHIGVVGDHLEYDGPIFIDNVRLYKKSS

SEQ ID NO: 511 - DNA, 2043 bp, Thermotoga maritima
atggggattggtggcgacgactcctggagcccgtcagtatcggcggaattccttttattgatcgttgagctctctttcgttctctttgcaagtgacgagttcgtgaaagtggaaaacggaaaattcgctctgaacggaaaagaattcagattcattggaagcaacaactactacatgcactacaagagcaacggaatgatagacagtgttctggagagtgccagagacatgggtataaaggtcctcagaatctggggtttcctcgacggggagagttactgcagagacaagaacacctacatgcatcctgagcccggtgttttcggggtgccagaaggaatatcgaacgcccagagcggtttcgaaagactcgactacacagttgcgaaagcgaaagaactcggtataaaacttgtcattgttcttgtgaacaactgggacgacttcggtggaatgaaccagtacgtgaggtggtttggaggaacccatcacgacgatttctacagagatgagaagatcaaagaagagtacaaaaagtacgtctcctttctcgtaaaccatgtcaatacctacacgggagttccttacagggaagagcccaccatcatggcctgggagcttgcaaacgaaccgcgctgtgagacggacaaatcggggaacacgctcgttgagtgggtgaaggagatgagctcctacataaagagtctggatcccaaccacctcgtggctgtgggggacgaaggattcttcagcaactacgaaggattcaaaccttacggtggagaagccgagtgggcctacaacggctggtccggtgttgactggaagaagctcctttcgatagagacggtggacttcggcacgttccacctctatccgtcccactggggtgtcagtccagagaactatgcccagtggggagcgaagtggatagaagaccacataaagatcgcaaaagagatcggaaaacccgttgttctggaagaatatggaattccaaagagtgcgccagttaacagaacggccatctacagactctggaacgatctggtctacgatctcggtggagatggagcgatgttctggatgctcgcgggaatcggggaaggttcggacagagacgagagagggtactatccggactacgacggtttcagaatagtgaacgacgacagtccagaagcggaactgataagagaatacgcgaagctgttcaacacaggtgaagacataagagaagacacctgctctttcatccttccaaaagacggcatggagatcaaaaagaccgtggaagtgagggctggtgttttcgactacagcaacacgtttgaaaagttgtctgtcaaagtcgaagatctggtttttgaaaatgagatagagcatctcggatacggaatttacggctttgatctcgacacaacccggatcccggatggagaacatgaaatgttccttgaaggccactttcagggaaaaacggtgaaagactctatcaaagcgaaagtggtgaacgaagcacggtacgtgctcgcagaggaagttgatttttcctctccagaagaggtgaaaaactggtggaacagcggaacctggcaggcagagttcgggtcacctgacattgaatggaacggtgaggtgggaaatggagcactgcagctgaacgtgaaactgcccggaaagagcgactgggaagaagtgagagtagcaaggaagttcgaaagactctcagaatgtgagatcctcgagtacgacatctacattccaaacgtcgagggactcaagggaaggttgaggccgtacgcggttctgaaccccggctgggtgaagataggcctcgacatgaacaacgcgaacgtggaaagtgcggagatcatcactttcggcggaaaagagtacagaagattccatgtaagaattgagttcgacagaacagcgggggtgaaagaacttcacataggagttgtcggtgatcatctgaggtacgatggaccgattttcatcgataatgtgagactttataaaagaacaggaggtatgtga

SEQ ID NO: 512 - protein, 680 aa, Thermotoga maritima
MGIGGDDSWSPSVSAEFLLLIVELSFVLFASDEFVKVENGKFALNGKEFRFIGSNNYYMHYKSNGMIDSVLESARDMGIKVLRIWGFLDGESYCRDKNTYMHPEPGVFGVPEGISNAQSGFERLDYTVAKAKELGIKLVIVLVNNWDDFGGMNQYVRWFGGTHHDDFYRDEKIKEEYKKYVSFLVNHVNTYTGVPYREEPTIMAWELANEPRCETDKSGNTLVEWVKEMSSYIKSLDPNHLVAVGDEGFFSNYEGFKPYGGEAEWAYNGWSGVDWKKLLSIETVDFGTFHLYPSHWGVSPENYAQWGAKWIEDHIKIAKEIGKPVVLEEYGIPKSAPVNRTAIYRLWNDLVYDLGGDGAMFWMLAGIGEGSDRDERGYYPDYDGFRIVNDDSPEAELIREYAKLFNTGEDIREDTCSFILPKDGMEIKKTVEVRAGVFDYSNTFEKLSVKVEDLVFENEIEHLGYGIYGFDLDTTRIPDGEHEMFLEGHFQGKTVKDSIKAKVVNEARYVLAEEVDFSSPEEVKNWWNSGTWQAEFGSPDIEWNGEVGNGALQLNVKLPGKSDWEEVRVARKFERLSECEILEYDIYIPNVEGLKGRLRPYAVLNPGWVKIGLDMNNANVESAEIITFGGKEYRRFHVRIEFDRTAGVKELHIGVVGDHLRYDGPIFIDNVRLYKRTGGM

SEQ ID NO: 513 - DNA, 3650 bp, THERMOBIFIDA FUSCA
gcgggggatgggcatcctgttcgtcacccacgacttggcgctgggcaactacatcagcgaccagacggtcatcctctacaagggtgagatcgtggagcgcggggtcaccgagaaggtgttcagcgatccgcgccacccctacacgaagaagctgttcgcctcggtgccgcagttccacaagaagtgggaggaggtcgaggccgagctccgtgccaaggaggccgccgatacctccacgcatccctaccaccttgaggagggccaggaggtccccagcgagctggtgcaggtctccgaggggcactacgtgcagcctttccaccgtcgggccgcggtgtagtccctagttcgccgtcgagccggccagcggctggctgagagtcgctgaccggctcttcggcgtgcctgaaaacgggagaacggcttttattggcaatttactgaaccgcttaattttcctctcagcctcttgacactgaaccggtttactagtctcatggggaacgcggcggaacaccgacgaccgtcgtaagagtcgggtgcgacccggcaccgggttacgccccctccctcctccaggcgcccgggtcgcacccttgaagtgcaacaccgcttcacctgtggagacgccatggcagtgcgcatcgaactgcgcgagaactgggtcctccgtgcggacgatcccgccgaggttccagtggagatcggccctgcggggataccggcgaccgtgccgggatgcgtgcacaccgacctcatggcggcgaacctcattcccgacccttaccaaggtcgcaacgagaccgagctcggctggatcggccgcacccagtggagctacacgaccaccttcgacgccaccgcactggctgaggcagaacggatcgacctggaatgcgccggactggacaccgtggccacggtgttcctcaacggtacggaagtcggccagagccgcaatatgcaccgctcctaccgtttcgacctgcgccgggcgctccgagacggcactaacgaactgagggtcgagttcgcctccccctacagctacgccacggcgctccgcgacaagctcggggaccggcccaacgcctaccccgagccgttccagttcatccgcaagatggcctgcaacttcggctgggactggggccccaccctcgtcacctcggggatctggcggccgatccacgtgcacgcgtggcacacggcccgcctagcccaggtcgtccccctgatcaccgtggcccgcacccacgacggcagcctggagggccgcgtcctggtgcgggtggaggtggagcggagcgagcacggggaggacaccgagctggtcgtgcgcgtccggatcgccgaccgggagcagtcaatcgccgtccccgccggggtgtgccgtaccgaactggaggtcaccgtccccgaccccgacctctggtggccccgcggctacggtgaccagccgctctacgacctgcgcgtcgatctggccgctcacggggaggaactggacacctggcagcgccggatcgggttccgcacggtcgagctcgacaccggtgtcgacgaggacggccgccggttcaccatcgtcgtcaacggggtgcccgtcctcgtcaagggcgccaactggattcccgacgactgttttgtgagccgggtggggcgcgaccgctacgccgcgcggatcgaccaggcggtcgcggccaacatgaacctgctgcgggtgtggggcggcggccgctacgagagcgaggacttctacgagctgtgcgacgagcgcggcatcctcgtctggcaggacttcctgttcgcctgcgccgcctaccccgaggagccgccgatcactgaagaggtcgaggccgaggcccgcgaagtggtggcccggctcgccccctaccccagcctggtgctgtggaacggcaacaacgagaacatctggggctactgggactggggctggaaggaggagctggcgggccggagctggggcgaaggctactacctggagctgctgccgcggatcgtcgccgaggtcgaccctacgcgcccctactggccgggcagcccgtactccggggtgccggacatccaccccaacgacccgcggtacgcctccatccacatctgggacgtgtggaacgaggtggactacaccgcctaccgcaactaccggccccggttcgtggccgagttcgggttccaggccccgcccacctacgccacgctgcgctccgccctgcccggagaggagctgcgaccggattcgccgggcatgctgcaccaccagaaggcggtcgacggcaacggcaagctcgcccgcggcctggccccgcacttcggcaaccctgccgacttcgacgactggcactatctgacccaggtcaaccaggcgcgcgcgattactctgggcatcgagcacttccgcgcccagtggccccggtgcacggggagcgtggtctggcagctcaacgactgctggccggtgacgtcgtggtcggctgtggacggcgaaggccggcgcaaaccgctgtggtacgccctgcgggcggtctacgccgagcggctggccacggtgcagcctgacggcgacggcctggtcctcgtcgtggcaaacgacagcaaccgggagtggaccgggaccgcgcacctggcccggcgggccttggacggcacggtgctggccgcggccgatgccccgttcactgtgcctgcccgcggcgccgtccgggtgccgctgcccgccgaggtggcgcgccccggggatgcgacccgggaattgattaccgcggacacgggggcacgccgagcgtactggttcttcgctgaggaccgcgagatcgcctatccggcgccggagtacgacacccgtgtcgtgccgcgtggcgcggacctgtgcgtgaccgtgacggcgcggagcctgctgcgcgacctctccctgttcgcggaccgcctcgatccgggggccgaggcggatgacatgctggtcaccctcctgccgggagagtcgcacacgttcacggtgcgcggcggtgcccacctcgaccctgcccaggtggtccagccgcccgtgctgcgcaccgtcaacgacgcgctgcgcgccgcgcaggacagcatcccggtctgaccagcccagactccggttccggatggggtgagaaagcgggctttccgggaccggacggcggtacgtggtggggcaagcaccgcgtgccgccacccatgctggcccggcgggtgaggggttcgcctcacccgccggactcggcgaggacggcgtacaccacgagggagtcggagtagtggccgctagccgggtcgaagtccccggcgcaggtcaccaggcgcagctccgggcggtcgctcggcccgtagacctggtcggtggggaagtcttccttgggcacctgttcgacccggtccaccacgaacacgggctgggagccgtcggcgcgcgccacgtggacgaggtcgtcgggacgtagttcgttgaggcgggcgaagaccgacggcccgctccgggtgtcgaggtgcccggtgagcacggcgggcccggcttcgcccggggaggcaccgagcgcgtaccagccgaccaggttggggtcgtccagcggcgggtcttccagcgtgccgtcggggttgagccccagttc

SEQ ID NO: 514 - protein, 840 aa, THERMOBIFIDA FUSCA
MQHRFTCGDAMAVRIELRENWVLRADDPAEVPVEIGPAGIPATVPGCVHTDLMAANLIPDPYQGRNETELGWIGRTQWSYTTTFDATALAEAERIDLECAGLDTVATVFLNGTEVGQSRNMHRSYRFDLRRALRDGTNELRVEFASPYSYATALRDKLGDRPNAYPEPFQFIRKMACNFGWDWGPTLVTSGIWRPIHVHAWHTARLAQVVPLITVARTHDGSLEGRVLVRVEVERSEHGEDTELVVRVRIADREQSIAVPAGVCRTELEVTVPDPDLWWPRGYGDQPLYDLRVDLAAHGEELDTWQRRIGFRTVELDTGVDEDGRRFTIVVNGVPVLVKGANWIPDDCFVSRVGRDRYAARIDQAVAANMNLLRVWGGGRYESEDFYELCDERGILVWQDFLFACAAYPEEPPITEEVEAEAREVVARLAPYPSLVLWNGNNENIWGYWDWGWKEELAGRSWGEGYYLELLPRIVAEVDPTRPYWPGSPYSGVPDIHPNDPRYASIHIWDVWNEVDYTAYRNYRPRFVAEFGFQAPPTYATLRSALPGEELRPDSPGMLHHQKAVDGNGKLARGLAPHFGNPADFDDWHYLTQVNQARAITLGIEHFRAQWPRCTGSVVWQLNDCWPVTSWSAVDGEGRRKPLWYALRAVYAERLATVQPDGDGLVLVVANDSNREWTGTAHLARRALDGTVLAAADAPFTVPARGAVRVPLPAEVARPGDATRELITADTGARRAYWFFAEDREIAYPAPEYDTRVVPRGADLCVTVTARSLLRDLSLFADRLDPGAEADDMLVTLLPGESHTFTVRGGAHLDPAQVVQPPVLRTVNDALRAAQDSIPV

SEQ ID NO: 515 - DNA, 2055 bp, Thermotoga maritima; identical to SEQ ID NO: 466

SEQ ID NO: 516 - protein, 684 aa, Thermotoga maritima; identical to SEQ ID NO: 467

SEQ ID NO: 517 - DNA, 1533 bp, Pyrococcus furiosus
atgttccctgaaaagttcctttggggtgtggcacaatcgggttttcagtttgaaatgggggataaactcaggaggaatattgacactaacactgattggtggcactgggtaagggataagacaaatatagagaaaggcctcgttagtggagatcttcccgaggaggggattaacaattacgagctttatgagaaggaccatgagattgcaagaaagctgggtcttaatgcttacagaataggcatagagtggagcagaatattcccatggccaacgacatttattgatgttgattatagctataatgaatcatataaccttatagaagatgtaaagatcaccaaggacactttggaggagttagatgagatcgccaacaagagggaggtggcctactataggtcagtcataaacagcctgaggagcaaggggtttaaggttatagttaatctaaatcacttcacccttccatattggttgcatgatcccattgaggctagggagagggcgttaactaataagaggaacggctgggttaacccaagaacagttatagagtttgcaaagtatgccgcttacatagcctataagtttggagatatagtggatatgtggagcacgtttaatgagcctatggtggttgttgagcttggctacctagccccctactctggcttccctccaggggttctaaatccagaggccgcaaagctggcgatacttcacatgataaatgcacatgctttagcttataggcagataaagaagtttgacactgagaaagctgataaggattctaaagagcctgcagaagttggtataatttacaacaacattggagttgcttatcccaaggatccgaacgattccaaggatgttaaggcagcagaaaacgacaacttcttccactcagggctgttcttcgaggccatacacaaaggaaaacttaatatagagtttgacggtgaaacgtttatagatgccccctatctaaagggcaatgactggataggggttaattactacacaagggaagtagttacgtatcaggaaccaatgtttccttcaatcccgctgatcacctttaagggagttcaaggatatggctatgcctgcagacctggaactctgtcaaaggatgacagacccgtcagcgacataggatgggaactctatccagaggggatgtacgattcaatagttgaagctcacaagtacggcgttccagtttacgtgacggagaacggaatagcggattcaaaggacatcctaagaccttactacatagcgagccacataaagatgatagagaaggcctttgaggatgggtatgaagttaagggctacttccactgggcattaactgacaacttcgagtgggctctcgggtttagaatgcgctttggcctctacgaagtcaacctaattacaaaggagagaattcccagggagaagagcgtgtcgatattcagagagatagtagccaataatggtgttacgaaaaagattgaagaggaattgctgaggggatga

SEQ ID NO: 518 - protein, 510 aa, Pyrococcus furiosus
MFPEKFLWGVAQSGFQFEMGDKLRRNIDTNTDWWHWVRDKTNIEKGLVSGDLPEEGINNYELYEKDHEIARKLGLNAYRIGIEWSRIFPWPTTFIDVDYSYNESYNLIEDVKITKDTLEELDEIANKREVAYYRSVINSLRSKGFKVIVNLNHFTLPYWLHDPIEARERALTNKRNGWVNPRTVIEFAKYAAYIAYKFGDIVDMWSTFNEPMVVVELGYLAPYSGFPPGVLNPEAAKLAILHMINAHALAYRQIKKFDTEKADKDSKEPAEVGIIYNNIGVAYPKDPNDSKDVKAAENDNFFHSGLFFEAIHKGKLNIEFDGETFIDAPYLKGNDWIGVNYYTREVVTYQEPMFPSIPLITFKGVQGYGYACRPGTLSKDDRPVSDIGWELYPEGMYDSIVEAHKYGVPVYVTENGIADSKDILRPYYIASHIKMIEKAFEDGYEVKGYFHWALTDNFEWALGFRMRFGLYEVNLITKERIPREKSVSIFREIVANNGVTKKIEEELLRG

SEQ ID NO: 519 - DNA, 3690 bp, Aspergillus aculeatus
ctgcagccatgcgtgcgcttcccacaacagccaccacgctgttgggcgtattattcttcccctcagcgagcagaagccaatatgttcgtgacctgggtactgaacaatggacgctcagcagtgccacgttgaaccgtacggtgccggcccagtttccatctcaggtacatatggatctcttgcgggagggaataattggtaagatgatgagctctttcattcgccaaatagtctctgggctgtgatttgctgatgatatccaatgtttacagatgaaccgtaagaatcgaccctgcaccctgctttgatgatcccctacttttttttagaagggatactgcatatttttcagcggtcttctctaacaggactctgcacaggtataatgatttgaatgatttcaatctgaggtggattgcggatgccaattggacgtataccagcgggaaaattgaaggcttgtgagtgatttccctccagtaccgtggtgatatacatttgggtttgttttttggggggtaagtaatttgacctggctaatttggatctttggttgttatagaggagaggactatgaatccacgtggctggtgttcgacgggctggacacgttcgcctcgatctcgttctgcgggcaattcgtcggggcgacggataatcagtttcgacagtacatgttcgatgtctcttccattcttaaagcctgcccggaggaaccgactttgggtattcagtttggcagtgcgccgaatattgtggatgccattgcacaggacccgagctcgccgagttagtggtgccttttgttttccataaagattgttttgatgtgggatgcagagctaatgatggtttagcatggcccgagggagtccaaatcacctacgagtatcctaaccggtggttcatgcgcaaggaacagtcggatttcggctgggactggggtccggcatttgcgccggctggaccctggaagcccggatacgtggttcagttgaaacaggcggccccggtgtatgtccgcaacacggatctggatatctaccggctgggtcagatcaattatcttccgcctgatcagacccagccgtgggtggtgaacgccagtctggactatctgggctctctgccagagaacccgtctatggcgatagaggtgaaggatctacagtccggagagattcttgcttcacggccactgacgaacatcactgtcaccgagggctcggtcacgggcgtcacggttctggagggagtagacccgaagttgtggtggccgcagggtctgggtgatcagaacctctataatgtgaccatttcggttaccgatggggggaatcagtctgtcgctgaagtcacgaagcgaactggtttccgcacgatcttcctcaatcagcgcaatatcaccgacgctcagctagcgcaagggatcgctcccggggcgaattggcacttcgaagtcaatggacatgagttctatgccaagggatcgaacctgattccaccagactgcttctggactcgagttaccgaggacacgatgactcgactgttcgatgcagtcgtggctggcaaccagaacatgctccgcgtctggtcctctggagcttaccttcacgactatatctacgacctggcggacgagaagggaattcttctgtgcagtgaattccagttcagcgacgcgctgtaccctacagatgacgctttcttggagaacgtcgctgcggaggtggtttacaacgtccgacgagtcaaccaccacccatctctggccttgtgggccggtggcaacgagatcgaatctctgatgctgctgcttgtcgaagcggccgatccagagtcgtaccctttctacgtgggcgagtacgagaagatgtacatcagtcttttcctgccgctcgtctacgagaacacgcggtccatctcttactcccctagcagcaccactgagggctacctggacatcgacctctccgcacccgtccccatggctgagcgctacagcaacaccacggagggcgaatactacggcgacacagaccattacaactacgacgcgagcatcgccttcgactacggcacctacccggtgggccgattcgccaacgagttcggcttccacagcatgcccagcttgcagacctggcagcaagccctcacggacccggccgacctgaccttcaacagcagcgtcgtcatgctccgcaaccaccactaccccgccggcgggctcatgaccgacaactaccacaacacggtcgctcggcatgggcgaaatgacccagggcgtgctggcctactacccgacgcccaacattccgtccgaccccgtggccaacttcagcgcctggtgccacgcgacccagctcttccaggcggacctctacaagtcacaaatccagttctaccggcggggcagcgggctgcccgaacgccagctagggtccctgtactggcagctcgaggacatctggcaggcgccctcgtgggcggggatcgagtacggcggccgctggaaggtcctcactacgtggcgcgcgacatctacaagcccgtgatcgtttcgccgttctggaactacaccaccggcgccctggacatctacgtcacctcggacctgtggacggcggccgcggggagcgtcaccctcacctggcgcgatctgtcgggcaagcccatcgcgtcgaacggcggcctccccaccaagccgctccccttccacgtcggcgccctcaactccacgcgtctgtatcggatgaacatgaagcagcagcccctgccgcggcacgaggatgccatcctggcacttgagctgaccgccacggggtcattgccgaacaccgacgaggaagttaccttcacccatgagcagtggttcacgcccgcgttcccgaaggatttggatctggttaatctccgggtcagggttgagtatgatgcgccgttgggaaagttcgcggtcgaggcgacggccggggtggcgctgtatacttggttggagcacccggagggggtggtggggtacttcgaggagaattcgtttgtggtggtgccgggccagaagaaggtcgtggggtttgtggtgcaggcggatgagacggacggggagtgggtgcatgatgtgacggtcaggagtctgtgggatctgaatgagggagaatgagggaggcgaggggatttttcgcggggatgggatctagtagtcgattgtgtagtgtatagaattgaataaatgacatggttatgtgtgtgagaatactctttgtggatggatattgtactttctcagccaagcctgcacagctttgagcttaaacataagctggaccctgctattagagtccaaagataactatacacgccagtttgaagcgccaggttatggatctgttcatgtcctacctgactgaactcgcctggatagagggatatgtacagctctataccaacaaccagaacccaatataattcactatgcaccacacagtccgctcccctcccctcaatacccgaaaaataagagacaacgagaagcggagcgcggggatgcaaagcgagtaatatgcgaacatggcccttcttatgtactgtacaaggaccgtcacttccacaacaccagcaagtgatgattacaccagttgctcactgctactctcgtcagtgggcagttccggcccatggctgcag

SEQ ID NO: 520 - protein, 937 aa, Aspergillus aculeatus
MRALPTTATTLLGVLFFPSASRSQYVRDLGTEQWTLSSATLNRTVPAQFPSQVHMDLLREGIIDEPYNDLNDFNLRWIADANWTYTSGKIEGLGEDYESTWLVFDGLDTFASISFCGQFVGATDNQFRQYMFDVSSILKACPEEPTLGIQFGSAPNIVDAIAQDPSSPTWPEGVQITYEYPNRWFMRKEQSDFGWDWGPAFAPAGPWKPGYVVQLKQAAPVYVRNTDLDIYRLGQINYLPPDQTQPWVVNASLDYLGSLPENPSMAIEVKDLQSGEILASRPLTNITVTEGSVTGVTVLEGVDPKLWWPQGLGDQNLYNVTISVTDGGNQSVAEVTKRTGFRTIFLNQRNITDAQLAQGIAPGANWHFEVNGHEFYAKGSNLIPPDCFWTRVTEDTMTRLFDAVVAGNQNMLRVWSSGAYLHDYIYDLADEKGILLCSEFQFSDALYPTDDAFLENVAAEVVYNVRRVNHHPSLALWAGGNEIESLMLLLVEAADPESYPFYVGEYEKMYISLFLPLVYENTRSISYSPSSTTEGYLDIDLSAPVPMAERYSNTTEGEYYGDTDHYNYDASIAFDYGTYPVGRFANEFGFHSMPSLQTWQQALTDPADLTFNSSVVMLRNHHYPAGGLMTDNYHNTVARHGRNDPGRAGLLPDAQHSVRPRGQLQRLVPRDPALPGGPLQVTNPVLPAGQRAARTPARVPVLAARGHLAGALVGGDRVRRPLEGPHYVARDIYKPVIVSPFWNYTTGALDIYVTSDLWTAAAGSVTLTWRDLSGKPIASNGGLPTKPLPFHVGALNSTRLYRMNMKQQPLPRHEDAILALELTATGSLPNTDEEVTFTHEQWFTPAFPKDLDLVNLRVRVEYDAPLGKFAVEATAGVALYTWLEHPEGVVGYFEENSFVVVPGQKKVVGFVVQADETDGEWVHDVTVRSLWDLNEGE

SEQ ID NO: 521 - DNA, 1788 bp, Bacteroides fragilis
atgaagacaatcctactctttgctctgagtctgttgctctctttatccgtgtcggatgtttgtgcacaagagcgtgtttatgacatttcccagtttggcttgaaagctaatagtaagaaaaatgcgtctcctgtggttcgtaaggccatagcgaagattaaagctgaatgccgtgatggggaaaaagtgatacttcgttttcctgccggacgttacaattttcatgaagcgggttctaccgtgcgtgaatattatatttccaatcacgaccaggacaatcctaaaaaagtggggattgccttggaggatatgaaaaacctgactattgacgggcagggttccgaatttgtgttttatggaagaatgattccggtttctttgcttcgttcggagaattgtgtattgaaaaactttagcattgattttgaacaaccccatattgctcaagtacaagtggtagagaatgatccggaaaaaggaatcacgttcgaacctgcaccatgggtcgattaccgcatcagtaaggattcggtattcgaagggctgggtgaaggctgggtgatgagatattcatggggcattgctttcgatggcaaaacgaaacatgtggtatataataccagtgatatcggttgtcctaccaagggagcttttgaagtggctccccgccggatttgctctccaaagtggaaagatgcacgtctggtgcccggcacagtggtggctatgcgtggatggggacgtccgactccgggcattttcatgtcgcatgatgtgaatacttccttgctggatgtcaaagtacattatgccgaaggtatgggattgctggcacagctttgcgaagatattacgcttgatggttttggagtctgcctgaaaggcgataatgatccgcgctattttacaacgcaggcagatgctacacacttttccggatgtaagggaaagattgtctcaaagaatggtttgtatgaaggaatgatggatgatgccattaatgtacatggtacgtatttgaaagtcatcaagcgtgtggatgatcatacgctgataggacgttatatgcacgatcaatcctggggctttgaatggggacgtccgggtgacgatgttcagtttgtacgttcggaaacaatggagttgattggcaagcagaatcagattactgccattcgtccgtatgataagggtgagatacgaggtgcccgtgagttcagcattacttttaaagaggcaatcgatcctgctattaacgaaaaaagtggctttggtattgaaaacctgacgtggacccctgaagtgttatttgccggtaatacgattcgtaataaccgtgctcgcggtacactattcagtactcctaaaaagacggtggtggaggacaatttgtttgaccatacttccggtacggctatattgctgtgtggcgattgcaatggctggtttgagacaggtgcttgccgtgatgtcaccattcgtcgcaatcgttttatcaatgcgcttactaatatgttccagtttaccaatgcagtaatctctatctatccggaaatacctaatctgaaagatcagcaaaagtacttccatggtggtaaagatggaggtatcgtgattgaggataatgaattcgatacgtttgatgcaccgattctttatgcaaaatctgtagatgggttgatattccgtaacaatgtgatcaaaaccaatacagagtttaagcccttccactggaataaagatcgattcttgttggaacgagtgacaaacgtgaagatttcagagtga

SEQ ID NO: 522 - protein, 595 aa, Bacteroides fragilis
MKTILLFALSLLLSLSVSDVCAQERVYDISQFGLKANSKKNASPVVRKAIAKIKAECRDGEKVILRFPAGRYNFHEAGSTVREYYISNHDQDNPKKVGIALEDMKNLTIDGQGSEFVFYGRMIPVSLLRSENCVLKNFSIDFEQPHIAQVQVVENDPEKGITFEPAPWVDYRISKDSVFEGLGEGWVMRYSWGIAFDGKTKHVVYNTSDIGCPTKGAFEVAPRRICSPKWKDARLVPGTVVAMRGWGRPTPGIFMSHDVNTSLLDVKVHYAEGMGLLAQLCEDITLDGFGVCLKGDNDPRYFTTQADATHFSGCKGKIVSKNGLYEGMMDDAINVHGTYLKVIKRVDDHTLIGRYMHDQSWGFEWGRPGDDVQFVRSETMELIGKQNQITAIRPYDKGEIRGAREFSITFKEAIDPAINEKSGFGIENLTWTPEVLFAGNTIRNNRARGTLFSTPKKTVVEDNLFDHTSGTAILLCGDCNGWFETGACRDVTIRRNRFINALTNMFQFTNAVISIYPEIPNLKDQQKYFHGGKDGGIVIEDNEFDTFDAPILYAKSVDGLIFRNNVIKTNTEFKPFHWNKDRFLLERVTNVKISE

SEQ ID NO: 523 - DNA, 1818 bp, Bacteroides fragilis
atgaaaaagtatctgcacatcctacccgcctgctttttattttacgctgccgcccatgcacagcagaaagatactgtctacgtcaccgacttcggagcagtcccctactcgtacgagaactgtgttacacaaatacaggctgccatcgacgaatgtaaacgcacgggagccaaagtgctatcgctgcccgaaggccgctatgacatctggcccgaaggagccatccgcaaagaatactacatatcgaatacatccaccgaacaggaatgtccctcaaaagtaaagaccgtgggactgatgctccatgaaatcgatgacctgaccatcgaaggaaacggagccaccctgatgtatcatgggaaaatgacgaccatcgccctggaacattgcaacggggtgagaataaacaacctgcacatcgactttgaacgtcctgcaggatctgagattcaataccggaaagtgaccggaggagaaactgaagtaaccctgcaccgcgatacgcgttatgagattgtgaacggaaagatccggctgtatggcgagggatggcgttccaacaggaatcactgcatcgagtacgacccggatacggaatctttcacctacagccaggggtggaatacactgtcggcatccgatgccagagagattgctccgggcatcgtccgcttcaataccccggcggaatttatgcccaaagcaggaaacacactgaccgtccgcgatattatccgcgaccaggtggggcttttcattcttgaaagcaaaaacatcacgctgagcaggctacagatgcactacatgcacgggttgggcatcgtcagccagtataccgaaaacataacgatggacagagtcaagtgtgctccccgccccgatagcggcaggttattggcagcctcagcggatatgatgcacttttcgggatgtaaaggaaaagtaatcatagacagttgttattttgccggagcacaagacgatccggtcaatgtgcacggaaccaacctgcgcgcccttgagaaaatagatgcgcaaaccctgaagttacgcttcatgcacggacagagctatggattcaacgcttacttcaagggagataccgtcgcctttgtccgggcagccaccatggaacgctttgcctcggcaacggtcagggacgtaaggcgaatatcggacagaatagtggaagtacgtttcgaccgggacattccgacaagcctggagctcaatcacgattgcgtagagaacatgacctgtacccccgaagtggaaatacgtaactgctacttcacacgaaccagtacaagaggaactctggtcaccactccaagaaaggtggtgatagagaacaatacgtattacaagacgggcatgagcgccatactgattgaggccgacgccgaaggctggtacgaatcgggaccggtcaaagatgtattgatcaaaggcaatacctttatagactgtgcctataatggaggccccggccatgctgtgatcgccatacatccttccaacaaaatcatcgatgccgaacgcccggtacaccagaacatccgcatagaggataacacgttcagaacattcgactacccggtgctctacgccaagagtacggcaggactcttgttcaggaacaacaccatcgtccgcacggaaacttttcctgccgtatccggcaatccgtacgttttctatctgaacggctgcaagaaggcagtgatagaaggcaccgtattcgaaggagagactccccggcagagtataaaaacagagaatatgaaaagaaaagacctgaaaacaacgatcaaataa

SEQ ID NO: 524 - protein, 605 aa, Bacteroides fragilis
MKKYLHILPACFLFYAAAHAQQKDTVYVTDFGAVPYSYENCVTQIQAAIDECKRTGAKVLSLPEGRYDIWPEGAIRKEYYISNTSTEQECPSKVKTVGLMLHEIDDLTIEGNGATLMYHGKMTTIALEHCNGVRINNLHIDFERPAGSEIQYRKVTGGETEVTLHRDTRYEIVNGKIRLYGEGWRSNRNHCIEYDPDTESFTYSQGWNTLSASDAREIAPGIVRFNTPAEFMPKAGNTLTVRDIIRDQVGLFILESKNITLSRLQMHYMHGLGIVSQYTENITMDRVKCAPRPDSGRLLAASADMMHFSGCKGKVIIDSCYFAGAQDDPVNVHGTNLRALEKIDAQTLKLRFMHGQSYGFNAYFKGDTVAFVRAATMERFASATVRDVRRISDRIVEVRFDRDIPTSLELNHDCVENMTCTPEVEIRNCYFTRTSTRGTLVTTPRKVVIENNTYYKTGMSAILIEADAEGWYESGPVKDVLIKGNTFIDCAYNGGPGHAVIAIHPSNKIIDAERPVHQNIRIEDNTFRTFDYPVLYAKSTAGLLFRNNTIVRTETFPAVSGNPYVFYLNGCKKAVIEGTVFEGETPRQSIKTENMKRKDLKTTIK

SEQ ID NO: 525 - DNA, 1221 bp, Aspergillus fumigatus
atgtaccaccgcagtgcattcggcctcgttctcgccagcatattattgctcaatccagtcgctggcaaaccgcctctaggccaaaccccccaaatgggctggaattcatggaacaccttcaagtcccagatcaacagttcggtaatcgagaacaccgtccagctgttcgagcacctcggcctcaaagacgtgggctacgagtatatcctcctggatgagggatggtccgattactcgcgcaccgcagacggataccttcagcccaacctgacctcgttcccgaacggcatcaagccgcttatagacgataaccacgcaaaggagctgaagattggtttgtatggcgatagcgggatcctaacctgcggctttcggcccggaagctggagctacgaggagcgggatgcgcagacgctcgcccgctggggcgtggattactggaagtatgacaactgcggcggattccaggccatgactgagccgccgcaggtgcgctttgggatcatgcaaaaggcgctggagctgtctgggcggcagatcttctactcggtctgtgaatggggctatcagtttccgtggcactggggagggaagatcggccattcctatcgcatgtcgggcgacatcaccgccaaattcaccaacgagaccggctgcgcctgcaagaccgcctactgcctcaacaccgggtatgcgggctgctcggtgctgagcatcatccgcaagatgcgcgagatcagccagtaccagaccccggggcactggctggacatggacatgctggagattggtaacggtgagatgacgctgtaccagcagcagacccattttgcgttttgggcggcgctcaagtctccgctgattattggggccgatttgtcgaagctgtcggacgagagcgtggcagttctgaagaataaggacattattgcggtcaaccaggactcgctgggccaggcggtgcattatatcgagtctgcgagcaaagagggagcatggcaagtctgggcgggcccggtgaacggtggattcgtggttcttctgttgaatgagaagagctatccccaggctctgtcggtctcgtttgcggatctgagattgggccttgatgggcccgtccaggtcaccgaactgtggtctcacaagtcattggggaaggtggatggttataaaggcgtactgcagccctatcagacgctggtgtttagactacgcttttag

SEQ ID NO: 526 - protein, 406 aa, Aspergillus fumigatus
MYHRSAFGLVLASILLLNPVAGKPPLGQTPQMGWNSWNTFKSQINSSVIENTVQLFEHLGLKDVGYEYILLDEGWSDYSRTADGYLQPNLTSFPNGIKPLIDDNHAKELKIGLYGDSGILTCGFRPGSWSYEERDAQTLARWGVDYWKYDNCGGFQAMTEPPQVRFGIMQKALELSGRQIFYSVCEWGYQFPWHWGGKIGHSYRMSGDITAKFTNETGCACKTAYCLNTGYAGCSVLSIIRKMREISQYQTPGHWLDMDMLEIGNGEMTLYQQQTHFAFWAALKSPLIIGADLSKLSDESVAVLKNKDIIAVNQDSLGQAVHYIESASKEGAWQVWAGPVNGGFVVLLLNEKSYPQALSVSFADLRLGLDGPVQVTELWSHKSLGKVDGYKGVLQPYQTLVFRLRF

SEQ ID NO: 527 - DNA, 1281 bp, Aspergillus fumigatus
atgagcaggtctaaaactcgacagggaaaactacccgctctaggctggaacacgtggaatgcgttcggctgcgacattgatgcgaccaagatcatgactgccgcgaacgaggtcgtcaatctgggtctgaaggatctaggatatgagtatatcaatatcgatgattgctggtctgtcaaaagcggacgagacgcgagcacgcagcgaatcatcccggaccctgacaagttccctgatggtatctctggcgtagcggaccagatacatgatctggggctgaaaattggaatctatagcagtgccgggctcacgacctgcgccgggtaccctgccagtctgggatacgaagacatcgatgctcagacgttcgcggaatggggcatagattacctgaagtacgacaactgcggcgtcccctcaaactggacagacacgtacacatactgcgtccccgacccgggcagtaaagccacaaacgggacctgtcccgataacaagaatcccgcgccggcgggttatgactggcgcacgtcgttgacagcggagcggtacaggcggatgcgcgatgcgttggtcagcgtcgaccgcacaatcctgtactcgctatgtgaatggggccaagcgaatgtgaacgactggggcaacgagacaggcaattcctggcgaacgactggggatatcacgccatcctggcctcgtatcgccgccatcgccaatgaaaactccttcctgatgaaccatgttgatttctggggttatccggacccggacatgctggaggtcggcaacggcaatctcacactagcagagaaccgagcgcactttgcgctctgggcggcaatgaagtcgcccttgatcattgggactgctctcgactccattagccaggaccacctcgctatcctctctaacaagattctcctaaagttccaccaggacccggtgatcggccgtcctgcgcagccatacaaatgggggtacaatcctgactggacgtttgaccccgctcatcccgcagagtactggtccggcgcatcgtcagtgctgggtggcacgctggtgctgatgctgaattcggaagatacgacgcagaggcgaacggctgtgtggaaggaggtccctgagctgaaagatgtgctcggtagacagggaaaacggcgcattggatttcgtgtgacggatgtgtggaccgggaaggatctgggttgcgtgagagatcattacagtgtggaattagagagtcatgatgtggccgcgttagttgttgggagagcgtgctag

SEQ ID NO: 528 - protein, 426 aa, Aspergillus fumigatus
MSRSKTRQGKLPALGWNTWNAFGCDIDATKIMTAANEVVNLGLKDLGYEYINIDDCWSVKSGRDASTQRIIPDPDKFPDGISGVADQIHDLGLKIGIYSSAGLTTCAGYPASLGYEDIDAQTFAEWGIDYLKYDNCGVPSNWTDTYTYCVPDPGSKATNGTCPDNKNPAPAGYDWRTSLTAERYRRMRDALVSVDRTILYSLCEWGQANVNDWGNETGNSWRTTGDITPSWPRIAAIANENSFLMNHVDFWGYPDPDMLEVGNGNLTLAENRAHFALWAAMKSPLIIGTALDSISQDHLAILSNKILLKFHQDPVIGRPAQPYKWGYNPDWTFDPAHPAEYWSGASSVLGGTLVLMLNSEDTTQRRTAVWKEVPELKDVLGRQGKRRIGFRVTDVWTGKDLGCVRDHYSVELESHDVAALVVGRAC

SEQ ID NO: 529 - DNA, 2958 bp, Aspergillus niger
atggtgaagttgacgcatctccttgccagagcatggcttgtccctctggcttatggagcgagccagtcactcttatccaccactgccccttcgcagccgcagtttaccattcctgcttccgcagatgtcggtgcgcagctgattgccaacatcgatgatcctcaggctgccgacgcgcagtcggtttgtccgggctacaaggcttcaaaagtgcagcacaattcacgtggattcactgccagtcttcagctcgcgggcaggccatgtaacgtatacggcacagatgttgagtccttgacactgtctgtggagtaccaggattcggatcgactgaatattcagattctccccactcatgttgactccacaaacgcttcttggtactttctttcggaaaacctggtccccagacccaaggcttccctcaatgcatctgtatcccagagcgacctttttgtgtcatggtcaaatgagccgtcgttcaatttcaaggtgatccgaaaggctacaggcgacgcgcttttcagtacagaaggcactgtgctcgtatatgagaatcagttcatcgaatttgtgaccgcgctccctgaagaatataacttgtatggccttggggagcatatcacgcaattccgcctccagagaaatgctaatctgaccatatatccttcggatgatggaacacctattgaccaaaacctctacggccaacatcccttctatctggatacaagatattacaaaggagataggcagaatgggtcttatattcccgtcaaaagcagcgaggctgatgcctcgcaagattatatctccctctctcatggcgtgtttctgaggaactctcatggacttgagatactcctccggtctcaaaaattgatctggcggaccctaggtggaggaatcgatctcaccttctactcaggccccgccccggccgatgttaccaggcaatatcttaccagcactgtgggattaccggccatgcagcaatacaacactcttggattccaccaatgtcgttggggctacaacaactggtcggatctggcggacgttgttgcgaactttgagaagtttgagatcccgttggaatatatctggaccgatattgactacatgcacggatatcgcaactttgacaacgatcaacatcgcttttcctacagtgagggcgatgaatttctcagcaagctacatgagagtggacgctactatgtacccattgttgatgcggcgctctacattcctaatcccgaaaatgcctctgatgcatacgctacgtatgacagaggagctgcggacgacgtcttcctcaagaatcccgatggtagcctctatattggagccgtttggccaggatatacagtcttccccgattggcatcatcccaaggcagttgacttctgggctaacgagcttgttatctggtcgaagaaagtggcgttcgatggtgtgtggtacgacatgtctgaagtttcatccttctgtgtcgggagctgtggcacaggtaacctgactctgaacccggcacacccatcgtttcttctccccggtgagcctggtgatatcatatatgattacccagaggctttcaatatcaccaacgctacagaggcggcgtcagcttcggcgggagcttccagtcaggctgcagcaaccgcgaccaccacgtcgacttcggtatcatatctgcggacaacgcccacgcctggtgtccgcaatgttgagcacccaccctatgtgatcaaccatgaccaagaaggccatgatctcagtgtccatgcggtgtcgccgaatgcaacgcatgttgatggtgttgaggagtatgatgtgcacggtctctacggacatcaaggattgaacgctacctaccaaggtctgcttgaggtctggtctcataagcggcggccatttattattggccgctcaaccttcgctggctctggcaaatgggcaggccactggggcggcgacaactattccaaatggtggtccatgtactactccatctcgcaagccctctccttctcacttttcggcattccgatgtttggtgcggacacctgtgggtttaacggaaactccgatgaggagctctgcaaccgatggatgcaactgtccgcattcttcccattctaccgaaaccacaatgagctctccacaatcccacaggagccttatcggtgggcttctgttattgaagcaaccaagtccgccatgagaattcggtacgccatcctaccttacttttatacgttgtttgacctggcccacaccacgggctccactgtaatgcgcgcactttcctgggaattccctaatgacccaacattggctgcggttgagactcaattcatggttgggccggccatcatggtggtcccggtattggagcctctggtcaatacggtcaagggcgtattcccaggagttggacatggcgaagtgtggtacgattggtacacccaggctgcagttgatgcgaagcccggggtcaacacgaccatttcggcaccattgggccacatcccagtttatgtacgaggtggaaacatcttgccgatgcaagagccggcattgaccactcgtgaagcccggcaaaccccgtgggctttgctagctgcactaggaagcaatggaaccgcgtcggggcagctctatctcgatgatggagagagcatctaccccaatgccaccctccatgtggacttcacggcatcgcggtcaagcctgcgctcgtcggctcaaggaagatggaaagagaggaacccgcttgctaatgtgacggtgctcggagtgaacaaggagccctctgcggtgaccctgaatggacaggccgtatttcccgggtctgtcacgtacaattctacgtcccaggttctctttgttggggggctgcaaaacttgacgaagggcggcgcatgggcggaaaactgggtattggaatggtag

SEQ ID NO: 530 - protein, 985 aa, Aspergillus niger
MVKLTHLLARAWLVPLAYGASQSLLSTTAPSQPQFTIPASADVGAQLIANIDDPQAADAQSVCPGYKASKVQHNSRGFTASLQLAGRPCNVYGTDVESLTLSVEYQDSDRLNIQILPTHVDSTNASWYFLSENLVPRPKASLNASVSQSDLFVSWSNEPSFNFKVIRKATGDALFSTEGTVLVYENQFIEFVTALPEEYNLYGLGEHITQFRLQRNANLTIYPSDDGTPIDQNLYGQHPFYLDTRYYKGDRQNGSYIPVKSSEADASQDYISLSHGVFLRNSHGLEILLRSQKLIWRTLGGGIDLTFYSGPAPADVTRQYLTSTVGLPAMQQYNTLGFHQCRWGYNNWSDLADVVANFEKFEIPLEYIWTDIDYMHGYRNFDNDQHRFSYSEGDEFLSKLHESGRYYVPIVDAALYIPNPENASDAYATYDRGAADDVFLKNPDGSLYIGAVWPGYTVFPDWHHPKAVDFWANELVIWSKKVAFDGVWYDMSEVSSFCVGSCGTGNLTLNPAHPSFLLPGEPGDIIYDYPEAFNITNATEAASASAGASSQAAATATTTSTSVSYLRTTPTPGVRNVEHPPYVINHDQEGHDLSVHAVSPNATHVDGVEEYDVHGLYGHQGLNATYQGLLEVWSHKRRPFIIGRSTFAGSGKWAGHWGGDNYSKWWSMYYSISQALSFSLFGIPMFGADTCGFNGNSDEELCNRWMQLSAFFPFYRNHNELSTIPQEPYRWASVIEATKSAMRIRYAILPYFYTLFDLAHTTGSTVMRALSWEFPNDPTLAAVETQFMVGPAIMVVPVLEPLVNTVKGVFPGVGHGEVWYDWYTQAAVDAKPGVNTTISAPLGHIPVYVRGGNILPMQEPALTTREARQTPWALLAALGSNGTASGQLYLDDGESIYPNATLHVDFTASRSSLRSSAQGRWKERNPLANVTVLGVNKEPSAVTLNGQAVFPGSVTYNSTSQVLFVGGLQNLTKGGAWAENWVLEW

SEQ ID NO: 531 - DNA, 1614 bp, Aspergillus niger
atgaaccaaggaaccaagagtatactactggctgccacgctagcagccatcccctggcaagtctacggctccatcgagcagtccagcctcctgccaataccacccatgggtttcaacaattgggcccgcttcatgtgcgacctcaacgagaccctgtttaccgagactgccgatgcgatggctgctaacggtctgcgggacgcaggctacaatcgcatcaatctggatgattgctggatggcttatcagcgatccgacaatggatccctacagtggaacacgactaagttcccacacggcctgccttggctagctcaatatgtcaaagccaaagggtttcattttggaatctatgaagattctggcaacatgacttgtggcggataccccggatcctacaaccacgaggagcaggacgccaacacctttgctttatgggggattgactatctcaagctcgacggttgcaatgtctacgcaacacaaggtaggacactcgaggaggaatacaagcaacgctacggacattggcaccaagtcctcagcaagatgcagcacccactgatcttctccgagtcagccccggcatacttcgcgggcacagacaacaacacagactggtacaccgtgatggactgggtcccgatctacggggagctggcccgccattctaccgatatcctggtgtacagtggagcaggtagcgcatgggacagcattatgaataactacaactacaacactcttcttgcgcgctaccagcgaccggggtatttcaatgatcctgattttctgatcccggatcatcctggcctgacggcggatgaaaagcgatcgcattttgcactgtgggcttctttctcggctccacttattatcagtgcttatatacctgcactttcgaaggatgagattgccttcttgacgaacgaggcattgattgcggtgaatcaggatcccctggcgcagcaggccacgtttgcgagccgcgataacacactggatatattgacgcgtaatctggcaaacggcgacaggctgctgacggtgcttaataagggaaacacaactgtaacgagggacattcccgtacaatggttgggtcttacagagactgactgtacatacacggccgaggatctctgggatggcaagacccagaagatcagcgaccatataaagattgaactagccagccatgcgacagcagtcttccggctcggtcttccgcagggttgttcctcggtagtgccaacgggacttgtcttcaacacagcatcgggcaattgtctgaccgctgcctcaaattcttcagtcgcatttcagtcctgcaatggagagacctctcagatctggcaggtgacactgtcaggagtcattcgtccagtatcgcagaccacacaatgcttggctgctgatggaaactcagttaagctgcaagcatgtgacagcacggatagcgacggccagaactggacgtatgcagtcacgggaaatttaaagaatgcgaagacagatggttgcctgactgagggatcagtgcagatgaagtcgtgtctttatgagagggatggccaggtatttggtctcccaagtggcgttcagttgtcgtag

SEQ ID NO: 532 - protein, 537 aa, Aspergillus niger
MNQGTKSILLAATLAAIPWQVYGSIEQSSLLPIPPMGFNNWARFMCDLNETLFTETADAMAANGLRDAGYNRINLDDCWMAYQRSDNGSLQWNTTKFPHGLPWLAQYVKAKGFHFGIYEDSGNMTCGGYPGSYNHEEQDANTFALWGIDYLKLDGCNVYATQGRTLEEEYKQRYGHWHQVLSKMQHPLIFSESAPAYFAGTDNNTDWYTVMDWVPIYGELARHSTDILVYSGAGSAWDSIMNNYNYNTLLARYQRPGYFNDPDFLIPDHPGLTADEKRSHFALWASFSAPLIISAYIPALSKDEIAFLTNEALIAVNQDPLAQQATFASRDNTLDILTRNLANGDRLLTVLNKGNTTVTRDIPVQWLGLTETDCTYTAEDLWDGKTQKISDHIKIELASHATAVFRLGLPQGCSSVVPTGLVFNTASGNCLTAASNSSVAFQSCNGETSQIWQVTLSGVIRPVSQTTQCLAADGNSVKLQACDSTDSDGQNWTYAVTGNLKNAKTDGCLTEGSVQMKSCLYERDGQVFGLPSGVQLS

SEQ ID NO: 533 - DNA, 1332 bp, Aspergillus niger
atgcggtggcttctcacctcgtccgcactgttagtgccggccgcagccctggttcgacccgatggcgtgggccgcactcctgcccttggctggaactcttggaacgcatacagctgcgacattgatgccgacaaaatcgtgactgccgccaacgaggtggtcaatctggggttgaaggacctgggatatgagtatatcaacatcgacgactgctggtccgtcaaatccggccgcaacaccaccaccaaacgcatcatccccgacccagacaaattccccaatggcatctccggcgtcgcagaccaggtgcacgctttgggattgaagctgggaatctacagcagcgccggcctcaccacctgcgccggctaccccgccagtctaggctacgaagaaatcgacgcgcaatcctttgccgaatgggggattgactacctaaaatacgacaactgcggcgtccccaccaacctcacagaccaatacacctactgcgtccccgacagcaccgacggctccaactaccccaacggcacctgcgtgaacctcacggacgccgcaccccaggggtacgactgggccacctccaccacggcgaagcggtaccagcgcatgcgcgatgccctgctcagtgtgaacaggacgatcctgtactcgctatgtgactggggccaggcggatgttaatgcctggggaaatgcaacgggaaatagttggcgcatgtcaggggatatcacggcaacctggtcccgcatcgccgaaatcgccaacgaaaacagcttcctcatgaactacgccaacttctggggctatccggacccagacatgctggaagtgggcaatgggaatctgacacttcccgagaatagagcgcattttgccctttgggcgatgatgaaggcgccgttgattattgggacgcctttggattcaatcgatacctcccacctcactatcctctccaacaaacccctgctcaccttccaccaagacgctgtgatcggtcgtcctgcgtacccgtataaatggggatataatcccgattggacgtttgatccggagcatccggcggagtattggtctgggccgacttcttctggggaggtgtttgtgttgatgttgaattcggagggggaggtcaagactcgctcggcggtttgggaggaggtgcctgagttgaaggacagaggtacgaagaagaattcgaaggagaagaaggggtttaaggtgacggatgcgtggacgggcaaggacctggggtgtgtcaaggataagtatgaggttaagttgcaggcgcatgatgtcgcggttttggtggtgggagggcaatgttag

SEQ ID NO: 534 - protein, 443 aa, Aspergillus niger
MRWLLTSSALLVPAAALVRPDGVGRTPALGWNSWNAYSCDIDADKIVTAANEVVNLGLKDLGYEYINIDDCWSVKSGRNTTTKRIIPDPDKFPNGISGVADQVHALGLKLGIYSSAGLTTCAGYPASLGYEEIDAQSFAEWGIDYLKYDNCGVPTNLTDQYTYCVPDSTDGSNYPNGTCVNLTDAAPQGYDWATSTTAKRYQRMRDALLSVNRTILYSLCDWGQADVNAWGNATGNSWRMSGDITATWSRIAEIANENSFLMNYANFWGYPDPDMLEVGNGNLTLPENRAHFALWAMMKAPLIIGTPLDSIDTSHLTILSNKPLLTFHQDAVIGRPAYPYKWGYNPDWTFDPEHPAEYWSGPTSSGEVFVLMLNSEGEVKTRSAVWEEVPELKDRGTKKNSKEKKGFKVTDAWTGKDLGCVKDKYEVKLQAHDVAVLVVGGQC

SEQ ID NO: 535 - DNA, 1848 bp, Bacteroides thetaiotaomicron
atgagaacattcctatcattaaagacatgcttactatctgcacttttactttgcgtaaacagcattgcagcaagcaagattatttccgtatctgatttcggtttgaaacccgacagccgtatcaacgcagttccatttatacaaaaggcaatcgatgcttgcaagcaacatcccggttccacgcttgttttcccaaaaggaagatatgacttctgggcacaacatgctatcgaaaaagattattacgaaacgaacacctacgatgttaatcccaaaattctcgccgtgctattggagcagatcaatgatctgacgattgacggtaatggttctgagtttattatgcatggacggatgcaaccattcactttggatcattgccggaacattactttaaagaatttctccgtcgattgggaaatcccattaactgcgcaaggtattgtcactcaatctacctccgaataccttgagatcgaaatcgactcccaccaatatccttatatcatagaaaacaaacgactgacttttgtcggcgaaggatggaaaagcagtctttgggcgatcatgcagtttgatcccgacacccatctcgtcctgccaaatacaggtgataacttaggctggcgctcatacgatgcaacagaaataaaccccggattaatacgcttatccgatcctaaaaaggaggctgataaattcttccctgcgccgggtacggtccttgtgttacgacacagcaccagagatcacgccggtatcttcatttaccacagtatggatacaaagctagagaacgtaaagctattccatacctgcggactgggaattctgtcacaatatagcaagaatatctctttcaatgatgtacatatcatccctaacacttccaagaaacgtgtgctgagcggacatgacgacggtttccacttcatgggatgcagcggattactcaagattgagaactgtagttgggcaggattgatggatgaccctattaacatccatggaacatgttcccgtattatggaagttctttctcctacccgtatcaaatgcaagttcatgcaagacatgagtgaagggatggaatggggacgcccagacgaaacaatcggatttatagagcataaaaccatgcgtaccgtagctaccggtaaaatgaataaatttgaagcactgaataaagctgaatttatcatcgaattatcagtaccacttccagccggagtggaagccggatatgtaatagagaatctgacctgcacacctgatgcagaaatacgcaactgccatttcggaagttgccgggcacgtggtctgcttgtatctactcccggcaaggttattatcgagaacaatgtattcgaatccagcggctctgccattctgattgccggagacgcaaacgcatggtatgaatcaggagctgtcaaagatgtgctgatacgcaacaatgatttccgttacccttgcaattcttcaatttatcaattctgtgaagctgtgattagcattgacccggaaataccgacaccggaacagaagtacccctatcatcgcaatatccgcattatggataataccttccacctatttgattatccgatactcttcgcacgttcggtaaacgggctcaccttctcctccaatacactcatacgtgatacgacttaccagccttatcactatcgcaaagaaggtattacgctggaagcatgtaaatctgtagttatttcaaacaataagattgaaggggatgtattaggacgtattgttacaattgaaaagatgaaaccttcggatgtcaagattagcaagaatcctttctttaaactgaaaaaataa

SEQ ID NO: 536 - protein, 615 aa, Bacteroides thetaiotaomicron
MRTFLSLKTCLLSALLLCVNSIAASKIISVSDFGLKPDSRINAVPFIQKAIDACKQHPGSTLVFPKGRYDFWAQHAIEKDYYETNTYDVNPKILAVLLEQINDLTIDGNGSEFIMHGRMQPFTLDHCRNITLKNFSVDWEIPLTAQGIVTQSTSEYLEIEIDSHQYPYIIENKRLTFVGEGWKSSLWAIMQFDPDTHLVLPNTGDNLGWRSYDATEINPGLIRLSDPKKEADKFFPAPGTVLVLRHSTRDHAGIFIYHSMDTKLENVKLFHTCGLGILSQYSKNISFNDVHIIPNTSKKRVLSGHDDGFHFMGCSGLLKIENCSWAGLMDDPINIHGTCSRIMEVLSPTRIKCKFMQDMSEGMEWGRPDETIGFIEHKTMRTVATGKMNKFEALNKAEFIIELSVPLPAGVEAGYVIENLTCTPDAEIRNCHFGSCRARGLLVSTPGKVIIENNVFESSGSAILIAGDANAWYESGAVKDVLIRNNDFRYPCNSSIYQFCEAVISIDPEIPTPEQKYPYHRNIRIMDNTFHLFDYPILFARSVNGLTFSSNTLIRDTTYQPYHYRKEGITLEACKSVVISNNKIEGDVLGRIVTIEKMKPSDVKISKNPFFKLKK

SEQ ID NO: 537 - DNA, 1707 bp, Bacteroides thetaiotaomicron
atgatgagcgtttggttcatccagttggctatttttgcccagtctagaataatagaggtttttccggagcagggaaaagatattgaaaatatagcgttagctttaaaaaaagctgctgactgtaaaggaaggccggttactgtaaagttttcaccgggaatttatcagttagaccgtgcgaaatcatcacaagtgttatattatatatcaaatacgacttctgagttggatgatcctgatccgactaaacatatcggattgtatcttaatacattaaagaatatcactattgatggttgtgggtcaactttattgatgaatggtgaaatgacaagtttcgtacttgataaatgtgaaggtattgttttgaaaaattttaatatagattataaacatcctactcaaacagaggttgaagtattggaagaggggaatgattatttgattgttcaggtacatcccacatcccaatatcggattgtagacgcacagttggagtggtatggtgatggttggtcttttaagaacggaatagcgcagtcgtatgaccgtataagtgaaatgacttggcgttcttggagtccgatggagaatttgcttcgtacagtagaacttcgtccaaatgtgttatatctgcaatataaagaaaaaccacaagtaggactacatactatttttcagatgcgcgattctttccgtgacgaagtgagtggatttgtaaacagaagtaagggaatactgttggagaatatcaacttctattatttaggaaatttcggggtagtctgtcaatacagtgagaatattactgttgatcgttgtaactttgctcctcgtccaggttcaggacgtactaatgcgggatttgctgattttattcaggtttctggttgccgtggtatgattgatattaagaattcccgttttataggtgcacacgatgatcctataaatatacatggtacacatttgcgagtaatagaatttttgtcggacaatcgtttaaaacttcgttttatgcatgaccagacttttggatttgaagccttttttaaaggagacgatatagaacttgttgattcacgttctctgttggtagtagggaagtgtaaagtaaaagaggcaaaattagtaacgccaagagaaatggaactcactctgtcaagtccactctcttcggaggtaatgcaacagaaagacctggttattgagaacgtgacgtggacaccggaagtgcggattacaaacaattactttgcaagagtaccaaccagagggattcttatcacaacacgacgtaagtctctgatagaaggaaatacattctacggcatgcagatgagtggaatatttgtagccgatgatggattaagctggtatgagtcaggaccggtacatgacttgactattcgtcaaaatacgtttttaaactgtggagaaccgattattagcattgatccggagaatagagaatataaaggggcggttcataaaaatattactattgaagaaaattatttttatatgagaaaaaatagctcatgtgccattcgagcgaaggctgttgatggtctgatgatacgtcataatttgatttattctctagatactgaaaaaaataaagagtctgattttattcagatgtataattgtaatgaagttacaataaaagaaaatcgggtacagttgcaccacctatttaaataa

SEQ ID NO: 538 - protein, 568 aa, Bacteroides thetaiotaomicron
MMSVWFIQLAIFAQSRIIEVFPEQGKDIENIALALKKAADCKGRPVTVKFSPGIYQLDRAKSSQVLYYISNTTSELDDPDPTKHIGLYLNTLKNITIDGCGSTLLMNGEMTSFVLDKCEGIVLKNFNIDYKHPTQTEVEVLEEGNDYLIVQVHPTSQYRIVDAQLEWYGDGWSFKNGIAQSYDRISEMTWRSWSPMENLLRTVELRPNVLYLQYKEKPQVGLHTIFQMRDSFRDEVSGFVNRSKGILLENINFYYLGNFGVVCQYSENITVDRCNFAPRPGSGRTNAGFADFIQVSGCRGMIDIKNSRFIGAHDDPINIHGTHLRVIEFLSDNRLKLRFMHDQTFGFEAFFKGDDIELVDSRSLLVVGKCKVKEAKLVTPREMELTLSSPLSSEVMQQKDLVIENVTWTPEVRITNNYFARVPTRGILITTRRKSLIEGNTFYGMQMSGIFVADDGLSWYESGPVHDLTIRQNTFLNCGEPIISIDPENREYKGAVHKNITIEENYFYMRKNSSCAIRAKAVDGLMIRHNLIYSLDTEKNKESDFIQMYNCNEVTIKENRVQLHHLFK

SEQ ID NO: 539 - DNA, 1878 bp, Streptomyces avermitilis
atggctcacggatgctccggaggggctatgtctcggttcgtgtttcttggggtggcactcgcgttgctcggaggtgccaccagtcctgccgccgcggcgccgagggtgacgccggtggtggtcgacgtggacgactacggagccgaccccaccggccggacggactcgacgcccgctgtcgccgcggcgctgcggcacgccaagagcgtcgaccggccggtcaggatcgtcttctccaagggcacctaccagctgtaccccgagcgggccgagacgcgtgagctgtatatgtccaacaccgtcggcgccgaccagcgttaccgggacaagaagatcgggctgctcgtcgaggacatgcacgacgtcaccgtcgacggcggcggggccaagctcgtccaccacggtcttcagacggcgttcgcgtcgatccgctcgaccgatgtgaccttccagaacttctccttcgactacgcggcccccgaggtcatcgacgcgaccgtcgccaccaccggtgtcaccgacggacacgcctaccgcgttctgaagatccccgccggcagcccgtaccgggtgaacggcacgcacatcacctggctcggcgagaccagtcccgccaccgggcagccgtactggtcgggtgtcgacgggctccagtacacacagatccacgaccccgaggcgcaacggacctggcgcggagacaaccccctgttcaacgacgtcgccgcggtcaccgacctcggcggccgccggatccggatcgactacaccaccgcggcgcggccggcggacgccgggctcgtctaccagatgcgcctcatcgagcgaacggagccgggcgctttcatctgggagtccaagaacgtcacgatgcgctcgatgaacgcctactacctacagtccttcggcgtggtggggcagttcagcgagaacatctccatcgacaaggtgaacttcgcacccgatccgaggtccggccggtcgacggcctcgttcgcggacttcgtgcagatgtccggcgtcaaggggaaggtctcgatcacccggagcctcttcgacggcccgcacgacgacccgatcaacatccacggcacctacctcgaggtcgtcgggaagccggggccgtccaccctcaccctcgcctacaagcacccgcagaccgcgggattcccacagttcgccccgggtgacgaggtcgagttcgccaccaagcgcacgatgaccccgctggcggacgcgcacgcacaggtcaccgcggtcgacgggccgagcggcatggaccacacgaaaccgctgaccacgatgaccgtcaccttcgaccggccggttcccgccggggtcgagaccggcggcacggtcgtcgagaacatcacggccaccccgtcggtcgtcatctccggcaacgtgttccgcaacgtgccgacccgcggcatcctggtcaccacccgcaagcccgtcctcatcaccggcaaccggttcgacgggatgtccatggccagcatctacgtctccgccgacgcctaccagtggtacgagtccgggccggtcgccgacctcacgatccgcgggaactccttcacgcggcccagtggtccggtcatcttcgtggagccgaccaatcaggtcatcgacccggcgaccccggtgcatcacaacatctcggtcgagcacaactcgttcgacatcggtgacgtcaccgtcgtcaacgccaagagcgtcggcgggttcgctttcaccggcaacacggtccggcggctggacggagcggatcacccgccgtacacctcaccgctgttcgtcttccacggcagttcaggcatccggatcgcacgcaaccactacgacaagggcctgaacacctccgtggtcacggactag

SEQ ID NO: 540 - protein, 625 aa, Streptomyces avermitilis
MAHGCSGGAMSRFVFLGVALALLGGATSPAAAAPRVTPVVVDVDDYGADPTGRTDSTPAVAAALRHAKSVDRPVRIVFSKGTYQLYPERAETRELYMSNTVGADQRYRDKKIGLLVEDMHDVTVDGGGAKLVHHGLQTAFASIRSTDVTFQNFSFDYAAPEVIDATVATTGVTDGHAYRVLKIPAGSPYRVNGTHITWLGETSPATGQPYWSGVDGLQYTQIHDPEAQRTWRGDNPLFNDVAAVTDLGGRRIRIDYTTAARPADAGLVYQMRLIERTEPGAFIWESKNVTMRSMNAYYLQSFGVVGQFSENISIDKVNFAPDPRSGRSTASFADFVQMSGVKGKVSITRSLFDGPHDDPINIHGTYLEVVGKPGPSTLTLAYKHPQTAGFPQFAPGDEVEFATKRTMTPLADAHAQVTAVDGPSGMDHTKPLTTMTVTFDRPVPAGVETGGTVVENITATPSVVISGNVFRNVPTRGILVTTRKPVLITGNRFDGMSMASIYVSADAYQWYESGPVADLTIRGNSFTRPSGPVIFVEPTNQVIDPATPVHHNISVEHNSFDIGDVTVVNAKSVGGFAFTGNTVRRLDGADHPPYTSPLFVFHGSSGIRIARNHYDKGLNTSVVTD

SEQ ID NO: 541 - DNA, 1347 bp, Aspergillus clavatus
atgtcgaggtttcatctcccgcttgcggcagcggtagtactggtttcttgtctctggagcgcaaatgcgctggttagaccggatggcgtgggtaaactgcccgcgctgggctggaactcctggaacgcatttggctgcgacatcgacgacgcgaagatcatgacggcggcaaaggagattgtgaatctcggtctgaaggacttggggtatgagtacatcaacatcgatgattgctggtccgtcaagagcggacgtgacaaaaccacgaagcgcattgtcccggacccggcgaagtttcccgacggcattgcgggtgttgcggacagaatccacgatcttgggttgaaggttgggatctatagcagtgccggcttgacgacctgtgctggataccctgccagtctgggctacgaggagattgatgcccaaacctttgcggaatggggcattgactatttgaaatacgacaactgcggcgtcccctccaactggacagatgcgtatacattctgcgtccccgaccccggcagcgcctcgaccaacggcacctgccccgataacgagaacccagcgccgcaaggctacgactggagcacatccctgacagcccagcggcaccagcgtatgcgcgacgccttgctcggcgtcgagcataccatcttctactccctctgcgaatggggccaggcggatgtgagtgcctggggtaatgccacgggtaactcctggcggatgtcgggcgatatcacgccatcctgggaccgcatcgcggccatcgccaatgaaaactccttcctgctgaatcacgtcgatttctggggtcactcagacccagatatgctggaagttggtaatggggaccttactttggcggagaatagagcgcattttgcgctgtgggcggcgatgaaatcgcccttgatcatcggtactgctctcgacggcattgatcccgctcacctcgaaatactattgaataaatacctcattgcgttccatcaggaccccgtcatcggtcgtcctgcatatccctataaatggggctatagtcctgactggacgtttgacccggcccaccccgcagaatactggtccgggccatcttcgacgctggatgggacgttggtgctgatgctgaattcagaagggagcaggcagacgcgcaccgctgtgtggaaggagattccggaattgaaggacgcgcttggaagaaaggggagacggcaaacgggcttccgtgtgaccgatgtgtggacgggtaaggatttgggatgcgtgcgggatcactacactgtcaccctggaaagtcatgatgttgcagccttgcttgttggaaaaggatgctag

SEQ ID NO: 542 - protein, 448 aa, Aspergillus clavatus
MSRFHLPLAAAVVLVSCLWSANALVRPDGVGKLPALGWNSWNAFGCDIDDAKIMTAAKEIVNLGLKDLGYEYINIDDCWSVKSGRDKTTKRIVPDPAKFPDGIAGVADRIHDLGLKVGIYSSAGLTTCAGYPASLGYEEIDAQTFAEWGIDYLKYDNCGVPSNWTDAYTFCVPDPGSASTNGTCPDNENPAPQGYDWSTSLTAQRHQRMRDALLGVEHTIFYSLCEWGQADVSAWGNATGNSWRMSGDITPSWDRIAAIANENSFLLNHVDFWGHSDPDMLEVGNGDLTLAENRAHFALWAAMKSPLIIGTALDGIDPAHLEILLNKYLIAFHQDPVIGRPAYPYKWGYSPDWTFDPAHPAEYWSGPSSTLDGTLVLMLNSEGSRQTRTAVWKEIPELKDALGRKGRRQTGFRVTDVWTGKDLGCVRDHYTVTLESHDVAALLVGKGC

SEQ ID NO: 543 - DNA, 6990 bp, Bifidobacterium longum
gatccaaggagattgtggcctgggacgtcagccggcaccccgacctcacccagcagcaacggctgctcgccatgctcgaggagaagctgcccgaaggcgccgatcgtatcggatttggtcgatgtgcttatggccgattcgccgctcccatccgacgctttggaaagccagttcctggccgattggaatgaatccaccaacgacgacgagcgcctgcgcgtcgccatcgatcgtaggtttcggacgtttcggccttctcgccttcgtctttgcgggcgagccggccgtcgtccaccatcgcgtcgatgatcacaatgtgagtcttgaggagttcgccgatttgcgccagtggctacttgacaacgacattacctctggcgtgctgtagtcagccgccatcactggaattggcgcggccgtcgcagcaatcggacatcgagggcgcttgtggctgactcggtcatagactgttctcccatgagcgaagtgagcactgcaagcactactgcacatactgaagagaatcatacggaaatagcaatccccaacttggctcccctcagagaagggagcaagggaaactagatgccggaatcagcgtccacttgcataacgtagatgttgcgcctcagggagcgggcttgggctcggttgatgtcgccggcttcgtacatgtcctgaatcataccgagttcgataccgtagctctcgcgctttacgtcctcgacctgcgtgatggtttccgtagtgccgctcatggtcggacgtgcctgcaatgaagcctcggcacgacgataatccagcaacagtgccgaacaatgctcggtgttgtacgtatcctggcccatctcgtcaataagccgaccgataacatgatgaatcgcctcgacctgcagttcgcgggtgcgcgcgaaaatctggtcctcgctcaccaatggtgtggtgtggcgaatcttggacaccgtgcgtttggcgtaattgctcatctgccgctggaacatgcgtacgcgaccgcgaatctgcgataccgcatgccccgaagtcggatcagtggaagtgtgacgcagcgtattcataatctggtcaagcatgcgctcgcaggcttcgacgttcagctcttgcgtggccgtatccgccgccggatgtgctttggtgtcggcaagccggtcgcgcacgaattccttttcccaatgcagcgcttcgatctgcaattgctcgaatccctggggatcggtatcgccgatgcgctgctgcaatcgcccgatgcgcttggtgtactggtcgattaccatcagaatcgcacgacgattctctggcgtgatgcgtccggtcaattcctccaccgtggcgcgtaacacatcgatggtcaccggaattatttccgcgctgggatccttgccacggttcggagccaatagcggtaacaggaagttggccagcagcaaggtcacgataatcacgcctgacgcaatgaaaatcagctcgtcacgcatcgggaacggcgcaccgccggcaatgtaatacgggatggtgaacatcaatgacagcgtgatggttcccttggggccgccaaaggtcatcactgcggccgagcgccagcgttcgggtgtcattttgcggcgctggccggagattgtatctcgcgccacgcgcagcatggccgcaatccagaagaatcgaagcgcgattaccaccagagtgaccagcagaataatgccgatcagcacggtattgctgatatacgggtcagaccagctggccctcatggcgcgcggcagctgcatgcccagaagaatgaacaccgcaccgttgagcgagaaactcagcacaccccatactgaagtggaaacgatattcgtacgtgccacattcggccccacgccggtacggtcgaatcggatgaacaggccagcggccaccaccgacagaatgccggacacattgaattcctccgcgcccaaatacagcaggaagggcaggaacagttccatcagaatacgtgtggtggtggtttcccaaccgagggatcgcacggtctcgaatagccagttggccgctgctgctatcatcaggccaaataaggtgccgccaaagaaggagatcacgaattcgccggcggcctgccccacggcgaattcgccagtgaaggcggcggccagagcgaactggaagccgacgatgccggaagcgtcattgaagagtgattcgcctttcagcacgctgcgctgacgctgcgtcagcgaggcttctttacctagggagctgacggccaccgcatcggtcgggccgagtgccgcgccgagtgctaaggctgaggctaaggtgatggacggccagacggcatgcaaagtgaatccgaccgccgccatcgtgacgatagccagtccgatagccagcgataggctcagatccagcgttttcagcaacgccgacttatcgatttcgtgcgcttccagatacagcagcggcgcgataaacagcaccatgaacagttccgggtcgagctttgcatccgggaaaaacggcagatacgtaaccagcacgcccagcacaatctggaccagcggtgtggaaaccttcggtacgaagcgactggcaaacgagctcaccaccaccgccgcaatgatgcataggatgagctcaaataccgccatgttgccgccttctcgtattttttctccaccaaaagtatatgggaaccatgaagaaaacgttaagattgcggccgattatgcacatcatgagacgatatgagaaaaaggcatacactcgttggtatggaatatgacgaggcgatgcgctgcgcactggaactggccggtcaggccgcagccgctggtgacgtaccggttggtgcggtggtgctggatgcggccggccagattgtcgggcgcggatacaacacgcgtgaggctgatggcgacccgcttgcccacgccgaaatcatcgccatgcgtcaggcggcccaagccttgggcgcttggaatctcgccgattgcacgctggccgtcacacttgagccgtgcccgatgtgcgcgggtgcctgcatccagacccatatcggcaccatcgcgttcggtgcctgggatcccaagctcggtgcatgcggttcgatttgggatattccgcgcgatccgcatatcggccatagtcctgaagtgcacggcggcgtgctggaaggcgagtgtcagtccatcctgactgatttcttcgcccagcggcgatagacacggacgcattacttacctcacgcaaccaacacgcggcaccaaggcaacatattccatttcttctaccatcgaaaccagtagtgcaatgcaaatccacacacgtcgaaggagacaatatggccgagaacacctccactttcaccggtgccgccgctgacggcaccgcactcaccgccgtctacctgacccagcccgccgccaatgtggcgatcggtctggtgtttgccggcagcgacctgccgcacatcgtccactggggccgcccgctggccaagcccgacaccctgctggccgcctatgacgccctgaagccgcagcgcgtgtccggcgcgctcgacgacaccgcctggccgtctatcctgcccacccaggccgaaagctggatcggcgagcagcgcgtggtgctgcgccgcgccggcgtcgagctcttccccaagttcaccgtgaccaatatcgaggccggcggcgtgctggaagccaccctcgatgccgtgtccggcgaaagctacaccgatgtggccggccatgcccgtgccaccggtccggtccgcgtgcccggcgtcatagtcaccgcgcgcgatgaggagcagggcgtggaagtcgaatggcacctcgaactgctccccggcggcctggtccgtcagaaggccaccgtaaccaacctgttcggtgcagacgccggagccccgctcgagatcggcaagatcgagctcggcttcccgctgcccgaatccgccggcgaaatcctcaccaccaccggtcaccatctacgtgaacgcagtccgcagcgccagccgctgaccgtcggccgtttcgaaaagccgcagctcgccggccgccctgacttcgacgcatccctgctcctgaccgccggcgtgcccggtttcggcttcgagcatggcgacgcctattcggtgcacgtgggctggagcggcaactccgtgctgtccgccgaacgtctgccctacacaaccggcgtgatcggcggcggcgaactcctgttcggcggcgaagtgacgctcgctggccctggcgaaggccagaactcctacgacaccccgtggctgttcggctcctatggcgatggtctcaacgagatcgccgcccgattccactcctacgtgcgctccctgcacccgcgcctgttctcgcacggccgtccggtgatcctcaacacatgggaagccgtgtacttcgaccacaacttcgatacgctgaaggcgctcgccgacaaggccgccgactccggcgtggaacgattcgtggtggacgacggctggttcggttcccgccgcgacgacacctccggcctcggtgactggcagattgcgcaggacgtctggcccgatggcccgaagtccctgaaggcgctcgccgactacgtgcacgccaagggtatggaattcggcttgtggttcgagccggaaatggtcaaccccgattccgatgtggcccgtaaccaccctgattggattctctcgcccaccgctggccgactgccgctgcagggccgcactcagcaggtgctcgatctgaccaatccggatgcgttcgactacatctacggctgcatggaccagcttgtcggcgagcttggtatcgactacatcaagtgggaccacaacaagctcgtcaccgagcccggttcccgccgctccggccgcccggccgtgcacgcgcagacccttgccgtctacaacatcttcaagggcctcaagaccgcacatccgggccttgagatcgaaagctgctcctctggtggcggccgcgtggatcttggcatcctggagcacgccgatcgtatctgggtctccgactgcgtggacccggtcgagcgcgcggacatccagcgctacacctcgctgctggtgccgccggcgatgatgggcgagcacgtgggcgccagccccgcacactccacccagcgcgccaccagccaggaactgcgcatggccatggcgttcttcggtcacatgggcatcgaatggaacctgttgaaggagccggacgaggcgctcgccaagctggccgtgtgggtggccgaattcaagaagcaccgcgactggttcgccatcgacacctgcgtgcacgccgactccaacgatccggccgtgcgtctggacggtatggtgatgccgaaccgtgacgccgccatctaccgcttcacccagctgaccaccagccagacctatccggccgcgcccgtgcatctgcccggacttgaccccgagcgcacctaccgtgtcagcccgcttgacccgagcttggatttgaccggtctgaccaacggccagagcactctcggctggtggaacgaggaaggcgtagtcctgaccggcgaagccctgcagcgctacggcattcgtcccccgtccctccacccccagcaggcagtattgctcaaggctgtggcgttaagctgacagcctagtaggctgtcagtagccacggcctgagcgaagcgacagctgagcgaaggtgggattgagccttgccgataggcaagtccgtaattgctggtcgtggcggagtaactgtggcgaagcaacgttcttggctcccctctctgaggggagccaagaacggcctacccaatatgcttcacaatcacgcgactggcggcggctttggcccagagctgccagtcgtggttcataatcgtgaacttgaccggctgggtctggctgtgacggtagaaacgaatgccgtcacgtagcgaatcggtgccgagcttggccaaaaacgcggactccccggcaatcatcacatgcccgggcatcgcgatattcgccaccgtagccaccagcgatcccaaccggaaacacgtccggttcaccaactgcgtggcctgcggcacgcgttccttggcatcgcgcgcaaagtcctcaaaactgaccgcgcgacccacaatcgcagagtactgttcggcgattgaatcgtcagtcaagcattgtgaacagccgatatgtccgctggtgcagcgcggcccctccggatcgataagcacgtggcccaccagaccatagctcttatccgggtactgcactggcttgccgttcacggccagcgaataaccaacacccacgccgatggtcaccacggcgaacatatccacgccgacacccggcccgaaccaggaggcatccaccagcagagaatcgatatcattgaacaccccgcacggcaggccggtcgcctctgtgaccatcgtccccaagtccgtggccccgtcccaatgcaggaacggcgcgaacgtcacaatcgaatcgtcgaccacatgcccacctaccgcaacgcccaccgcagtgggggagggtagtccggaagaggcgatatcggcggaacattcgcgcaccagccgcgtgatggccgacaccacatactcagccgactgatccgccccgatcggcacctcgtgccggccggacaccacctcgccatgcgcgttcaccgcagcggccacaatcgacatcccatgaaccttgacaccaatgaaggtgcgtgcgttcgaacacaacaccagcgaagtctgcgggcgtccgcgacgatccgaactttcccttggcgtgaatcgctcgggcagcttgcctgacgggccggcctcggccggaagctcctcgatcaccccggcgtagatcagatcgctggtgatgcgggacaaggccccttggctcagtcccagcatctgtgccaacgtagtgcgggctatcggcccgtattgggcaattgccgccgccacgcgatgcgtatgctcggatcc

SEQ ID NO: 544 - protein, 690 aa, Bifidobacterium longum
MAVFELILCIIAAVVVSSFASRFVPKVSTPLVQIVLGVLVTYLPFFPDAKLDPELFMVLFIAPLLYLEAHEIDKSALLKTLDLSLSLAIGLAIVTMAAVGFTLHAVWPSITLASALALGAALGPTDAVAVSSLGKEASLTQRQRSVLKGESLFNDASGIVGFQFALAAAFTGEFAVGQAAGEFVISFFGGTLFGLMIAAAANWLFETVRSLGWETTTTRILMELFLPFLLYLGAEEFNVSGILSVVAAGLFIRFDRTGVGPNVARTNIVSTSVWGVLSFSLNGAVFILLGMQLPRAMRASWSDPYISNTVLIGIILLVTLVVIALRFFWIAAMLRVARDTISGQRRKMTPERWRSAAVMTFGGPKGTITLSLMFTIPYYIAGGAPFPMRDELIFIASGVIIVTLLLANFLLPLLAPNRGKDPSAEIIPVTIDVLRATVEELTGRITPENRRAILMVIDQYTKRIGRLQQRIGDTDPQGFEQLQIEALHWEKEFVRDRLADTKAHPAADTATQELNVEACERMLDQIMNTLRHTSTDPTSGHAVSQIRGRVRMFQRQMSNYAKRTVSKIRHTTPLVSEDQIFARTRELQVEAIHHVIGRLIDEMGQDTYNTEHCSALLLDYRRAEASLQARPTMSGTTETITQVEDVKRESYGIELGMIQDMYEAGDINRAQARSLRRNIYVMQVDADSGI

SEQ ID NO: 545 - protein, 143 aa, Bifidobacterium longum
MRCALELAGQAAAAGDVPVGAVVLDAAGQIVGRGYNTREADGDPLAHAEIIAMRQAAQALGAWNLADCTLAVTLEPCPMCAGACIQTHIGTIAFGAWDPKLGACGSIWDIPRDPHIGHSPEVHGGVLEGECQSILTDFFAQRR

SEQ ID NO: 546 - protein, 768 aa, Bifidobacterium longum
MAENTSTFTGAAADGTALTAVYLTQPAANVAIGLVFAGSDLPHIVHWGRPLAKPDTLLAAYDALKPQRVSGALDDTAWPSILPTQAESWIGEQRVVLRRAGVELFPKFTVTNIEAGGVLEATLDAVSGESYTDVAGHARATGPVRVPGVIVTARDEEQGVEVEWHLELLPGGLVRQKATVTNLFGADAGAPLEIGKIELGFPLPESAGEILTTTGHHLRERSPQRQPLTVGRFEKPQLAGRPDFDASLLLTAGVPGFGFEHGDAYSVHVGWSGNSVLSAERLPYTTGVIGGGELLFGGEVTLAGPGEGQNSYDTPWLFGSYGDGLNEIAARFHSYVRSLHPRLFSHGRPVILNTWEAVYFDHNFDTLKALADKAADSGVERFVVDDGWFGSRRDDTSGLGDWQIAQDVWPDGPKSLKALADYVHAKGMEFGLWFEPEMVNPDSDVARNHPDWILSPTAGRLPLQGRTQQVLDLTNPDAFDYIYGCMDQLVGELGIDYIKWDHNKLVTEPGSRRSGRPAVHAQTLAVYNIFKGLKTAHPGLEIESCSSGGGRVDLGILEHADRIWVSDCVDPVERADIQRYTSLLVPPAMMGEHVGASPAHSTQRATSQELRMAMAFFGHMGIEWNLLKEPDEALAKLAVWVAEFKKHRDWFAIDTCVHADSNDPAVRLDGMVMPNRDAAIYRFTQLTTSQTYPAAPVHLPGLDPERTYRVSPLDPSLDLTGLTNGQSTLGWWNEEGVVLTGEALQRYGIRPPSLHPQQAVLLKAVALS

SEQ ID NO: 547 - protein, 390 aa, Bifidobacterium longum
GSEHTHRVAAAIAQYGPIARTTLAQMLGLSQGALSRITSDLIYAGVIEELPAEAGPSGKLPERFTPRESSDRRGRPQTSLVLCSNARTFIGVKVHGMSIVAAAVNAHGEVVSGRHEVPIGADQSAEYVVSAITRLVRECSADIASSGLPSPTAVGVAVGGHVVDDSIVTFAPFLHWDGATDLGTMVTEATGLPCGVFNDIDSLLVDASWFGPGVGVDMFAVVTIGVGVGYSLAVNGKPVQYPDKSYGLVGHVLIDPEGPRCTSGHIGCSQCLTDDSIAEQYSAIVGRAVSFEDFARDAKERVPQATQLVNRTCFRLGSLVATVANIAMPGHVMIAGESAFLAKLGTDSLRDGIRFYRHSQTQPVKFTIMNHDWQLWAKAAASRVIVKHIG

SEQ ID NO: 548 - DNA, 1344 bp, Neosartorya fischeri
atgacgacgtttctctctctgaccactgcagctgcagtgttaaccctcgctcgaggaagcaatgcgctcgttagaccgggcaatgtgggaaaactacccgccctaggctggaactcgtggaatgcgttcggctgcgacatcgatgcggccaagatcatgactgccgcgaacgaggtcgtcaatctgggtctgaaggatctaggatatgagtatatcaatatcgatgattgctggtccgtcaagagcggacgagacgcgagcacgcagcgaatggtcccggaccctgagaagttccctgatggtatctccggcctagcggaccagatacatgatctggggctgaaagttggaatctatagcagtgccgggctgacgacctgcgccggataccctgccagtctgggctacgaagatatcgatgcccagacatttgcggaatggggcattgactacctgaagtacgacaactgcggtgtcccctcgaactggacagacgcgtacacctactgcgtcccagacccgggcagtaaatccacaaacgggacctgtcccgataacaagaatcccgcgccggcgggttacgactggcgcacgtcgttgacagcggagcggtacaggcggatgcgcgatgcgttggtcagcgtcgaccgcacaatcctgtactcgctatgtaactggggtcaagcggatgtgaacgactggggcaacgagacaggcaattcctggcgaacgactggggatatcacgccatcctggccccgcatcgccgccatcgccaatgagaactccttcctgatgaactacgttgatttctggggctatccggacccggacatgctggaggtcggcaacggcaatctcacactagcagagaacagagcgcactttgcgctctgggcggcgatgaagtcgcccttgattatcgggactgctctcgactccatcagccaggaccacctcgctatcctctcaaacaagattctcctaaagttccaccaggacccggtggtgggccgtcctgcgcacccatacaaatgggggtacaatcctgactggacgtttgacccggctcatcccgcagagtactggtctggcgcatcgtcagtgctgggtggcacgctggtgctgatgctgaattcggaagatacgaagcagaggcgtacggctgtgtggaaggaaatccctgagctgaaagatgtgctcggtagacaggggaaacggcgcactggatttcgtgtgacggatgtctggaccgggaaggatttgggttgcgtgagagatcactacagtgtggaattggagagccatgatgtggctgcgctggttgtggggagggcatgctag

SEQ ID NO: 549 - protein, 447 aa, Neosartorya fischeri
MTTFLSLTTAAAVLTLARGSNALVRPGNVGKLPALGWNSWNAFGCDIDAAKIMTAANEVVNLGLKDLGYEYINIDDCWSVKSGRDASTQRMVPDPEKFPDGISGLADQIHDLGLKVGIYSSAGLTTCAGYPASLGYEDIDAQTFAEWGIDYLKYDNCGVPSNWTDAYTYCVPDPGSKSTNGTCPDNKNPAPAGYDWRTSLTAERYRRMRDALVSVDRTILYSLCNWGQADVNDWGNETGNSWRTTGDITPSWPRIAAIANENSFLMNYVDFWGYPDPDMLEVGNGNLTLAENRAHFALWAAMKSPLIIGTALDSISQDHLAILSNKILLKFHQDPVVGRPAHPYKWGYNPDWTFDPAHPAEYWSGASSVLGGTLVLMLNSEDTKQRRTAVWKEIPELKDVLGRQGKRRTGFRVTDVWTGKDLGCVRDHYSVELESHDVAALVVGRAC

SEQ ID NO: 550 - DNA, 2374 bp, Aspergillus niger; identical to SEQ ID NO: 501

SEQ ID NO: 551 - protein, 747 aa, Aspergillus niger; identical to SEQ ID NO: 502

SEQ ID NO: 552 - DNA, 2160 bp, Aspergillus niger
tctagttaccaaatgattgtggtaattgtctctcaaccccgcagttccacgtaagttcagtcaaacatcaccactacagccaatataacttgcatcaacctgcagcaacgctattcccgatgcaacacggaacatcaagtccgctaacgtgcaattgacagtgccacatcaatatcctgccatgcctgcatttctccctaatagcctagttcggatagacccaagtcccggcactattggcctcgcctgcagatcttacccggacctgcaggtgtattattgctggttccccgcacgagcagctcagctatataggtcatgttctcctcactcttttcgttcaccgtcactgctcatctgtctaaatatccattgaaagcacttgagaaaagatgcggtggcttctcacctcgtccgcactgttagtgccggccgcagccctggttcgacccgatggcgtggtatgttgcctgcattcctccaaattcaatctctcgactaacaagaagatcgttgattgtagggcctcactcctgcccttggctggaactcttggaacgcatacagctgcgacattgatgccgacaaaatcgtgactgccgccaacgaggtggtcaatctggggttgaaggacctgggatatgagtatatcaacagtatgccttctctctttcacaacaatcaaaccacattgctaattggaatagtcgacgactgctggtccgtcaaatccggccgcaacaccaccaccaaacgcatcatccccgacccagacaaattccccaatggcatctccggcgtcgcagaccaggtgcacgctttgggattgaagctgggaatctacagcagtcagtacctaccccaacatcccccacccctaagcaatcagcacactaaccaaagtaatatgaaggcgccggcctcaccacctgcgccggctaccccgccagtctaggctacgaagaaatcgacgcgcaatcctttgccgaatgggggattgactgtatgcctcccacaagtccccaataccctctaacccaagcgtgctaacgaaagtatagacctaaaatacgacaactgcggcgtccccaccaacctcacagaccaatacacctactgcgtccccgacagcaccgacggctccaactaccccaacggcacctgcgtgaacctcacggacgccgcaccccaggggtacgactgggccacctccaccacggcgaagcggtaccagcgcatgcgcgatgccctgctcagtgtgaacaggacgatcctgtactcgctatgtgactggggccaggcggatgttaatgcctggggaaatgcaacaggaaatagttggcgcatgtcaggggatatcacgggtatgctccctatgtccccttcaaccacaaagatcccatgaaaaaaagtatcttgaggatgatactaataaaaagtacatcaatacagcaacctggtcccgcatcgccgaaatcgccaacgaaaacagcttcctcatgaactacgccaacttctggggctatccggacccagacatgctggaagtgggcaatgggaatctgacacttcccgagaatagagcgcattttgccctttgggcgatgatgaaggcgccgttgattattgggacgcctgtatgtcctcttcccttatccctcccccaccttataactattcccccctttcctgtcaatgacgacgtgctaatatctaatggggggatgtagttggattcaatcgatacctcccacctcactatcctctccaacaaacccctgctcaccttccaccaagacgctgtgatcggtcgtcctgcgtacccgtataaatggggatataatcccgattggacgtttgatccggagcatccggcggagtattggtctgggccgacttcttctggggaggtgtttgtgttgatgttgaattcggagggggaggtcaagactcgctcggcggtttgggaggaggtgcctgagttgaaggacagaggtacgaagaagaattcgaaggagaagaaggggtttaaggtgacggatgcgtggacgggcaaggacctggggtgtgtcaaggataagtatgaggttaagttgcaggcgcatgatgtcgcggttttggtggtgggagggcaatgttaggaaaaagactttttctctt

SEQ ID NO: 553 - protein, 443 aa, Aspergillus niger
MRWLLTSSALLVPAAALVRPDGVGLTPALGWNSWNAYSCDIDADKIVTAANEVVNLGLKDLGYEYINIDDCWSVKSGRNTTTKRIIPDPDKFPNGISGVADQVHALGLKLGIYSSAGLTTCAGYPASLGYEEIDAQSFAEWGIDYLKYDNCGVPTNLTDQYTYCVPDSTDGSNYPNGTCVNLTDAAPQGYDWATSTTAKRYQRMRDALLSVNRTILYSLCDWGQADVNAWGNATGNSWRMSGDITATWSRIAEIANENSFLMNYANFWGYPDPDMLEVGNGNLTLPENRAHFALWAMMKAPLIIGTPLDSIDTSHLTILSNKPLLTFHQDAVIGRPAYPYKWGYNPDWTFDPEHPAEYWSGPTSSGEVFVLMLNSEGEVKTRSAVWEEVPELKDRGTKKNSKEKKGFKVTDAWTGKDLGCVKDKYEVKLQAHDVAVLVVGGQC

SEQ ID NO: 554 - DNA, 2236 bp, Lactobacillus fermentum
aggaagttcattcatgccagtctttatcaacgaagagaccaagctcttccacttacaaaccaagaacactagctacatcttccaaatcctcgctaacgaggcggcgggacaggtttattacggcgccaaggttccggttaagccttcctattccaacctaatgacgatggaagaacacgactgcaccaacaccctgtcggaagaaaacacttccttccaactcgaactggttaaacaagaatacgccacccagggtaagggggactttccgggaggccgcctacgttatccaatacccagacggctcccggaccaggaatttgaataccaggttaccaagtcgaagagggaaaaagcgcctgccggttctgcaattttgtttgacgacgaaggaacggacgccaccagcctgacgttaattttaaaggaccgcctttacgatttgaggatgaacctgcactacacgttctttaacgatgacgacgtaattgttcgctcagctagctttgaaaataagggtgacaccgtcatgatcgatcgggccctgtccgctcaacttgacttgccggacgacaattatgacctcctacaattctccgggacctgggctcgcgaacctaacttataccgcaaccacctgcggccgggaacccaaagcgtggccagtcggcggatcaaactccagccaccacgaaacccggccatcatcttagcccggcccaaacaccggataataatcagggtgaagcctttggttttaaccatagtttactccgggagtttcttagacacggttgaggttgaccagtttaacaccacccgggtcgttaccgggattcaccccgatgacttctcctggcaactagaagccggccaatccttccagaccccagaagcggttctttcctataccaacgccggcatgaacgccctcagccagcaaatgggccgcttctaccgtgaccacttaattaacccccactttgctaaggaagaccggccaatcctaatcaacaactgggaagccaccttcatggactttaccgaagaaaaactgatgaagatcgtcactaaggctaaggaaaccgggatcgaaatgtttgtcttagatgacggttggttcgggcaccgtgataacgacctgactagcctgggggactggttcgttgaccaaaagaagttcttaaacggggtcggcggctttgccagccgggtgcacaagttggggatgaagtttggcctctggtttgaaccagaaatgatctcaattgactccaagctctacgaagaccaccccgactggatgatccaaactaagggacggctagccaccccggcccgccaccaattcgtcctcgacatggcccgccaagaagtcgtcgatgacatcttcaacaagatgagcgccgtgattaaagacaccaagcttgactacatcaagtgggacatgaaccggacgatcaccgaggccttcaccgctaccctgccggctaatcgccaacaagaatttgcccaccgctacatcctcggggtttaccaactctacgaacgcctaacgcaggccttcccgagcgtcctctttgaatcctgcgcctccggtggtggccgcttcgacctcgggatgatgtactacgccccacaagcctggtgctctgacgacaccgacgccgtggaacggatctacatccaagacgggacctcctacggttacattccgtccatgtggggggcccacgtttcggccgtgccaaacgaccaggtcggccgcgtcacttccctaaacacccgggccaaggtggcctactttcggtgcctttggttacgaactggacttaaacgaactgtcagaagaagagcaggaaacgggttaaagaacaagtcgccttttacaagcagcaccgccacttcttccaacacgggaccttctaccggattgacagtccagacaccgctaccgataacgtctacgggctggcaagtggtcaatgacgaccagtccgaagccatcgccgtgcgcttccagatcctcaataaacccaacccgggttacatccgcttctactttaccggcttagacccggaaaagacctaccaagttaacgacgacgaggaaacttactccggtgcagaactgatgaacgccggttacttcgtggctcggatcatgccacgctcggcctcgccaaagccgctggccgactttaacgccaccatgtttgtggttaaggccgtctag

SEQ ID NO: 555 - protein, 740 aa, Lactobacillus fermentum
MPVFINEETKLFHLQTKNTSYIFQILANEAAGQVYYGAKVPVKPSYSNLMTMEEHDCTNTLSEENTSFQLELVKQEYATQGKGDFPGGRLRYPIPRRLPDQEFEYQVTKSKREKAPAGSAILFDDEGTDATSLTLILKDRLYDLRMNLHYTFFNDDDVIVRSASFENKGDTVMIDRALSAQLDLPDDNYDLLQFSGTWAREPNLYRNHLRPGTQSVASRRIKLQPPRNPAIILARPKHRIIIRVKPLVLTIVYSGSFLDTVEVDQFNTTRVVTGIHPDDFSWQLEAGQSFQTPEAVLSYTNAGMNALSQQMGRFYRDHLINPHFAKEDRPILINNWEATFMDFTEEKLMKIVTKAKETGIEMFVLDDGWFGHRDNDLTSLGDWFVDQKKFLNGVGGFASRVHKLGMKFGLWFEPEMISIDSKLYEDHPDWMIQTKGRLATPARHQFVLDMARQEVVDDIFNKMSAVIKDTKLDYIKWDMNRTITEAFTATLPANRQQEFAHRYILGVYQLYERLTQAFPSVLFESCASGGGRFDLGMMYYAPQAWCSDDTDAVERIYIQDGTSYGYIPSMWGAHVSAVPNDQVGRVTSLNTRAKVAYFRCLWLRTGLKRTVRRRAGNGLKNKSPFTSSTATSSNTGPSTGLTVQTPLPITSTGWQVVNDDQSEAIAVRFQILNKPNPGYIRFYFTGLDPEKTYQVNDDEETYSGAELMNAGYFVARIMPRSASPKPLADFNATMFVVKAV

SEQ ID NO: 556 - DNA, 2253 bp, Emericella nidulans
atgttccgctcaacggctacggtggccgcagccaccgccatgggcctgttgacggccaccggccatggctcattggcgattgcgcagggtacaactggttccaatgcggtcgtcgtcgacgggacgaacttcgctctcaacggagccagcatgtcctacgtcttccacgccaacagcaccaccggcgatctggtctctgaccacttcggcgcgaccatcagcggtgccattccggctccaaaggagccagccgtcaacggctgggtcgggatgcccggtcgaatccggcgcgaattccccgaccaagggcgcggcgatttccggatccccgcggtgcgcatccgtcaaacggctggatatactgtcagcgacctgcagtatcagggccatgaggtggtcgacggtaaaccggcgttgcctggcctgccggcgacattcggtgaggcgggggatgtgacgacgttggttgtacatctgtacgacaattacagtgccgtcgctgcggacctctcgtacagtgtgtttccagaatttgatgctgtggttagaagcgtcaacgttacgaataaaggaaagggcaatattactattgagaatttggcgagtctctctgtagacttcccgctcgaggacttggacctcgtcagtttgaggggtgattgggcgagagaggcgaaccgagagaggcggagagtagagtatggcattcaaggattcggaagcagcaccggctactcctcccacctgcacaaccccttcttcgccctcgtgcacccgtctacgaccgaatcccagggcgaagcatggggcttcaacctcgtctacaccggctccttctccgctcaagtcgagaagggatcccagggtttgacccgcgcgttgatcggcttcaaccccgaccaactctcctggaacttgggacccggcgagaccctgacgtcccctgaatgtgtgtctgtgtacagcaaagacggaatcggcggcatgtcgcgcaaattccaccgtctctaccgcaagcacctcatcaggagcaagttcgcgacatcggatcggccgcccctcttgaacagctgggaaggcgtttactttgacttcaaccagagcagtatcgagactcttgccgagcaatccgctgctcttggcatccgcctcttcgtcatggatgacggctggtttggggacaaatacccccgtacctccgacaatgcaggactcggcgactggacgccgaatccggatcggttccctaatggactggagccggtcgtcgaggagatcacaaatctgaccgtcaacgacacctccgctgagaaactgcgattcggtatctgggtcgagccggagatggtcaaccctaactcgagcctctaccgggagcaccccgactgggccctgcacgctggcgcctacgcacgcacggagagacgcaaccagctcgtcttgaacctggcgctccccgaagtccaagaatatatcatcgatttcatgacagacttgctcaacagcgcggacatctcctacatcaagtgggataacaaccgcggcatccacgaggccccgtctcctagtaccgaccacgagtatatgctgggtgtataccgagtctttgacaccttgacagcgcgattccccgatgtgctatgggagggatgtgcctctggtgggggccgcttcgacgcgggtgttttgcattacttcccgcaaatctggacgtcggataacaccgacggcgtggaccgagtcactatccaattcggcacgagtctggcctatccaccttccgccatgggtgcacatctctccgccgtcccgaatcaccagacgggccgcacggtgccactggagttcagagcgcacgtcgcaatgatgggcgggtcgttcggactggagttggatcccgccacacttcaggatgatccagacgtccctgaacttattcaaatggcagagaaggtgaatcctctggtcctgaacggggatctctaccgcctgcgtttgcctgaggagagccagtggccggcggcactgtttgtggctgaagatggaagccaggctgtactcttctacttccagctgtcgccaaacgtcaatcacgcagcgccctgggtcaggctccagggccttgatccggaggcgagctacactgtcgatggggataagacatatactggtgcgacccttatgaacctgggtctgcagtacacatttgatacggagtacgggagcaaagtggtcttcttagaaaggcagtga

SEQ ID NO: 557 - protein, 740 aa, Emericella nidulans
MFRSTATVAAATAMGLLTATGHGSLAIAQGTTGSNAVVVDGTNFALNGASMSYVFHANSTTGDLVSDHFGATISGAIPAPKEPAVNGWVGMPGRIRREFPDQGRGDFRIPAVRIRQTAGYTVSDLQYQGHEVVDGKPALPGLPATFGEAGDVTTLVVHLYDNYSAVAADLSYSVFPEFDAVVRSVNVTNKGKGNITIENLASLSVDFPLEDLDLVSLRGDWAREANRERRRVEYGIQGFGSSTGYSSHLHNPFFALVHPSTTESQGEAWGFNLVYTGSFSAQVEKGSQGLTRALIGFNPDQLSWNLGPGETLTSPECVSVYSKDGIGGMSRKFHRLYRKHLIRSKFATSDRPPLLNSWEGVYFDFNQSSIETLAEQSAALGIRLFVMDDGWFGDKYPRTSDNAGLGDWTPNPDRFPNGLEPVVEEITNLTVNDTSAEKLRFGIWVEPEMVNPNSSLYREHPDWALHAGAYARTERRNQLVLNLALPEVQEYIIDFMTDLLNSADISYIKWDNNRGIHEAPSPSTDHEYMLGVYRVFDTLTARFPDVLWEGCASGGGRFDAGVLHYFPQIWTSDNTDGVDRVTIQFGTSLAYPPSAMGAHLSAVPNHQTGRTVPLEFRAHVAMMGGSFGLELDPATLQDDPDVPELIQMAEKVNPLVLNGDLYRLRLPEESQWPAALFVAEDGSQAVLFYFQLSPNVNHAAPWVRLQGLDPEASYTVDGDKTYTGATLMNLGLQYTFDTEY

SEQ ID NO: 558 - DNA, 1980 bp, Emericella nidulans
atgagagccctcgttccaatggtcgttgccgccacggccctggcatccccagcgccagccctcaagccccgtctcgatgacgggctagcacgcacgcctcagatgggatggaacacctataatcaatataactgctttcccaacgagagtattgtgcacgagaacgcgcaagccctagtcgacaccggcctcgctgacctcggctaccgctatgtgactatcgattgcggctggggcgtcgaggacagattgcccaatggcacgatcacttggaacccggagctctttccgcagggcttcccagcgatgggtcaatatctgcatgatctgggtctactgttcggagtctacggcgactcgggtattctgctgtgtgggagtccgcccaacattacagggagcttgtactacgaggatatcgatgcaagaaccttcgccgaatggggagctgattcgctgaaatacgacaactgctactctgacgccgcaactaactacccaaacgtcaattacgcgccttcaacatccccgcacccccgttttgcaaacatgtctcgctacatccaagcccaagaccgggacatcctattccaagtatgcgaatggggtatcgacttccccgccctctgggccccggaaattggccactcgtggcgtatcgggaacgacattatacctcactggcgctccatcttccgcacgctcaaccaggccgttccgcaaaccgactttgccgggccaggccagtggccagatctagacatgttgcttgtcgggctcgatggagtgttgaccgtgcctgaggagcagacgcatttctcgctgtggagtatcctcaagagccccttgacgattggggctgcaatcccgggtatgagggcggaatcgttggagattctgagtaatgcagatgttattgcattcaaccaggacgctcttggtgtcagcgcggccttgagaaggaggtggagtgacgaagggtatgaggtatggagtgggcctttggaaggggggaggactattgcggcggtgatcaactggagggacgaggatagggagatcacgcttgatttgccggacattgggctgcagtacgctgagacactgcagaatgtctgggcggatgaaaccgtgaatggggtcaagacaagctacagcagtgttgtcgaggcgcacggagtgatgctggtgcagcttgctgagacggtagaggagggagtgtatccggcagatgtgtttgcggccacgaatcgtgatgtgacgacattctccgacgtctacgccatcacttcaagccctaactttgtgctcaatatcacccttaccgaagtcactgcagctgcgacaaatataactatcatcacagacagcagcaggaggccaatctcaacttctatcccagctgggtcttcctcgatatcaacatccgtcagcctaatcgccggctccaataacaccatcaccatccgcaacgctcctcccctctcttccattaccctcagtcccccagagccaacctactataccggcgcgcaagactttactctgacatccccagcaggcgcatatacctgccctgacgcatactgtcttcccgctggctccaagattgtcgatctcagcacagaaagcgccgcaacggcccacatcaactcttcaacgtcggggtccaaatacctcgaaatcgactacataaacaatgaggtcgcatttgactcttcctggggatggggtgcaaactcgcggaatctcacaatcaaagtcaatgataataacccagtcagactggaggttccgctatcgggacgccatagtgagctctttggcccaggactcgggtggtgggattctggccgacttggggttctgacagatgggtggataaagggaactaacgagcttgtgctcagcaatgaggggggcgaagggggatttacgaagtatgctcctgatgttgtgggcattgctgtgtatgattga

SEQ ID NO: 559 - protein, 659 aa, Emericella nidulans
MRALVPMVVAATALASPAPALKPRLDDGLARTPQMGWNTYNQYNCFPNESIVHENAQALVDTGLADLGYRYVTIDCGWGVEDRLPNGTITWNPELFPQGFPAMGQYLHDLGLLFGVYGDSGILLCGSPPNITGSLYYEDIDARTFAEWGADSLKYDNCYSDAATNYPNVNYAPSTSPHPRFANMSRYIQAQDRDILFQVCEWGIDFPALWAPEIGHSWRIGNDIIPHWRSIFRTLNQAVPQTDFAGPGQWPDLDMLLVGLDGVLTVPEEQTHFSLWSILKSPLTIGAAIPGMRAESLEILSNADVIAFNQDALGVSAALRRRWSDEGYEVWSGPLEGGRTIAAVINWRDEDREITLDLPDIGLQYAETLQNVWADETVNGVKTSYSSVVEAHGVMLVQLAETVEEGVYPADVFAATNRDVTTFSDVYAITSSPNFVLNITLTEVTAAATNITIITDSSRRPISTSIPAGSSSISTSVSLIAGSNNTITIRNAPPLSSITLSPPEPTYYTGAQDFTLTSPAGAYTCPDAYCLPAGSKIVDLSTESAATAHINSSTSGSKYLEIDYINNEVAFDSSWGWGANSRNLTIKVNDNNPVRLEVPLSGRHSELFGPGLGWWDSGRLGVLTDGWIKGTNELVLSNEGGEGGFTKYAPDVVGIAVYD

SEQ ID NO: 560 - DNA, 2133 bp, Pseudoalteromonas sp. KMM 701
atggccgacactaaatcattttatcgattagacagagtaaacagcaccgttattttcgactgccagagcaaaacaccggcgttactgtactttggtaagcgcctatctgagcgaacaacagaaacaatgcttactcagcttgctacccgtcaagaagtaaaatgtgccgtggttgaagaagcgcctatttctctatctcctttattaggcgaaggctttactggcgcgccagggcttgagctagtaaatgactcaatcgcatggtcagttgggccagagcttcaagaagtgcgtcagccttcaagtgcggctgttgagtttgtaagtgtagataagcttcgtggtattgaagtcgtgcacagcattacgcttgacaacaacagtgacgtattaagtgcacatactgtattaactaatttaggtgactcaccactgagcgttaatttctgcgccgcgccaacatttcaattgccagacagcgtaagtaaaatagtgagctttgaaggtcgttggtcaaacgaattccagcgtcaatctgttgatttagtgcttggtagctttgtacgtgaaaaccgtaaaggcaaaacatcacacgatgtgtttcctggtttattagtgcataacgaaaatgcaggcgagcaacacggcgaatgttacggctttcatttaggttggagcggcaacaataaactacgcgcagagcttctagctgaaggtcgtcgttatgtacaaatgggtgagctattacttcctggtgagcttacgcttgctaaaggtcaaacgtatcaaagcccgagcatttatggctcgttttcaagtgaaggttttagcgcgctttctcgtaattttcatcgttttgttaaagctaatttacttagccaagctcaacgtgaaaaagcgcgccctatgcattacaacacgtgggaaggtatttactttgatcacgacgtagacacgcttaagcagttagccgacaaagtagcgccgttaggtattgagcgttttgtacttgaagacggctggttcaaagagccgtcgtggcgacaatgcaggcttaggtattggacagtagattacaaaatttacccagatggcttatcgccagtcattgatcatgttaatagcttaggtatggagtttggtatttggtttgaaccagaaatggtcaaccctgatagctttttataccgcgcgcatccagattgggttttaggatctgaaaataacgagcagttaagctttagaaatcagctagtacttgatttaacgcgctctgaggttgttgagtacctatataaagcgattgacgatattttagttgaatacccaactattaagtacattaaatgggatatgaaccgcgatattaaccatgcgggtaattttgatggcaagcctgctgtgcatcagcaaacattagcactttatcgtttaattgaccgtattaaagcggcgcacccagggcttgaaatagaaagctgttcgtcaggtggtgcacgtgtagattacggcgtacttgcacacacagaccgtgtatggacgtcagattcaaatgatgcgcttgatcgccttgaaatacagcgtggatgttcgttctttttcccatcgtcggttatgggtgcacacgtaggcccacgcgattgccatatcacagggcgtaatgtaagtattgaaatgcgtgctgcggtatcaatgttcggccacatgggaatcgaaatggacccacgtgagctgaacgatcacgaatacaatgcacttaaagcggcaatagcacttcacaaagagcatcgtgagtttattcatagcgccgatttataccgcctagatagcgacgatttatcaattaactttggtttaatcgatgcgcaaaaaacgaaagcgttatttgcctataacagcgttcgcgaaacaccgcgtacagcgcctaataagcttcgttttgttggcctagatgccgatgcgcagtacacacttaatttagtgtggccggtaaaatttgaagagtatcgcccatcttctattgctgcggtaaatggtcaaacatttaccggtgaagcgctaatgcagtttggtttacaaatgccaatttcattcccgcaaacatcgcttatatttgagctcaacaaagcgtaa

SEQ ID NO: 561 - protein, 710 aa, Pseudoalteromonas sp. KMM 701
MADTKSFYRLDRVNSTVIFDCQSKTPALLYFGKRLSERTTETMLTQLATRQEVKCAVVEEAPISLSPLLGEGFTGAPGLELVNDSIAWSVGPELQEVRQPSSAAVEFVSVDKLRGIEVVHSITLDNNSDVLSAHTVLTNLGDSPLSVNFCAAPTFQLPDSVSKIVSFEGRWSNEFQRQSVDLVLGSFVRENRKGKTSHDVFPGLLVHNENAGEQHGECYGFHLGWSGNNKLRAELLAEGRRYVQMGELLLPGELTLAKGQTYQSPSIYGSFSSEGFSALSRNFHRFVKANLLSQAQREKARPMHYNTWEGIYFDHDVDTLKQLADKVAPLGIERFVLEDGWFKEPSWRQCRLRYWTVDYKIYPDGLSPVIDHVNSLGMEFGIWFEPEMVNPDSFLYRAHPDWVLGSENNEQLSFRNQLVLDLTRSEVVEYLYKAIDDILVEYPTIKYIKWDMNRDINHAGNFDGKPAVHQQTLALYRLIDRIKAAHPGLEIESCSSGGARVDYGVLAHTDRVWTSDSNDALDRLEIQRGCSFFFPSSVMGAHVGPRDCHITGRNVSIEMRAAVSMFGHMGIEMDPRELNDHEYNALKAAIALHKEHREFIHSADLYRLDSDDLSINFGLIDAQKTKALFAYNSVRETPRTAPNKLRFVGLDADAQYTLNLVWPVKFEEYRPSSIAAVNGQTFTGEALMQFGLQMPISFPQTSLIFELNKA

SEQ ID NO: 562 - DNA, 2425 bp, Lactobacillus plantarum
atggcagtaacgttgcagcaaactttaattgacattgatgaagaacaacttgtctttcacctgcataacgatcaaatatcgtatattctaggtgtggagacaggcaacgtgttggcccacttgtactttggcccacgggttcgggattatcatggcgagcgtcagtatccccggattgatcgggggttctcaggaaatttaccgaatacgactgatcgaagctattccaaggatgatttgccacaggaatacggtggcaataataccggtgattatcggcaacccgccgcgattattcgcgcggccaatggtgctcgaacagttgattttcgttatcaagactgccggatggaagccggtaagccggaacttaagggcttgccacaaacttatgtcgaagatgaggatgaagcccaaactttgattgtgacgttgcgagatgccacattaggcgtgacactcgaattagcctacacgatttatcgggatcggccagttatcacgcgtagcgcccggttgattaatcacagtgagcaagctgtcgacttaaaaaaagtggcttcgatgcagatggacctgccaacccaaccattagatgccatttcgttacctggaagctatgcgcgtgagcgccagcttagtcgtgaacggctccatcgaggtgtaactcagtttgaaagtcgccggggtgctagttctcatcatatgaacccttttgtggcgctagctgatccgaatactaatgaatttcaaggcaatgtccttggtgcattgctaatttattcaggtaaccaccagattagtttagaacgggacccaattggtcagacacgcttgactatgggaatcaatgaatataacttcgactggcgattggcggccggtgatagtttccaaacgcccgaggttgcaatggtatactcgacgacggggcttaatggtatgtcgcaaacctaccatgatttattgcgtgatcgcgtggcgcgcagtcgttacaagcacgatctccggccgatcttgatcaacaattgggaagccacttactttgactttgatgcggacaagattcaatcaatcttggatgctgcagcaccactgggtatcgaaatgtttgtgctggatgacggttggttcggtcatcgaaatgatgataatagttcgctaggtgactggtttgttaatcggaacaagttaccaggaggcttagcggatattagcaaacggacccatgataaagggatgcggttcggactttggttcgagccagaaaatatttcagccgattccgatctttatcgggcccatcctgattgggtgttaggcgtaccagatcgtggccgaacgttatcgcggaacgaatacgtgcttgatttcagccagcgggatgttgtcgacaatatttttgaacaaatgaccgcagttcttgataaggtgcccattgattatatcaagtgggatatgaaccgcaatttaacggaagtctattcgccacatagcgattcaactcatgaaggtgagactagccaccgctttatcttaggtgtatatgacttgatggagcgtttaacgaaacgctatccacagatcttatttgaaggttgctctggcggtggtggccgctttgatgctggtttaatgtattatatgccacagagttggccatcagataataatgacccgattgaacggctcaaaattcaatatgggacttcactcgtttatccaatttctgcaattaccgcccatgttgggacgagcccggatgaattgttaggacggtcgacgtcgatgaagatgcgtggtgctgtggcaatgagtggtaccttgggctatgaactggacgcggcccaactaagtgatgcggacaagcaggccgttaaaagacaggttgccttctataagcagcaccgtgagttagttcaatacgggaccttttatcgattagagagcccgtttgaatctaatacggtggcgtggatgtttgttagtccggatcagaaagaagccttgctgttcaccttcgttattttaggtgcagttcaaccagaaccgcatattacgaagttagcgggattagaccctcagcagacctacgttgagaccgacacaaacaaaatgtacggtggcgatgaattgatgcaactaggactctacacgactcccgttcaaactagtgactttacggcgcaggtacattacttcaaggctaaggactaagctcagccattaaacatattaaaacttaatcatcgttaatctaaaagaacgctctggcaaataactcgccggagcgttcttttgaaatcaaaataacttttagaaatgaatattaaagctgaagtcaatgtcttgatcagcggaagcttccagatcctggcggatcaaatcgaattgttgccgagaaatatcgctttggtaatgatga

SEQ ID NO: 563 - protein, 738 aa, Lactobacillus plantarum
MAVTLQQTLIDIDEEQLVFHLHNDQISYILGVETGNVLAHLYFGPRVRDYHGERQYPRIDRGFSGNLPNTTDRSYSKDDLPQEYGGNNTGDYRQPAAIIRAANGARTVDFRYQDCRMEAGKPELKGLPQTYVEDEDEAQTLIVTLRDATLGVTLELAYTIYRDRPVITRSARLINHSEQAVDLKKVASMQMDLPTQPLDAISLPGSYARERQLSRERLHRGVTQFESRRGASSHHMNPFVALADPNTNEFQGNVLGALLIYSGNHQISLERDPIGQTRLTMGINEYNFDWRLAAGDSFQTPEVAMVYSTTGLNGMSQTYHDLLRDRVARSRYKHDLRPILINNWEATYFDFDADKIQSILDAAAPLGIEMFVLDDGWFGHRNDDNSSLGDWFVNRNKLPGGLADISKRTHDKGMRFGLWFEPENISADSDLYRAHPDWVLGVPDRGRTLSRNEYVLDFSQRDVVDNIFEQMTAVLDKVPIDYIKWDMNRNLTEVYSPHSDSTHEGETSHRFILGVYDLMERLTKRYPQILFEGCSGGGGRFDAGLMYYMPQSWPSDNNDPIERLKIQYGTSLVYPISAITAHVGTSPDELLGRSTSMKMRGAVAMSGTLGYELDAAQLSDADKQAVKRQVAFYKQHRELVQYGTFYRLESPFESNTVAWMFVSPDQKEALLFTFVILGAVQPEPHITKLAGLDPQQTYVETDTNKMYGGDELMQLGLYTTPVQTSDFTAQVHYFKAKD

SEQ ID NO: 564 - DNA, 5103 bp, Bifidobacterium bifidum
ctcgtggtgatctacgttccgttcctcaactccgcgttcggcaccacgccgctcggaccgtgggcatgggtcgagtgcatctgcctcgccgcggtcgtactgatcgcctcggaaatctacaaggcgatcatgcgcgccatcgaccgcaagcgcggcatcatggcataacaatgccataagcctccaccggcagtcagggctcccgctctccacatcggaaaacgggagcccttctcataccccggaatcgctgaatatgcggtgacatgacggaacgatgtcgtagcatcggaggcgaaccatatatcaatggcacgttccgaagggattcgcaatgtcactcatcgaacaattccatggcgccgccgccgatggaacggaactcaccgctatttatgctgagcagccggctgctgatgtggcgttcgcgctggtcttcgccggtcacggtcttccgcgcttcgtgcactggggccgaccgctcgcggcgccgggaaccgtactcgccgcatacgacgccctgcggccgcagcgcgtgtccggcgcgctggacgagaccgcctggccaagcatcatgcccacgcaaagcgagtcgtggataggggcaccgcgactggatatccggcgcgccggcgtaacgccgttctgtgcattcacggtgaccggcatcgcaatccgtcaggacgaacgccaaggcgttgacgtgtctgacggcgtggacggtgccgcgcataccgtcacgcaacaggtgccggtcgtcaccgtgaccgcgtcggatgccgagcagggcgtggaactgtcatggacggccgaactgttgcccggcggactgatcagacagcgcaccacgctgcgtaatcttccagccggtaatcttccgaccggtgacttggaagtcggtaaagtcgaactcggcttcccgctcccggcacttgccacggagatactcaccaccaccggccatcatctgcgcgaacgcagcccgcagcggcagccgctgaccgaaggacgcttcgagaaggtctcgatggcggggcgcccaggttttgacgcctctctgttgctttccgcgggcgagcccggcttcgggttcgagcatggcgaggtctattcggtgcatgtgggctggagcggcaattccgtgctgtcggcagagcgtcagccgtatacgaccggtctgattggcggcggcgaggtgctgctcggcggcgaggccacgctcgcccgcggcgaaacgtacaccaccccgtggctgtacgggtcgtacggtgacgggctcaacgaggtggctgcgagattccatgattacgtacgctcctgtcacccggatctcgccgtcaagccgcgtccggtgattctcaacacgtgggaggccgtgtatttcgaccatgactacgacacgttgaaggctctggccgataaggccggggattccggtgtcgaacggttcgtggtggatgacggctggttcggctcccgccgagactccacatccgggctcggcgactggcaaatagcgcaggatgtgtggccggacgggccgaagagcctcaaggcgctcgccgattacgtgcacggaaaaggcatggagttcggcctgtggttcgaaccggagatggtcaacccggattccgacgtggcccgcgcccaccctgactgggtgctgcgcccgactgcgaaccgtctgccgatgcagggacgctcgcagcaagtgctcgacctgaccaatcccgacgcctaccgatacatccatgattccatcgatgcgctggtcggcgagttgggcatcgactacatcaaatgggaccacaacaaattcgtcaccgaggcggtctcgccacgtaccggcaggccggcggtgcacgggcagacgctcgccgtgtaccggatgttccgtgacctcgaagtcgcgcatccgggactggagattgagagttgcgcatcgggcggcggccgtatcgacctgggcatactcgaattcgccagccgcgtgtggacgtccgactgcgtggacccggtcgagcgggccgatattcagcggtacacgtcgctgctcgtgccgccctgcatgatgggcgagcatgtgggggcgagtcctgcacattccacgcatcgcgccacgagccaggagatgcgcatggcgatggcgttcttcgggcacatgggcgtcgaatggaatctgctcaaggagccggacgaggcgttgaacaagctcggcgaatgggtcgccgaatacaagaggcaccgcgcatggttcgcgatcgacacgtgcgtgcacgccgatatcgccgatccggccgtccgggtcgacggcatggtcaagccggatcgttccgcggcgttctaccggttcacgcaactgacaacgtcccagactctccctgcggcgccgattcgcgtgcccggtcttgaccccgatggcacgtaccgcatacagccgttgtggctggatctcgatctcgacgggcttggtcttggcagcggccagtcgccgttgggctggtggaccaaagacggcgtgctgatgacgggccgggcgctgatgacctacgggttgcgccctccatcgctgcatccggcgcagtcggtgctgttcaccgccattcgccaataagccagacggcatcgaacggagcataacaatgtgccggcggcccagtcatggagtcgccggcacattgcgtcaaagaacttgggtatcggctctagtcgttgacgtcggccttgtagaagttcacgtaggaacggctgggggtcgggccgcgctggccctgataatgggagccggtgcccttggagccgtaagggtgctcggccggagagctgagctggaagaagcacatctgcccgatcttcatgccgggccagagcttgaccggaagcgtcgacacgttgctcaactccagcgtgatatgcccctcgaaaccggggtcgatgaagccggccgtcgaatgtgtgaggatgcccagacggcccagcgagcttttgccttccaagcgtgccgccaccgtcgcgtcgagcttgacgtactcccacgtcgagccgagcgcgaactcgcccggatgcaggatccacggctcgtccggagcgacgtcgaactgctcggtcagcgccccctggttctcggccggatccacgtatgtgtaggcatgattgttgaacaggcggaagaaacggtcgaggcgcacgtcaatcgacgcgggctgcaccatttccggagtccatgggtcaagagaaatatgaccgtccttctgggcggcgagaatgtcgcggtcggacagcagcatgaggattctccttttcgcgctcacgtgtatggcgcacggcgccacactacagtctacagccattaccatgtgatgggattcagcccgcgacatcaactcacaggaagctttcagacaatctcagcattgcaccaagaaacgggtgttttactattaactgtcagcacaagccgaccgggaatcggcagcacgattctcaataactgaacccctttcttcctctctctcctttctctccccggcgggcaacaccgccggggtttctttttgcccgcgcgcagccgttaagccggacgccgaagttaacgtgtcgggtgcggagtcggtttatattgtgaagtaatcccacacaaccgacggagagccggagcgagccttggaagtctttcagctgatactgtgcattatcggcgtcgtcgtattctcgtcgttcgccagccggttcatccccaaggtgtcgactccgctggttcagatcgcgatgggcgcgatcatcacgcaggtgccgggattccccaacgcctccctgaatcccgaactgttcatggtgctgttcatcgcgccgctgctgtatctggaagcgcacgagatcgacaaatccgaattgctgaaatcgctgaaactgtcattgtcattggcaatcggactggccatcgccaccatggtggcggtcggcgtcatcgtccatgccgtctggccgtccgtgacgctcgccgccgcactggcgcttggcgcggcgctggggccgaccgacgcggtggcggtcagctcgctgggcaaggaggcgtcgctgagcctgcgccagttgggcgtgctcaaaggcgagtcgttgttcaatgacgcatccggcatcgtcggcttccagttcgccatcgccgccgccatcaccggcgagttcgcgatcggccgggctgccggcgagttcgcgctctcgttcatcggcggtgccgtatacggtctggtgattgccctgctcgcgaactggctgttcgagaccgtgcgctcgctgggttgggagaccaccaccacccgcatattgatggagctgttcctgccgttcatgctgtacctgaccgcagaggaactgcacgtgtccggcattctcgcggtggtcgcgtccggcctgttcgtgcggttcgaccggaccggcatcgggccgaacgtcgcccgcaccaacatcgtgtcgtccagcgtgtggggtgtactgtcgttcagcctcaacggtgccgtgttcatcctgctcggcatgcagctgccgaaggcgatgagcgccagttgggacgatcccggcgtgagcaacgtgcgcctgagcatcgtgattctgctggtgtcgctggtcgtggtgacgatgcggttcctgtgggtggccgggatgctgcgtttggcgcgcgacgtcaacactggcaaacggcgcaagatgacgccggcccgttggcgcagcgccgcggtgatgaccttcggaggcgccaagggcacgatcaccctgtcgctgatgttcaccatcccgttcaccgtcacctggggcgtgccgttccccatgcgcgacgagttgattttcatcgcatccggcgtcatcgtcgtcacgttactattggcgaatttcatgctgcctctgctcgctccgaaccgtgaccgcatggcacccgagatgacggagatcaccatagagatcttacgcaagaccgtcgaggagctgacggggcgagtcgacgatgagaaccgccgcgcggtgctcatggtcatcgagtcgtatacgaagcgcatcacgagattgaagcagcgcgtcggggaatccgacccccagggattggagcgg

SEQ ID NO: 565 - protein, 759 aa, Bifidobacterium bifidum
MSLIEQFHGAAADGTELTAIYAEQPAADVAFALVFAGHGLPRFVHWGRPLAAPGTVLAAYDALRPQRVSGALDETAWPSIMPTQSESWIGAPRLDIRRAGVTPFCAFTVTGIAIRQDERQGVDVSDGVDGAAHTVTQQVPVVTVTASDAEQGVELSWTAELLPGGLIRQRTTLRNLPAGNLPTGDLEVGKVELGFPLPALATEILTTTGHHLRERSPQRQPLTEGRFEKVSMAGRPGFDASLLLSAGEPGFGFEHGEVYSVHVGWSGNSVLSAERQPYTTGLIGGGEVLLGGEATLARGETYTTPWLYGSYGDGLNEVAARFHDYVRSCHPDLAVKPRPVILNTWEAVYFDHDYDTLKALADKAGDSGVERFVVDDGWFGSRRDSTSGLGDWQIAQDVWPDGPKSLKALADYVHGKGMEFGLWFEPEMVNPDSDVARAHPDWVLRPTANRLPMQGRSQQVLDLTNPDAYRYIHDSIDALVGELGIDYIKWDHNKFVTEAVSPRTGRPAVHGQTLAVYRMFRDLEVAHPGLEIESCASGGGRIDLGILEFASRVWTSDCVDPVERADIQRYTSLLVPPCMMGEHVGASPAHSTHRATSQEMRMAMAFFGHMGVEWNLLKEPDEALNKLGEWVAEYKRHRAWFAIDTCVHADIADPAVRVDGMVKPDRSAAFYRFTQLTTSQTLPAAPIRVPGLDPDGTYRIQPLWLDLDLDGLGLGSGQSPLGWWTKDGVLMTGRALMTYGLRPPSLHPAQSVLFTAIRQ

SEQ ID NO: 566 - DNA, 1934 bp, Lachancea thermotolerans
ttgaatccatggcacgctttcagctttttgcaaggaaaatagaaatgaaggcgtaacgccaactctgttcaacagtacctgtgcgcacgttctattctcaaaatggatcctaaaggcaatgacgaaaaatgtacctaagccctcgggattatgtcatccccggatgtttacattctcaatggttaagaaaaagcctacaatatgctcttaccatatagttctttttttcagatcctttatttttcctatgtgcatcaattactacgccaagcagaacatatcggatcacagtgctccgggagcctcgtaatccaacaaccccacatgggaatgtttggagtatcgtttagaagaatcgcgaaatgcattttagcatccctagaacgaaatcgcctcgagtttggcttctaaatggtgttctactatattataaaagctaacaactcgatatcttttggtgaagaaaagctcaaaaacttttacaagatagattaacaccagcaaatccctgattgatgatatattattcagccttattagttttattatcatgcttacatggtacagctttaggcgttagcccctcttataatggattaggacttaccccacaaatgggatggaataactggaattcatttgcttgcgatgtaaaggaagaaatgctgctaggatccgctgaaaaattggtctctttggggcttaaagatctcgggtataagtatgttatcctcgatgattgctggtcgggaggcagaagtgaaaatggtagcctatttcctcatcctgaaaaatttcccaacgggatgaagcacgtcgcggaccgtttgcataaacaggatttgctttttggaatgtactcctctgcaggcgagtatacttgtgcaggttattcggggtcgctcggtcatgaagaaactgacgccaacagttttgccagctgggatgttgactacttgaagtatgacaactgttataatcgcggacagttcgggactcctgaagcctcatttaatcgctacaaagctatgtcagatgcattgaacaaaacaggaaggccgatcttctactcgctatgcaactgggggcaagacttgaccttttactggggctctgctatcagcaactcctggagaattagtggtgatatatatcccttttttgatcgcccagacagcagatgtccctgcgaagatgacgaatatgattgcaaatatgcagggtttcactgctctatcatgaatatcctagggaaagctgcaccaatggggcaaaacgctggcgtcggcggttggaacgacctagatgccctcgaagttggtgttggtaaccttactgatgacgaagagatggcgcacttttcgatgtgggcaattgtgaaatcacctttggtcatcggtgcgaaccttgagaaaataaacccatcttcttattctatcctctccaatccagcagtgatcgccatcaaccaagatcccgctggaacacctgcggttcgtgtatggagagagcaaatacgcgacactgatgagtatggccgcggagaaattcagttatggagtggatcactacacaacggcgatcaagtggttgctctgctaaacggcggcgcaatccctaggcccatgaatgctactctgaacgacattttccctgagagcgaggttgggacagccgagcgtgagggaacttgggccgtttacgatctgtgggctaaccgactagaaaacagcacatcttcgagtatcatatacggaggcagtcaagatgctacaaagtactataatgcgactgagatgtcttacaaggaagggctcgcaagaaatgatactagactgtttggaaagtacatttcagacctttcctctgggaagtccatcacagctactgttcctgctcatggtattgccctgtatagactaagacagaaataa

SEQ ID NO: 567 - protein, 472 aa, Lachancea thermotolerans
MIYYSALLVLLSCLHGTALGVSPSYNGLGLTPQMGWNNWNSFACDVKEEMLLGSAEKLVSLGLKDLGYKYVILDDCWSGGRSENGSLFPHPEKFPNGMKHVADRLHKQDLLFGMYSSAGEYTCAGYSGSLGHEETDANSFASWDVDYLKYDNCYNRGQFGTPEASFNRYKAMSDALNKTGRPIFYSLCNWGQDLTFYWGSAISNSWRISGDIYPFFDRPDSRCPCEDDEYDCKYAGFHCSIMNILGKAAPMGQNAGVGGWNDLDALEVGVGNLTDDEEMAHFSMWAIVKSPLVIGANLEKINPSSYSILSNPAVIAINQDPAGTPAVRVWREQIRDTDEYGRGEIQLWSGSLHNGDQVVALLNGGAIPRPMNATLNDIFPESEVGTAEREGTWAVYDLWANRLENSTSSSIIYGGSQDATKYYNATEMSYKEGLARNDTRLFGKYISDLSSGKSITATVPAHGIALYRLRQK

SEQ ID NO: 568 - DNA, 1934 bp, Lachancea thermotolerans
ttgaatccatggcacgctttcagctttttgcaaggaaaatagaaatgaaggcgtaacgccaactctgttcaacagtacctgtgcgcacgttctattctcaaaatggatcctaaaggcaatgacgaaaaatgtacctaagccctcgggattatgtcatccccggatgtttacattctcaatggttaagaaaaagcctacaatatgctcttaccatatagttctttttttcagatcctttatttttcctatgtgcatcaattactacgtcaagcagaacatatcggatcacagtgctccgggagcctcgtaatccaacaaccccacatgggaatgtttggagtatcgtttagaagaatcgcgaaatgcattttagcatccctagaacgaaatcgcctcgagtttggcttctaaatggtgttctactatattataaaagctaacaactcgatatcttttggtgaagaaaagctcaaaaacttttacaagatagattaacaccagcaaatccctgattgatgatatattattcagccttattagttttattatcatgcttacatggtacagctttaggcgttagcccctcttataatggattaggacttaccccacaaatgggatggaataactggaattcatttgcttgcgatgtaaaggaagaaatgctgctaggatccgctgaaaaattggtctctttggggcttaaagatctcgggtataagtatgttatcctcgatgattgctggtcgggaggcagaagtgaaaatggtagcctatttcctcatcctgaaaaatttcccaacgggatgaagcacgtcgcggaccgtttgcataaacaggatttgctttttggaatgtactcctctgcaggcgagtatacttgtgcaggttattcggggtcgctcggtcatgaagaaactgacgccaacagttttgccagctgggatgttgactacttgaagtatgacaactgttataatcgcggacagttcgggactcctgaagcctcatttaatcgctacaaagctatgtcagatgcattgaacaaaacaggaaggccgatcttctactcgctatgcaactgggggcaagacttgaccttttactggggctctgctatcagcaactcctggagaattagtggtgatatatatcccttttttgatcgcccagacagcagatgtccctgcgacgatgacgaatatgattgcaaatatgcagggtttcactgctctatcatgaatatcctagggaaagctgcaccaatggggcaaaacgctggcgtcggcggttggaacgacctagatgccctcgaagttggtgttggtaaccttactgatgacgaagagatggcgcacttttcgatgtgggcaattgtgaaatcacctttggtcatcggtgcgaaccttgagaaaataaacccatcttcttattctatcctctccaatccagcagtgatcgccatcaaccaagatcccgctggaacacctgcggttcgtgtatggagagagcaaatacgcgacactgatgagtatggccgcggagaaattcagttatggagtggatcactacacaacggcgatcaagtggttgctctgctaaacggcggcgcaatccctaggcccatgaatgctactctgaacgacattttccctgagagcgaggttgggacagccgagcgtgagggaacttgggccgtttacgatctgtgggctaaccgactagaaaacagcacatcttcgagtatcatatacggaggcagtcaagatgctacaaagtactataatgcgactgagatgtcttacaaggaagggctcgcaagaaatgatactagactgtttggaaagtacatttcagacctttcctctgggaagtccatcacagctactgttcctgctcatggtattgccctgtatagactaagacagaaataa

SEQ ID NO: 569 - protein, 472 aa, Lachancea thermotolerans
MIYYSALLVLLSCLHGTALGVSPSYNGLGLTPQMGWNNWNSFACDVKEEMLLGSAEKLVSLGLKDLGYKYVILDDCWSGGRSENGSLFPHPEKFPNGMKHVADRLHKQDLLFGMYSSAGEYTCAGYSGSLGHEETDANSFASWDVDYLKYDNCYNRGQFGTPEASFNRYKAMSDALNKTGRPIFYSLCNWGQDLTFYWGSAISNSWRISGDIYPFFDRPDSRCPCDDDEYDCKYAGFHCSIMNILGKAAPMGQNAGVGGWNDLDALEVGVGNLTDDEEMAHFSMWAIVKSPLVIGANLEKINPSSYSILSNPAVIAINQDPAGTPAVRVWREQIRDTDEYGRGEIQLWSGSLHNGDQVVALLNGGAIPRPMNATLNDIFPESEVGTAEREGTWAVYDLWANRLENSTSSSIIYGGSQDATKYYNATEMSYKEGLARNDTRLFGKYISDLSSGKSITATVPAHGIALYRLRQK

SEQ ID NO: 570 - DNA, 2208 bp, Clostridium stercorarium
atgccaattatttttcatgaagaatctggtgaatttcatctttataataaaagcatcagctatataattaaaatattgcctaataaacagcttggaaacctttatttcggcaaagttataaaagacagaaagtcattttcacatttattccagaaaaaagccagacccttatcggcttatgtttttgaagatgatccggctttttcacttcagcataccatgcaagaatatccgtcatatgggactactgattttagaagccctgcttttgagataaagcagaaaaatgggagcagaatatcctgttttgaatataaaaaacatgaaatttttgcaggcaagaatggcttagaaggccttccggcgacttatgtggaagaaccagccgatgcagatacccttgaaataacgctgtatgatgaacttattaaaacagaactggttttgagctatacaatattcaacaattattctgcgatagccagaagcgcaaggttcataaacaaaggagaagaaacgattgtgctggaaagggcaatgagcgcaagcattgattttattgacagcgattttgagatgatccagctttccggcgcatggtcacgggaacggcatattaaaacgagaaaacttcagcagggcatacagggggtttacagtatgcgcggtattagcagtgcggaacataatccgtttattgccctaaaaagaccaaatacggatgaaaacagcggcgaagtatatggtttcagcttaatatacagcggcaaccatcttgaacaggttgaggtagatacccacaacatgacaagagttatgctgggtattcatccggatacttttgagtggccgttggaaaaaggagaattttttcagacacctgaagcaataattgtttattcagacgaggggctcaataagatgagtcagacattccataagctgttcagcaaacatcttataagcagacaatggcgtgacaaacccagaccggttcttataaacagttgggaagctactggcgcaaattttactgaggaaaagcttttaagaatggcagaaatagcaaaggaacttggaatcgaactgtttgtgcttgatgacggatggtttggaaaccgagacaacgataaagcagggctgggagattggaatattgttaacaggaaaaaacttcccgatggtattgaaggcctggctgacaaaattgaatcaatgggcatgaaattcgggctttggtttgagccggaatcagtaaataaggacagcaacttatacagaaaacaccctgattggataattgcgaccccgggaagaaggacatcagcttcacgtaaccagtacgttttggatttctcgagaaaagaagtggttgattatatttattccgtaatggaaaaagttctgagcagtgcaaaaatatcctatgtaaaatgggatatgaacaggtatataactgagtgttattctttgggggcggaagccggcagccaaggaacggtttttcaccggtatattctgggagtatataatttattttcaagattgacagagaggtttccatatatactttttgaagcatgctcaagcggtggggcacggtttgatcccggaatactgtatttatctccgcaagtatggacaagcgataatactgatgcaattgagagactgaagattcagtatggtacttctctgctctatccaataagtactatgggagctcatgtttcagaagttcccaatcagcaagtaggaagaattacgcctattgaaacaagagccaatgtagcttatttcggagtgtttggttatgaacttgatttgactttattaacagaagaagaaaaagaaaagataaaaaaacagattactttttataaattccacagagaactttttcttaaaggaacattttaccgtatattaagcccgtttgacggaaatgaaacgtcctggatagttgtatcagaagataaatcagaagctattgcagcgtattacaagactctgaattatgctaacaaaggctggaaaaggcttaaacttgtagggcttgacagagataagaaatatattattgacaacgacaatgaaaggtattattacggtgatgaacttatgaatgtcggtattgtattaaaggatgaagaattatgtgcaaacggaaatgacttttcgtccattatcttttatttgaaaagtatc

SEQ ID NO: 571 - DNA, 2226 bp, Bifidobacterium breve
atggcaatcatggatttccacgggagttcgagccgtggcgaagatatccacgtcgtgtatgtcgagcagcgggacgcgcggtccgcgttcgcattcgcgattgtggatcgcgagctgccgcgcatcgtgcattggggccggccgctctccgacccgcgcacactcgtcgcagcggtcgatgcgctgcgcccgcagcgtgtctccggcgcgctcgacgagacggcctggccgagcatcctgcccacgcaggccgaagcatggaccggcgcgccgcgcttcgtcgtgcgcgccggcggcgtggagctgttctgccgcttcaccgtgaccgatgtgcgcatcgacgatggcggcgcaacggtcagcgccgaggacgccgagcagggcgtgcgcgtcctgtggcggtgcgaactgcgtgaaagcggcctcgtgcgccaacgcatgtcggttgtcaacatgcgcgccgaggaactggaaatcggcacggtggagctcgcattccccgtgcccgcggacatgaccgagatcctcacgacgaccggccaccacctgcgcgaacgctcgccgcagcgccagccgttcacgatcggccggttccagaaggcgagcctcgtcggacgccccgatttcgattcgtcgctgctgctgaacgtgggccgccccggcttcggtttcacgcacggcgacgtctactccgtgcatgtggcctggagcggcaactcactcatggccgcggaacgtctgccgtacacctccggcctgatcggcggcgcggaagcgctttccggcggggaagtgacgttgtgtgcggacggggacgataaccgctacacgacaccatggctgtacggctcgtacggcgaagggttcaacgaggtcgcatcacgcttccacaacgaactgcgcgcgacgcacgcgcagtggcgcgccgaactcggtgtggccgaaaaaccgcgccccgtgatcctcaacacatgggaggcggtctatttccagcatgatttcgacacgttgaaggcgctcgccgacaaggccgccgcaagcggcgtcgaacgcttcgtcgtggacgacgggtggttcggcgcccggcgcgacgataccgcagggctgggcgactggcacatcgcacaggacgtctggccggacggcgaccattcactcaaggcgctcgccgactacgtgcacgccaaaggcatggagttcggcttgtggttcgagccggagatggtcaatcccgattcggacatgtaccgagagcaccccgactgggtgctgcgccccacggcgcatcgcctgccgatgcagggccgcaaccagcaggtcgtcgacctgacgaacccgcaggcctacggctatgtgtacggctgcatggatgcgcttgtcagcgaactcggcatcgactacatcaagtgggaccacaacaaatatgtgaccgaagcggtgtcgccgcgcaccggccgaccggccgtgcatgggcagacactcgccgtctaccgcatcttccgcgacctcaaaaccgcgcaccccggcctggagatcgaaagctgctcgtccggcggcggccgcgtcgacctcgcgatcctctcgctcgccgaccgcatctgggcgtcggattgcgtcgatccggtcgaacgcgcggacatccagcgctacacgtcgcttctcgtgccgccggagatgatcggcgaacatgtgggcgcgagccccgcgcattccacccaccgtgcgacgagccagcagatgcgcatggcgatggcgttcttcgggcatctgggcatcgaatggaacctgctcaaggaaccacagtcggcgctcgacgaactcggtgtgtgggtcgacgcgtacaagcggcaccgcgcggacttcgcgcacggcaccgtggtccacggcgatgcggccgatcccgcggtgcgcgtcgatggcgtcgtcagcgccagcggcgaacgcgccgtctaccgcttcacgcaattgacgacatcgcagacctacccggcggcaccggtgcgcctgccgggactcgccccggacgccgactatctgatccagccgctcgcatgcaatctcgccagcggcgagccgttcacacaaatcggtaacgggcagagcgaactcggctggtggaacagccaaggcgtggtcatgaacggcggtgcgctcgacgcgttcggcttgcgcccgccgtgcatccacccggcgaacgccgtgctgttcagcgccacgcgcgtgtga

SEQ ID NO: 572 - protein, 741 aa, Bifidobacterium breve
MAIMDFHGSSSRGEDIHVVYVEQRDARSAFAFAIVDRELPRIVHWGRPLSDPRTLVAAVDALRPQRVSGALDETAWPSILPTQAEAWTGAPRFVVRAGGVELFCRFTVTDVRIDDGGATVSAEDAEQGVRVLWRCELRESGLVRQRMSVVNMRAEELEIGTVELAFPVPADMTEILTTTGHHLRERSPQRQPFTIGRFQKASLVGRPDFDSSLLLNVGRPGFGFTHGDVYSVHVAWSGNSLMAAERLPYTSGLIGGAEALSGGEVTLCADGDDNRYTTPWLYGSYGEGFNEVASRFHNELRATHAQWRAELGVAEKPRPVILNTWEAVYFQHDFDTLKALADKAAASGVERFVVDDGWFGARRDDTAGLGDWHIAQDVWPDGDHSLKALADYVHAKGMEFGLWFEPEMVNPDSDMYREHPDWVLRPTAHRLPMQGRNQQVVDLTNPQAYGYVYGCMDALVSELGIDYIKWDHNKYVTEAVSPRTGRPAVHGQTLAVYRIFRDLKTAHPGLEIESCSSGGGRVDLAILSLADRIWASDCVDPVERADIQRYTSLLVPPEMIGEHVGASPAHSTHRATSQQMRMAMAFFGHLGIEWNLLKEPQSALDELGVWVDAYKRHRADFAHGTVVHGDAADPAVRVDGVVSASGERAVYRFTQLTTSQTYPAAPVRLPGLAPDADYLIQPLACNLASGEPFTQIGNGQSELGWWNSQGVVMNGGALDAFGLRPPCIHPANAVLFSATRV

SEQ ID NO: 573 - DNA, 3298 bp, Clostridium josui
gatatctaaagtttagttggttttaccaagataaataagttatggtaaaatgatatttattatagataaagtcccagcataacaaacatacatactcagttaacgttgttctagtttgtgtctcactattaattttttggaggttattataatgaaaaaaatcaaacgccttatagccttggcaattttaacaatggtgtttatctcaccatttccggcatctgtcttaaatttcaatcaagtaatggccctgaacaacggtctgggattgactcccccaatgggttggaacagctggaatatatttgggggtgacatcaacgaagataaaattaaagaaattgcagatgctatggttacaacaggaatgaaggatgcaggctatgagtatgtaaatcttgatgacaattggatggcaaaccctgcacgtgacgctaatggaaaacttattccagaccccaaacgttttccgagcggaatgaaggctttggcagattatattcattcaaaaggattaaaatttggaatatatggtgacaggggagtaaccacttgctgcaatattccccaaagtggaagtcagggatatgaggagcaagatgcaaaaacttttgctgaatgggggctggactatttaaaatatgataactgcgcttcagacagcaatttgcaggcaggctacgaaaaaatgagggatgctcttttgaagacagggaggcctattttttacagcatatgttgctggtattttgcaggtccgtggatggtagattgcggtaattcttggagaaccacgggggatataagtgacagttggggaagcattataaggaatattgacgaaaactctaaatcagccgcttacgcaggtcctgggcattggaacgacccagatatgttggaggttggtaatggtaatatgacagacacagaatacaaagcgcatttcagcatgtggtgtatgatggcagctccacttattgccggaaatgatcttagaaatatgacacctgctaccaaagaaattcttaccaacaaagaagtcattgctattgaccaagatgccgcaggagtgcaaggcactaaggtaagttcttcaggagaacttgaagtatggtgtaaacctctagggacagatggtactaccaaggcggttgcactcttaaatagaggagccacttcggcagatatcacagttaattggagtgatatacagcttgccgatggtcctgtcacagttcgtgatctttgggagcataaggactgcggtacctttaacactgggtatacagccaatgtaccgtcacatggtgtagtggtactaaaagtacaagcaagctccactgatacaaatatagagtttggtgatgttgacggaaatggcatgattgacgcattagattattcattagtaaaacggtatttgctgggccagatttctgattgtcctgattcaaaaggcaagcttgctgctgatgttgatggagaccagcaaataacagcactggatttttcattaattaagcaatacttacttgggactattaacaaatttcctgctcaaacagcaagtaaaatcaagccataatctctctacttctttataataaatgtgggtggttgaaacgaggtgaacgtaactaatgtaagagtagcaaaagcaaagtcttattccggggcaggaccatgaaacaatttgcggcttactagatatgtatcaagggcaaattggatgacgatgggggaagtgaatctgacagtagcagcggtcagaatatggcatacattaatgacccggacggtagactctgtgattgggggattccacgtacagagtgttgcggtgtacgtcttccttttgattataacgaagaagtacctccacaaatgcttatgcttgatgttcccgaagctgagtaattattgtgttatataaatttagtgaaaatcgtatactcttaagagaagtggcattgaggcttttctagggtatacgattttttgagtttatccaacagtatataaagcagctcattaaatttgataattgtgtaaacttaatgttaccttgcacaagtatatgttacttcttcatcataatccaattttatttatcatttatagacaaaaaataacaaatttattaattttaatactaaaatgtaataaatataaatattgtaaaattatatatttgagtatataatgttcttatacacacattgtaaaatattgatataaattgcatagattcataaaaaaagaaactattttcagttataatattgcagaacttaatagaattggggacagtatatttttgagggaaagcatgtgaataatggaaatgactaagatgaattgttttatgtattccagtgtatctggaagaaatttacattggtcgcgatgctgttagtaccaatagcgtggatttgctcaatctgcgatagatattctgtaaattaattagttcgctttttatcataataggtataaaaaggcattctccgttaaacacatccatacctttaaaaaaggccttctcaaagcccttggagcagtaatgcggcattaattccagggatttttaaagttctcaaaagatacaagaagtgtatatcagattcatccatatttataatttaataaccgagatatatgttatcagtttaagtttagctttaactgattttgatttcctattatcgcaatcagaaaggaagaagaatcatgacaaaacaagagattttttgtattatcaaggaaaatattctagaaatacttccagatttaccagaagaaagcattactattgaggaaagtttaaaaaatcttggagcaaattcaatcgaccgtatggatatcattgtggatactattgaaaggcttcaactaaagattcctttagttgaatttggcatgctgaaaaacattggggaaatcgtagaccttttgtatgaaaagaagatggggagttaaataaatgggcgatagtaaaagaatggttgcgattacgggcatgggaattgtaagttccattgggaacagtatcccggaatttacagcctctctcaaagaaggaaaacatggtattaaaaagctggaaaatatgccggcacctgaaatttccgtgaccattggtgggcaaattaaaaacttttcctttgaagcaggcttggaaaaaatatactcttttgcctgccgaaacagtgaaaaacgccaggcagtttgcacggcggtcatcactacccattcaggcttcagttctagctactttggaggcatgggagaattc

SEQ ID NO: 574 - protein, 478 aa, Clostridium josui
MKKIKRLIALAILTMVFISPFPASVLNFNQVMALNNGLGLTPPMGWNSWNIFGGDINEDKIKEIADAMVTTGMKDAGYEYVNLDDNWMANPARDANGKLIPDPKRFPSGMKALADYIHSKGLKFGIYGDRGVTTCCNIPQSGSQGYEEQDAKTFAEWGLDYLKYDNCASDSNLQAGYEKMRDALLKTGRPIFYSICCWYFAGPWMVDCGNSWRTTGDISDSWGSIIRNIDENSKSAAYAGPGHWNDPDMLEVGNGNMTDTEYKAHFSMWCMMAAPLIAGNDLRNMTPATKEILTNKEVIAIDQDAAGVQGTKVSSSGELEVWCKPLGTDGTTKAVALLNRGATSADITVNWSDIQLADGPVTVRDLWEHKDCGTFNTGYTANVPSHGVVVLKVQASSTDTNIEFGDVDGNGMIDALDYSLVKRYLLGQISDCPDSKGKLAADVDGDQQITALDFSLIKQYLLGTINKFPAQTASKIKP

SEQ ID NO: 575 - DNA, 1677 bp, Trichoderma reesei
gacaagcgaaggccttactgcaagaacgagtggcagtctacatcttctacagcggacggagagattatcgaactgcttgtatcatagctggaacacacaatgacccctcactcgattgaccgggccgcgaggccttccgtctggagtggccttgctcttctcctctctacagcacacgcaatcgtgatgcctgatggagtgactggaaaagttccaagtctggggtggaactcgtggaatgcctaccactgcgatatcgatgaaagcaagtttctctcggccgccgaagtcattgtgagctctgggcttctcgacgcaggctacaattatgtcaatattgatgactgctggtcgatgaaagacggtcgtgtggacggccatattgcagtcaacacaactcgcttccctgacggcattgatgggctggcgaagaaggtccacgacttgggcttgaagttgggcatttacagcactgctgggactgcaacttgtgctggctaccctgccagtcttggctacgaggacgtcgatgccgctgattttgccgactggggcgtggactatctgaaatatgacaattgcaacgtcccttcagactggcaagatgaatacgtcgcctgcgcccccgacgccgtccaaaccggccccaacggcacctgctcaaccgcccttgagccaaacctcgcccctccgggctacgactggagcacttccaagtcagccgagcgcttcaacgccatgaggaacgccctggcgaagcagagccgcgagatcgtgctcagcctgtgcatctggggagtggccgacgtcttctcctggggcaacgagacaggcatcagctggcgcatgagcggcgatatttcgcccgaatggggctccgtgacgcacatcatcaacatgaattcgttcaagatgaattccgtcggcttctggggccacaacgacgcggatatactcgaggtcggcaacggcaacctgacggctgctgagacgcggacgcactttgcgctgtgggcggccatgaagtcgccgctgctgatcgggacggatcttgctcagttgtcgcaggagaacattgagttgctgaagaataagcatctgctggcgtttaaccaggacagcgtctacggtcagcctgccacgccctataaatggggcgtcaaccctgactggacctttaactatacgaaccctgccgagtactgggccggtccatcgtcaaaggggcatctggtgctgatgatgaacacgctggatcacacggtgagaaaggaggccaagtggtctgagattccggggctgtctgcgggacggtatgaggtccgggatgtgtggacggacaagagccttgggtgcctcagctcgtacaagacggctgttgcagctcatgacaccgctgttattctggttggcaagaagtgccgaaactggtgatggggtcggaagaggatggatatcgactggacctctggttgaatgcttgtcatcgtctgcatcctgacgggagccggaaggactgtggctgctgtctgcttcagatccagatggaagcacccttatccagactatccagaaatcacaagccaattgcaggattccagtcttctcagttactaggaggtgaataagtaaggtagagatggctgacttgtcctgctaaaaaaaaaaaaaaaaaaa

SEQ ID NO: 576 - protein, 1677 aa, Trichoderma reesei
GACAAGCGAAGGCCTTACTGCAAGAACGAGTGGCAGTCTACATCTTCTACAGCGGACGGAGAGATTATCGAACTGCTTGTATCATAGCTGGAACACACAATGACCCCTCACTCGATTGACCGGGCCGCGAGGCCTTCCGTCTGGAGTGGCCTTGCTCTTCTCCTCTCTACAGCACACGCAATCGTGATGCCTGATGGAGTGACTGGAAAAGTTCCAAGTCTGGGGTGGAACTCGTGGAATGCCTACCACTGCGATATCGATGAAAGCAAGTTTCTCTCGGCCGCCGAAGTCATTGTGAGCTCTGGGCTTCTCGACGCAGGCTACAATTATGTCAATATTGATGACTGCTGGTCGATGAAAGACGGTCGTGTGGACGGCCATATTGCAGTCAACACAACTCGCTTCCCTGACGGCATTGATGGGCTGGCGAAGAAGGTCCACGACTTGGGCTTGAAGTTGGGCATTTACAGCACTGCTGGGACTGCAACTTGTGCTGGCTACCCTGCCAGTCTTGGCTACGAGGACGTCGATGCCGCTGATTTTGCCGACTGGGGCGTGGACTATCTGAAATATGACAATTGCAACGTCCCTTCAGACTGGCAAGATGAATACGTCGCCTGCGCCCCCGACGCCGTCCAAACCGGCCCCAACGGCACCTGCTCAACCGCCCTTGAGCCAAACCTCGCCCCTCCGGGCTACGACTGGAGCACTTCCAAGTCAGCCGAGCGCTTCAACGCCATGAGGAACGCCCTGGCGAAGCAGAGCCGCGAGATCGTGCTCAGCCTGTGCATCTGGGGAGTGGCCGACGTCTTCTCCTGGGGCAACGAGACAGGCATCAGCTGGCGCATGAGCGGCGATATTTCGCCCGAATGGGGCTCCGTGACGCACATCATCAACATGAATTCGTTCAAGATGAATTCCGTCGGCTTCTGGGGCCACAACGACGCGGATATACTCGAGGTCGGCAACGGCAACCTGACGGCTGCTGAGACGCGGACGCACTTTGCGCTGTGGGCGGCCATGAAGTCGCCGCTGCTGATCGGGACGGATCTTGCTCAGTTGTCGCAGGAGAACATTGAGTTGCTGAAGAATAAGCATCTGCTGGCGTTTAACCAGGACAGCGTCTACGGTCAGCCTGCCACGCCCTATAAATGGGGCGTCAACCCTGACTGGACCTTTAACTATACGAACCCTGCCGAGTACTGGGCCGGTCCATCGTCAAAGGGGCATCTGGTGCTGATGATGAACACGCTGGATCACACGGTGAGAAAGGAGGCCAAGTGGTCTGAGATTCCGGGGCTGTCTGCGGGACGGTATGAGGTCCGGGATGTGTGGACGGACAAGAGCCTTGGGTGCCTCAGCTCGTACAAGACGGCTGTTGCAGCTCATGACACCGCTGTTATTCTGGTTGGCAAGAAGTGCCGAAACTGGTGATGGGGTCGGAAGAGGATGGATATCGACTGGACCTCTGGTTGAATGCTTGTCATCGTCTGCATCCTGACGGGAGCCGGAAGGACTGTGGCTGCTGTCTGCTTCAGATCCAGATGGAAGCACCCTTATCCAGACTATCCAGAAATCACAAGCCAATTGCAGGATTCCAGTCTTCTCAGTTACTAGGAGGTGAATAAGTAAGGTAGAGATGGCTGACTTGTCCTGCTAAAAAAAAAAAAAAAAAAA

SEQ ID NO: 577 - DNA, 1862 bp, Saccharomyces mikatae
ttaacaatgagttattgttggccgtggtaatatccgcctcgagatgttgtggcccttgtacgaagtaacgaatgtaggttataaatatagagaaaatattgataaaaggaaagtatgatacccagtactcaactgctcctcatagaaagaaaccaacaatgtcttacatatatctcttcattacagccgctgctgttactggtgcgcttggctcatccccaagttacaatggacttggccttactccccagatgggttgggacaattggaatacatttgcctgcgacgtcagtgagcaattacttttgaacactgctgatcgaatttctgaaatagggttgaaagatttgggctataaatacgttatactcgatgattgctggtctagcggcaggaattccaacggtacacttgttgcagacaagaacaagtttcccaatggaatggatcacgtggcaaggcatcttcataacaataacttcctgtttggtatgtactcgtctgccggtgaatacacttgtgcgggataccctggatctttgggacatgagcaagaagatgcagagttctttgctagaaatggggttgattatttgaagtatgataactgctataacaaaggcaaatttggcaccccagaaacgtcctacaaacgctacaaagctatgtctgatgctttgaacaaaaccggcaggcccattttttattctttgtgtaattggggccaggacttgacattttactggggatccgatatagccaattcttggagaatgagtggtgacatttaccctgagttcgatcgccctgacagcaggtgtccttgtgatggtgaccagtatgattgctcatatgctggttttcattgttctatcatgaatattcttaacaaagccgctccaatggggcaaaatgcagggattggtggttggaatgatttggacaatttagaagttggagttggaaatctgactgacgatgaagaaaaggctcatttttccatgtgggcaatggttaagtctccacttatcattggcgccgatgttaatcacttgaaggagtcttcgtattctatatatagccaggcttctgttatagccatcaaccaagatccaaagggtgtaccagcaacaagggtatggagacattatgtttcacaaactgacaagtacggcaaaggagaaattcagctctggagctgtcccctcgataatggtgaccaagttattgctctattgaatgggagtaataagaaaaggccaatgaatgctagtttagaagacattttctttgatagctacttgggttccgaagaattatcttcaagctgggatatttatgatctatgggccaacaggatcgacaacaccatagcgtctaacattcttaagaataacaaagtgactaacagtagtctgtacaatgctactgaattatcttacaaagaagggctgtcgaagaacgatactagattatttggcgtccagattggtactgtttctcctggtgggttacttaacaccactgttccagctcatggagttgcattgtataggttaagacgttctcgctaaaattgtatacaaagcgaatgtatacatatacttttataaggtatgaattctttttacttcgtatatagttttagttccagtttattatgataagtaggaacataagtaatgtagcattatacgacataaaattcacccgagcaataacaataaaccattaaaagtttttagttttcataattttgccaataaagatgtgcagatatgtagattgatgttagttgatgagtgcgttacacatatattgatatatatttatttgtttgataatagtaaataaccaatgtg

SEQ ID NO: 578 - protein, 471 aa, Saccharomyces mikatae
MSYIYLFITAAAVTGALGSSPSYNGLGLTPQMGWDNWNTFACDVSEQLLLNTADRISEIGLKDLGYKYVILDDCWSSGRNSNGTLVADKNKFPNGMDHVARHLHNNNFLFGMYSSAGEYTCAGYPGSLGHEQEDAEFFARNGVDYLKYDNCYNKGKFGTPETSYKRYKAMSDALNKTGRPIFYSLCNWGQDLTFYWGSDIANSWRMSGDIYPEFDRPDSRCPCDGDQYDCSYAGFHCSIMNILNKAAPMGQNAGIGGWNDLDNLEVGVGNLTDDEEKAHFSMWAMVKSPLIIGADVNHLKESSYSIYSQASVIAINQDPKGVPATRVWRHYVSQTDKYGKGEIQLWSCPLDNGDQVIALLNGSNKKRPMNASLEDIFFDSYLGSEELSSSWDIYDLWANRIDNTIASNILKNNKVTNSSLYNATELSYKEGLSKNDTRLFGVQIGTVSPGGLLNTTVPAHGVALYRLRRSR

SEQ ID NO: 579 - DNA, 2509 bp, Saccharomyces paradoxus
aagcttgtaccgtacatttactgtataacagtcaagccctataagattattcagtacaatttatcatgaaaaaaaaatgcagtatttttcaaagtattatccataacctatgcatcatgaacttaataaaaaagttgaagaaattgaaagaaacatcagtggtacaggggtgttttccaacaatatagaaagaaaaaaatatattgagctctctttgggtctctatactcctacagaagaggttgccatcaacaggtagccaactaacaccacaataattcattccatgaaaatacattcttgttccttgaattaccgaactaccaaactctatcagaccccctgctcacggccgcttcctaaaagggacaaaagaaaatgtagttctaagaattcaagcccaaacccaccttgtccctgtcgctatacccttgtttggaatatcaagccaggaacaatagatatcgtttaccattactgattacatcgaaaacttatgctgttagggctcatcaagatttaatgcggagaactcttaacggagtactttgatccactgcttcggcttactattttccgaagtaagtcttaagacaaatattctcaactagtaaaactataccaaaactagaatgatggaaaagctgtgatcgcgaacgacatggtcaatgattataaaaaggcggttttaattgtgtggaaatagaaagatattaatggcgtgcgttcaactccctttttttttgcaactaaaataatagcaatagtagtagcattagcaatgttcaatctaaatttttttaattacacttgccactgtgagtggtgtttttgggtcctcccgagttataacggccttgggctcacccctcagatgggatgggacaattggaacacatttgcgtgtaacgttagcgaagatttacttcttaacactgctgataggatctcagacataggtctcaaggatctagggtacaagtacgttatattagacgattgttggtccagtggaagggatgaggatggtttcctcgttgcagatgaacagaaatttcctaatggtatgggccatgttgctgatcgtttacacaacaacagtttcctttttggtatgtactcatctgcgggcgagtacacctgtgctgggtatcctgggtctttgggtcgtgaagaggaggatgctcagttctttgcaaataatcgggtagactatttgaagtatgacaattgttacaataaaggtcgatttggcacgccggagtcttctcacaaacgctacaaggccatgtcggatgccttaaataaaacaggaaggcctattttttactctctgtgtaattggggccaggacttgacgttttattgggggtctgatattgcgaattcttggagaatgagtggtgatattactgctgaattttctcgtcctgatagtaggtgcccttgtgacggtgatgaatatgattgcaaatacgctggttaccactgttctataatgaacatccttaacaaagcggcaccgatgggacaaaatggaggtataggtggctggaacgatttggataatctagaagttggtgtgggtaatttgactgatgatgaggaaaagacacatttttctatgtgggcaatggtaaagtctccacttattattggtgctgacgtgaaccatttaaaagcatcttcatattcaatctacagccaatcctcagttattgcgattaatcaagatcctaagggaattcctgcaacaagagtatggagatattatgttcctcaaacagataaatacggtcaaggagagatccaattttggagtggccctcttgaaaatggtgaccaagtaattgctctgttgaatgggggaatgaaagccagaccaatgaatgcaactttagaagatatcttctttgacagttaccagggttcggaggagctgtctaccagctgggacatttatgacttgtgggctaacagaattgataatgcaacagcgtctgctattcttgaaaacaacaaagtaacaaataatactctttataacgccactaaattgtcatataaggagggtttgttgaacggtgacagcagactatttggtaccaaagttggtactatttctcctgatggaataatcaatacaactgttccagcacatggaatcgccttatatagattaagaagcagtagttaagacagtattccaaatagtagtatattttataagcagttccggaaataagtgatgattactcgcaacatgcttcaaagccatgtaagtataccaaatataaggggtagagaatgagataaggaggacgtaagtgagacacaggagagagaaactggatcaactgttgccaaaatacctctaagcgaaaagaaccaatttctcttttctgcacatttcttaattttcatagacatcaatcttcagattttcaaaggaccagaaacttcttcttgttctagcctggaaaagtcctcattagtgtagttactgcag

SEQ ID NO: 580 - protein, 471 aa, Saccharomyces paradoxus
MFNLNFFNYTCHCEWCFWVLPSYNGLGLTPQMGWDNWNTFACNVSEDLLLNTADRISDIGLKDLGYKYVILDDCWSSGRDEDGFLVADEQKFPNGMGHVADRLHNNSFLFGMYSSAGEYTCAGYPGSLGREEEDAQFFANNRVDYLKYDNCYNKGRFGTPESSHKRYKAMSDALNKTGRPIFYSLCNWGQDLTFYWGSDIANSWRMSGDITAEFSRPDSRCPCDGDEYDCKYAGYHCSIMNILNKAAPMGQNGGIGGWNDLDNLEVGVGNLTDDEEKTHFSMWAMVKSPLIIGADVNHLKASSYSIYSQSSVIAINQDPKGIPATRVWRYYVPQTDKYGQGEIQFWSGPLENGDQVIALLNGGMKARPMNATLEDIFFDSYQGSEELSTSWDIYDLWANRIDNATASAILENNKVTNNTLYNATKLSYKEGLLNGDSRLFGTKVGTISPDGIINTTVPAHGIALYRLRSSS

SEQ ID NO: 581 - DNA, 7344 bp, Saccharomyces cerevisiae
gaattcttcctgtacgctcaaggggtggagaccttttgaaggatagcaccctaccgaagttgacctctaagtaaacactactactaggaggtgactgaatctgggaaaccacatgatggtctgagtgcgtttagctcctgccataaacatagcatgtttgttttaatgcattctcgtgtctgtacgaaattaatgtggggaggagaggaaagacatccctgaaaggtttttccaggtaaatagtcagggcgcattggctttctttcggctatacgtcttccgacagaagaagaaagcaaggcacatattacattatccaacaaaaaaatggttcttgacgtctacaaaccaagaatcttaaagacattgaacgaagtagctgaataaaaattataaaaattatgaaaactataaaaactataaaaactgtacttaagtcctcaataaaacataaacttcttactgtatagggttttcgataatttcttacttgattctaggagagcaacggtaataaaagcaacgacgatgtttgctttctactttctcaccgcatgcatcagtttgaagggcgtttttggggtgtctccgagttacaatggccttggtctcactccacagatgggttgggacaactggaatacgtttgcctgcgatgtcagtgaacagctacttctagacactgctgatagaatttctgacttggggctaaaggatatgggttacaagtatgtcatcctagatgactgttggtctagcggcagggattccgacggtttcctcgttgcagacaagcacaaatttcccaacggtatgggccatgttgcagaccacctgcataataacagctttcttttcggtatgtattcgtctgctggtgagtacacctgtgctgggtaccctgggtctctggggcgtgaggaagaagatgctcaattctttgcaaataaccgcgttgactacttgaagtatgataattgttacaataaaggtcaatttggtacaccagacgtttcttaccaccgttacaaggccatgtcagatgctttgaataaaactggtaggcctattttctattctctatgtaactggggtcaggatttgacattttactggggctctggtatcgccaattcttggagaatgagcggagatattactgctgagttcacccgtccagatagcagatgtccctgtgacggtgacgaatatgattgcaagtacgccggtttccattgttctattatgaatattcttaacaaggcagctccaatggggcaaaatgcaggtgttggtggttggaacgatctggacaatctagaggtcggagtcggtaatttgactgacgatgaggaaaaggcccatttctctatgtgggcaatggtaaagtccccacttatcattggtgccgacgtgaatcacttaaaggcatcttcgtactcgatctacagtcaagcctctgtcatcgcaattaatcaagatccaaagggtattccagccacaagagtctggagatattatgtttcagacaccgatgaatatggacaaggtgaaattcaaatgtggagtggtccgcttgacaatggtgaccaagtggttgctttattgaatggaggaagcgtagcaagaccaatgaacacgaccttggaagagattttctttgacagcaatttgggttcaaaggaactgacatcgacttgggatatttacgacttatgggccaacagagttgacaactctacggcgtctgctatccttgaacagaataaggcagccaccggtattctctacaatgctacagagcagtcttataaagacggtttgtctaagaatgatacaagactgtttggccagaaaattggtagtctttctccaaatgctatacttaacacaactgttccagctcatggtatcgccttctataggttgagaccctcggcttaagctcaatgttgagcaaagcaggacgagaaaaaaaaaaataatgattgttaagaagttcatgaaaaaaaaaaggaaaaatactcaaatacttataacagagtgattaaataataaacggcagtataccctatcaggtattgagatagttttatttttgtaggtatataatctgaagcctttgaactattttctcgtatatatcatggagtatacattgcattagcaacattgcatactagtgacttttgagaagtggcttttggtttctcaattttttgaaggaaacatccttggacctgtggcaactcctccaataattccagcctcactcagtttgtctattaaatccaggaccataaaatcgcaacctggcgcagctccaatagccgcagttactggcaaatacttttctgtcaaggtgattctagaattgtatggcacttcaccaagaggaacaatagcttcaggcgtacgtgcaaacaatgaaatcatcatatcagcaaaaccggatatcgaagaagcagaaggcgctgatctataggtgtctctgtagttaaccgtgccaatacttgataaaaacaaatacaaggagttcgaacacgtttctgggtcccgagtggtgacgttggtgttccaccattggtcgaacaactgtttgtttgctaccgcccgctcatagccggtttcagtaaaattgaagtaagcccagtcccatctgaatttgggaatagggtctaaaaagggagtatcaccatcgaacgcttcttgatagtccttggcgaacggttgccagatgttcacatattggtagtaccctgctagaccagaccacgtactattggatacatcggtaaggctttgacctgtatcttcttcaaatttggaataaacatctaacttagggttggtaccgttcacaaaattgacaacatcgttgacaaacttgttgaacatctcaagtgcttcaggactagcacgactctgagtgaaccccacctgctcttccttgatgtcgaaagtgtaaacagtgttggggaacgaagtgtagctcttagaaatgttttcattctcgccgtaccaggcttcaccgaacactctgaataactcaggatctcttgaaaagtaaccagcagtgtccatgatatcactcatcggaataacaccatctaaggagatggcatcaaaagtaggtctcaacccatatagaccttgggccccagcaggacatctcaccgaacagccagtatcggatccaactgtgaagtccaaccaatcataagcagcttctgctgcaccagacccacatgatgaagaagaaggggactgatatccatcacctctgggattaaatggtgcatggtaatcgacataatctgctgttggtgtctcaccatttgcaaactgagttagctttaggtttcctacaataacagcacccatgtcaattaaacggtgaactgaaggccaggtcatattagcctcaccgtaaacatcataataggtcctggaggatccaccagttttgacaccggcgatatcatacaggtccttaatagcaacacggtaacccgctagtggttgttctttcgtaactgtatagtacaacttagaaggcaccgcaatggtctgtgcgtgcgcaacagcaacacctcctggtagaaccataaaggaattagcgtcctcatcagagggaacgatacctgattggaatgcggcatacgtgtctgcatatagacggtaagccttgtagatactcaatttaccatccaaatacgaaccaaagtatggaccatttggtagaatagagccgtccaatgtcagaacggaggatacattgaggggagaaatagaagcgtttgtgcataacgtggcgctagcacctgaagattgaaccaaaatagtttccaggaaatagtcctggtaaaacatcatcagacgaaggaaagttattcagaaattagatttaaccgctggatagtccagactacctgagtggttaattacggtcaatggaaagagtagcgagtggcctaaacttccgaattgcttcgaaattaatctatcatcaatcgtcagttctggaacatcaggaacataatacgaaatgtcgccaagcttagcttgcttagatactgagattgcctgcaacgcttcggcaaaaaaacttaagcaaagggtccaaaagaaatgctttccatttgcttcagaggtttacttggagatatggataaaaacatttgaactgaatgaaaccaggaaaggtagaatattgactaccagcattttatatgaatttccaagtcgataatatttagaccaatgccttcctgacattcaacttgcatcattcatccgtgtgaggcttagtaacagcatccaataaccctttagttgtctttcaagtgcttgttatcctacgttagctatcatctccagagattattttcaaagaataggtaggagtgtaatctttccaaccaatcatttcaactaatacgaagataaagtaaaactttgttcaatgaataaattgaaactccaagataactgttttatcgatgcaagaagaaagctgaccggggtcatcaaatttattgttatcgttactcgttattctgagcttgctactctatgtggtttttgagttttcacatgcgtcccaaagcggacatacagcacccaggaacactttttcaaagttttctttaatgctaaaaaggcaattctgcctggaaaaatcagtagccgaagtaacgtcattttcgcaagcttatcagggcagcattctacgttagctatcatctccagagattattttcaaagaataggtaggagtgtaatctttccaaccaatcatttcaactaatacgaagataaagtaaaactttgttcaatgaataaattgaaactccaagataactgttttatcgatgcaagaagaaagctgaccggggtcatcaaatttattgttatcgttactcgttattctgagcttgctactctatgtggtttttgagttttcacatgcgtcccaaagcggacatacagcacccaggaacactttttcaaagttttctttaatgctaaaaaggcaattctgcctggaaaaatcagtagccgaagtaacgtcattttcgcaagcttctacgttagctatcatctccagagattattttcaaagaataggtaggagtgtaatctttccaaccaatcatttcaactaatacgaagataaagtaaaactttgttcaatgaataaattgaaactccaagataactgttttatcgatgcaagaagaaagctgaccggggtcatcaaatttattgttatcgttactcgttattctgagcttgctactctatgtggtttttgagttttcacatgcgtcccaaagcggacatacagcacccaggaacactttttcaaagttttctttaatgctaaaaaggcaattctgcctggaaaaatcagtagccgaagtaacgtcattttcgcaagctttatcagggcagcattctatcgttcttgagggaaggtattagctaaaacccaaatttctaagatatatggcactgaaaaggatatggggacctcagcatcctggagattactgatttgcttgaataagctacctgggacatgtagatgtgagaattatgtgaataattagataattgttgggattccattgttactaaaggctataatattagatatacagaatacactagaagttctcctcgaggatataggaatccacaaagggaatcgatagttctacatagtgttattattttatcttctttctttttatatgttgtgattcattatcctattgcattatcaatccttgcatttcagcttccattagattgcatgactgtttctcaatctttatgccatcctcttgcaccgcatattataatatactattaaatagatgatattagaatttcattccaacaagatgcttatctatcgatctgcaattgtactctatcattagctcgttttcgtatcagataaagggccccccccttttttgtttctcttcattcaggttattttgagtatgggtatgaaagtctatcttgatacatcgactgtctaaccctatcgacattacaaaaacggcatgcgttaaccggattggttgaaattcaactcaattataaagtactactattatcttgtctatgatttgctctgcggacacagcaaatcaccgatcatagtacctatgaagttgtccagtataattcacctacctaatatggcttgtcatgctggacacccatacccctcctcttgcactttggttttaaaatctaaaatcatgattatataccattctaaggcaaaggaaatgatttaacgtctcagcaggagccattttctacaatttttttttttgtttaagagggagtttttctcgtataaaaaatcacgtaggtatgtcaaactctgtctctcgtcaacagattctgttcatatcagtattacattagttaactctccttggagatgctaccaatcgtgttgtttctttactacgcgtttactttcatcctgtaaagaaagcatggctctcttgtcaacggaaatacgtaaaaatacctgaagatgccttaccgcatcgcatcgtcgaacgaagttgtcgtcagtatgctactcagaacgccaattaaagctatactccccgtgatggctgaattaatggaaccataacgcctacagtgtgtgtttctgcggccggaaaagctttttcttaagtattagataaaatggcattcttttctgtattacatccaatctgtttctatctccatgcaagtcgttgataaaggggtaatagcacaaatgttatgattaagattgtcctgatgatataccttttagccatataaatacttagcgaaatagtttatcaatgttcttcttgcaatgtcccaacagtagcaatttcttggatatgcgttgtttctaatatgttaaacggaaggacaaattacaatctgacgctggggaagtaaggtaacctttaattgccattttcttacaaaatataaaaaagtaaagacttgtccgaccatgaagcttcgagccttctaactgaagaacccgttttattggcgtctctgtaagtttcagtcacttttatatcatatccgtatcgttatgagaatatctctttatatgtaaacatgtatatactaaaaggaaaaagatatacctctttaaaataatcatggctgctcaaccttaacattgtcaccattcttagcggaagacttcaaaaatgcatctacacatgctagatgatggaagacaaccctcggcgtacccaaatataatgacttgttcttcttactgaccgcttcgtggaagttcaagaattc

SEQ ID NO: 582 - protein, 471 aa, Saccharomyces cerevisiae
MFAFYFLTACISLKGVFGVSPSYNGLGLTPQMGWDNWNTFACDVSEQLLLDTADRISDLGLKDMGYKYVILDDCWSSGRDSDGFLVADKHKFPNGMGHVADHLHNNSFLFGMYSSAGEYTCAGYPGSLGREEEDAQFFANNRVDYLKYDNCYNKGQFGTPDVSYHRYKAMSDALNKTGRPIFYSLCNWGQDLTFYWGSGIANSWRMSGDITAEFTRPDSRCPCDGDEYDCKYAGFHCSIMNILNKAAPMGQNAGVGGWNDLDNLEVGVGNLTDDEEKAHFSMWAMVKSPLIIGADVNHLKASSYSIYSQASVIAINQDPKGIPATRVWRYYVSDTDEYGQGEIQMWSGPLDNGDQVVALLNGGSVARPMNTTLEEIFFDSNLGSKELTSTWDIYDLWANRVDNSTASAILEQNKAATGILYNATEQSYKDGLSKNDTRLFGQKIGSLSPNAILNTTVPAHGIAFYRLRPSA

SEQ ID NO: 583 - DNA, 4988 bp, Saccharomyces cerevisiae
gaattcttcttgtacgctcaaggggtggagaccttttgaaggatagcaccctaccgaagttgacctctaagtaaacactactactaggaggtgactgaatctgggaaaccacatgatggtctgagtgcgtttagctcctgccataaacatagcatgtttgttttaatgcattctcgtgtctgtacgaaattaatgtggggaggagaggaaagacatccctgaaaggtttttccaggtaaatagtcagggcgcattggctttctttcggctatacgtcttccgacagaagaagaaagcaaggcacatattacattatccaacaaaaaaatggttcttgacgtctacaaatcaagaatcttaaagacattgaacgaagtagctgaataaaaactataaaaactataaaaactgtatcttagttctcaaaatacggtaaagttctcagtgtataatgttttcgataatttcttatttgtttctggtagagcaacggtaataaaaataacaacgatgtttgctttctactttctcaccgcatgcaccactttgaagggtgttttcggagtttctccgagttacaatggtcttggtctcaccccacagatgggttgggacagctggaatacgtttgcctgcgatgtcagtgaacagctacttctagacactgctgatagaatttctgacttggggctaaaggatatgggttacaagtatgtcatcctagatgactgttggtctagcggcagggattccgacggtttcctcgttgcagacaagcacaaatttcccaacggtatgggccatgttgcagaccacctgcataataacagctttcttttcggtatgtattcgtctgctggtgagtacacctgtgctgggtaccctgggtctctggggcgtgaggaagaagatgctcaattctttgcaaataaccgcgttgactacttgaagtatgataattgttacaataaaggtcaatttggtacaccagacgtttcttaccaccgttacaaggccatgtcagatgctttgaataaaactggtaggcctattttctattctctatgtaactggggtcaggatttgacattttactggggctctggtatcgccaattcttggagaatgagcggagatattactgctgagttcacccgtccagatagcagatgtccctgtgacggtgacgaatatgattgcaagtacgccggtttccattgttctattatgaatattcttaacaaggcagctccaatggggcaaaatgcaggtgttggtggttggaacgatctggacaatctagaggtcggagtcggtaatttgactgacgatgaggaaaaggcccatttctctatgtgggcaatggtaaagtccccacttatcattggtgccgacgtgaatcacttaaaggcatcttcgtactcgatctacagtcaagcctctgtcatcgcaattaatcaagatccaaagggtattccagccacaagagtctggagatattatgtttcagacaccgatgaatatggacaaggtgaaattcaaatgtggagtggtccgcttgacaatggtgaccaagtggttgctttattgaatggaggaagcgtagcaagaccaatgaacacgaccttggaagagattttctttgacagcaatttgggttcaaaggaactgacatcgacttgggatatttacgacttatgggccaacagagttgacaactctacggcgtctgctatccttgaacagaataaggcagccaccggtattctctacaatgctacagagcagtcttataaagacggtttgtctaagaatgatacaagactgtttggccagaaaattggtagtctttctccaaatgctatacttaacacaactgttccagctcatggtatcgccttctataggttgagaccctcggcttaagctcaatgttgagcaaagcaggacgagaaaaaaaaaaataatgattgttaagaagttcatgaaaaaaaaaaggaaaaatactcaaatacttataacagagtgattaaataataaacggcagtataccctatcaggtattgagatagttttatttttgtaggtatataatctgaagcctttgaactattttctcgtatatatcatggagtatacattgcattagcaacattgcatactagtgacttttgagaagtggcttttggtttctcaattttttgaaggaaacatccttggacctgtggcaactcctccaataattccagcctcactcagtttgtctattaaatccaggaccataaaatcgcaacctggcgcagctccaatagccgcagttactggcaaatacttttctgtcaaggtgattctagaattgtatggcacttcaccaagaggaacaatagcttcaggcgtacgtgcaaacaatgaaatcatcatatcagcaaaaccggatatcgaagaagcagaaggcgctgatctataggtgtctctgtagttaaccgtgccaatacttgataaaaacaaatacaaggagttcgaacacgtttctgggtcccgagtggtgacgttggtgttccaccattggtcgaacaactgtttgtttgctaccgcccgctcatagccggtttcagtaaaattgaagtaagcccagtcccatctgaatttgggaatagggtctaaaaagggagtatcaccatcgaacgcttcttgatagtccttggcgaacggttgccagatgttcacatattggtagtaccctgctagaccagaccacgtactattggatacatcggtaaggctttgacctgtatcttcttcaaatttggaataaacatctaacttagggttggtaccgttcacaaaattgacaacatcgttgacaaacttgttgaacatctcaagtgcttcaggactagcacgactctgagtgaaccccacctgctcttccttgatgtcgaaagtgtaaacagtgttggggaacgaagtgtagctcttagaaatgttttcattctcgccgtaccaggcttcaccgaacactctgaataactcaggatctcttgaaaagtaaccagcagtgtccatgatatcactcatcggaataacaccatctaaggagatggcatcaaaagtaggtctcaacccatatagaccttgggccccagcaggacatctcaccgaacagccagtatcggatccaactgtgaagtccaaccaatcataagcagcttctgctgcaccagacccacatgatgaagaagaaggggactgatatccatcacctctgggattaaatggtgcatggtaatcgacataatctgctgttggtgtctcaccatttgcaaactgagttagctttaggtttcctacaataacagcacccatgtcaattaaacggtgaactgaaggccaggtcatattagcctcaccgtaaacatcataataggtcctggaggatccaccagttttgacaccggcgatatcatacaggtccttaatagcaacacggtaacccgctagtggttgttctttcgtaactgtatagtacaacttagaaggcaccgcaatggtctgtgcgtgcgcaacagcaacacctcctggtagaaccataaaggaattagcgtcctcatcagagggaacgatacctgattggaatgcggcatacgtgtctgcatatagacggtaagccttgtagatactcaatttaccatccaaatacgaaccaaagtatggaccatttggtagaatagagccgtccaatgtcagaacggaggatacattgaggggagaaatagaagcgtttgtgcataacgtggcgctagcacctgaagattgaaccaaaatagtttccaggaaatagtcctggtaaaacatcatcagacgaaggaaagttattcagaaattagatttaaccgctggatagtccagactacctgagtggttaattacggtcaatggaaagagtagcgagtggcctaaacttccgaattgcttcgaaattaatctatcatcaatcgtcagttctggaacatcaggaacataatacgaaatgtcgccaagcttagcttgcttagatactgagattgcctgcaacgcttcggcaaaaaaacttaagcaaagggtccaaaagaaatgctttccatttgcttcagaggtttacttggagatatggataaaaacatttgaactgaatgaaaccaggaaaggtagaatattgactaccagcattttatatgaatttccaagtcgataatatttagaccaatgccttcctgacattcaacttgcatcattcatccgtgtgaggcttagtaacagcatccaataaccctttagttgtctttcaagtgcttgttatcctacgttagctatcatctccagagattattttcaaagaataggtaggagtgtaatctttccaaccaatcatttcaactaatacgaagataaagtaaaactttgttcaatgaataaattgaaactccaagataactgttttatcgatgcaagaagaaagctgaccggggtcatcaaatttattgttatcgttactcgttattctgagcttgctactctatgtggtttttgagttttcacatgcgtcccaaagcggacatacagcacccaggaacactttttcaaagttttctttaatgctaaaaaggcaattctgcctggaaaaatcagtagccgaagtaacgtcattttcgcaagcttatcagggcagcattctatcgttcttgagggaaggtattagctaaaacccaaatttctaagatatatggcactgaaaaggatatggggacctcagcatcctggagattactgatttgcttgaataagctacctgggacatgtagatgtgagaattatgtgaataattagataattgttgggattccattgttactaaaggctataatattagatatacagaatacactagaagttctcctcgaggtgtagtagctgatgattgggaagctgttgcaagaaatcttgaattc

SEQ ID NO: 584 - protein, 471 aa, Saccharomyces cerevisiae
MFAFYFLTACTTLKGVFGVSPSYNGLGLTPQMGWDSWNTFACDVSEQLLLDTADRISDLGLKDMGYKYVILDDCWSSGRDSDGFLVADKHKFPNGMGHVADHLHNNSFLFGMYSSAGEYTCAGYPGSLGREEEDAQFFANNRVDYLKYDNCYNKGQFGTPDVSYHRYKAMSDALNKTGRPIFYSLCNWGQDLTFYWGSGIANSWRMSGDITAEFTRPDSRCPCDGDEYDCKYAGFHCSIMNILNKAAPMGQNAGVGGWNDLDNLEVGVGNLTDDEEKAHFSMWAMVKSPLIIGADVNHLKASSYSIYSQASVIAINQDPKGIPATRVWRYYVSDTDEYGQGEIQMWSGPLDNGDQVVALLNGGSVARPMNTTLEEIFFDSNLGSKELTSTWDIYDLWANRVDNSTASAILEQNKAATGILYNATEQSYKDGLSKNDTRLFGQKIGSLSPNAILNTTVPAHGIAFYRLRPSA

SEQ ID NO: 585 - DNA, 3743 bp, Saccharomyces cerevisiae
gaattctttctgtacgctcagggtgggcctttaaaggatagcaccctaccgaagtcgacttctaagtaaacagcattactaggagatgactaaatctggaaaaccacatggtggtctgaatgcgtctagtctctgccataaacataacatgtttgttttaatgcattctcgtgtttaatcgacattaatgtggggggagaaagacatcccatccctgaaaggtttttccagggaatagtcaggacgcattggctttcattcggccatatgccttccgaaagaagaagaaaggaagacatgtattacattatccaacaaaaaatggttcttgacgtctacaaatcaagaatcttaaagacattgaacgaagtagctgaataaaaattataaaaattatgaaaactataaaaactataaaaactgtacttaagtcctcaataaaacataaacttcttactgtatagggttttcgataatttcttacttgattctaggagagcaacggtaataaaagcaacgacgatgtttgctttctactttctcaccgcatgcatcagtttgaagggcgtttttggggtgtctccgagttacaatggccttggtctcactccacagatgggttgggacaactggaatacgtttgcctgcgatgtcagtgaacagctacttctagacaccgctgatagaatttctgacttggggctaaaggatatgggttacaagtatatcattctggatgactgctggtctagcggcagagattccgacggtttcctcgttgcagatgaacaaaaatttcctaatggtatgggccatgttgcagaccacctgcataataacagctttcttttcggtatgtattcgtctgctggtgagtacacctgtgctggatatcctgggtctctgggtcgtgaggaagaagatgcacagttctttgcaaataaccgcgttgactacttgaagtacgataattgttacaataagggtcagtttggtacaccagaaatttcttaccaccgttacaaggccatgtcagatgctttgaataaaactggtaggcctattttttattctctgtgtaactggggtcaggatttgacattctactggggttctggtatcgccaattcttggagaatgagcggagatattactgctgagttcacacgtccagatagcagatgtccctgtgatggtgatgaatacgattgcaagtatgccggtttccattgttctattatgaatattcttaacaaggcagctccaatggggcaaaatgcaggtgttggtggttggaacgatcttgacaatctagaggtccgcgtcgggaatttgactgacgatgaggaaaaggcacattttcctatgtgggcaatggtaaagtctccacttatcattggtgccgatgtgaataccttaaagccatcttcatactcaatctatagtcaagcctccgtcatcgcaattaatcaagatccaaagggtatcccagcaacaagagtctggagatattatgtctcagacaccgatgaatatgggcaaggtgaaattcaaatgtggagtggtccccttgacaatggtgaccaagtggttgctttattgaatggaggaagcgtacctagaccaatgaacacgaccttggaagagattttctttgacagcaatttgggttcaaaggaactaacatcgacttgggatatttacgacctatgggcaaacagagttgacaactcgacggcgtctgctatccttggacagaacaagacagccaccggtattctctacaatgctacagagcaatcctataaagatggtttgtctaagaatgatacaagactgtttggtcagaaaattggtagtctttctccaaatgctatacttaacacaactgttccggctcacggtatcgctttctataggttgcggccctctgcttaggcttaatagtgagcaaagagaaacgagaaaaaattgatgattctagagttcatgaaaaaattactccaagacttgttcaggctaactaaataataaacggcagtataccctattagatgtagaggtagttttagttttgtaggtatataattcaaagcctttgaactatttctcggatatatcatggagctttacattgctttagcaacattatacagtataaatattagtagcttttgagaaatgggttttcgtttctcaattttttgaaggaaacatccttggacctgtggcaactcctccaataatcccagcctcgctcagtttctctattaactccaggaccataaaatcgcagcctggtgcaactccaatggcagccgttactggcaaatacttttgtgtcaatgtgattctagagttgtatggcacttcaccaagaggaacaacagcttcgggtgtacgcgcaaggtacgaaatcatcatatattagcaaaaccggatatcgaagaagcagaaggcgctgatctataaatgtccctgtagttaatcgtgcagatacttgataaaaacaaatacaaagagttcgaacacgtttctgggtctcgagtagtgacgttggtgttccaccactggtcgaacagctatttttttgctaccgctcgctcatagccggtttcagtaaaattgaagtaggcccaatcccatctgaatttgggaatagggtctaaaaagggaatatcaccgttgaatgcttcttgatagtccttaatgaatggttgccagatgttcacatattggtagtaccctgctagaccagaccacgtactgatggatacatcggtaagactttggcatgtatcttcttcaaattcagaatagacatctaacttgggattggtaccgttcacaaaagttacaacattgttgacaaacttgttgaacatctcaagtgcttcaggactagcacgactctgagtgaagcctacttgcccttccttaatgtcgaaagtgtacacagtgtgaggaaacgaagtgtatagctcttagaaatgtcttcattttcgccgtaccaggcttcaccgaacactttcaataactcaggatctcttgaaaagtaaccagcagtgtccatgatatcactcatcggaataaaaccatctaaggagatggcattaaaagtaggcctcagcccatataaaccttaggccccagcaggacatgtcactgaacaaccagtattcggatccacctgtaaagtccaaccaatcgtaagcagcttctgctgctgcattagacctgcatgatgaagaagaaggagactgatatccatcacctctgggattaaatggcgcatggtaatcggcataatctgccgttggtatctcatcattttcaaattgagttagctttagttttcctacaataacagcacccgtatcaatcaaaccctaaactgaaggccaggtcacattaacctcaccgtaaacgtcataataagtcccagaagatccaccagttttgacaccggcaatatcatataggtccttaatagcaacacagtaagccgcttgtggctgttctttcgtcactgttcagtacaacttagaaggcaccgcaatggtctgagcatgcgcagctagtcctcatgtttgaaaacgcagcgtgcatgctagcatatagatagtaagtcttgtagataatcattttattatcgaactccgaactgaagtatggaccatttgatgaaatggagccgcgcaataacaggacagaggacgtattaaagggaggtggcagaattc

SEQ ID NO: 586 - protein, 471 aa, Saccharomyces cerevisiae
MFAFYFLTACISLKGVFGVSPSYNGLGLTPQMGWDNWNTFACDVSEQLLLDTADRISDLGLKDMGYKYIILDDCWSSGRDSDGFLVADEQKFPNGMGHVADHLHNNSFLFGMYSSAGEYTCAGYPGSLGREEEDAQFFANNRVDYLKYDNCYNKGQFGTPEISYHRYKAMSDALNKTGRPIFYSLCNWGQDLTFYWGSGIANSWRMSGDITAEFTRPDSRCPCDGDEYDCKYAGFHCSIMNILNKAAPMGQNAGVGGWNDLDNLEVRVGNLTDDEEKAHFPMWAMVKSPLIIGADVNTLKPSSYSIYSQASVIAINQDPKGIPATRVWRYYVSDTDEYGQGEIQMWSGPLDNGDQVVALLNGGSVPRPMNTTLEEIFFDSNLGSKELTSTWDIYDLWANRVDNSTASAILGQNKTATGILYNATEQSYKDGLSKNDTRLFGQKIGSLSPNAILNTTVPAHGIAFYRLRPSA

SEQ ID NO: 587 - DNA, 2812 bp, Saccharomyces cerevisiae
gtcgacttctaagtaaacaccattactaggagatgactaaatctggaaaaccacatggtggtctgaatgcgtctagtctctgccataaacataacatgtttgttttaatgcattctcgtgtttaatcgacattaatgtggggggagaaagacatcccatccctgaaaggtttttccagggaatagtcaggacgcattggctttcattcggccatatgtcttccgaaagaagaagaaaggaagacatgtattacattatccaacaaaaaatggttcttgacgtctacaaatcaagaatcttaaagacattgaacgaagtagctgaataaaaattatgaaaactataaaaactataaaaactgtacttaagtcctcaataaaacataaacttcttactgtataaggttttcgataatttcttacttgattctaggagagcaacggtaataaaagcaacgacgatgtttgctttctactttctcaccgcatgcatcagtttgaagggcgtttttggggtgtctccgagttacaatggccttggtctcactccacagatgggttgggacaactggaatacgtttgcctgcgatgtcagtgaacagctacttctagacaccgctgatagaatttctgacttggggctaaaggatatgggttacaagtatatcattctggatgactgctggtctagcggcagagattccgacggtttcctcgttgcagatgaacaaaaatttcccaatggtatgggccatgttgcagaccacctgcataataacagctttcttttcggtatgtattcgtctgctggtgagtacacctgtgctggatatcctgggtctctgggtcgtgaggaagaagatgcacagttctttgcaaataaccgcgttgactacttgaagtacgataattgttacaataagggtcagtttggtacaccggaaatttcttaccaccgttacaaggccatgtcagatgctttgaataaaactggtaggcctatattctattctctatgtaactggggtcaggatttaacattttactggggctctggtatcgccaattcttggagaatgagtggagatgttactgctgagttcactcgtccagatagcagatgtccctgtgatggcgatgaatacgattgcaagtacgccggtttccattgttctattatgaatattcttaacaaggcagctccaatggggcaaaatgcaggtgttggtggttggaatgatctggacaatctagaggttggtgtcgggaatttgactgacgatgaggaaaaggcacatttctctatgtgggcaatggtaaagtctccacttatcattggtgccaatgtgaataacttaaaggcatcttcgtactcaatctatagtcaagcctctgtcatcgcaattaatcaagattcaaatggtattccagcaacaagagtctggagatattatgtttcagacacagatgaatatggacaaggtgaaattcaaatgtggagtggtcctcttgacaatggtgatcaagtggttgctttattgaatggaggaagcgtatctagaccaatgaacacgaccttggaagagattttttttgacagcaatctgggttcaaagaaactgacatcgacttgggatatctacgacctatgggccaacagagttgacaactcgacagcgtctgctatccttggacggaataagacagccaccggtattctctacaatgctacggagcaatcctacaaagacggtttgtctaagaatgatacaagactgtttggtcagaaaattggtagtctttctccaaatgctatacttaacacgactgttccagctcacggtatcgccttctataggttgagaccctcttcttgagcttattgttgagcaaagcagggcgagaagtattgatgattgttaaaaagttcatgaaaaaaatactactcgaatatttattcagagtaactaaataataaacgacagaatagcctatcaggtattccaatagttttcgttttgtaggtacataatctgaagcccttgaactttttctcgtttacatacttcattgcattagcgatatttcacatgtgctatactagtgacttttgtaaaatacttttctgccaatgtgattctagaattgtatgacatttcacgaagaggaacaacagcttcaggagtacatacaaacgacgaaatcatcatatcagcaaaaccggatatcgaagaagcagaaggcgctagtctacaggtatctctgtagttgatacaaacaaaaacaaagagttcgaacacatttctgggtcccgagtagtggcgttggtgttccaccattggtcgaacaattgttttttgctaccgctcgctcatagccggtttcagtaaaattgaagtaagcccagtttcatctgaatttgagaatagggtctaaaaagggagtatcaccatcgaacgcttcctgatagtccttagagaacagtcatcagatgtccatatattactactacccttctagacctgaccacgtactgttggatgcattggtaagaatttttgcccgtattatcttcaattttagaataaacatctaacttggggttagtagcgttcacaaatatgccaacattgttgacagacttgttgaacatctcaagttcttcaggactagcacggctttgagtgaagcccacttgttcttctttgatgtcgaaatcgcacacagtgttcaggaagaaattgtagctcttcgaaatgttttcgttctcactctaccaggcttcaccaagcactctgagaaactcgggatcc

SEQ ID NO: 588 - protein, 471 aa, Saccharomyces cerevisiae
MFAFYFLTACISLKGVFGVSPSYNGLGLTPQMGWDNWNTFACDVSEQLLLDTADRISDLGLKDMGYKYIILDDCWSSGRDSDGFLVADEQKFPNGMGHVADHLHNNSFLFGMYSSAGEYTCAGYPGSLGREEEDAQFFANNRVDYLKYDNCYNKGQFGTPEISYHRYKAMSDALNKTGRPIFYSLCNWGQDLTFYWGSGIANSWRMSGDVTAEFTRPDSRCPCDGDEYDCKYAGFHCSIMNILNKAAPMGQNAGVGGWNDLDNLEVGVGNLTDDEEKAHFSMWAMVKSPLIIGANVNNLKASSYSIYSQASVIAINQDSNGIPATRVWRYYVSDTDEYGQGEIQMWSGPLDNGDQVVALLNGGSVSRPMNTTLEEIFFDSNLGSKKLTSTWDIYDLWANRVDNSTASAILGRNKTATGILYNATEQSYKDGLSKNDTRLFGQKIGSLSPNAILNTTVPAHGIAFYRLRPSS

SEQ ID NO: 589 - DNA, 1423 bp, PENICILLIUM SIMPLICISSIMUM
atcgcctgaagcacacaatatgttgacttcgctgtctttgaccgcactggcattgttgccttcggcgaatgcactcgtaagaaaggatggtgtgggtagactaccagccttgggatggaatagctggaatgcgtttggttgcgatgtggattctacaaagatcatgactgccgccaatgagatggtgcatctcggtctgaaggacttgggatatgaatacgtcaacatcgatgactgctggtctgtaaagaacacacgcaattcaacgactcaacgaatcattcctgatactcagaaatttcctgatggaatttctggcgtggctgatcaggttcaccagttgggattgaagattggtatttatagcagtgctggcgagactacttgtgcgggataccctgctagtctggggtatgagaaggttgatgcagaagcctttgcggaatggggaattgactatttgaagtatgacaactgcggtgttcccagtaactggacagaccagtattcctcctgtgttcccgacggctccaacgaacctgcaaatggtacttgtcccggtctttccaacccagcccccgctgggtacgactggacgaagtcaaacaccttcactcggtatactatgatgcgcgatgcccttttgggccagactcgaactatcctatactctttgtgtgactggggccaggctgatgtcaacacctggggaaatgagactggaaactcatggcgcatgtccggagatatctcggcgaattgggctcgcatcgctcaaattgccaatgagaatactttcaggatgaattatgttggtttctggggtcaccctgatcctgacatgctcgaggttggaaatggagatcttacggccgcggagaaccgggcacatttcgcgttgtgggcaattatgaagtctcctctgattatcggtactgcgctcgacggcatcagtgatgccaacctagccgtcctgaaaaacaaatacttgatcgaattcaatcaagaccccattattggccgctcagcccacccctataaatggggatacaatccggattggacatttgacccagctcaccccgctgaatactggtctggtccctcatcgaccttgaagggtacattggtgttgatgttgaattcggagaattccacttcgacccgtactgcggtgtggaaagagattccggagttgaagggtcataatgcttaccgagtgactgatgcctggagtggtaaggaccttgggtgtgttaagaagcagtacagtgcttcgttggcaagccatgatgttgctgtgcttgtggtaaaggaggcttgttgagtagggagtgaacttcatagtgggcggaaactggtataggatgtgaacggctgtgtatctatctgagcggccgttgaacctggttatccgttttat

SEQ ID NO: 590 - protein, 435 aa, PENICILLIUM SIMPLICISSIMUM
MLTSLSLTALALLPSANALVRKDGVGRLPALGWNSWNAFGCDVDSTKIMTAANEMVHLGLKDLGYEYVNIDDCWSVKNTRNSTTQRIIPDTQKFPDGISGVADQVHQLGLKIGIYSSAGETTCAGYPASLGYEKVDAEAFAEWGIDYLKYDNCGVPSNWTDQYSSCVPDGSNEPANGTCPGLSNPAPAGYDWTKSNTFTRYTMMRDALLGQTRTILYSLCDWGQADVNTWGNETGNSWRMSGDISANWARIAQIANENTFRMNYVGFWGHPDPDMLEVGNGDLTAAENRAHFALWAIMKSPLIIGTALDGISDANLAVLKNKYLIEFNQDPIIGRSAHPYKWGYNPDWTFDPAHPAEYWSGPSSTLKGTLVLMLNSENSTSTRTAVWKEIPELKGHNAYRVTDAWSGKDLGCVKKQYSASLASHDVAVLVVKEAC

SEQ ID NO: 591 - DNA, 2283 bp, Clostridium stercorarium
acgttcatcagggaaattaattgtacagggggatgacaatgccaattatttttcatgaagaatctggtgaatttcatctttataataaaagcatcagctatataattaaaatattgcctaataaacagcttggaaacctttatttcggcaaagttataaaagacagaaagtcattttcacatttattccagaaaaaagccagacccttatcggcttatgtttttgaagatgatccggctttttcacttcagcataccatgcaagaatatccgtcatatgggactactgattttagaagccctgcttttgagataaagcagaaaaatgggagcagaatatcctgttttgaatataaaaaacatgaaatttttgcaggcaagaatggcttagaaggccttccggcgacttatgtggaagaaccagccgatgcagatacccttgaaataacgctgtatgatgaacttattaaaacagaactggttttgagctatacaatattcaacaattattctgcgatagccagaagcgcaaggttcataaacaaaggagaagaaacgattgtgctggaaagggcaatgagcgcaagcattgattttattgacagcgattttgagatgatccagctttccggcgcatggtcacgggaacggcatattaaaacgagaaaacttcagcagggcatacagggggtttacagtatgcgcggtattagcagtgcggaacataatccgtttattgccctaaaaagaccaaatacggatgaaaacagcggcgaagtatatggtttcagcttaatatacagcggcaaccatcttgaacaggttgaggtagatacccacaacatgacaagagttatgctgggtattcatccggatacttttgagtggccgttggaaaaaggagaattttttcagacacctgaagcaataattgtttattcagacgaggggctcaataagatgagtcagacattccataagctgttcagcaaacatcttataagcagacaatggcgtgacaaacccagaccggttcttataaacagttgggaagctactggcgcaaattttactgaggaaaagcttttaagaatggcagaaatagcaaaggaacttggaatcgaactgtttgtgcttgatgacggatggtttggaaaccgagacaacgataaagcagggctgggagattggaatattgttaacaggaaaaaacttcccgatggtattgaaggcctggctgacaaaattgaatcaatgggcatgaaattcgggctttggtttgagccggaatcagtaaataaggacagcaacttatacagaaaacaccctgattggataattgcgaccccgggaagaaggacatcagcttcacgtaaccagtacgttttggatttctcgagaaaagaagtggttgattatatttattccgtaatggaaaaagttctgagcagtgcaaaaatatcctatgtaaaatgggatatgaacaggtatataactgagtgttattctttgggggcggaagccggcagccaaggaacggtttttcaccggtatattctgggagtatataatttattttcaagattgacagagaggtttccatatatactttttgaagcatgctcaagcggtggggcacggtttgatcccggaatactgtatttatctccgcaagtatggacaagcgataatactgatgcaattgagagactgaagattcagtatggtacttctctgctctatccaataagtactatgggagctcatgtttcagaagttcccaatcagcaagtaggaagaattacgcctattgaaacaagagccaatgtagcttatttcggagtgtttggttatgaacttgatttgactttattaacagaagaagaaaaagaaaagataaaaaaacagattactttttataaattccacagagaactttttcttaaaggaacattttaccgtatattaagcccgtttgacggaaatgaaacgtcctggatagttgtatcagaagataaatcagaagctattgcagcgtattacaagactctgaattatgctaacaaaggctggaaaaggcttaaacttgtagggcttgacagagataagaaatatattattgacaacgacaatgaaaggtattattacggtgatgaacttatgaatgtcggtattgtattaaaggatgaagaattatgtgcaaacggaaatgacttttcgtccattatcttttatttgaaaagtatctaaatacggaatgggaaaaaggcgaatgatacatatt

SEQ ID NO: 592 - protein, 736 aa, Clostridium stercorarium
MPIIFHEESGEFHLYNKSISYIIKILPNKQLGNLYFGKVIKDRKSFSHLFQKKARPLSAYVFEDDPAFSLQHTMQEYPSYGTTDFRSPAFEIKQKNGSRISCFEYKKHEIFAGKNGLEGLPATYVEEPADADTLEITLYDELIKTELVLSYTIFNNYSAIARSARFINKGEETIVLERAMSASIDFIDSDFEMIQLSGAWSRERHIKTRKLQQGIQGVYSMRGISSAEHNPFIALKRPNTDENSGEVYGFSLIYSGNHLEQVEVDTHNMTRVMLGIHPDTFEWPLEKGEFFQTPEAIIVYSDEGLNKMSQTFHKLFSKHLISRQWRDKPRPVLINSWEATGANFTEEKLLRMAEIAKELGIELFVLDDGWFGNRDNDKAGLGDWNIVNRKKLPDGIEGLADKIESMGMKFGLWFEPESVNKDSNLYRKHPDWIIATPGRRTSASRNQYVLDFSRKEVVDYIYSVMEKVLSSAKISYVKWDMNRYITECYSLGAEAGSQGTVFHRYILGVYNLFSRLTERFPYILFEACSSGGARFDPGILYLSPQVWTSDNTDAIERLKIQYGTSLLYPISTMGAHVSEVPNQQVGRITPIETRANVAYFGVFGYELDLTLLTEEEKEKIKKQITFYKFHRELFLKGTFYRILSPFDGNETSWIVVSEDKSEAIAAYYKTLNYANKGWKRLKLVGLDRDKKYIIDNDNERYYYGDELMNVGIVLKDEELCANGNDFSSIIFYLKSI

SEQ ID NO: 593 - DNA, 2601 bp, Bifidobacterium breve
aactctgtgccgcgttcggtgactaatcattggtcaacatgagatgtatccaatgattcgaacgtctcgtcggcgttgtcgaaacgcgccgacttcttgctggcgatggcgcgggcctcgtcgagtgcctcaacggtctcctgaggcgcatcgggatagaagagattcaggggaatcccatgctcgcgaacaatctgccggtagaacgcgcgggtcacgctggagaagtcaagtccgaaatcctctgcgatgttggcggcctgctctttggtgtgcgcgtcgacacggacggtcacagatgccatggtcataacgacttcgatctctgttgtaagacaatggcaggtatatgtcttacatcgtgtctggcagtcgtggtccattcagaagatttctcgcatgcataccgtatggatggcgccacatcggccggcacgcgggtgtgcttgtagtgcagggcaaggtcggttactatgtcggcaacattggcaacgccagcatgcaaaggagggtgcccatgacgaaacgactgttggaaatcacgtcggtgacggcccacacggaatgcgggcccacgggcgaacgcagtgacatgtcattgccgctcgacgccgccgaactgcgtaagaccggcaacctcatcgagatctccgtgcacgcgcacgtgcccgttgagaaccccatcctcgagcatgcgactttccagccgggatgctcgctcacggtgtcatgcgcgctgcctaggtattcgcggcccgcgcagggaacgccgatcctgtgcctgtaccagcacaaggagtggtggatgcggcccacgtgggtcagctgttttgcagatgtgccggagcgcacgcagatgctcgtgtggaagacgcggagaacgtacaagggtcaggtccgcgagcaatggcatgtgctgctcgcggcgagcgacggggagtgccgtgccgatatccgcggttgcgcgacggatgcggcaggcgcggcaggtggggcgctggccgtcgatagctcgacgaatcgcgtcggtcagacgagtctggacggccttgctctgctgtacgcccgtggcggtgacccgtatgcactcatcgaacaatgcgtgactgcaacgtggaggcgcttgccggtagggccgaagtccttgcgccggttcccggaggcgttgcgcggcttcggttggtgtacgtgggactcgttggggcagaacgtgagcgaaagcggcatcctcgcgaaaatggatgagttcaaggcgaaacaggtgccggtctcgtgggtgctgatcgatgatggttggtcgcagacgcgcaacaacaagctgaccggtttcggcgccgatcccacccgcttcccccaaggccttgcgcacaccatcgacgtgctcaaacaggactacggcgtgcgatatgtgggcgtatggcaggcgttccaaggatactggggaggcgtcgaccccgattcagatgcgttcaaagagcgcagatacatgttcgagacattgccgggtggcatgaccgtgccatccgcccagccggcatgggatatgttcgtggacggcgaatgcctgtccgagtacggttgtgaacggttctggtggcgttggagtgaagagctcgccaacgctggcgtcgactttgtgaaggtggattcgcagagcacgatgtcggtgctcacgcggggtgcacaatcatacggtacgctgctcatgcggcaccgtgcggtcgatcttgcggcgtccgcgttcttcaataacgcgctcatcaactgcatgggcatggcgcccgaagactattggcggcgcccgtattcgccgatcacgcgcacaagcgacgacttcttcccgcgcatccccgagtcgctgcccgaacacgcgatcgagaacgcctactgctcattgctcatgggctgcctctaccactgcgactgggacatgttctggaccaaacaccccgacgcgcgcgtgcacgcgtggctccgctggttcagcggcggcccagtgtactgctccgacgcgctcggcgaaaccgatccggagacgttgaagccgttcttcgacgaagacggcgtgctgacgcatcccgacggtgtgggtatgccggtcataggcagcctgctttccgatccggtgcattccactgttcctcttggcgttcgcaacacgttccgtggtgaggaggtgctgttgttcgtcggcctgaacaccgcagccgtccagtccgcgcacattcccgccggcgattccgcgtgtctggtgcgcaatctggagacaggcgaatgcacacaggtcggcgcgggagagaccctcgacgtcgaactgcggtacggtgaatacgccgcgctcgccgtggcccgcgcataaatactttcccacacgcccacagcgcacagcgaatgggaaactaatttactgccgactagcatgggcacatctgaaaatcgttgaaataccaagcaaaggagcctcaagtcatgacgacgctcaaccggtccgcaattaccgacgacgtgcgtaccaacggcgcgacgccgaacccgtggtgggcgaacgcggtcgtctaccagatctacccgcgcagcttccaggactccgggtaccgagct

SEQ ID NO: 594 - protein, 613 aa, Bifidobacterium breve
MTKRLLEITSVTAHTECGPTGERSDMSLPLDAAELRKTGNLIEISVHAHVPVENPILEHATFQPGCSLTVSCALPRYSRPAQGTPILCLYQHKEWWMRPTWVSCFADVPERTQMLVWKTRRTYKGQVREQWHVLLAASDGECRADIRGCATDAAGAAGGALAVDSSTNRVGQTSLDGLALLYARGGDPYALIEQCVTATWRRLPVGPKSLRRFPEALRGFGWCTWDSLGQNVSESGILAKMDEFKAKQVPVSWVLIDDGWSQTRNNKLTGFGADPTRFPQGLAHTIDVLKQDYGVRYVGVWQAFQGYWGGVDPDSDAFKERRYMFETLPGGMTVPSAQPAWDMFVDGECLSEYGCERFWWRWSEELANAGVDFVKVDSQSTMSVLTRGAQSYGTLLMRHRAVDLAASAFFNNALINCMGMAPEDYWRRPYSPITRTSDDFFPRIPESLPEHAIENAYCSLLMGCLYHCDWDMFWTKHPDARVHAWLRWFSGGPVYCSDALGETDPETLKPFFDEDGVLTHPDGVGMPVIGSLLSDPVHSTVPLGVRNTFRGEEVLLFVGLNTAAVQSAHIPAGDSACLVRNLETGECTQVGAGETLDVELRYGEYAALAVARA

SEQ ID NO: 595 - DNA, 2410 bp, Lactobacillus plantarum
gagagctattaatgacgcgagccattaatagctctttttgtgaactgaaatagaaaaagctaatagcgaagggaagattttactatggcagtaacgttgcagcaaactttaattgacattgatgaagaacaacttgtctttcacctgcataacgatcaaatctcgtatattctaggtgtggagacaggcaacgtgttggcccacttgtactttggcccacgggttcggggttatcatggcgagcgtcagtatccccggattgatcgggggttctcaggaaatttaccgaatacgactgatcgaagctattccaaggatgatttgccacaggaatacggtggcaataataccggtgattatcggcaacccgccgcgattattcgcgcggccaatggtgctcgaacagttgattttcgttatcaagactgccggatggaagccggtaagccggaacttaagggcttgccacaaacttatgtcgaagatgaggatgaagcccaaactttgattgtgacgttgcgagatgccacattaggcgtgacactcgaattagcctacacgatttatcgggatcggccagttatcacgcgtagcgcccggttgattaatcacagtgagcaagctgtcgacttagaaaaagtggcttcgatgcagatggacctgccaacccaaccattagatgccatttcgttacctggaagctatgcgcgtgagcgccagcttagtcgtgaacggctccatcgaggtgtaactcagtttgaaagtcgccggggtgctagttctcatcatatgaatccttttgtggcgctagctgatccgaatactaatgaatttcaaggcaatgtccttggtgcattgctaatttattcaggtaaccaccagattagtttagaacgggacccaattggtcagacacgcttgactatgggaatcaatgaatataacttcgactggcgattggcggccggtgatagtttccaaacgcccgaggttgcaatggtatactcgacgacggggcttaatggtatgtcgcaaacctaccatgatttattgcgtgatcgcgtggcgcgcagtcgttacaagcacgatctccggccgatcttgatcaacaattgggaagccacttactttgactttgatgcggacaagattcaatcaatcttggatgctgcagcaccactgggtatcgaaatgtttgtgctggatgacggttggttcggtcatcgaaatgatgataatagttcgctaggtgactggtttgttaatcggaacaagttaccaggaggcttagcggatattagcaaacggacccatgataaagggatgcggttcggactttggttcgagccagaaaatatttcagccgattccgatctttatcgggcccatcctgattgggtgttaggcgtaccagatcgtggccgaacgttatcgcggaacgaatacgtgcttgatttcagccagccggatgttgtcgacaatatttttgaacaaatgaccgcagttcttgataaggtgcccattgattatatcaagtgggatatgaaccgcaatttaacggaagtctattcgccacatagcgattcaactcatgaaggtgagactagccaccgctttatcttaggtgtatatgacttgatggagcgtttaacaaaacgctatccacagatcttatttgaaggctgctctggcggtggtggccgctttgatgctggtttaatgtattatatgccacagagttggccatcagataataatgacccgattgaacggctcaaaattcaatatgggacttcactcgtttatccaatttctgcaattaccgcccatgttgggacgagcccggatgaattgttaggacggtcgacgtcgatgaagatgcgtggtgctgtggcaatgagtggtaccttgggctatgaactggacgcggcccaactaagtgatgcggacaagcaggccgttaaaagacaggttgccttctataagcagcaccgtgagttagttcaatacgggaccttttatcgattagagagcccgtttgaatctaatacggtggcgtggatgtttgttagtccggatcagaaagaagccttgctgctcaccttcgttattttaggtgcagttcaaccagaaccgcatattacgaagttagcgggattagaccctcagcagacctacgttgagaccgacacaaacaaaatgtacggtggcgatgaattgatgcaactaggactctacacgactcccgttcaaactagtgactttacggcgcaggtacattacttcaaggctaaggactaagctcagccattaaacatattaaaacttaatcatcgttaatctaaaagaacgctctggcaaataactcgccggagcgttcttttgaaatcaaaataacttttagaaatga

SEQ ID NO: 596 - protein, 738 aa, Lactobacillus plantarum
MAVTLQQTLIDIDEEQLVFHLHNDQISYILGVETGNVLAHLYFGPRVRGYHGERQYPRIDRGFSGNLPNTTDRSYSKDDLPQEYGGNNTGDYRQPAAIIRAANGARTVDFRYQDCRMEAGKPELKGLPQTYVEDEDEAQTLIVTLRDATLGVTLELAYTIYRDRPVITRSARLINHSEQAVDLEKVASMQMDLPTQPLDAISLPGSYARERQLSRERLHRGVTQFESRRGASSHHMNPFVALADPNTNEFQGNVLGALLIYSGNHQISLERDPIGQTRLTMGINEYNFDWRLAAGDSFQTPEVAMVYSTTGLNGMSQTYHDLLRDRVARSRYKHDLRPILINNWEATYFDFDADKIQSILDAAAPLGIEMFVLDDGWFGHRNDDNSSLGDWFVNRNKLPGGLADISKRTHDKGMRFGLWFEPENISADSDLYRAHPDWVLGVPDRGRTLSRNEYVLDFSQPDVVDNIFEQMTAVLDKVPIDYIKWDMNRNLTEVYSPHSDSTHEGETSHRFILGVYDLMERLTKRYPQILFEGCSGGGGRFDAGLMYYMPQSWPSDNNDPIERLKIQYGTSLVYPISAITAHVGTSPDELLGRSTSMKMRGAVAMSGTLGYELDAAQLSDADKQAVKRQVAFYKQHRELVQYGTFYRLESPFESNTVAWMFVSPDQKEALLLTFVILGAVQPEPHITKLAGLDPQQTYVETDTNKMYGGDELMQLGLYTTPVQTSDFTAQVHYFKAKD

SEQ ID NO: 597 - DNA, 2190 bp, Mycocladus corymbiferus
gcgttggatgtggggattcataagcatccctctttcgagacatggttcatggtgacaaagaagtctacatacgtggttggtgctacagcagatggatatgttatcaaccttcactggggaaagcgtttgacacaacttgatgacttgaatgcaactgtacctttgagtgatcaatcacagaatccacctattagctatgccatggaagaattaccagcttttggtggactaagatatcgtgacaacgtgctcaaggtggatttaccagatgggactcgcgaactgaatttgctgtattcaggagcaaagagcaaggatgatactcttctcgatatcgagctgtccgatggcaaccgtaccgatttcaaggtgacactgcactatgaactggacactgagaacgatatgatacgtcgatcgtatactgttgagaatggactgaagggtcgtgtcaaccttgacttggcattgtcagctgcatggcatccaccaacagcacttgacgttgacgagaaacgagagttactgacattggcaggcgaatggaacaatgaagcacaagtacaatcaaccgagttgaagcctggcatagcccatacgatccagacacccaaaggatttactgatcatgtgtcatatccatactttgccatcagacaagtaccaagtgaagtgaatcctggcactgaagtttactttggtactcttgcatggggaggtagttgggagattacagcacataccaacacatatggctatacccgtatcactggtggcatgcatcatcttgattttggatggacacttgaaccaggagaatcattcacaacaccagtgtttattgctggattcacagatgaaggcttaccaggcgcacgtagacgcttaccacgtcatgctcgaaagtatcagcaattgagcctgcagacacaaaagaatgacagtctttatcatcctgttctttacaactcttgggaagctgttacttttgatgtcacttttgacaagcaagttgccttggctgagaaagctgctccacttggtgttgaattgtttgttattgatgatggctggtttggggatcgtaacaacgactctgcaggattaggagattggtatcccaacaaggaaaagttcccaaatggtctcaagccccttgcagaccatgtgcatgatctcggcatgcagtttggcgtgtggtttgaacccgagtcggtcaatcccaattccaatctttatcgtgaacatcctgattgggtgctttactatgacggtgtcccaagatacgaagcacgtaatcagctgttactcaaccttggattaccagaagtgcaagattacatttatgatcgagtgagcagtatcattgaagagaatgatattgactatatcaagtgggatatgaatcgaccctatcaaggcgttactatgcatcattatgatagaaatcctcgagaagcatgggtgctgattgcgcgtggatatcaaaatttgctagccaagctcaagaaacgatttcccaatctgtggattgaaagctgtgctagtggtggtggacgtatggatctcagtgtgcttgaacatgctgatcaagtttggaccagtgacaatacaagacctgatgctcgtcttaagattcaatatggtgcttcattgtttttgcctccaagagccatgtatggttgggtgactgaaagtggggatgataacaatgtgcacatacctttatccttccggttccacacatctttcatgggtggccttggtattggtgccaacttgaacaagtactcagacaatgatatgaaagagagcacagcttggattgcattgtataagaagcttcgaccagtgattcaaaatggtgatctcgattggttagtgccaccttcaaaggttggtgaaatgattgctgtatcccagacaacatcaaaggatcaacaagaagcagtgatcttggcattccgaatcagcagccctttttcagctccaatgaatccagtacgaccacgttttctcaaggatgatgtagtatatcgggttcaaatctggttacaggatccacacaaggttgctgaagaatacgacatgtctggtgctttactcatgcacaagggaattagtcttgatggattgaatagagccatgtttactagtgcagttgtttatgtgaaagagtcatacgattaa

SEQ ID NO: 598 - DNA, 28 bp, Mycocladus corymbiferus
  misc_feature (6)..(6): n is a, c, g, or t
  misc_feature (12)..(12): n is a, c, g, or t
  misc_feature (15)..(15): n is a, c, g, or t
  misc_feature (24)..(24): n is a, c, g, or t
garytnttygtnatngaygayggntggt

SEQ ID NO: 599 - DNA, 29 bp, Mycocladus corymbiferus
  misc_feature (3)..(3): n is a, c, g, or t
  misc_feature (9)..(9): n is a, c, g, or t
  misc_feature (12)..(12): n is a, c, g, or t
  misc_feature (18)..(18): n is a, c, g, or t
ttnggrttnacngaytcnggytcraacca

SEQ ID NO: 600 - DNA, 2190 bp, Bacillus stearothermophilus
atggcggttacatacaatccgcaaacgaagcagtttcatttgcgggcgggcaaggcaagctacgtgatgcagcttttccgctccggctatttggctcatatctattggggaaaagcggtgcgcgatgttcggggggagcggaggttttcgcggctggatcgcgcgttttcccccaatcccgacccgtctgaccgcacgttttcgctcgatacgctgccgcaagaatatccagcctatgggaataccgattttcgttctccggcgtatcaagtgcagcttgagaacggctcgaccgtgaccgatttgcgctacaaaacgcaccgcatttacaaagggaagcctagacttaacggactgccggcgacatacgtggagcatgaacaggaagcggagacgctcgaaattgtccttggagatgcgctgatcggtctagaggtcacgttgcagtatacggcgtatgaaaaatggaacgtcatcacgcgcgcggcccgttttgaaaacaaaggcggcgagcggttgaaactgctgcgtgcgctcagtatgagcgttgatttcccaactgctgactatgattggatccatctccccggagcgtgggggcgcgagcgctggatcgagcgccgcccgcttgtgaccggcgtgcaagcggcggaaagccgccgcggcgcgagcagccaccaacaaaacccatttatcgcgctcgtcgccaaaaacgccgatgaacaccaaggcgaagtatacgggttcagctttgtgtacagcggcaatttcctcgcccaagtcgaggtcgaccagtttcacaccgcccgtgtctcgatgggaatcaacccgtttgatttcacatggctgcttcagccgggtgagtcgttccaaacgccggaagtggtcatggtctactccgaccaagggttaaatgggatgtcgcaaacgtaccatgaactgtaccgcacccgcctggcgcgcggcgcattccgcgaccgcgaacgcccgattttgatcaacaactgggaagcaacgtacttcgattttaacgaagaaaaactcgtcaacattgcgaaaacggaagcggaactaggcatcgaactgtttgtgcttgacgatggctggtttggcaagcgcgatgacgaccgtcgttcgctcggcgattggatcgtcaaccggcgcaagcttccgaacggcttagacgggttggcgaaacaagtgaacgaactcgggatgcagttcggcttatgggtcgaaccggaaatggtgtcgccaaacagcgaactgtaccggaaacaccccgactggtgtctgcatgtgcccaaccgcccgcgttcggaaggacgaaaccagcttgtgctcgattattcccgcgaagacgtttgcgactatatcatcgagacgatctcgaacgtcctcgcaagcgcgccgatcacgtacgtgaaatgggacatgaaccgccatatgacggaaatcggctcctccgccctgccgcccgagcgccagcgcgaaacggcgcaccgctatatgcttgggctgtaccgcgtcatggacgagatgacctcgcgctttccgcacattttgtttgaaagctgttcgggaggcggggggcggtttgacccggggatgctgtattatatgccgcaaacgtggacgagcgacaataccgatgccgtctcgcgcctgaaaattcaatacggcacgagcctcgtctatccgattagtgcgatgggcgcccacgtctcggcggtgccgaaccaccaagtcgggcgggtggcgtcgctcaaggcgcgcggccatgtcgcgatgtcaggcaacttcggctatgagctcgatatcacgaaattgacggaaacagaaaaacaaatgattaagcaacaagtcgcgttttacaaggacgtacgccgcctcgtccagttcggcacgttttatcgactgctaagcccgtttgaaggcaacgaggcggcgtggatgttcgtctctgccgaccgctcggaagcgctcgtcgcctacttccgcgttctggccgaagcgaacgcgccgctgtcatacctgcgcttaaaagggcttgacccgaatcaagactacgaaatcgagggacttggcgtttacggcggcgacgagctgatgtatgccggagtggccttgccgtaccgctctggcgattttatcagcatgatgtggcgattgaaagctgttcaacaataa

SEQ ID NO: 601 - protein, 729 aa, Bacillus stearothermophilus
MAVTYNPQTKQFHLRAGKASYVMQLFRSGYLAHIYWGKAVRDVRGERRFSRLDRAFSPNPDPSDRTFSLDTLPQEYPAYGNTDFRSPAYQVQLENGSTVTDLRYKTHRIYKGKPRLNGLPATYVEHEQEAETLEIVLGDALIGLEVTLQYTAYEKWNVITRAARFENKGGERLKLLRALSMSVDFPTADYDWIHLPGAWGRERWIERRPLVTGVQAAESRRGASSHQQNPFIALVAKNADEHQGEVYGFSFVYSGNFLAQVEVDQFHTARVSMGINPFDFTWLLQPGESFQTPEVVMVYSDQGLNGMSQTYHELYRTRLARGAFRDRERPILINNWEATYFDFNEEKLVNIAKTEAELGIELFVLDDGWFGKRDDDRRSLGDWIVNRRKLPNGLDGLAKQVNELGMQFGLWVEPEMVSPNSELYRKHPDWCLHVPNRPRSEGRNQLVLDYSREDVCDYIIETISNVLASAPITYVKWDMNRHMTEIGSSALPPERQRETAHRYMLGLYRVMDEMTSRFPHILFESCSGGGGRFDPGMLYYMPQTWTSDNTDAVSRLKIQYGTSLVYPISAMGAHVSAVPNHQVGRVASLKARGHVAMSGNFGYELDITKLTETEKQMIKQQVAFYKDVRRLVQFGTFYRLLSPFEGNEAAWMFVSADRSEALVAYFRVLAEANAPLSYLRLKGLDPNQDYEIEGLGVYGGDELMYAGVALPYRSGDFISMMWRLKAVQQ

SEQ ID NO: 602 - DNA, 2190 bp, Bacillus stearothermophilus
atgtcagttgcatacaatccacaaacgaagcagtttcatttgcgggcgggcaaggcaagctacgtgatgcagcttttccgctccggctatttggcgcatgtctattggggaaaagcggtgcgcgatgttcgcggcgcgcgggcatttccgcggctggaccgcgcgttttcccccaatcccgacccgtctgaccgcacgttttcgctcgatacgctgctgcaagaatatccagcctatgggaataccgatttccgtgctccagcgtatcaagtgcagcttgagaacggctcgaccgtgaccgatttgcgctacaaaacgcaccgcatttacaaagggaagcctagacttaacgggctgccggcgacatacgtggagcatgaacaggaagcggagacgctcgaaattgtccttggagatgcgctgatcggcctagaggtcacgttgcagtatacagcgtatgaaaaatggaacgtcatcacgcgttcagcccgttttgaaaacaaaggcggcgagcggttgaagctgctgcgcgcgctcagtatgagcgtcgatttcccaactgctgactatgattggattcatctccctggagcgtgggggcgcgagcgctggatcgagcggcgcccgcttgtgaccggcgtgcaggcggcggaaagccgccgcggcgcgagcagccaccaacaaaacccatttatcgcgctcgtcgccaaaaacgccgatgaacaccaaggcgaagtatacgggttcagctttgtgtacagcggcaattttctcgctcaaatcgaggtggaccagttcggcactgcccgcgtctcgatggggatcaacccgtttgattttacatggctgcttcagccgggtgagtcgttccaaacgccggaagtggtcatggtctactccgaccaagggttgaacgggatgtcgcaaacgtaccatgaactgtaccgcacccgcctggcgcgcggcgcattccgcgaccgcgaacgtccgattttaatcaacaactgggaagcgacgtactttgattttaacgaagaaaaaatcgtcaacatcgcgagaacagcagcggagcttggcatcgaactggttgtgcttgacgacggctggtttggcgagcgcgatgacgaccgccggtcgctcggcgattggatcgtcaaccggcgcaagcttccgaacggcttggacgggctggcaaaacaagtaaacgaacttggactccagttcggcttatgggtcgaaccggaaatggtgtcgccaaacagcgagctgtaccggaagcatcccgactggtgtctccatgtgccgaaccgcccgcgctctgaagggcggaatcagcttgtgctcgattattcccgcgaagacgtttgcgactatatcatcgagacgatctcgaacgtcctcgcaagcgcgccgatcacgtacgtgaaatgggacatgaaccgccatatgacggaaatcggctcctccgccctgccgcccgagcgccagcgcgaaacggcgcaccgctatatgcttgggctgtaccgcgtcatggacgagatcacctcgcgctttccgcacattttgtttgaaagctgttcgggaggcggggggcggtttgacccggggatgctgtattatatgccgcaaacatggacgagcgacaataccgatgccgtctcacgcctgaaaattcaatacggcacgagcctcgtctatccgattagtgcaatgggcgcccacgtctcggcggtgccgaaccaccaagtcgggcgggtggcgtcgctcaagacgcgcggccatgtcgcgatgtcaggcaacttcggctatgagctcgatatcacgaaattgacggaaacagaaaaacaaatgatgaagcaacaagtcgcgttttacaaggacgtgcgccgcctcgtccagttcggtacgttttatcggttgttaagcccatttgagggcaatgaagcagcatggatgttcgtctctgctgaccgctcggaagcgctcgtcgcctactttcgcgttctggccgaagcgaacgcgccgctgtcatacctgcgcttaaaagggcttgactcgaatcaagactacgaaatcgagggacttggcgtttacggcggcgacgagctgatgtatgccggagtggccttgccgtaccgctctagtgattttatcagcatgatgtggcgattgaaagctgttcaacaataa

SEQ ID NO: 603 - protein, 729 aa, Bacillus stearothermophilus
MSVAYNPQTKQFHLRAGKASYVMQLFRSGYLAHVYWGKAVRDVRGARAFPRLDRAFSPNPDPSDRTFSLDTLLQEYPAYGNTDFRAPAYQVQLENGSTVTDLRYKTHRIYKGKPRLNGLPATYVEHEQEAETLEIVLGDALIGLEVTLQYTAYEKWNVITRSARFENKGGERLKLLRALSMSVDFPTADYDWIHLPGAWGRERWIERRPLVTGVQAAESRRGASSHQQNPFIALVAKNADEHQGEVYGFSFVYSGNFLAQIEVDQFGTARVSMGINPFDFTWLLQPGESFQTPEVVMVYSDQGLNGMSQTYHELYRTRLARGAFRDRERPILINNWEATYFDFNEEKIVNIARTAAELGIELVVLDDGWFGERDDDRRSLGDWIVNRRKLPNGLDGLAKQVNELGLQFGLWVEPEMVSPNSELYRKHPDWCLHVPNRPRSEGRNQLVLDYSREDVCDYIIETISNVLASAPITYVKWDMNRHMTEIGSSALPPERQRETAHRYMLGLYRVMDEITSRFPHILFESCSGGGGRFDPGMLYYMPQTWTSDNTDAVSRLKIQYGTSLVYPISAMGAHVSAVPNHQVGRVASLKTRGHVAMSGNFGYELDITKLTETEKQMMKQQVAFYKDVRRLVQFGTFYRLLSPFEGNEAAWMFVSADRSEALVAYFRVLAEANAPLSYLRLKGLDSNQDYEIEGLGVYGGDELMYAGVALPYRSSDFISMMWRLKAVQQ

SEQ ID NO: 604 - DNA, 2311 bp, Bacillus stearothermophilus
agatggcgttatcaccaatgatcattatatatttatttgcacaaaaatggattattagtggggtaacaagaggatcgattaaataaaataaaagacggaggtgaagaaatggcaattgtatttgatccaacaaacaaaacctttcatctacaagcaaacgatacaagctatgtgatgcagctcgttcgatcaggatatttatctcatctttattggggaaaaaagattagaagtgcaaatggatcaagaagattccaatttttcgaccgcccgttctcccctaatcccgatccatccgaccgcacattttctttagataccgtgccgcaagaatacccggcgtatggcaacacggattttcgcgcgccggcgtatcaagtgcaattggaaaacggggcgacgatctcggatttgcgctataaaacgcatcgcatttataaaggaaagccaaagttaaaagggctgccggccacctatgtcgaacgcgaaaacgaggcggaaacattagaaatcgtattggaagaccgcgtgatcggattacacgtcacactgctttatacggtgtatgagcggtggaatgtggtgacgcgttctgcccgctttgaaaaccacggtgcggaacggatcaagctgttgcgggcgttaagcatgaatgtagatttcccgcatgctgactatgaatggctgcatctcccgggagcatgggggcgggagcgagcagtggaaagacggccgcttgtcaccggcatgcagtcggtagaaagccgtcgcggcgccagcagccaccagcaaaatccatttatcgccttgctggggaaaaatacaaatgaagatgtcggggaagtatacggctttagccttgtatacagcggcaatttcctcgctcaggtcgaagtcgatcaattccagacaacgcgtgtatctatgggaataaatccgtttgattttacgtggctgttagaaccgggcgagtcgtttcagacgccggaagtggtgatggtgtattccgatcaaggattgaatggaatgtcgcaaacttatcatcagctataccgcacccgcctagcgcgcggggcgttccgcgaccgggagcgcccgattcttattaacaactgggaagcgacatattttcattttaatgaagaaaaaattttgcgccttgcgaaaacagcagcggaattagggattgagctatttgtgctcgatgacggatggtttggcaaacgcgatgatgatcacagttcgttaggagattggttcgtcaataaacagaagctgccaaatggactggaagggctagcaaaaaacattaaccaaatgggcatgcagtttggtctatgggtagaaccggaaatggtttccgtcgacagcgagctgtatcggcagcatccggactggtgcctccatgtgccgaaccgcccgcgctcggaaggaagaaaccagcttgtattagactattcccgccaagaagtgtgcgactatattattcaagtcatttccgatgtgttagcgagcgcgccgatttcgtatgtcaaatgggatatgaaccgccatatgacggaaatcggctctgcgcccctgcctccggaacgccaacgcgaaacggctcaccgctacatgttagggttgtaccgcgtcatggaagaaataacatcccgttttccgcatgttctgtttgagagctgctcgggcggcggaggccggtttgacccgggcatgctgtactacatgccacaaacgtggacgagtgataatacggacgcggtttcccgcttaaaaatccaatacggcaccagccttgtttatccaatcatctcgatgggcgcgcacgtgtcagcggtgccgaaccaccaagttcatcgcattacatcgttggaaatgcgcggtcatgtggcgatgtcgggaaactttggctatgagctcgatttaacaaaactaagtgagaaagaaaaacaaaaagtaaaagaacaagtggcattttacaaagaaattcgccgtcttgtccaattcggaacgttttatcggatactcagcccgtttgaaggcaatgaggcggcgtggatgttcgtatccgaggaccaatcggaagcattggttgcctatttccgcgtgctggcggaagcgaatgcgccgctgtcgttcatacggttaaaaggactggatccaaataaagattacgaaattattggcagcggcgaagtgtatggcggcgatgaactgatgtatgcagggttaaatgtgccacagcgacgcggcgacttcattagtgtcatgtggcggttgaaagcagctcgttaatggacaaaaagac

SEQ ID NO: 605 - protein, 729 aa, Bacillus stearothermophilus
MAIVFDPTNKTFHLQANDTSYVMQLVRSGYLSHLYWGKKIRSANGSRRFQFFDRPFSPNPDPSDRTFSLDTVPQEYPAYGNTDFRAPAYQVQLENGATISDLRYKTHRIYKGKPKLKGLPATYVERENEAETLEIVLEDRVIGLHVTLLYTVYERWNVVTRSARFENHGAERIKLLRALSMNVDFPHADYEWLHLPGAWGRERAVERRPLVTGMQSVESRRGASSHQQNPFIALLGKNTNEDVGEVYGFSLVYSGNFLAQVEVDQFQTTRVSMGINPFDFTWLLEPGESFQTPEVVMVYSDQGLNGMSQTYHQLYRTRLARGAFRDRERPILINNWEATYFHFNEEKILRLAKTAAELGIELFVLDDGWFGKRDDDHSSLGDWFVNKQKLPNGLEGLAKNINQMGMQFGLWVEPEMVSVDSELYRQHPDWCLHVPNRPRSEGRNQLVLDYSRQEVCDYIIQVISDVLASAPISYVKWDMNRHMTEIGSAPLPPERQRETAHRYMLGLYRVMEEITSRFPHVLFESCSGGGGRFDPGMLYYMPQTWTSDNTDAVSRLKIQYGTSLVYPIISMGAHVSAVPNHQVHRITSLEMRGHVAMSGNFGYELDLTKLSEKEKQKVKEQVAFYKEIRRLVQFGTFYRILSPFEGNEAAWMFVSEDQSEALVAYFRVLAEANAPLSFIRLKGLDPNKDYEIIGSGEVYGGDELMYAGLNVPQRRGDFISVMWRLKAAR

SEQ ID NO: 606 - DNA, 2187 bp, Carnobacterium piscicola
atgatatcgattacgtttcaagaagaacaaaaaatctttcatttagcaacagaaacaatgagttatatctttaaaattgaggaagggaatattgtcgctcaccattattttggaagacgcatcgttcattatcatggaagtcggaactatccgcgagtagatcgctctttttcaccgaatttttatgatgccaaagatcgttttttttcaaaagatatagttttgcaagaatatagtgactttgggactggtgattttagaactccggctctggttttagaacaagaaaatggttctaaaatgacggattttcgtttcgcttcgtatcaaataatagatggaaaaaatgtagtgttaggcttaccacaaattcatagtgaaaatagccaaacattagaattgctgtttgtggattctacgctacctaagattcagctctatctttatttttctattgtagaaggtaaagatgtagtgatacgctcagctaaattagtgaatcaaagttctgaatcggtcacaataaaaaaaatggatagttgccaattagacttgccagaaagtagttttgaacttataagtttacctggcacttgggcaagagagcgccaacttgttagagaagagattcattctggaattcacactattgggtcaactcgaggtgcaagtagtcatcagcaaaatccttttgcagcattagtaagaccagaaacaactgaactatctggtgaagtttttggttttagttttatttatagtggtagttttcaatttacttttgaaaaagatccttttgatcaattgcgtataaatatgggattcaactcattgaattttaattggattttaggaagtaagcaagaatttcaaaccccagaatctgttttagcttattcggaccaaggtttaaatggcctctcgcaaatttatcatcaattatatagagaaaatttaatgcgaggagcttatcaaaaatgtgagcggcctattttagtcaataattgggaagctacttattttgattttgacgaagcaaaaatcaagactttgattgaggaatcctctgccttagggattgaactatttgtgttagatgatggttggtttggaaaacgaaatagcgacaaaacatcgctaggggattgggaaataaatcttgaaaagttaccaaatggattaaatggcatgaatgaaacagccaaagagtgtcagatgaagtttggtttatggtttgaacctgaaatgatttcagaggaaagtgagttatataaagagcatcctgattgggtattgcgagtaccaaatcgtccgatgtcccgtagtcgagatcaatttgtgttagatttttctagagcagatgttcgaatatatatttaccaaaaaatggctgaaatcttgtcaactcactcaatttcatatgttaaatgggattttaatcgtcatttaagtgaagtgtattcggatgcattaccggcaaaacaacaaggggaagtccatcatcgctatctgcttggtttatatgaatttttagaaaaattaaccacatcttttccaactgttttatttgaaagttgttctggtggaggtgggcgatttgatccaggaatgctctattatatgccgcaaacatggactagcgacaacactgatgctgtagcacgattgaaaatccaatatagcacgagtttagtttatccggtgattacgatgggctctcatgtttctgcaatacctaatcatcaaactggacgtgagacttctttagaaatgcgtggagcagtagcgatgtcaggtgtttttgggtatgaattagacgtgaatagcttaactaaagaagaaaaaaaagaaatcaaagaacaagtaactttttataaagaacaccgtcaactcattcaatttggtcttttttatcgtttattaagccccttcgaagggaaccaaacagcgtggtgctttgtttctaaggatcaaaaggaatgcttagtattttattttaatgttctagaagaagcttcagctccgttgactctcttaaaattggcaggtttacaagataatgagctgtatcatagtgatgaattaggtactttttcaggaagtgaactgatgcatgctggattctatacatccacaaaaaaaattggtgatttcagaagtgagtgttactattttaaaacagaatag

SEQ ID NO: 607 - protein, 728 aa, Carnobacterium piscicola
MISITFQEEQKIFHLATETMSYIFKIEEGNIVAHHYFGRRIVHYHGSRNYPRVDRSFSPNFYDAKDRFFSKDIVLQEYSDFGTGDFRTPALVLEQENGSKMTDFRFASYQIIDGKNVVLGLPQIHSENSQTLELLFVDSTLPKIQLYLYFSIVEGKDVVIRSAKLVNQSSESVTIKKMDSCQLDLPESSFELISLPGTWARERQLVREEIHSGIHTIGSTRGASSHQQNPFAALVRPETTELSGEVFGFSFIYSGSFQFTFEKDPFDQLRINMGFNSLNFNWILGSKQEFQTPESVLAYSDQGLNGLSQIYHQLYRENLMRGAYQKCERPILVNNWEATYFDFDEAKIKTLIEESSALGIELFVLDDGWFGKRNSDKTSLGDWEINLEKLPNGLNGMNETAKECQMKFGLWFEPEMISEESELYKEHPDWVLRVPNRPMSRSRDQFVLDFSRADVRIYIYQKMAEILSTHSISYVKWDFNRHLSEVYSDALPAKQQGEVHHRYLLGLYEFLEKLTTSFPTVLFESCSGGGGRFDPGMLYYMPQTWTSDNTDAVARLKIQYSTSLVYPVITMGSHVSAIPNHQTGRETSLEMRGAVAMSGVFGYELDVNSLTKEEKKEIKEQVTFYKEHRQLIQFGLFYRLLSPFEGNQTAWCFVSKDQKECLVFYFNVLEEASAPLTLLKLAGLQDNELYHSDELGTFSGSELMHAGFYTSTKKIGDFRSECYYFKTE

SEQ ID NO: 608 - DNA, 1425 bp, Thermus sp. T2
atgaggcttgtactgggcggcttggaggtgcccctgaaggcccaaggggtggaggtcttggaagacggggccctcctatggggctcagaggtacgggtccacgctccttttcgggcagaggcctttttccgccacggctggcaaagctggagcttggcggcctgggtagggtttgggtccaagaggcccctacttcctccagaacggaggccccaagcagatgacccttttctcctggaaagtgaggagctttgggggagtggcctaggggccctgaggcagagggaacgggtcctcctcctcggggccttagaccctggggcccgggtcctggggcgggaaggcctcctcctcgggcggtacgcgggggaagggggacgctggtttttggcggtgggacaggaggaggaggtttttgctgcctacgctgagcggctccccgggaggacccagaacccctctcctcgggtttggtgcagttggtatagcttctatacccggattagccaggacctttttcttgagatcctggagagtctaaagggttttccctttgaggtctttcaggtggacgacggctggcaacgggccttgggggattgggaacccaacgcccgtttcccccaggggatggcctacctagctggtcagattcgagcgcgaggtttccggccggggctttggctcgccccctttctggttaccgaggatagttccctcttccaagagcgccccgagtggctcctaagagatggagagggccggcttatccccgcgggcttcaactggggaaagcccctcttcgccctggatagcggtcaggaggaggtgctggactggttggaaatgctcattcggaaggtagtggcctggggctatgactacctaaagctggacttcctctatgcgggagccctcccgggagcagaaggggaggcccgctaccgccgcgccttggaacgcatccgaagggcggcgggaggtacctacctcctcttttccggggcccctatcctagcctccttgggcctagccgacgggcttcgggttggccccgacgtggccccctactgggacaacgaagaccgttctgtccacctcggagaccccacgggacccgggcttaggaacgctctccgttccactcttcaccggctgtggcttaaaaggaaagtacatgtggaccccgatgtggtctactttcgtcagcgctttaacctcctttctccctctgagatgcgcctacaacaagccatggcggaaatcaccggctttaaggccacctccgacccaccggcctggcttgctccggaagagaaggaggctctgatccgctttctcggccaggaccttcccgtggtccctttggcaccctaccgcttccgtgtaggggaggaggaggtggactatgccccctttccataa

SEQ ID NO: 609 - protein, 474 aa, Thermus sp. T2
MRLVLGGLEVPLKAQGVEVLEDGALLWGSEVRVHAPFRAEAFFRHGWQSWSLAAWVGFGSKRPLLPPERRPQADDPFLLESEELWGSGLGALRQRERVLLLGALDPGARVLGREGLLLGRYAGEGGRWFLAVGQEEEVFAAYAERLPGRTQNPSPRVWCSWYSFYTRISQDLFLEILESLKGFPFEVFQVDDGWQRALGDWEPNARFPQGMAYLAGQIRARGFRPGLWLAPFLVTEDSSLFQERPEWLLRDGEGRLIPAGFNWGKPLFALDSGQEEVLDWLEMLIRKVVAWGYDYLKLDFLYAGALPGAEGEARYRRALERIRRAAGGTYLLFSGAPILASLGLADGLRVGPDVAPYWDNEDRSVHLGDPTGPGLRNALRSTLHRLWLKRKVHVDPDVVYFRQRFNLLSPSEMRLQQAMAEITGFKATSDPPAWLAPEEKEALIRFLGQDLPVVPLAPYRFRVGEEEVDYAPFP

SEQ ID NO: 610 - DNA, 2186 bp, Phanerochaete chrysosporium
ggggcggctggccgggaaggtatgtcttcatttccctcatgatcttcgtgcgcatgtttctcatccacagtgaatatataagaagcctcgtttctggggcattgcacgagctgcagcagccttgacgcggacaactaggctacgatgcttccgcttgcgtctctcgtcctgcttagttctctccactggactgctgttttagcagcagataatggtctcgccatcactccacagatgggctggaacacctggaaccacttcggatgcgacattagcgaagacacgatcctcagcgctgcgcaggcaatcattgcaaacaacttgacagaccttgggtacgaatgtaaggccactgctctctgctcatcctctcgctcacgactgatatgtgccagatgtcatcatggacgattgtgagtagtccgtgcgttcgagataaactatgctagactcgccgttcgctcgtctaggctggcacgcaccttcccgagacaaccagacaggtgcgccggttgccgacccagccaagttcccgaacggaatcaaggacctctcagacaagatccacgcaatggggttgaaggtaacgtgagcatcaatgcagctggtacgtctatgttaacaacagatatgtcagtttggtatttatagcgacgccgggacgcaagtatttgcctgtagacagactacttcggtatcgactgaatgtcacaatccagatacacctgtggaggacgctttggttcactgggctacgaagacatcgacgcgaagacctacgccgagtggggcgtcgattacctgagtaaatactatactctacctcgtcattctcgttgtattcacctcccttccccgcagaatacgacaattgctacaacgagggactctccggaacgcctcatatatcgcacgagaggtatgcgaacatgtcaagagcattaaatgccacgggtcgtccaattctctactcaatgtgcaattggggagaagacggcccttggaactttgctcaggtgcggtataatagtctcctttccagttttcgaaacatttttgaccactgtcatgctccagaacatcgcgaacagctggagaatttccggagacatcatggatgtaggcttgacctgtcttgccttcgtgttatctgctgatttccgcctcagaacttcgatcgctacgacgaccgctgtccgtgtacgtccgtgatagattgcaaacttccaggatttcgtgagttgtttacacctattgtatgatcctatagcctctaattaacactttcagactgcgcgatgacgcggattatcgactttgccgctccagtcggacagaaggcgggaccaggtcattggaatgacttggacatgctggagattggcaatggtggcatgacattcgatgaatatggtgtggtctcatttccggcaaagcagccaaggcaagactttgacctagcatcgtctgcagtgacccatttctcgatgtggagcatcctcaaaagtccgttgatcctcggaaacgatgtcacaaacatggtcagttctcgcgcgtccgcggcaaattcacgcattgtcctgacacggtgcctggatagacgaatgagactctgacaatcatcacgaacaaggccatcatcgacatcaaccaggatgccgcgggctctccgacgaatcgcatgtggaagaggtctgttgatgaaggaggcgacctgtcgctatgggctggaagcctcgtgaacaagtgagtctcaatgatcgatcctcagcttcatgttgtgacacttcttgcgccagcacatacgtatttgccctactgaacacttccccggcggagcagaccgtccaggtagactttgtagacgtcttttttgaccaggtgcggagtgattgtggacccaacgacgacaaaagctgataacgggtactgcaggggaaagtttaccagacgcaaccatacgaagtctttgacttgtggcagaaagacgatgaaggtacctggggcaagtcctttggcattatacaaggcagcatgaatgtcactatcggcgtacaccaaacaaaggtatggaaggcggtacctgcgccgcagactagtacaagaagggactatgcagagttgtaaatagcacccgatcgttgtgcaagaatatcagacggcatcttgaaataaaaaaaaaaaaa

SEQ ID NO: 611 - protein, 438 aa, Phanerochaete chrysosporium
MLPLASLVLLSSLHWTAVLAADNGLAITPQMGWNTWNHFGCDISEDTILSAAQAIIANNLTDLGYEYVIMDDCWHAPSRDNQTGAPVADPAKFPNGIKDLSDKIHAMGLKFGIYSDAGTYTCGGRFGSLGYEDIDAKTYAEWGVDYLKYDNCYNEGLSGTPHISHERYANMSRALNATGRPILYSMCNWGEDGPWNFAQNIANSWRISGDIMDNFDRYDDRCPCTSVIDCKLPGFHCAMTRIIDFAAPVGQKAGPGHWNDLDMLEIGNGGMTFDEYVTHFSMWSILKSPLILGNDVTNMTNETLTIITNKAIIDINQDAAGSPTNRMWKRSVDEGGDLSLWAGSLVNNTYVFALLNTSPAEQTVQVDFVDVFFDQGKVYQTQPYEVFDLWQKDDEGTWGKSFGIIQGSMNVTIGVHQTKVWKAVPAPQTSTRRDYAEL

SEQ ID NO: 612 - DNA, 2185 bp, Phanerochaete chrysosporium
ggggcggctggccgggaaggtatgtcttcatttccctcatgatcttcgtgcgcatgtttctcatccacagtgaatatataagaagcctcgtttctggggcattgcacgagctgcagcagccttgacgcggacaactaggctacgatgcttccgcttgcgtctctcgtcctgcttagttctctccactggactgctgttttagcagcagataatggtctcgccatcactccacagatgggttggaacacctggaaccacttcggatgcgacattagcgaagacacgatcctcagcgctgcgcaggcaatccttgcaagcaacttgacagactttgggtacgaatgtaaggccactgctctctgctcatcctctcgctcacgactgatatgtgccagatgttatcatggacgattgtgagtagtccgtgcgttcgagataaactatgctagactcgccgttcgctcatctaggctggcacgcaccttcccgagacaatcagactggtgcgccggttgccgacccatccaaattcccgaacggaatcaaggatctctcagacaagattcacgcaatggggttgaaggtaacgtggccatcaatgcagctggggcacctatgttgacagcacgtgcgtcagtttggtatttatagcgacgccgggacgtaagtatttggctgtcgacagactacttcggtatagactgaataccacgtttcagatacacctgtggagggcgctttggttcactgggctacgaagaaatcgacgcgaagacctacgccgagtggggcgtcgattacctgagtaaatactatactctacctcttcattctcgttgtattcacctcccttccccgcagaatacgacaattgctacaacgagggcctctccggaacgcctcatatatcgcacgagaggtatgcgaacatgtcaagagcattaaatgccacgggtcgtccaattctctactcaatgtgcaattggggagaagacggcccttggaactttgcacaggtgcggtataatagtctcctttccagttttcgaaacaattttgactactgtcattctccagaacatcgcgaacagctggagaatttccggagacatcatggatgtaggcttgacctgtcttgccttcgtgttatctgctgatttccgcctcagaacttcgatcgctacgacgaccgctgtccgtgtacgtccgtgatagattgcaaacttccaggatttcgtgagttgtttacacctattgtatgatcctaaagcctctaattaacactttcagactgcgcgatgacgcggattatcgactttgccgctccagtcggacagaaggcgggaccaggtcattggaatgacttggacatgctggagattggcaatggtggcatgacattcgatgaatatggtgtggtctcatttccggcaaagcagccaagacaagactttgacctagcatcgtctgcagtgacccatttctcgatgtggagcatcctcaaaagtccgttgatcctcggaaacgatgtcacagacatggtcagttctcgcgcgtccgcggcaaattcacgcagtgtcctgacacggtgcctggatagacgaatgagactctgacaatcatcacgaacaaggccatcatcgacatcaaccaggatgccgcgggctctccggcgaaccgcatgtggaagaggtctgttgatgaaggaggcgacctgtcgctatgggctgggagcctcgtgaacaagtgagtctcgtgctcgatcctcagcttcgtttcgtgacacctcttgcgctagcacattcgtatttaccctactgaatacttcaccggcggagcagaccgtccaggtagactttgcagacgtcttctttgaccaggtgcggagttattgtggactcaacgacgacaaaagctgatgacgggtactgcaggggaaaacctaccagacgcaaccatacgaggtctttgacttgtggcagaaagatgatgaaggtacctggggcaagtccattggcattatacaaggcagcatgaatgtcactatcggcgtacaccaaacaaaggtatggaaggcggtacctgcgccgcagactagtacaagaagggactatgcagagttgtaaatagcacccgatcgttgtgcaagaatatcagacggcatcttgaaataaaaaaaaaaaaa

SEQ ID NO: 613 - protein, 438 aa, Phanerochaete chrysosporium
MLPLASLVLLSSLHWTAVLAADNGLAITPQMGWNTWNHFGCDISEDTILSAAQAILASNLTDFGYEYVIMDDCWHAPSRDNQTGAPVADPSKFPNGIKDLSDKIHAMGLKFGIYSDAGTYTCGGRFGSLGYEEIDAKTYAEWGVDYLKYDNCYNEGLSGTPHISHERYANMSRALNATGRPILYSMCNWGEDGPWNFAQNIANSWRISGDIMDNFDRYDDRCPCTSVIDCKLPGFHCAMTRIIDFAAPVGQKAGPGHWNDLDMLEIGNGGMTFDEYVTHFSMWSILKSPLILGNDVTDMTNETLTIITNKAIIDINQDAAGSPANRMWKRSVDEGGDLSLWAGSLVNNTFVFTLLNTSPAEQTVQVDFADVFFDQGKTYQTQPYEVFDLWQKDDEGTWGKSIGIIQGSMNVTIGVHQTKVWKAVPAPQTSTRRDYAEL

SEQ ID NO: 614 - DNA, 2400 bp, Zygosaccharomyces mrakii
ccgcattccaaggggcggggagcaaatacccgcctgtaacatgagaaagtttctgcaataggtcgatacctcttcaacactggttgctagcatgggcttttccccgatcttgctattgaaggcggggaagggtagtacatgattcacgaagagttagatatgttcaattacgtattgggtccgttctaggaatctgctactgcatgtgcacatggtgggatgatgatgaaggggaaggagaagcagaaggagaaggagtgtgggggagtgtgcctccaggatatctgtaaagggaagtccattaattcgagcacgttcaatccaacaaaagttcccttggtgtttcagtttcaattgatgaccaacataccttcaggactactgtagtccgaggaattgacaatagaacaggtagacttgtgaattcgcaggaagtgaaaaaccacttgactatgaacgagtctactgaccaggatgtgaaggatgacatataaaagagccaggattttccagtttaagcagatgttcacaggtaggatccgctgtagaacagtatagtacagcaactcactatgttttctttgctacttttgacatctactgcgcttgtagaaacagctctcggtgtgagccccagttacaatgggctcggcctcactccccagatgggatggaacaattggaacacgtttgcgtgcaacgtcacggagcaattgcttttgggaaccgctgacaggatctcagaattgggactgaaggatgtaggttacaactatgtcattttggatgattgttggtctggtggcagaagctcgaacgggtctcttgttcctgaccttaacaagtttcctcacggaatgaaatacgttgcggaccacctgcacgaccaggatcttcttttcggaatgtattcctctgcaggtgagtatacctgtgctggctaccctggctcgttgggtcacgaggagaaggatgcccagttctttgcaagaaacgaagttgactacttgaaatacgacaactgctataacaagggccaattcggtactcctcaagcgtcttatgagagatataaagccatgtcggatgccttgaataacactggtagaccaattttctactccctgtgcaactggggtcaagatttgacattttactgggggtctgcgattgctaattcatggagaatgagtggagatatcactgcggattttgatcgtcctgacagcagatgtccttgtggtgatgacgagtatgattgtaaatacgcagggtatcattgctcaatcatgaatattttgaataaagcggcaccaatgggccaaaatgcaaacccaggtggttggaatgatctagacatgttggaagtcggagttggtaatttgaccgatgatgaagagaaagctcatttctctatgtgggctatggttaggtcacccttgatcattggtgctgatgtcaatcacttaaagccttcctcattctcgatttacgctcaatctccggttattgccatcaaccaggatccaagaggtgttccagcaactagggtttggagacgtcaagtatcagatactgacgcctacggaagaggtgaagttcaattttggagtggtcctcttgagaacggcgatcaagttattgcatttttgaatggtggaaacagaatgaggcctatgaacgctggattggatgacatctttttcgacagtcacccgggcgctcctgaattaaattctacctgggctgtttatgacctatgggccaatagaatggaagatagtgtcgcatccgacattttaaatggtaatagatcttctaatgggttgctttacaacagtactcaacagtcttactcacagggtctggcaagaaatgatagcagattgtttggatcccaaattggcactattcaagcaggtggaagactgaatgttactgtaccagcacatggtgtcggcctttacagattgagacttcaataaataagttgtctagcactttagttacgaataaatgatcgatttctctacaacatactttctatattgcaggtgcacagggccatttctacgtcgaaattggcaacttgtgtatttttcatctcaaatatctttttaaaacaacttatcattattgatgttcatttcttctggcagcttaatggtctgaacacatttccgtctagaaattgttttgaattatagggatttgaagattaaaaagagcgcttcgcactgttatcagaaaaaatcaaattataaatagaatcttattacgctgaagaaaattcttgaaaacattggttgtagagcgatatcgattggatcatcacatttttatttgacttatggaccttgtccctaaaaaacataaattaaataataagtaggctcatta

SEQ ID NO: 615 - protein, 470 aa, Zygosaccharomyces mrakii
MFSLLLLTSTALVETALGVSPSYNGLGLTPQMGWNNWNTFACNVTEQLLLGTADRISELGLKDVGYNYVILDDCWSGGRSSNGSLVPDLNKFPHGMKYVADHLHDQDLLFGMYSSAGEYTCAGYPGSLGHEEKDAQFFARNEVDYLKYDNCYNKGQFGTPQASYERYKAMSDALNNTGRPIFYSLCNWGQDLTFYWGSAIANSWRMSGDITADFDRPDSRCPCGDDEYDCKYAGYHCSIMNILNKAAPMGQNANPGGWNDLDMLEVGVGNLTDDEEKAHFSMWAMVRSPLIIGADVNHLKPSSFSIYAQSPVIAINQDPRGVPATRVWRRQVSDTDAYGRGEVQFWSGPLENGDQVIAFLNGGNRMRPMNAGLDDIFFDSHPGAPELNSTWAVYDLWANRMEDSVASDILNGNRSSNGLLYNSTQQSYSQGLARNDSRLFGSQIGTIQAGGRLNVTVPAHGVGLYRLRLQ

SEQ ID NO: 616 - DNA, 2506 bp, Thermus thermophilus
ggatcctcaggggcttcttcgcctccattcccaaggagctggaggaggcggccatggtggacggggccacgcccttccaggccttccaccgggtgatcctgcccctggccctcccgggcctcgcggccacggccgtctacatcttcctcaccgcctgggacgagctcctcttcgcccaggtcctcaccaccgaggccacggccaccgttcccgtgggcatccgcaacttcgtgggcaactaccagaaccgctacgatctggtcatggccgccgccacggtggccacgctgcccgtcctcgtcctcttcttcttcgtgcagcgccagctcatccagggcctcaccgccggggcggtgaagggctaggttcttggaggagaaacgcctatgaccgagaacgccgaaaaattcctttggggagtggccaccagcgcctaccagattgagggggccacccaggaggacggccgggggccttccatctgggacgccttcgcccagcgccccggggccatccgggacgggagcacaggggagcccgcctgcgaccactaccgccgctacgaggaggacatcgccctgatgcaatccctcggggtgcgggcctaccgcttctccgtggcctggccccggatcctccccgagggccgggggcggatcaaccccaagggcctcgccttctacgaccgcctggtggaccggcttctcgcttccgggatcacgccctttctcaccctctaccactgggacctgcctttggccctggaggagcggggaggctggcggagccgggaaaccgccttcgccttcgccgagtacgccgaggcggtggcccgggccctcgccgaccgggtgcccttcttcgccaccctgaacgagccctggtgctcggccttcctcgggcactggacgggggaacacgcccccggcctcaggaacctggaagcggccctccgcgctgcccaccacctcctcctgggccacggcctcgccgtggaggccttgagggccgcgggggcgaggcgggtggggatcgtcctcaacttcgccccggcctacggcgaggaccccgaggcggtggacgtggccgaccgctaccacaaccgcttcttcctggaccccatcctgggcaaggggtatcccgaaagccccttccgagaccccccgcccgtccccatcctctcccgcgacctggagctcgtggcaaggcccctggacttcctgggggtgaactactacgcccccgtccgcgtggccccggggacggggaccttgcccgtgcgctaccttcccccggaagggccggccacggccatggggtgggaggtctaccccgaggggcttcaccacctcttgaagcgcctcggccgggaggtgccctggcccctttacgtcacggaaaacggggccgcctaccccgacctctggacgggagaggccgtggtggaggaccccgagcgggtggcctacctcgaggcccacgtggaggccgccctccgggcccgggaagaaggggtggacctccggggctacttcgtctggagcctcatggacaactttgagtgggccttcggctacacccggcgcttcggcctctactacgtggacttccccagccagaggcgcatccccaaaaggagcgccctctggtaccgggagcggatcgcgcgggcccagacctaagtgccccgccagaggggcgggccctaaaactcaaagaaggccgggacgaaggcgtagccctccccttcccgccggatgtacccgacggcgggccaggggaagtggtaggcggtgatcaggctccgctcctccgagaccttctggaagaggcgggcccgggtccgcaccacctgcgccttgtccatgtcaaaggccaggtaggcctgggggaagcggagggagaggaggtagtggcccgccgcatccccaaaaatgaagagcctctttccctcggagatgcctcgaggctcatgtgccccggggtgtggccgaagaggccaccgcccgcacccccgggaggatctcctccccgtcctccacgggccggatgcgctcctttaggggcacgagggccctttgcaccgcgggcgaggggttttgaagccagaactccaggtccacccggcccatgaggtgctccgccttggcgaagacgggccgcccctccccgtccaccagacccccgatgtggtcggggtggccgtgggtgaggaagacgtgggtgatgtcctcgggaaggtagccggcaagctccaggtgggcgaggagccgccccccacttcccgcacccctccccgtgtccacgaggagcctggcctcccccaggtccaggagcaccgggttgaagttgttgcgggtggcctccgggtccaggaagtgctccacgagcgtcctgcggaaggcctcctggagctccgggttcgccccccagttggggaggagggggcctggaggggactggccgtcggagaggaccaccgcctggatcccccctacccggaagc

SEQ ID NO: 617 - protein, 431 aa, Thermus thermophilus
MTENAEKFLWGVATSAYQIEGATQEDGRGPSIWDAFAQRPGAIRDGSTGEPACDHYRRYEEDIALMQSLGVRAYRFSVAWPRILPEGRGRINPKGLAFYDRLVDRLLASGITPFLTLYHWDLPLALEERGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRFFLDPILGKGYPESPFRDPPPVPILSRDLELVARPLDFLGVNYYAPVRVAPGTGTLPVRYLPPEGPATAMGWEVYPEGLHHLLKRLGREVPWPLYVTENGAAYPDLWTGEAVVEDPERVAYLEAHVEAALRAREEGVDLRGYFVWSLMDNFEWAFGYTRRFGLYYVDFPSQRRIPKRSALWYRERIARAQT

SEQ ID NO: 618 - DNA, 2958 bp, Torulaspora delbrueckii
aagcttgacagctgcgaaatcgttggggaaaatataggtattctcgtaagcaggattcgatgaacctgaagccctagtgttattgggacacaagtaacattttgggtcgtattcaggcgcatcattcttagatggtgcctcttggctctatgaggcgagacaaggacccaggagtccgtcaatggattcacacgtttgaaggaacagtaaatttaccaacatcgatagtttaactgagtatacatagttgacctaatcctcgccaaacactatcaatcaagacgtgacaagcaacacttcttcatcacggcatgctctcccccacgccaaattaaacgaaataaaaacctactcaaacgttcaaacagcgtttaccaacgctgctggtgacaacataatgaaaaaaaatggtttagcgccccctcaagaaaacaaatcaatctacctcgcaccccggctttttttttcatgatgacgtgtttttcgacctcggaacactgtcgagcgatacgaagagtcgcacctctttgagtagttcgttagttagtcatccggttcctgtggttacgcgtgcctggcgggggtgagaaggcatagagcagagaatggagcagaattggatcaagatcctaaaaagtagaagtatgatatcctcctaccttgcatgagggtacgaggattgctaccccaacgagatgttgaagtgacgggtgagtaaaccgcagagttgagttggcccgtcgggggggggggggttctagcagcttttgttagggccgtgaagcctaaacgaaatattgttgggttgtacatagctagtggtaggtagagttcgaattcatgacgagctgatatgggaaaaaaaggtataaaatgggcaggatgtaagagtagttgagcagtaggttgtttagttgctctcaaaccatcgaggattcacgaattcgatgattaacttttctttattaactagcattgttttgctcgctagcaaagttgttggtgtatcgccaagctataatggtctcgggctcaccccgcagatgggttggaacaactggaacacttttgcttgtaatgtgagcgaagaccttctattgagtacagttgataggattgccgcccttggtttgagagacattggctaccactacgtcattctagatgactgttggtcagatggtagagattctgacgggatgttagtcccagactctacgaagttccccaacggtatgaaacatgttgcagattatctgcatggaaaggatttcttatttggtatgtattcctcagcgggtgagtatacttgtgctggctacgccggttccctggaccatgaagaagacgatgcagccttttttgccaagaacgaagtggattatttgaaatatgacaactgttacaatcgtggtcagtttgggactcctgaaacttccttcaatcggtatcgcgctatgtcggaagccttgaacaagacagagaggccaattttctactcattgtgtaactggggccaggatttgaccttctactggggttccggaattgctaactcttggagaattagtggcgacatcacagcggagtttgaccgtcccgatagcagatgtccgtgcgatggagatgaatacgattgcccctacgcaggtttccactgttccatcatgaacattttgaacaaagcagcaccaatgggacagaacgcaggagttggaggttggaacgacttagactgcttggaagtcggtgtcggcaatttgacagatgatgaagaaaaagctcacttctccatgtgggctattgttaagtctgcaatggttattggtgcagatgtcagaaatttgaagccttcttccttctcgatatacagtcaggcctcggttctagccatcaaccaggatccagccggtgctccagccattagagtgtggagacgttatgttcccgagactgatcaacatggccaaggtgaagttcaattatggagtggtccgcttgacaacggtgatcgtgtcgtagctttgttgaatggcggagcaaaggagagaccaatggtagcctacttggaggacattttcattgacagcttcgtgggttccgaagagctatcatccacttggaacgtttatgacctatgggccaacagaattgacgattccaccgcttctcagattttggttggaaatcgcactgcaaatggcttattgtataatgcgacacaactttcctacgctgatggtctgaaggccaacgatacaagattatttggtgaaaaagttggtaccattgagccttatggattgttgaacgtgacagttcctgcccacggagtcggcctattcaggttaagaagagagagtagaaagtagtagactagcaatttttatacgatttttcatgaatacgatggatgcttatgagagtttagcacactgtcaaaggggtaatcgctcttgatctcttgaagttttcacagaagtttgttatgtctgaccgtgtctaccagttataaaaacttgcgttgccgggataaatttcagtacgtaagtcctttttcactaattatccagtaaaaacataatatgttcttcaaaggcagagcttgaaattgaaatcacttatgaaggtatccttaggaatgacacatctgattgcaagttgaacgaaggttaggattaaaatacagtgcatacccgtccagagttgcatttacgtagtgtaagataaagttttactcttgaatttcgctattgcaaacaaacctgtcttgccttttcaatagacttcatgaattttgaggtccctgctctatccagggagacctaccaatgagaagctacccatttaagccagtatcaaagcgttctattctttagatccattgcgggaactactctccccaaacgacaggatcacttcttcgtaccataccctgtattaagtaagttgaagctt

SEQ ID NO: 619 - protein, 474 aa, Torulaspora delbrueckii
MINFSLLTSIVLLASKVVGVSPSYNGLGLTPQMGWNNWNTFACNVSEDLLLSTVDRIAALGLRDIGYHYVILDDCWSDGRDSDGMLVPDSTKFPNGMKHVADYLHGKDFLFGMYSSAGEYTCAGYAGSLDHEEDDAAFFAKNEVDYLKYDNCYNRGQFGTPETSFNRYRAMSEALNKTERPIFYSLCNWGQDLTFYWGSGIANSWRISGDITAEFDRPDSRCPCDGDEYDCPYAGFHCSIMNILNKAAPMGQNAGVGGWNDLDCLEVGVGNLTDDEEKAHFSMWAIVKSAMVIGADVRNLKPSSFSIYSQASVLAINQDPAGAPAIRVWRRYVPETDQHGQGEVQLWSGPLDNGDRVVALLNGGAKERPMVAYLEDIFIDSFVGSEELSSTWNVYDLWANRIDDSTASQILVGNRTANGLLYNATQLSYADGLKANDTRLFGEKVGTIEPYGLLNVTVPAHGVGLFRLRRESRK

SEQ ID NO: 620 - DNA, 1518 bp, Penicillium purporogenum
cttcaatcggtgaatcctgtatttgagccaaaggagcctggaacacttccaaggttgtgattgtctgacttcaaactgaaacatacaatgttaagtagtgtaactgtagcggccttgctgctgactctgaagtgtgcagatgcattgatacttcctgatgatgtgggaagattaccagctctaggctggaactcatggaacgcctacggttgcaatgtcaatgagaccaaaatcgtgacagctgccaccaaactcaacacaaccggtttacaggccctgggctaccaatacgtcaacattgatgactgctggtctgttaaatctggtcgtgataatgtcacgaatcgcattatcccaaatcctgacactttcccgaatgggatcaatggtaccgctcagcaggtccatgatcttggtttgaaaatcggtatatacagtagcgccggatatgagacgtgtgctggttatccagcaagtctcgggtacgagacaatcgatgcccagacctttgctgaatggggcattgattatctcaaatatgacaactgcaactacccctccgagtgggatgacgaatacaatgcctgtatccccgacagcgactatcccggcgtcaaccctaacggcacttgtccaggcctcacaaacccagctcctgcaggctatgactggagtacctccaacaccacgaaacgattcaatatcatgagagatgccttggtcgctgttcaagatcaacgcgttattctgtattcactgtgtgaatggggatatgccgacgtcccatcttggggtaatggcactggtaattcgtggcgtgtaactggtgacatcaacgcaacatgggatagaatcacagctatcgccaacatgaacgctcatgagctatcaagtgtcgacttctggggccacaatgacccagacatgttggaagtcggcaatggagacttgacgatcgaggaaaaccgtgcccatttcgctctttgggcaatcatgaagtctcccctgatcattggaacagatttgtcaaccctccccgacacgcacctctccatcctcaaaaacgccgacctgatcgccttcaaccaagatcccgtaatcggcaaaccagctcttccatacaaacaaggctacaacaacggcacatacaaccccaactacccgcccgagtactggtctggcgcaacctcttatggctggaacctggtgctacttttcaactccgaggatgtcgctgctagtagatctgctgtgtggagtgaaattccgcaactgggtaagcatagcaataggtatagggtggaggatgtttggactggaaaagatttgggctgtgtgcataaggagtatactgcgcagttggaggcgcatgatgttgcggtgcttaaagtgactggcacttgctaacctgtcaactctgactatgttgaggcgcgaaaggctgttatgggaatgatgtattgagcccgaaaatctggatttgcgatactaaaatacaagaaccatgttcctcgcatt

SEQ ID NO: 621 - protein, 439 aa, Penicillium purporogenum
MLSSVTVAALLLTLKCADALILPDDVGRLPALGWNSWNAYGCNVNETKIVTAATKLNTTGLQALGYQYVNIDDCWSVKSGRDNVTNRIIPNPDTFPNGINGTAQQVHDLGLKIGIYSSAGYETCAGYPASLGYETIDAQTFAEWGIDYLKYDNCNYPSEWDDEYNACIPDSDYPGVNPNGTCPGLTNPAPAGYDWSTSNTTKRFNIMRDALVAVQDQRVILYSLCEWGYADVPSWGNGTGNSWRVTGDINATWDRITAIANMNAHELSSVDFWGHNDPDMLEVGNGDLTIEENRAHFALWAIMKSPLIIGTDLSTLPDTHLSILKNADLIAFNQDPVIGKPALPYKQGYNNGTYNPNYPPEYWSGATSYGWNLVLLFNSEDVAASRSAVWSEIPQLGKHSNRYRVEDVWTGKDLGCVHKEYTAQLEAHDVAVLKVTGTC

SEQ ID NO: 622 - DNA, 1226 bp, Mortierella vinacea
aaatgctcagcaacactcaaattcttactatccttggtctttccgtggtccaagtaatgggtatcattgaccctagccttgccaaaacaccccaaatgggctggaactcttggaacaaatatcagtgtaatgtgaatgaaactgtcatcatcaacactgccaatgccatggtttcaagtggcctcaaggacttaggataccattatattaacattgatgattgctggtcattgcatcaacgtgacaatactactcagcgcattgcgcctgaccctaccaaattcccaaatggtatctcaggtgttgcttctaaggttcatgcacttggcctcaagttcggaatatattccgatgcgggtaccaacacctgtgccggttatccaggatcatatggatatgaagcgatcgacgcacaagctttttctgattggggagttgattacctcaagtacgacaactgtaacaaccttggcttagctggaaatgctaccatttccagcaaacgttataagcgtatgggagatgctctcaagaacgtcagtagacccatattcttctccttgtgcagctggggcacggacgacgtttgggactggggtcgatccattggaggccaatcatggcgcatgtctggcgacatttccgacaactggtctagcgttgtgtccatcacgggtcaagcggtacctattgccaatatctcagcccctggtggatggaacgatatggatatgttggaagtcggtgtacacgatcaaatgaccatcactgagtacactagccacttttcaatttgggctgccatgaaaagccctttgattcttggaaatgatatcaccaacatgacaaatgatattaagaacatcattacaaacaatgaggtcattgccatcagtcaagactctctaggagcatctgtgcaacaaagatccatgaagggaaatactcaattgtttgcaggtcctttatctaagaatggctatgtctctctattcttgaatgagggtaactcgacaactaatatgaccggtacctggtctgagatcttcaataatcccaaggcaaacacacacaagtctatcgctgtacgcgatctctgggcacacaaagacttgggcagattccagggtagcattagcgttagtgttgagtcacatggagttcgtatgttgaaattcagtcaacaagcttaaaatccaatgcaaataaacgtatgatttacccac

SEQ ID NO: 623 - protein, 396 aa, Mortierella vinacea
MLSNTQILTILGLSVVQVMGIIDPSLAKTPQMGWNSWNKYQCNVNETVIINTANAMVSSGLKDLGYHYINIDDCWSLHQRDNTTQRIAPDPTKFPNGISGVASKVHALGLKFGIYSDAGTNTCAGYPGSYGYEAIDAQAFSDWGVDYLKYDNCNNLGLAGNATISSKRYKRMGDALKNVSRPIFFSLCSWGTDDVWDWGRSIGGQSWRMSGDISDNWSSVVSITGQAVPIANISAPGGWNDMDMLEVGVHDQMTITEYTSHFSIWAAMKSPLILGNDITNMTNDIKNIITNNEVIAISQDSLGASVQQRSMKGNTQLFAGPLSKNGYVSLFLNEGNSTTNMTGTWSEIFNNPKANTHKSIAVRDLWAHKDLGRFQGSISVSVESHGVRMLKFSQQA

SEQ ID NO: 624 - DNA, 1783 bp, Thermotoga neapolitana
agagcacctcgtatccaccagtctgaacacgggaaaaaccatctatgtgaggtgatctgtgtggagatcttcaaaagaccgttcagagaagggagcttcgttctgaaagagaaggactacaccgttgagttcgaggtggagaagatccatcttggatggaagatttcagggagagtgaagggaaatcccggaaggcttgagatctttcggacaaacgcaccgaagaaactcctcgtgaacaactggcagtcctggggaccctgcagggtggtggatcttccatccttcaccccacccgagatagatccaaactggcagtacacggcctctgtggtaccggatgtgatcaaaaaccgtcttcagagtgactacttcgtggcagaggaagggagagtatacggttttttgagttcgaagatcgcacatcctttctttgcggcagagaatggagaacttgttgcgtatcttgagtacttcgatgtgaagttcgatgacttcgttccgatagaaccttttgtcgttcttgaagatccaaacacctctctccttctggaaaagtacgctgaactcgtcgggaaggaaaacagcgcgaggattccagaacgtacaccggttggatggtgcagctggtaccactatttcctcgatctcacctgggaggagactttgaagaatctggaacttgcaggagagtttcccttcgaggtctttcagatagacgacgcgtatgaaaaagacatcggagactggctcgtcacgaagaaagacttcccatctgtggacgagatggcaaggacgatacaggagaaaggctttgttcctggtatatggaccgcaccgttcagtgtttcagaaacatcggatgtgttcaactcctatccggactgggtcgtgaaggaaaacggaatgccaaagatggcgtacaggaactggaacagaaagatctacgctcttgacctttcaaacaaagaagtcctggactggctcttcgacctcttcagctctctcaagaagatgggctacagatacttcaagatcgactttctctttgcaggagcgattccgggtgagaggaaagaaaacatcacacccgttcaggcgttcagaaaggggatggaggtgatcagaaaggcggttggagacttgttcatactcggatgtggctctccccttcttcctgcggtgggctacgttgacggcatgaggatagggccggacaccacacccttctggggtgatcaaatagaagacaacggagcacccgctgcaagatgggctctgagaaatgccatcacacgttacttcatgcacgacagactctggctgaacgatccggactgcctcatcctgagagaggaaaaaacagaactgaccccaaaagagagagagctctactcgtacacctgtgggatcctcgacaacatgatcatagaaagtgacgacctgtcacttgtgaaagagcacggaaggaaggttctgagagagacactcgatcttctcgggggaaagccccgtgttctgaacatcatgacagaggatctgaagtacgagatcgtctcgtctggcacgatctctggaaacaccaggctcgttgtcgatctcaaaaacagagagtaccatctggaaaaagagggaaagtcctctctgagaaagaaggttgtcaaaagagaagacggaagaaacttctacttctacgaagagggtgagagagaatgagagagaatgatggaactcaggtacaacccgctcacagacgaatgggtgatcatctccgctgcaacac

SEQ ID NO: 625 - protein, 551 aa, Thermotoga neapolitana
MEIFKRPFREGSFVLKEKDYTVEFEVEKIHLGWKISGRVKGNPGRLEIFRTNAPKKLLVNNWQSWGPCRVVDLPSFTPPEIDPNWQYTASVVPDVIKNRLQSDYFVAEEGRVYGFLSSKIAHPFFAAENGELVAYLEYFDVKFDDFVPIEPFVVLEDPNTSLLLEKYAELVGKENSARIPERTPVGWCSWYHYFLDLTWEETLKNLELAGEFPFEVFQIDDAYEKDIGDWLVTKKDFPSVDEMARTIQEKGFVPGIWTAPFSVSETSDVFNSYPDWVVKENGMPKMAYRNWNRKIYALDLSNKEVLDWLFDLFSSLKKMGYRYFKIDFLFAGAIPGERKENITPVQAFRKGMEVIRKAVGDLFILGCGSPLLPAVGYVDGMRIGPDTTPFWGDQIEDNGAPAARWALRNAITRYFMHDRLWLNDPDCLILREEKTELTPKERELYSYTCGILDNMIIESDDLSLVKEHGRKVLRETLDLLGGKPRVLNIMTEDLKYEIVSSGTISGNTRLVVDLKNREYHLEKEGKSSLRKKVVKREDGRNFYFYEEGERE

SEQ ID NO: 626 - DNA, 2438 bp, Trichoderma reesei
cacagttggccccggactctgtggtggccaatcttcacgatgctcggcgctccctctcctagaaggctggcggacgtcctcgccgtgaccgcgggactggtggcctctgttagggcagcaagtcccatctccgtgtctggcaagtcgtttgccctcaacggcgacaacgtctcgtaccgcttccacgtcgacgacgactctaaggacctcatcggcgaccactttggcggccctgccacggaagatggcgtcttcccccccatcatcggccccatccagggctgggtcgacctcatcggccggcagcggcgcgagttccccgacctgggccgcggcgactttcgcacgcccgcggtgcacatccggcaggcggcgggctacacggtcagcgacttccagtacaagtcgcaccgcgtcgtcgagggcaagccggcgctgcgcggcctgccgtcgacgtttggcgacgccggcgatgtgtcgactctggtcgtgcacatgtatgataactacagctccgtggccgccgacctgacctactccatcttccccaaatacgacgccattgtgcgcagcgtcaacatcaccaacatgggcaagggtaacatcaccattgagaagctcgccagcttgagcgtcgatctgccgtatgaggactttgacatgctggagctcaagggtgactgggctcgcgagggaaagcggctgcgtcgcaaggttgactacggctctcagggtttcgggagcacgactggctattcttcccatctccacaaccccttcttctcgctcatcacgcctacgacgaccgagtcccaaggagaggcatggggcttctcccttgtgtacactggctccttctccgtcgaggtcgaaaagggttcgcagggtctcacgcgagccgccattggcgtcaacccctatcaactgtcgtggccgttgggccctggcgagaccttcagcagccccgaggcggttgccgtcttctctaccactggcgttggcggaatgtcgcgaaagttccacaacctgtaccgcaagcatctgatcaagagcaaattcgcgacgcagatgcaccccgtcttgctcaacagctgggagggcctcggcttcgactacaacgacaccaccattctgcatctggcgcaggagtctgccgatctcggcatcaagctgtttgtgctggatgatggctggtttggcgtcaagcatcctcgagttagtgacaatgctggcctgggcgactgggaggcgaaccccaagaggttcccgcagggcctgccagacttcattagcgacgtgacaaagctcaaggtggccaactcctctgatcatctgcagtttggcctctggttcgagcctgaaatggtcaaccccaactcaaccctatacatggaacacccggactgggcgattcacgccgggtcgtaccctcgtaccttgacgaggaaccagctggtgctcaacgtcgctctcccagaggtgcaggatttcatcattgagtcgctgtccaacattctgagcaacgccagcatttcgtacgtcaagtgggacaacaaccgcggcatccacgaggccccttaccccgggctcgactacgcctacatgctgggcctgtaccgcgtctttgacacgctgtcgtcaaagttccccaatgttcgctgggagggttgcgcgtctggcggcggccgcttcgatcccggcgtgctgcagtactttcctcacatctggacgtctgacgacacggatgccgtggagcgcattgcgatccagtttggcacgtcgctcgtgtatccgccgtcggccatgggagcccacgtctctgccgtaccgaacggccagacgcagcgcacgacgtcgattgccttccgcgcccacgttgccatgatgggaggttcgtttggcttcgagctcacccctgcggagatgccggaggacgacaaggcgcagatcccgggcatcattgcgctggcggaaaaggtgaaccccattgttgtcaagggcgacatgtggcggctgagcctgccggaggagtccaactggccggcggcgctcttcatctcgcaggacggcagccaggcggtgctgttctacttccagatccgggccaacatcaacaacgcgtggccggtgctgcggctgcagggcctggatgcgtcggccaagtacaagattgacggcaaccagacgttctcgggggcgacgctgatgaacatcgggctgcagtatcagttcaatggggactatgacagcaaggtggtgtttttggagaagcagacatgagctgattttgtgaacccatcaccatgacctagatgacctacaggctttgtttgatgcatcgtttcttcagtagcacttatgtatggtagcttagcattcagtagttaatacacagcaggcgttttctgactgaaaaaagaaaaaaaaaaaaaaaaaaa

SEQ ID NO: 627 - protein, 746 aa, Trichoderma reesei
MLGAPSPRRLADVLAVTAGLVASVRAASPISVSGKSFALNGDNVSYRFHVDDDSKDLIGDHFGGPATEDGVFPPIIGPIQGWVDLIGRQRREFPDLGRGDFRTPAVHIRQAAGYTVSDFQYKSHRVVEGKPALRGLPSTFGDAGDVSTLVVHMYDNYSSVAADLTYSIFPKYDAIVRSVNITNMGKGNITIEKLASLSVDLPYEDFDMLELKGDWAREGKRLRRKVDYGSQGFGSTTGYSSHLHNPFFSLITPTTTESQGEAWGFSLVYTGSFSVEVEKGSQGLTRAAIGVNPYQLSWPLGPGETFSSPEAVAVFSTTGVGGMSRKFHNLYRKHLIKSKFATQMHPVLLNSWEGLGFDYNDTTILHLAQESADLGIKLFVLDDGWFGVKHPRVSDNAGLGDWEANPKRFPQGLPDFISDVTKLKVANSSDHLQFGLWFEPEMVNPNSTLYMEHPDWAIHAGSYPRTLTRNQLVLNVALPEVQDFIIESLSNILSNASISYVKWDNNRGIHEAPYPGLDYAYMLGLYRVFDTLSSKFPNVRWEGCASGGGRFDPGVLQYFPHIWTSDDTDAVERIAIQFGTSLVYPPSAMGAHVSAVPNGQTQRTTSIAFRAHVAMMGGSFGFELTPAEMPEDDKAQIPGIIALAEKVNPIVVKGDMWRLSLPEESNWPAALFISQDGSQAVLFYFQIRANINNAWPVLRLQGLDASAKYKIDGNQTFSGATLMNIGLQYQFNGDYDSKVVFLEKQT

SEQ ID NO: 628 - DNA, 2004 bp, Trichoderma reesei
gacaagccaaaggcgcaaagcgttcagttacatcgcagcacaatgtcgcccagtgctgcagttctcattcccctcgcagcggcagttctgcttcgtcctgtggtcggtcaaacgcaatgcggcggcaatctgtacactccggggacgctcaacttcactctggagtgctacaatgcgtttcaggactgcgtcgctcagtttgaggccaacgcaagccaagtcgactgcaacgacggcaagggaaacctgttcatgcaacaacaggccaacttgggggcctcgccaggaagccagaacaacgacgccatcattgcctttcaggacattcgcgatctctgtctgctcagcggttcaacaactgcaacgtggggatatagcgacaaccagtggtattgggcggctgccgaagatgcctgctacacaaacgatcccacgaggaccgacgttgtcaagactcacccggcgccgttttgcatccagaaccgcgactcttcactgcctgagtgctacccacagccggatgccacccctcccggcggcccactcaaggtcatcaagacggccaagacgcgaaacgggttcaagtcctcagcccgaggctggaatacctacggcgtccaagctctggtcaacggttcccaggtcgtgccgtcctttgctggacagtcgggtctgttctacacccagaagttcgtcgagactcagtgtggagttcttgcccgacccgagttcaagaaggctgggtacgatctctgcagccttgattcgggttggcaggctactaccgccgttgatcagcatggtcgaatcatctacaacaccacgcgattcaacctccccgagcttgcttcatggctacacaagagggatttgaagctcggcgtatacattacccctggcgtgccatgtctggctcacaaccaaaccatcctcggcaccaacatcaagatcaaggatgtcttgaatgggaacaacgatcagatcaactgtgactttgacttccgcaaagatggtgtccagcagtggcacgattccgtcgtcgcacaatgggcttcctggggcgtggacatgctcaaactggactttctgacgcctggctccccttccaatggcgcaaacctcgcgtgtgacagttcagatgctgttcgagcataccagaaggcaatcaagaagtcaggacgaaaaattcgcctcgacatctcgtggaagctttgccgcaacgaaacctggctacctatctggagcgaccttgctgagtcaatgcgcactgatcaggatctcgacaactacggcaccaacactttgatggcatggcaggtcggccagcgcgcgattgagaactacaggcagtacatcggtttgcaagcgcagagaaatgtccccctcacgatctatcctgatatggatgctcttttcacggtcaaccccgagcatctcgccggtgtaaacgacactattcgctatacggttcagaaccactggcttggagctggcgccaacctcatcattggtggcgatatggagcaggtcgatgctctggggctcaagctgactaccagcaagcaatcgattgatgcggcagacttttttgcaaagtatcccatgcagcctcgtaaccccggaaccggaagcaacgccgccaagcagctccaggcctggatcggtggcccttcggatgaccacgaggcttatgtgctcattgtcaactacgggccagacttggggaatggtggcttttcaaccaagctgtatggaaagcagaaagtgacagtgtcgttgaaggatcttggtatctctggctccgcctggacttttaccgacatatggtccggcaagtccagcagagtgactgggtcctactctgcctggctcaccgagggcgagtcccagcttctgcgcctgaaaaggactcactagtgaacacgaagacgtatagaggtttctagagtttagcgaagcaatacactttataatccctaaaaaaaaaaaaaaaaaaaaaaaaaa

SEQ ID NO: 629 - protein, 624 aa, Trichoderma reesei
MSPSAAVLIPLAAAVLLRPVVGQTQCGGNLYTPGTLNFTLECYNAFQDCVAQFEANASQVDCNDGKGNLFMQQQANLGASPGSQNNDAIIAFQDIRDLCLLSGSTTATWGYSDNQWYWAAAEDACYTNDPTRTDVVKTHPAPFCIQNRDSSLPECYPQPDATPPGGPLKVIKTAKTRNGFKSSARGWNTYGVQALVNGSQVVPSFAGQSGLFYTQKFVETQCGVLARPEFKKAGYDLCSLDSGWQATTAVDQHGRIIYNTTRFNLPELASWLHKRDLKLGVYITPGVPCLAHNQTILGTNIKIKDVLNGNNDQINCDFDFRKDGVQQWHDSVVAQWASWGVDMLKLDFLTPGSPSNGANLACDSSDAVRAYQKAIKKSGRKIRLDISWKLCRNETWLPIWSDLAESMRTDQDLDNYGTNTLMAWQVGQRAIENYRQYIGLQAQRNVPLTIYPDMDALFTVNPEHLAGVNDTIRYTVQNHWLGAGANLIIGGDMEQVDALGLKLTTSKQSIDAADFFAKYPMQPRNPGTGSNAAKQLQAWIGGPSDDHEAYVLIVNYGPDLGNGGFSTKLYGKQKVTVSLKDLGISGSAWTFTDIWSGKSSRVTGSYSAWLTEGESQLLRLKRTH

SEQ ID NO: 630 - DNA, 1011 bp, Phlebia Tremellosa
  misc_feature (30)..(30): n is a, c, g, or t
catgcatattttctcacggattgaaaccgnctttccaagcaaacgtcggcctcgacgaggttgttgaagtgcagaggcccttcctcgagaggagtggcatgggcgttgccgactttattcaatttgctggtgcagtcgcgtctacgaactgccccggggctccgcctctcaatgtttccatcggacgcgtggatgctacccaacctgctccggacggccttgtccccgagccattcgacgatgctgacaagattctagcccgtttcgcggatgctggcgacttcgacgaactggagactgtctggttcctgattgctcataccgttgccgctcagaacgatattgaccccagcatcccgcggactcctttcgattccactcccgagcttttcgatggccagtttttcattgagactcagctggagggtattgccttcccaggggatgggcccaaccaaggtgaagttgtctccccgcttaggggagagttccgactgcagtcagacttcctgcttgcccgtgacaaccggactgcttgcgagtggcagtcgttcggaacggaccaagccaaactccagaatcgattccagttcattttccaggctatgggccagctcgggcaggatccgactacgttgactgactgcagcgacgttcttgctattcctcgcaacctgacgactactcctcaccttcccgccggcaagtttttcaaggatgttcaagctgcttgcgccgcgacccccttcccggctttcactgccgctccgggccccgccactaaggttgctccagttccgcaggattaagcagaaagtggtgatatatttagattgttgtgattttccagcgttaactcttgtgggcgtggattgtggtctcatgtctgtatcactattcagttccctatgaagtgtggcaattgttctatacactgaagtcgagtgtcgaccaatcagattatctttgccctgaaaaaaaaaaaaaaaaaaaaaaaaaaaaaaaaaaaaa

SEQ ID NO: 631 - protein, 268 aa, Phlebia Tremellosa
  misc_feature (10)..(10): Xaa can be any naturally occurring amino acid
CIFSHGLKPXFQANVGLDEVVEVQRPFLERSGMGVADFIQFAGAVASTNCPGAPPLNVSIGRVDATQPAPDGLVPEPFDDADKILARFADAGDFDELETVWFLIAHTVAAQNDIDPSIPRTPFDSTPELFDGQFFIETQLEGIAFPGDGPNQGEVVSPLRGEFRLQSDFLLARDNRTACEWQSFGTDQAKLQNRFQFIFQAMGQLGQDPTTLTDCSDVLAIPRNLTTTPHLPAGKFFKDVQAACAATPFPAFTAAPGPATKVAPVPQD

SEQ ID NO: 632 - DNA, 919 bp, Phlebia Tremellosa
ctttcctcgccaggagcaacatgagcgtagctgacttcatccagtttgccggtgcggttggcgtatctaactgccccggtgctcctccgcttcctgtcttcgtcggtcgcaaggatgctacccagcctgctcctgatggcctcgtccctgaaccgttcgatctcatcgatgatgttttggcccgcttcgcggatgccggtggcttcgatgaactcgaagtagtctggttcttgatcgcacataccattgctgcgcagaacgacattgacccgaccatcccgcgcacacctttggactccacgcctactctcttggacggtcagttcttcatcgagactcaactgcgcggcaccggtttccctggcaaggccggtattcaaggtacggtggagtctcctcttaagggcgagttccgtctccagaccgaccatctgttggctcgtgactctaggactgcttgcgagtggcagtcgtttggtaccgaccaagccaagctccagaaccgtttccagttcattttcggcgcaatgggccagcttggccacgacccgaacgacctgatcgactgcagcgaggtcctgcccaccccacccgatcttaccactttacctcacttccccgccggcaaatccaactcggacgtcgaacaggcctgcgctgagactcctttcccggttttcaggaccgaccctggcccccagactgcggtggcaccggtcccaagctccccgattttcaacgtttgatagcgttcggctgctttgctactcctttgtcctattctggtcaccaagtgtgtatctacgcttctggattgcctctgtaaacctgtatctgggttgttaccgttctattgcactccaatgagatgtctttctcgggttcaaaaaaaaaaaaaaaaaaaaaaaaaaaaaaaaaa

SEQ ID NO: 633 - protein, 247 aa, Phlebia Tremellosa
FLARSNMSVADFIQFAGAVGVSNCPGAPPLPVFVGRKDATQPAPDGLVPEPFDLIDDVLARFADAGGFDELEVVWFLIAHTIAAQNDIDPTIPRTPLDSTPTLLDGQFFIETQLRGTGFPGKAGIQGTVESPLKGEFRLQTDHLLARDSRTACEWQSFGTDQAKLQNRFQFIFGAMGQLGHDPNDLIDCSEVLPTPPDLTTLPHFPAGKSNSDVEQACAETPFPVFRTDPGPQTAVAPVPSSPIFNV

SEQ ID NO: 634 - DNA, 1313 bp, Trametes versicolor
gggggatagggaggccaacgagctctcttcctccatccctcgcaatcccaggcaatggcgttcaagctccttggttccttcgtctccctcctcgcggcccttcaggtcgctaacggtgccctcacccgccgtgtgacgtgcgccaccggccaggtcacctcgaacgcggcctgctgcgcgctcttccccgtcatcgacgacatccagacgaacctgttcgacggcggcgagtgcggcgaggaggtccacgagtccctccgcctcaccttccacgacgccatcggcatctcgcccgccatcgccaagaccggtgtcttcggtggtggaggcgcggacggctccattgccatcttcgccgacatcgagacgaacttccacgcgaacaacggtgtcgacgagatcatcggcgagcaggcgcccttcatcgcccgccacaacctcaccaccgccgacttcatccagttggccggtgccatcggtgtctccaactgccctggcgcgccccgcctgaacgtcttcattggccgcaaggacgcgacccagcccgctcccgacctgacggtccccgagcccttcgacgacgtcaccaagattcttgctcgcttcgaggatgccggcaagttcacccccgctgaggttgttgccctgctcgcctcgcacacgatcgccgctgccgaccacgtcgaccccaccatcccgggaacgcccttcgactccacccccgagctgttcgacacccagttcttcatcgagacccagctccgcggcacgctcttccccggcaacggcagcaaccagggtgaggtccagtctcccctcggcggtgagctccgtctccagtccgacggactacttgcccgcgaccagcgcacggcctgcgagtggcagtcgttcgtcaacaaccaggcgaagctccagagcgcgttcaaggccgcgttcgcgaggatgaccgtgctcggccagaacacgcgcgcgctcatcgactgctcggacgtcgtccccaccccgcccgcccccgccagcaaggcacacttccccgccggcctctcccgccgcgacatcgagcaggcgtgccgcgcgacgcccttccccacgctccccactgaccccggacccgttaccaccgtcgcccctgtccccccgtcctaaatgttgcgctgcgcaacgcttgcatgttatgccactaagattttattgggaattgggtcgcttcactagaatgatgcctttgatagtaatgctgtcttgagttgttgaaatgtgatgctattattggttacgcgtcaaaaaaaaaaaaaaaaaaaaaaaaaaaa

SEQ ID NO: 635 - protein, 364 aa, Trametes versicolor
MAFKLLGSFVSLLAALQVANGALTRRVTCATGQVTSNAACCALFPVIDDIQTNLFDGGECGEEVHESLRLTFHDAIGISPAIAKTGVFGGGGADGSIAIFADIETNFHANNGVDEIIGEQAPFIARHNLTTADFIQLAGAIGVSNCPGAPRLNVFIGRKDATQPAPDLTVPEPFDDVTKILARFEDAGKFTPAEVVALLASHTIAAADHVDPTIPGTPFDSTPELFDTQFFIETQLRGTLFPGNGSNQGEVQSPLGGELRLQSDGLLARDQRTACEWQSFVNNQAKLQSAFKAAFARMTVLGQNTRALIDCSDVVPTPPAPASKAHFPAGLSRRDIEQACRATPFPTLPTDPGPVTTVAPVPPS

SEQ ID NO: 636 - DNA, 1395 bp, Trametes versicolor
  misc_feature (45)..(45): n is a, c, g, or t
gatagggaacaaacgacacccgtcgacgaactcgtaggacagcantcgggaccgcttcagcacgcttgcattcgacgaccttcatcatgttctccaaggccctcctctccatcgtcgctctcgctgcgtccttcaccgctgctgtcccgtccgccaacaagcgggctacctgcagcggcggtcagaccactgctaacgatgcatgctgcgtgtggttcgacgtcctcgacgacattcagagcaacctcttccacggcggcgagtgtggcgagaacgcccacgaatctctccggctcatcttccacgacgccatcggcatctcccctgcgttgacggcggcggggcagttcggcggcggaggtgctgacggctcgatcatggcccacaccgacgtcgagatccagtacgccgccaacaacggccttgacgagatcatcgaggagcagcgccccttcgcgctcaagcacaacgtgtccttcggcgacttcatccagttcgcgggagcggtcggtgtggcgaactgcaacggtggcccgcagattggcttcttcgctggccgctcgaacgactcgcagcccgcgcccgacaagctcgtgccgctccccagcgactcggtcaccgacatcctcgcacgtgtcgccgacgcgggcttcgcccctgtcgagctcgtctggatgctgatctcgcacacggtcgccgcgcaggacaaggttgacgactccatccccggcacgcccttcgactccaccccgagcgacttcgacgcccagttcttcgtcgagtcgatgctcaacggcactctcactcccggcagcgctctccacgacggtgaggtccagtcgcccctccccggcgagttccgtctccagtccgacttcctcatcggccgggactcccgcacctcgtgcgagtggcagaagatgatcgccgaccgcgcgaacatgctccagaagttcgagcagaccgtgctcaagctgtcgctgctcgggttctcccagtcggcgctcactgactgctcggacgtcatcccgatcgcgaccggcacggtcgcggaccccttcctccctgcgggcaagacgatggccgacatcgaggctgcgtgcgccgccacgcccttccctacgctgtctgccgcgcctggtcccgagaccaccatccccgcagtccccctcgactcgtaagatgcggtcatacgatatggtggcgggcagtaatgtctggcacgatgaacggacttgattggaagtagataactttatgatccttggtattacggtggaacttgaagggcttcgcgtacgagctgattaggtctatttgttgaacgtgatgtgatacgctatcgtcttcaaaatgcattccttgctgctccttaaaaaaaaaaaaaaaaaaaaa

SEQ ID NO: 637 - protein, 364 aa, Trametes versicolor
MFSKALLSIVALAASFTAAVPSANKRATCSGGQTTANDACCVWFDVLDDIQSNLFHGGECGENAHESLRLIFHDAIGISPALTAAGQFGGGGADGSIMAHTDVEIQYAANNGLDEIIEEQRPFALKHNVSFGDFIQFAGAVGVANCNGGPQIGFFAGRSNDSQPAPDKLVPLPSDSVTDILARVADAGFAPVELVWMLISHTVAAQDKVDDSIPGTPFDSTPSDFDAQFFVESMLNGTLTPGSALHDGEVQSPLPGEFRLQSDFLIGRDSRTSCEWQKMIADRANMLQKFEQTVLKLSLLGFSQSALTDCSDVIPIATGTVADPFLPAGKTMADIEAACAATPFPTLSAAPGPETTIPAVPLDS

SEQ ID NO: 638 - DNA, 1219 bp, Pleurotus pulmonarius
tacgtcttactgcagtcgcattcctacttcgtaatgaccatcgcatcactttccgcgctcgtccttgccttcgctgcgactgtccaagttgctcaagcggtctctttgcctcagaaacgtgcaacttgtgctggcggccaagttaccgccaatgcagcctgttgcgttctcttcccgctcatggaagacctacagaagaacttgtttgacgacggcgcatgcggcgaagatgcccatgaagcccttcgcctgaccttccacgatgcaattggattctctccttctaggggtgtcatgggaggcgccgatggctctgtcatcacgttctccgacactgaggttaattttccagctaaccttggtatcgatgagatcgttgaggctgagaaaccgttcctcgcaaggcataacatctccgcgggcgacttggttcattttgctggtactctcggggtcagtaactgccctggtgctccacaaaatctctcgttcttcttgggtcgtcctcctgccaaagccgcctcgccgatcggattagtgcctgaaccattcgacaccatcacagatattctagcccgaatggatgacgctggctttgtctccgtcgaggttgtctggctcctttccgctcactccgttgccgcagctgatcatgttgacgaaagcattcccggaacgccgttcgactcaacaccaaatctctttgactcgcaaatcttcatcgagactcaactccgtggaatttcgttcccaggcaccggaggcaatcatggtgaagtccaatctccgcttaggggtgaaatgagactccagtccgatcacttgttcgcgcgagacgataggacatcttgcgaatggcaatccatgactaatgatcagcaaaagatccaagaccgattctctgacacactgttcaagatgtcgatgctcggacaaaaccaggacgctatgattgattgctccgatgtcatccccgtccccgctgctctcgttaccaagccccatctccctgccggcaaggtcaggaccgatgttgaacaggcctgcgccaccgacgccttcccagctctcgctgctgaccctggcccagtcacctctgttcctcgcgtgccacctgcgtaagcaaagtgcgaaagggcttttcatcagtttcgtcttcatttttatctttactgtcgatcgttcgagccccaaaaaaaaaaaaaaaaaaaaaaaaaaa

SEQ ID NO: 639 - protein, 362 aa, Pleurotus pulmonarius
MTIASLSALVLAFAATVQVAQAVSLPQKRATCAGGQVTANAACCVLFPLMEDLQKNLFDDGACGEDAHEALRLTFHDAIGFSPSRGVMGGADGSVITFSDTEVNFPANLGIDEIVEAEKPFLARHNISAGDLVHFAGTLGVSNCPGAPQNLSFFLGRPPAKAASPIGLVPEPFDTITDILARMDDAGFVSVEVVWLLSAHSVAAADHVDESIPGTPFDSTPNLFDSQIFIETQLRGISFPGTGGNHGEVQSPLRGEMRLQSDHLFARDDRTSCEWQSMTNDQQKIQDRFSDTLFKMSMLGQNQDAMIDCSDVIPVPAALVTKPHLPAGKVRTDVEQACATDAFPALAADPGPVTSVPRVPPA

SEQ ID NO: 640 - DNA, 1173 bp, Phlebia radiata
atggccttcaactttgctgcaatcctcgccttcgtctcgctcgccgcagtgaccagtgctgctccgagcaagaccacctgctccaatggtgtagtcgtccccgacgcagtgtgctgcgacttcgtccctcttgcgtccgcccttcagagcgaggtgctcatgggcgattgtggcgaagacgcgcacgagctcgtccgtcttattttccacgacgctattgccatctcgcaaagcatgggtccctcagctggtggcggtgccgatgggtcgatgctcatcttccctacggtcgaaccggccttcttcccgaaccttggtatcgccgacagcgtcaacaacctgatccccttcctctcgcagttccccacgatttccgctggtgatcttgttcatttcgcaggcgccgtcgcgatcagcaactgccctggtgccccccagctagagttccttgccggacgtcccaacgcaaccgctcctgctatcgacggtctcatccccgagccccaggacgatgtcaccaagatccttgcgcgcttcaaggacgctggtaacttcagccctgccgaagtcgttgctctcctggcttcgcacagtattgcccgtgctgatcacgttgaccccacactcgatgccgcgcccttcgactccacaccgttcgacttcgacacccaggtcttcctggaggttctgctcaagggtgtcggcttccccggcttggccaacaacaccggcgaggtctcctccccgctccccgtcactgacggcacagacgtcggcgagctgcgcctccagtccgacttcgcgctcgcccgcgacgagcgcaccgcctgtgcctggcagagcttcgtcaacgagcaggaggcgatggccaccgcgttcaagaacgccgtcaagaagctcgctgtgctcggccacaaccgcaacgacctcgtcgactgctctgccgtcgtccccgtccccaagcccgcgaccggcacgcccgcgacgttccccgcttccacgggcccgcaggacctcgagctcacgtgcacgaccgagccgttccccacgctgtccaccgcccccggcgcccagcagactctgatcccgcactgctccgacggcaccatgacctgcaactccgtgcagttcgacggccctgccaccaacttcggtggtgcagacgactcgtag

SEQ ID NO: 641 - protein, 390 aa, Phlebia radiata
MAFNFAAILAFVSLAAVTSAAPSKTTCSNGVVVPDAVCCDFVPLASALQSEVLMGDCGEDAHELVRLIFHDAIAISQSMGPSAGGGADGSMLIFPTVEPAFFPNLGIADSVNNLIPFLSQFPTISAGDLVHFAGAVAISNCPGAPQLEFLAGRPNATAPAIDGLIPEPQDDVTKILARFKDAGNFSPAEVVALLASHSIARADHVDPTLDAAPFDSTPFDFDTQVFLEVLLKGVGFPGLANNTGEVSSPLPVTDGTDVGELRLQSDFALARDERTACAWQSFVNEQEAMATAFKNAVKKLAVLGHNRNDLVDCSAVVPVPKPATGTPATFPASTGPQDLELTCTTEPFPTLSTAPGAQQTLIPHCSDGTMTCNSVQFDGPATNFGGADDS

SEQ ID NO: 642 - DNA, 1089 bp, Phlebia radiata
atggctttcaagcagcttcttaccgccatctccattgtctcggttgctaacgctgccctcactcgccgcgttgcctgccccgatggtgtcaacactgctaccaacgcggtgtgctgctcattgttcgcggtccgcgacctcatccaggaccagctgttcgacggcggcgagtgtggcgaggaggtgcacgagtctctgcgcctcacgttccacgatgccatcggtatctcgcccactatcgccagtaccggcgtgttcggtggaggaggtgctgatggttccatcgccatcttcgccgagatcgagaccaacttccacgctaacaatggtgtcgacgagattatcggcgagcaggcgccatttattcagatgaccaacatgacgaccgctgactttatccagttcgctggcgctgtcggggtcagcaattgccctggtgctccagccctccccgttttcgtcggtcgtccggatgctactcaacccgcgcctgacaagacagttcccgagccatttgacaccgttgacagcattcttgctcggttcgccgacgctggtggcttcagctcagcggaagtcgtggctttgctcgcgtcgcacacgatcgctgccgccgatcacgtcgacccatcgatccctggaacccccttcgactccacccccgagatcttcgacactcagttcttcatcgagactcagcttcgtggtatactcttccccggcacgggtggaaaccagggcgaggttgagtcccctcttcacggcgagatccgtctccaatccgactctgagcttgcccgtgactcgaggaccgcctgcgagtggcagtcattcgtcaacaaccaggccaagatccagagcgccttcaaggctgcgttcaggaaaatgaccatcctcggtcactccgagagcagcctcatcgagtgctctgaggttattcaaaccccaccggcgttggagggtaatgctcacctcccggctggccagactatgaacgacattgagcaggcgtgcgctactactccattcccctcgctcagcgccgatcccggccccgccacctctgttgcgcctgtccccccgtcgtga

SEQ ID NO: 643 - protein, 362 aa, Phlebia radiata
MAFKQLLTAISIVSVANAALTRRVACPDGVNTATNAVCCSLFAVRDLIQDQLFDGGECGEEVHESLRLTFHDAIGISPTIASTGVFGGGGADGSIAIFAEIETNFHANNGVDEIIGEQAPFIQMTNMTTADFIQFAGAVGVSNCPGAPALPVFVGRPDATQPAPDKTVPEPFDTVDSILARFADAGGFSSAEVVALLASHTIAAADHVDPSIPGTPFDSTPEIFDTQFFIETQLRGILFPGTGGNQGEVESPLHGEIRLQSDSELARDSRTACEWQSFVNNQAKIQSAFKAAFRKMTILGHSESSLIECSEVIQTPPALEGNAHLPAGQTMNDIEQACATTPFPSLSADPGPATSVAPVPPS

SEQ ID NO: 644 - DNA, 1349 bp, Trametes cervina
gagtgctccagcagtacctcctctcctcagtcgaaacacactccaaccatggcattccagaccctcttcgctcttgctactctcgccaccactgtcctcgctgtgccctctcctctcgtgagctgcggtggcggccggtctgtcaagaacgctgcctgctgtgcatggttcccagttctggacgacattcaggcgaatttgttcaacggcggcaaatgcgaggaggaagcccatgaggccgttcgcctcactttccacgacgcagtcggtttcagtcttgctgctcagaaggctggaaagtttggtggcggtggtgccgatggttctatcttggccttctcggacatagagactgcattcattccaaactttggcttgggattcaccactgaagggttcatccccttcgctctggcccacggcgtttccttcggcgacttcgttcagtttgctggcgctgtcggcgcagctaactgtgccggaggtcctcgtcttcagttcttggctggcagatccaacatctcccagccttctcctgacggcctcgttcccgacccgactgactccgccgacaagatcctggcgcgcatggcagacatcggtttctctcccactgaggtcgttcacctgctcgcttcccacagtattgctgctcaatacgaagtggacacggacgtcgctggaagcccatccgactccacgccaagcgtcttcgatacacagttcttcgtcgagtctctgctccacggtacccagttcactggtagcggtcaaggcggtgaggtgatgtcccccatcccgggcgagttccgtcttcagtccgacttcgcgctctctcgtgaccccagaaccgcctgtgaatggcaagccctcgtcaacaaccaacaggcaatggtcaacaacttcgaggccgtcatgtccaggctcgccgtcatcggccagatcccgtctgagctcgtcgactgctccgatgtcattcccactccaccccttgccaaggttgcacaggtcggaagcttgccgccgggcaagtccatggctgacgtccaggtcgcttgcaccaacggcatgccattcccaagcctgccgacttcccccggccctgtccagaccgttgcccccgttctcgggtaaacggcgattggctgtcgaagcttttagttgtgtcttattgaatcgtgtacggtgtcggttaaagatgtgttttttgtaactcgctgccttgtatcatcatcttagaggtacaagtagtcggcgattttgtttgaatcggtggaatatatcgcattgtctgcaaaacatgaaaaaaaaaaaaaaaaaaaaaaaaaaaaaaaaaaaaaaaaaaaaaa

SEQ ID NO: 645 - protein, 361 aa, Trametes cervina
MAFQTLFALATLATTVLAVPSPLVSCGGGRSVKNAACCAWFPVLDDIQANLFNGGKCEEEAHEAVRLTFHDAVGFSLAAQKAGKFGGGGADGSILAFSDIETAFIPNFGLGFTTEGFIPFALAHGVSFGDFVQFAGAVGAANCAGGPRLQFLAGRSNISQPSPDGLVPDPTDSADKILARMADIGFSPTEVVHLLASHSIAAQYEVDTDVAGSPSDSTPSVFDTQFFVESLLHGTQFTGSGQGGEVMSPIPGEFRLQSDFALSRDPRTACEWQALVNNQQAMVNNFEAVMSRLAVIGQIPSELVDCSDVIPTPPLAKVAQVGSLPPGKSMADVQVACTNGMPFPSLPTSPGPVQTVAPVLG

SEQ ID NO: 646 - DNA, 1961 bp, Phanerochaete chrysosporium
acccttgcacaggctagcaatacacatctctgtaatcggctggtaaagcccatcggagagtgcacgaacaggatgggtcagagaggcggcccaggcaccgaaagggcacggagagaagcgtataaaggcgagggcaaatcgacctcctctctccaaggcactcgtcttctcctacagtcagtcgaacggccatggctttcaagcaactcgtcgccgcaatttctcttgctctttccatctctgcggtccaaggtgcgcctcctggcaaatccgagcgacagccagagtcctaacctcgacgccaggtgccgccgttaaggagaagcgtgccacctgctcgaacggcgccactgtcggcgacgaatcatcgtgcgcgtggttcgatgtactcgacgacatccaggagaacttattccaaggcgctcagtgcggcgctgaggctcatgagtcgattcgcctgtaggcactcctactcccgctgtcatgagtctcggcttacccagtcgtagcgtcttccacgatgcaattgccatctcgcccgccatggaggcgcagggccagttcgggcaagtatcgcgcatgtggcacattttaccaacactcgctgacccatcttctctagcggtggaggtgctgatggctctatcatcatcttcgacacgattgagactgcgttccacccgaacattggtctcgacgagatcgtcaacctgcagaagccgttcatcgccaagcacggtgtgacacccggagacttcattgctttcgcgggcgcagtcgccctcagcaactgccctggtactccccagatgaacttcttcaccggtcgtgctcccggtatgtcttaaagtctgacaaaactaatactcgactgactttgcctgtgtagccacccaagccgctccagacggcctggtcccggagccattccgtacgttcattgccagttctgcctatcgttgctgaagctgaaaaccccttcagacaccgtcgaccagctcattaaccgtgtcaacgacgccggtcagttcgatgagctcgagctcgtttggatgctctccgcgtaagtcacttacacgcacaaccagttggattcgactgacatctgctgcagccactccgttgctgcagtcaacgacgtggacccgaccatccagggccttgccttcgactccactcccggcattttcgactcccagttcttcgtcgagactcagctccgtggtaccgcattccccggctctggcggaaaccagggtgaggtcgaatctccgctcccgggcgagatccgcatccagaccgaccacacgctcgctcgcgacccccgcacggcgtgcgagtggcaatcgttcgtcgcgaaccagtccaagcttgtctccgacttccagttcatcttcctcgccctcactcagctcggccaggacccgaacgcgatgaccgactgctccgacgtcatcccgatctcgaagcccatccccggagaccttccgttctcgttcttccccgccggcaagaccgctgccgatgtcgagcaggctgtgcgtagctgccctctgtattacttctctattactgactgaccgcctcctgtagtgcgccgagacccccttcccatcgctcactacccttccgggtcccgagacctccgtccagcgcatgtgcgtagcttttggatccgctggtagttactggaatactaacaatgctctccagcccgccgccccctggtgcttaaggagcgccttcaatggtaacaacggcctcgtgtcaaatcgtccacggatatcgctctctcggatcgtgtgtcactgtacagtatgcattcggatgtgaaaatgtatacgcgttgtttctacgaatttgcgtctccctcgccgcggagtatccgtttgagattgcatgtggcgcatcagtccgcaagcatttgccatcctgaatacctggatatacaaccctggaac

SEQ ID NO: 647 - protein, 372 aa, Phanerochaete chrysosporium
MAFKQLVAAISLALSISAVQGAAVKEKRATCSNGATVGDESSCAWFDVLDDIQENLFQGAQCGAEAHESIRLVFHDAIAISPAMEAQGQFGGGGADGSIIIFDTIETAFHPNIGLDEIVNLQKPFIAKHGVTPGDFIAFAGAVALSNCPGTPQMNFFTGRAPATQAAPDGLVPEPFHTVDQLINRVNDAGQFDELELVWMLSAHSVAAVNDVDPTIQGLAFDSTPGIFDSQFFVETQLRGTAFPGSGGNQGEVESPLPGEIRIQTDHTLARDPRTACEWQSFVANQSKLVSDFQFIFLALTQLGQDPNAMTDCSDVIPISKPIPGDLPFSFFPAGKTAADVEQACAETPFPSLTTLPGPETSVQRIPPPPGA

SEQ ID NO: 648 - DNA, 1313 bp, Phanerochaete chrysosporium
tcagctctcaaggacatccgcactcgaatatcgcaatggccttcggttctctcctcgccttcgtggctctcgccgccataactcgcgccgccccgactgcggagtctgcagtctgtccagacggtacccgcgtcaccaacgcggcgtgctgcgctttcattccgctcgcacaggatttgcaagagactctgttccagggtgactgtggcgaagatgcccacgaagtcatccgtctgaccttccacgacgctattgcaatctcccagagcctaggtcctcaggctggcggcggtgctgacggctccatgctgcacttcccgacaatcgagcccaacttctccgccaacagcggcatcgatgactccgtcaacaacttgcttcccttcatgcagaaacacgacaccatcagtgccgccgatcttgtacagttcgccggtgcggtcgcgctgagcaactgcccaggtgctcctcgcctcgagttcatggctggacgtccgaacactaccatccccgcagttgagggcctcattcctgagcctcaagacagcgtcaccaaaatcctgcagcgcttcgaggacgccggcaacttctcgccgttcgaggtcgtctcgctcctggcttcacacaccgttgctcgtgcggacaaggtcgacgagaccatcgatgctgcgcccttcgactcgacacccttcaccttcgacacccaggtgttcctcgaggtcctgctcaagggcacaggcttcccgggctcgaacaacaacaccggcgaggtgatgtcgccgctcccactcggcagcggcagcgacacgggcgagatgcgcctgcagtccgactttgcgctcgcgcgcgacgagcgcacggcgtgcttctggcagtcgttcgtcaacgagcaggagttcatggcggcgagcttcaaggccgcgatggcgaagcttgcgatcctcggccacagccgcagcagcctcattgactgcagcgacgtcgtccccgtcccgaagcccgccgtcaacaagcccgcgacgttccccgcgacgaagggccccaaggacctcgacacgctcacgtgcaaggccctcaagttcccgacgctgacctctgaccccggtgctaccgagaccctcatcccccactgctccaacggcggcatgtcctgccctggtgttcagttcgatggccctgcctaaaccactcacctccggcaatgcacctttagtagatgtcgattctatttggttgattagaagtactgggttctcgtgtcatataccaccaagttttcagaatgcaagtctcctttctttccaaaaaaaaaa

SEQ ID NO: 649 - protein, 382 aa, Phanerochaete chrysosporium
MAFGSLLAFVALAAITRAAPTAESAVCPDGTRVTNAACCAFIPLAQDLQETLFQGDCGEDAHEVIRLTFHDAIAISQSLGPQAGGGADGSMLHFPTIEPNFSANSGIDDSVNNLLPFMQKHDTISAADLVQFAGAVALSNCPGAPRLEFMAGRPNTTIPAVEGLIPEPQDSVTKILQRFEDAGNFSPFEVVSLLASHTVARADKVDETIDAAPFDSTPFTFDTQVFLEVLLKGTGFPGSNNNTGEVMSPLPLGSGSDTGEMRLQSDFALARDERTACFWQSFVNEQEFMAASFKAAMAKLAILGHSRSSLIDCSDVVPVPKPAVNKPATFPATKGPKDLDTLTCKALKFPTLTSDPGATETLIPHCSNGGMSCPGVQFDGPA

SEQ ID NO: 650 - DNA, 1119 bp, Phanerochaete chrysosporium
atggctcttaagcaactcgctgctgccgtcgctctcgcactctcgatccaggctgcccaaggcgctgctgtgaaggagaagcgcgccacctgctccaacggcgcgactgtcggcgacgcgtcgtcgtgcgcctggtttgacgttctcgacgacatccagcagaacctcttcaacggcgcccagtgtggtgctgaggctcacgagtccattcgtcttgtcttccacgacgccatcgctatctcgcctgcccttgagtctcaaggcaaattcggtggtggaggcgctgatggctccattatcctcttcgacgatatcgagaccaactttcaccccaacattggccttgacgagattgtcaacctgcagaagcccttcatccagaagcacggcgttactcctggcgatttcattgcctttgctggcgccgtcgccatgagcaactgccctggtgctccgcagatgaacttcttcaccggtcgtgctcctgctactcaggccgctccagacggcctcgttcccgagccattccacactgtcgaccagatcatctctcgcgtcaacgacgctggcgagtttgacgagcttgagctcgtctggatgctgtctgctcactccgtcgctgcggcgaacgatgtcgatccgacgatccaggggcttgcgttcgactctaccccgggtgtcttcgactcgcagttcttcgttgagacacagcttcgcggcacggcgttccccggctcgggtggcaaccagggtgaggttgaatcccctctccccggtgagatgcgcctccagtccgactcctcgatcgcccgcgactcgcgcacggcgtgcgagtggcagtccttcgtcaacaaccagtcgaagctcgttagcgacttccagttcatcttcctcgcccttacccagctcggcgagaacccggatgctatgaccgactgctcagacgtgatcccgatctcgaagccggtccccaacaacgtcccgttctcgttcttcccggctggcaagaccatggctgatgttgagcaggcgtgtgctgagacgcccttcccgactctgacgacgcttcctggccccgagacctcggtgcagcgcatccagcctcctccgggtgcttaa

SEQ ID NO: 651 - protein, 372 aa, Phanerochaete chrysosporium
MALKQLAAAVALALSIQAAQGAAVKEKRATCSNGATVGDASSCAWFDVLDDIQQNLFNGAQCGAEAHESIRLVFHDAIAISPALESQGKFGGGGADGSIILFDDIETNFHPNIGLDEIVNLQKPFIQKHGVTPGDFIAFAGAVAMSNCPGAPQMNFFTGRAPATQAAPDGLVPEPFHTVDQIISRVNDAGEFDELELVWMLSAHSVAAANDVDPTIQGLAFDSTPGVFDSQFFVETQLRGTAFPGSGGNQGEVESPLPGEMRLQSDSSIARDSRTACEWQSFVNNQSKLVSDFQFIFLALTQLGENPDAMTDCSDVIPISKPVPNNVPFSFFPAGKTMADVEQACAETPFPTLTTLPGPETSVQRIQPPPGA

SEQ ID NO: 652 - DNA, 1119 bp, Phanerochaete chrysosporium; identical to SEQ ID NO: 650

SEQ ID NO: 653 - protein, 372 aa, Phanerochaete chrysosporium; identical to SEQ ID NO: 651

SEQ ID NO: 654 - DNA, 2730 bp, Corynascus heterothallicus
ggcacgagcagagtcgaggccaaaccagtctctgcgatccaagatgaggacctcctctcgtttaatcggtgcccttgcggcggcactcttgccgtctgcccttgcgcagaacaacgcgccggtaaccttcaccgacccggactcgggcattaccttcaacacgtggggtctcgccgaggattctccccagactaagggcggtttcacttttggtgttgctctgccctctgatgccctcacgacagacgccaaggagttcatcggttacttgaaatgcgcgaggaacgatgagagcggttggtgcggtgtctccctgggcggccccatgaccaactcgctcctcatcgcggcctggccccacgaggacaccgtctacacctctctccgcttcgccaccggctatgccatgccggatgtctaccagggggacgccgagatcacccaggtctcctcctctgtcaactcgacgcacttcagcctcatcttcaggtgcgagaactgcctgcaatggagtcaaagcggcgccaccggcggtgcctccacctcgaacggcgtgttggtcctcggctgggtccaggcattcgccgaccccggcaacccgacctgccccgaccagatcaccctcgagcagcacgacaacggcatgggtatctggggtgcccagctcaactccgacgccgccagcccgtcctacaccgagtgggccgcccaggccaccaagaccgtcacgggtgactgcggcggtcccaccgagacctctgtcgtcggtgtccccgttccgacgggcgtctcgttcgattacatcgtcgtgggcggcggtgccggtggcatccccgccgccgacaagctcagcgaggccggcaagagtgtgctgctcatcgagaagggctttgcctcgaccgccaacaccggaggcactctcggccccgagtggctcgagggccacgaccttacccgctttgacgtgccgggtctgtgcaaccagatctgggttgactccaaggggatcgcttgcgaggataccgaccagatggctggctgtgtcctcggcggcggtaccgccgtgaatgccggcctgtggttcaagccctactcgctcgactgggactacctcttccctagtggttggaagtacaaagacgtccagccggccatcaaccgcgccctctcgcgcatcccgggcaccgatgctccctcgaccgacggcaagcgctactaccaacagggcttcgacgtcctctccaagggcctggccggcggcggctggacctcggtcacggccaataacgcgccagacaagaagaaccgcaccttctcccatgcccccttcatgttcgccggcggcgagcgcaacggcccgctgggcacctacttccagaccgccaagaagcgcagcaacttcaagctctggctcaacacgtcggtcaagcgcgtcatccgccagggcggccacatcaccggcgtcgaggtcgagccgttccgcgacggcggttaccaaggcatcgtccccgtcaccaaggttacgggccgcgtcatcctctctgccggtacctttggcagtgcaaagatcctgctgaggagcggtatcggtccgaacgatcagctgcaggttgtcgcggcctcggagaaggatggccctaccatgatcagcaactcgtcctggatcaacctgcctgtcggctacaacctggatgaccacctcaacaccgacactgtcatctcccaccccgacgtcgtgttctacgacttctacgaggcgtgggacaatcccatccagtctgacaaggacagctacctcaactcgcgcacgggcatcctcgcccaagccgctcccaacattgggcctatgttctgggaagagatcaagggtgcggacggcattgttcgccagctccagtggactgcccgtgtcgagggcagcctgggtgcccccaacggcaagaccatgaccatgtcgcagtacctcggtcgtggtgccacctcgcgcggccgcatgaccatcaccccgtccctgacaactgtcgtctcggacgtgccctacctcaaggaccccaacgacaaggaggccgtcatccagggcatcatcaacctgcagaacgccctcaagaacgtcgccaacctgacctggctcttccccaactcgaccatcacgccgcgccaatacgttgacagcatggtcgtctccccgagcaaccggcgctccaaccactggatgggcaccaacaagatcggcaccgacgacgggcgcaagggcggctccgccgtcgtcgacctcaacaccaaggtctacggcaccgacaacctcttcgtcatcgacgcctccatcttccccggcgtgcccaccaccaaccccacctcgtacatcgtgacggcgtcggagcacgcctcggcccgcatcctcgccctgcccgacctcacgcccgtccccaagtacgggcagtgcggcggccgcgaatggagcggcagcttcgtctgcgccgacggctccacgtgccagatgcagaacgagtggtactcgcagtgcttgtgagcccacgcgtgggttattaacaagccccgagggccgtgagtttgtgtggtgataggaactctggttttcttgatggggagttgagtttgtgaaattttttacttgtccatacaatcaactccccagccttcctcctttggtgtttgcttcaatgtccatagttttttttctcaatcgtacataaccctcgattgatcaga

SEQ ID NO: 655 - protein, 828 aa, Corynascus heterothallicus
MRTSSRLIGALAAALLPSALAQNNAPVTFTDPDSGITFNTWGLAEDSPQTKGGFTFGVALPSDALTTDAKEFIGYLKCARNDESGWCGVSLGGPMTNSLLIAAWPHEDTVYTSLRFATGYAMPDVYQGDAEITQVSSSVNSTHFSLIFRCENCLQWSQSGATGGASTSNGVLVLGWVQAFADPGNPTCPDQITLEQHDNGMGIWGAQLNSDAASPSYTEWAAQATKTVTGDCGGPTETSVVGVPVPTGVSFDYIVVGGGAGGIPAADKLSEAGKSVLLIEKGFASTANTGGTLGPEWLEGHDLTRFDVPGLCNQIWVDSKGIACEDTDQMAGCVLGGGTAVNAGLWFKPYSLDWDYLFPSGWKYKDVQPAINRALSRIPGTDAPSTDGKRYYQQGFDVLSKGLAGGGWTSVTANNAPDKKNRTFSHAPFMFAGGERNGPLGTYFQTAKKRSNFKLWLNTSVKRVIRQGGHITGVEVEPFRDGGYQGIVPVTKVTGRVILSAGTFGSAKILLRSGIGPNDQLQVVAASEKDGPTMISNSSWINLPVGYNLDDHLNTDTVISHPDVVFYDFYEAWDNPIQSDKDSYLNSRTGILAQAAPNIGPMFWEEIKGADGIVRQLQWTARVEGSLGAPNGKTMTMSQYLGRGATSRGRMTITPSLTTVVSDVPYLKDPNDKEAVIQGIINLQNALKNVANLTWLFPNSTITPRQYVDSMVVSPSNRRSNHWMGTNKIGTDDGRKGGSAVVDLNTKVYGTDNLFVIDASIFPGVPTTNPTSYIVTASEHASARILALPDLTPVPKYGQCGGREWSGSFVCADGSTCQMQNEWYSQCL

SEQ ID NO: 656 - DNA, 3751 bp, Phanerochaete chrysosporium
gatatcttccgcggctctgccttcgtgaagtcatcttgtcacctacatcggtgccgtattccccagttcgagcttccccgtgggggaacgtcgtgtaactccgcacttcttgggcgagtaccgtgttcctggttcaccattttcaatatcagtcacgtctgaaagctcttgtacacttcgattctgccgaggcttttggtcgggtttacgtcgggcaacgccgcacaccgcgtcgccctcggtggaagatagctggcaacatctgcacgggctcgcaccccatgctgctcacgcgcaccgtgaggtattctgggcttcctacgattttacctcggtgttatcaacaacgtctgtcgcctttgcttaccctcatcacgaccgtgatcacgagcgggtacacgtatccgacgtgtctccgccgcgtccgtcagcgagctacattgcgcgccccgccggccacgaatacacatgtgccacgacgtccctctatagcggatctttttctgcgtacctcacgaggactgtcggccaatctctgaacatggatttgttttctcagctgccggcatatcttcgcccgtctcggaaagaaaatagagcaagcccgctttaaaaaccagagagagggcagcaacagcaggccaggtgcacttcggtcgagttcacgatgctaggtcgatcgttacttgcgcttctgccttttgtaggcctcggtacgcggttttaacgtcctcacagaaggcttcgcaactgacgcaaagcgcgcggccagcgttctcgcagagtgcctcacagtttaccgaccctaccacaggattccagttcactggtatcaccgaccctgttcatgacgtgacctacggcttcgttttcccccctctggccacctccggagcgcaatccactgagttcatcggagaggttgttgcccccatcgcatcaaaatggattggtattgccctcggtggcgccatgaacaacgacctgctacttgtggcttgggccaacggcaaccaaattgtttcctccactcgctgggctacgtacgttttcccacatactcgccgtataccaggagctaataagtctatagtggctatgtacagccgacgtgagtgctatagctcaacatcatactctgccttgctgaagttgtgttacagtgcatatacgggaactgccactttgacaacactccctgagacaaccatcaactccacgcactggaagtgggtcttcaggtgtcagggctgcactggtaagcggatccttcatagctgacaaatgcattgcctgacaattgcactcacagagtggaacaatggcggcggaatcgacgtcactagccagggcgttctggcgtgggcattctccaacgtcgccgtcgacgacccctccgacccgcagagtaccttcagcgagcacaccgacttcggcttcttcggaattgactactcgaccgacagcgccaactaccagaactaccttaatggcgactccggcaaccctacgaccacgagcaccaagcccacaagcacgagcagctcagtcacgactggacccactgtttctgtacgtgttggcaacttctgggtagggcatctagttgacttgtgatcataggctacaccttacgattacatcatcgtcggtgctggtcctggcggtatcattgcagctgatcgtctgtcggaggctggcaagaaggttctccttctcgagcgcggtggccctagcaccaagcagaccggtggaacgtatgtcgctccatgggctactagcagtggtgtaagcgcgatccatctctcgcaacgcgccaatgctaataattcactgtgtgtagctaacgaagttcgatattcccggactgttcgagtccttgttcactgattccaaccccttctggtggtgcaaaggtgagttcaccttactagcgagacaggctgcatcgctgacttcgggatcagacatcacagtcttcgctggttgcctggtcggcggcggtacttcggtcaacggagcgtgagtttcccccgtttccatcttattgcagccagactaaacggaactagtctctactggtaccctaacgacggcgacttctcctcgagcgttggttggccaagcagctggaccaaccacgccccgtacacgagcaagctttcgtctcgtctccccagtacggaccacccttcgactgatggccagcgctaccttgagcaatcattcaacgtcgtgtctcaacttctcaaaggccaaggctacaaccaggccaccatcaacgacaaccccaactacaaggaccacgtcttcggctacagcgcattcgatgtacgtgctttctcatgtcacgaagcatgccccgtctaagcatccttcagttccttaacggcaagcgtgctggtccagtcgccacctacctccagacggcattggctcgccccaacttcactttcaagaccaatgtcatggtctcgaacgttgtccgcaacggctcgcagatcctcggtgtccagacgaacgacccgacgctcggccccaacggtttcatccccgtgaccccgaaggggcgtgtcatcctctctgctggtgcatttggcacttcgcgcattctcttccaaagcggtattggccccacggatatgattcagactgttcagagcaacccgaccgccgccgccgcgctcccgccgcagaaccagtggatcaacctcccagtcggcatgaacgcacaggacaacccctcgatcaacgtacacagttttcctaccacgcctgtccgtaagactgaacgttctgtgcagctggtcttcacccaccccagcatcgatgcctatgagaactgggctgacgtctggagcaacccgcgcccggctgacgctgcacagtacctcgcgaaccagtccggtgtcttcgcaggtgcttctcccaagtcagtatgctgccctgcatgatgtcactcccgtgtctaacagatcctccagactcaacttctggcgcgcatactctggttcggatggctttacccgttatgtacgtgatcgccgtcttcgtgcggaccccagactcaccgggatctgcaggcccaggggacggtgcgcccgggcgcagcctccgtgaactcctcgctgccgtacaacgcgagccagatcttcacgatcaccgtgtacctctctacgggcatccagtcgcgtgggcgcatcggcatcgatgcagcgctccgcggtacggtgctcacaccgccgtggctcgtgaatccggtcgacaagaccgtgctcctgcaggcgctgcacgacgtcgtctcgaacatagggtcgattcccggcctgacgatgatcacgcccgacgtcacgcagacactcgaggagtacgtcgatgcgtacgaccccgcgacgatgaactcgaaccactgggtctcgtccacgacgatcggctcatctccccagagcgcggtagtcgattcgaacgtcaaggtctttggcacgaacaacctggtgagtgtccgcggtcccgaaaggtatggcgtcgtggctgacgctgcatagtttatcgtcgacgcaggtatcattccccacctgcccacgggcaacccccagggcacgctcatgtctgccgccgagcaggcggccgcgaagatcctcgcgcttgcgggaggtccttgagcgaaattctttatattactgtcctcggggctgtagacgtaaaaacggatgttatactatcgatggaaaaaaatacgtttgtcccatct

SEQ ID NO: 657 - protein, 2454 aa, Phanerochaete chrysosporium
CTTCGGTCGAGTTCACGATGCTAGGTCGATCGTTACTTGCGCTTCTGCCTTTTGTAGGCCTCGCGTTCTCGCAGAGTGCCTCACAGTTTACCGACCCTACCACAGGATTCCAGTTCACTGGTATCACCGACCCTGTTCATGACGTGACCTACGGCTTCGTTTTCCCCCCTCTGGCCACCTCCGGAGCGCAATCCACTGAGTTCATCGGAGAGGTTGTTGCCCCCATCGCATCAAAATGGATTGGTATTGCCCTCGGTGGCGCCATGAACAACGACCTGCTACTTGTGGCTTGGGCCAACGGCAACCAAATTGTTTCCTCCACTCGCTGGGCTACTGGCTATGTACAGCCGACTGCATATACGGGAACTGCCACTTTGACAACACTCCCTGAGACAACCATCAACTCCACGCACTGGAAGTGGGTCTTCAGGTGTCAGGGCTGCACTGAGTGGAACAATGGCGGCGGAATCGACGTCACTAGCCAGGGCGTTCTGGCGTGGGCATTCTCCAACGTCGCCGTCGACGACCCCTCCGACCCGCAGAGTACCTTCAGCGAGCACACCGACTTCGGCTTCTTCGGAATTGACTACTCGACCGACAGCGCCAACTACCAGAACTACCTTAATGGCGACTCCGGCAACCCTACGACCACGAGCACCAAGCCCACAAGCACGAGCAGCTCAGTCACGACTGGACCCACTGTTTCTGCTACACCTTACGATTACATCATCGTCGGTGCTGGTCCTGGCGGTATCATTGCAGCTGATCGTCTGTCGGAGGCTGGCAAGAAGGTTCTCCTTCTCGAGCGCGGTGGCCCTAGCACCAAGCAGACCGGTGGAACGTATGTCGCTCCATGGGCTACTAGCAGTGGTCTAACGAAGTTCGATATTCCCGGACTGTTCGAGTCCTTGTTCACTGATTCCAACCCCTTCTGGTGGTGCAAAGACATCACAGTCTTCGCTGGTTGCCTGGTCGGCGGCGGTACTTCGGTCAACGGAGCTCTCTACTGGTACCCTAACGACGGCGACTTCTCCTCGAGCGTTGGTTGGCCAAGCAGCTGGACCAACCACGCCCCGTACACGAGCAAGCTTTCGTCTCGTCTCCCCAGTACGGACCACCCTTCGACTGATGGCCAGCGCTACCTTGAGCAATCATTCAACGTCGTGTCTCAACTTCTCAAAGGCCAAGGCTACAACCAGGCCACCATCAACGACAACCCCAACTACAAGGACCACGTCTTCGGCTACAGCGCATTCGATTTCCTTAACGGCAAGCGTGCTGGTCCAGTCGCCACCTACCTCCAGACGGCATTGGCTCGCCCCAACTTCACTTTCAAGACCAATGTCATGGTCTCGAACGTTGTCCGCAACGGCTCGCAGATCCTCGGTGTCCAGACGAACGACCCGACGCTCGGCCCCAACGGTTTCATCCCCGTGACCCCGAAGGGGCGTGTCATCCTCTCTGCTGGTGCATTTGGCACTTCGCGCATTCTCTTCCAAAGCGGTATTGGCCCCACGGATATGATTCAGACTGTTCAGAGCAACCCGACCGCCGCCGCCGCGCTCCCGCCGCAGAACCAGTGGATCAACCTCCCAGTCGGCATGAACGCACAGGACAACCCCTCGATCAACCTGGTCTTCACCCACCCCAGCATCGATGCCTATGAGAACTGGGCTGACGTCTGGAGCAACCCGCGCCCGGCTGACGCTGCACAGTACCTCGCGAACCAGTCCGGTGTCTTCGCAGGTGCTTCTCCCAAACTCAACTTCTGGCGCGCATACTCTGGTTCGGATGGCTTTACCCGTTATGCCCAGGGGACGGTGCGCCCGGGCGCAGCCTCCGTGAACTCCTCGCTGCCGTACAACGCGAGCCAGATCTTCACGATCACCGTGTACCTCTCTACGGGCATCCAGTCGCGTGGGCGCATCGGCATCGATGCAGCGCTCCGCGGTACGGTGCTCACACCGCCGTGGCTCGTGAATCCGGTCGACAAGACCGTGCTCCTGCAGGCGCTGCACGACGTCGTCTCGAACATAGGGTCGATTCCCGGCCTGACGATGATCACGCCCGACGTCACGCAGACACTCGAGGAGTACGTCGATGCGTACGACCCCGCGACGATGAACTCGAACCACTGGGTCTCGTCCACGACGATCGGCTCATCTCCCCAGAGCGCGGTAGTCGATTCGAACGTCAAGGTCTTTGGCACGAACAACCTGTTTATCGTCGACGCAGGTATCATTCCCCACCTGCCCACGGGCAACCCCCAGGGCACGCTCATGTCTGCCGCCGAGCAGGCGGCCGCGAAGATCCTCGCGCTTGCGGGAGGTCCTTGAGCGAAATTCTTTATATTACTGTCCTCGGGGCTGTAGACGTAAAAACGGATGTTATACTATCGATGGAAAAAAATACGTTTGTCCCATCTAAAAAAAAAAAAAAAAAAAAAAAAAAAAA

SEQ ID NO: 658 - protein, 772 aa, Phanerochaete chrysosporium
MLGRSLLALLPFVGLAFSQSASQFTDPTTGFQFTGITDPVHDVTYGFVFPPLATSGAQSTEFIGEVVAPIASKWIGIALGGAMNNDLLLVAWANGNQIVSSTRWATGYVQPTAYTGTATLTTLPETTINSTHWKWVFRCQGCTEWNNGGGIDVTSQGVLAWAFSNVAVDDPSDPQSTFSEHTDFGFFGIDYSTDSANYQNYLNGDSGNPTTTSTKPTSTSSSVTTGPTVSATPYDYIIVGAGPGGIIAADRLSEAGKKVLLLERGGPSTKQTGGTYVAPWATSSGLTKFDIPGLFESLFTDSNPFWWCKDITVFAGCLVGGGTSVNGALYWYPNDGDFSSSVGWPSSWTNHAPYTSKLSSRLPSTDHPSTDGQRYLEQSFNVVSQLLKGQGYNQATINDNPNYKDHVFGYSAFDFLNGKRAGPVATYLQTALARPNFTFKTNVMVSNVVRNGSQILGVQTNDPTLGPNGFIPVTPKGRVILSAGAFGTSRILFQSGIGPTDMIQTVQSNPTAAAALPPQNQWINLPVGMNAQDNPSINLVFTHPSIDAYENWADVWSNPRPADAAQYLANQSGVFAGASPKLNFWRAYSGSDGFTRYAQGTVRPGAASVNSSLPYNASQIFTITVYLSTGIQSRGRIGIDAALRGTVLTPPWLVNPVDKTVLLQALHDVVSNIGSIPGLTMITPDVTQTLEEYVDAYDPATMNSNHWVSSTTIGSSPQSAVVDSNVKVFGTNNLFIVDAGIIPHLPTGNPQGTLMSAAEQAAAKILALAGGP

SEQ ID NO: 659 - DNA, 3627 bp, Phanerochaete chrysosporium
ttttggtcgggtttacgtcgggcaacgccgcacaccgcgtcgccctcggtggaagatagctggcaacatctgcacgggctggcaccccatgctgctcacgcgcaccgtgaggtattctgggcttcctacgattttacctcggtgttatcaacaacatctgtcgcctttccttaccctcatcacgaccgtgatcacgagcgggtacacgtatccgacgtgtctccgccgcgtccgtcagcgagctacattgcgcgccccgccggccacgaatacacatgtgccacgacgtccctctatagcggatctttttctgcgtacctcacgaggactgtcggccaatctctgaacatggatttgttttctcagctgccggcatatcttcgcccgtctcggaaagaaaatagagcaagcccgctttaaaaaccagagagagggcagcaacagcaggccaggtgcacttcggtcgagttcacgatgctaggtcgatcgttacttgcgcttctgccttttgtaggcctcggtacgcggttttgacgtcctcacagaaggcttcgcaactgatgcaaagcgcgcggccagcgttctcgcagagtgcctcacagtttaccgaccctaccacaggattccagttcactggtattaccgaccctgttcatgacgtgacctacggcttcgttttcccccctctggccacctccggagcgcaatccactgagttcatcggagaggttgttgcccccatcgcatcaaaatggattggcattgccctcggtggcgccatgaacaacgacctgctacttgtggcttgggccaacggcaaccaaattgtttcctccactcgctgggctacgtacgttttcccacatactcgccgtataccaggagctaacaagtctatagtggctatgtacagccgacgtgagtgccatagctcaacaacgtactctgccttgctgaagttgtgttacagtgcatatacgggaactgccactttgacaacactccccgagacaaccatcaactccacgcactggaagtgggtcttcaggtgccaaggctgcactggtaagcgggtccttctgctgacaattgcattgcctgaccattgcacacacagagtggaacaacggcggcggaatcgacgtcactagccagggtgttctggcgtgggcattctccaacgtcgccgtcgacgacccctccgacccgcagagtaccttcagcgagcacaccgacttcggcttcttcggcattgactactcgaccgcgcacagcgccaactaccagaactaccttaacggcgactccggcaaccctacgaccacgagcaccaagcccacaagcacgagcagctcagtcacgactgggcccactgtttctgtgcgtgttggcaacttctgggtagggcatctagttgacttgtgatcataggctacaccttacgattacatcatcgtcggtgctggtcctggcggtatcattgcagctgatcgtctgtcggaggctggcaagaaggttctccttctcgagcgcggtggccctagcaccaagcagaccggtggaacatatgtcgctccatgggctactagcagtggtgtaagcacgatccatctcccgcaacgcctcaatgctgacatgtcactgtgtgcagctgacgaagttcgatattcccggactgttcgagtccttgttcactgattccaaccccttctggtggtgcaaaggtgagttcaccttcctagcgagacaggctgcatcgctgactcttcgggatcagacatcacagtcttcgctggttgcctggtcggcggcgggacttcggtcaacggagcgtgagtttcctccgtttccatcttatcgcagccagactaaacggaactagtctctactggtaccctaacgacggtgacttctcctcgagtgttggctggccaagcagctggaccaaccacgccccgtacacgagcaagctttcgtctcgtctccccagtacggaccacccttcgactgatggccagcgctaccttgagcagtcattcaacgtcgtgtctcaacttctcaaaggccaaggctacaaccaggccaccatcaacgacaaccccaattacaaggaccacgtcttcggctacagcgcattcgatgtacgtgctttctcatctcaggaaaatgccctgtctaagctttcttcagttccttaatggcaagcgtgctggtccagtcgctacctacctccagacggcattggctcgccccaacttcactttcaagaccaatgtcatggtttcgaacgttgtccgcaacggctcgcagatcctcggtgtccagacgaacgacccgacgctcggccccaacggtttcatccccgtgaccccgaagggtcgtgtcatcctctctgctggtgcatttggcacttcgcgcattctcttccaaagcggtattggccccacggatatgatccagactgttcagagcaacccgaccgccgccgctgcgctcccgcctcaaaaccagtggattaacctcccagtcggcatgaacgcacaggacaacccctcgatcaacgtgagcagcaaattttcctaccacgcctgtccgcaagactgacgttctgtgcagctggtcttcacccaccccagcattgatgcctatgagaactgggctgacgtctggagcaacccgcgcccggctgacgctgcacagtacctcgcgaaccagtccggtgtcttcgcaggtgcttctcccaagtcagtatgctgccctgcatgatgtcactcctgtgtctaacagatcctccaggctcaacttctggcgcgcatactctggttcggatggctttacccgttatgtacgtgatcgtcgtcttcgtgcgggaccccagactcaccgggatctgcaggcccagggaaccgtgcgcccgggcgcagcctccgtgaactcgtcgctgccgtacaacgcgagccagatcttcacgatcaccgtgtacctctctacgggcatccagtcgcgtgggcgcatcggcatcgacgcagcgctccgcggtacggtgctcaccccgccatggctcgtgaacccggtcgacaagaccgtgctcttgcaggcgctgcacgacgtcgtgtcgaacatagggtcgattcccggcctgacgatgatcacgcccgacgtcacgcagacactcgaggagtacgtcgatgcgtacgaccccgcgacgatgaactcaaaccactgggtctcgtccacgacgatcggctcgtccccccagagcgcggtcgtcgattcgaatgtcaaggtctttggcacgaacaacctggtgagtgtccgcggtcccgaaagagtatggcatcgtggctgacgctgcacagtttatcgtcgacgcaggtatcattcctcacctgcccacaggcaacccccagggcacgctcatgtctgccgccgagcaggccgccgcgaagatcctcgcgcttgcgggaggtccttgagcgaaattctttatatcactgtcctcggggctgtagacgtaaaaacggatgttatactatcgatggaaaaaagatacgtttgtcccatctatcgggcgtgaggatcgatgctccgccatcgctggccgtcgcgcgaccactgcgcgagctc

SEQ ID NO: 660 - protein, 773 aa, Phanerochaete chrysosporium
MLGRSLLALLPFVGLAFSQSASQFTDPTTGFQFTGITDPVHDVTYGFVFPPLATSGAQSTEFIGEVVAPIASKWIGIALGGAMNNDLLLVAWANGNQIVSSTRWATGYVQPTAYTGTATLTTLPETTINSTHWKWVFRCQGCTEWNNGGGIDVTSQGVLAWAFSNVAVDDPSDPQSTFSEHTDFGFFGIDYSTAHSANYQNYLNGDSGNPTTTSTKPTSTSSSVTTGPTVSATPYDYIIVGAGPGGIIAADRLSEAGKKVLLLERGGPSTKQTGGTYVAPWATSSGLTKFDIPGLFESLFTDSNPFWWCKDITVFAGCLVGGGTSVNGALYWYPNDGDFSSSVGWPSSWTNHAPYTSKLSSRLPSTDHPSTDGQRYLEQSFNVVSQLLKGQGYNQATINDNPNYKDHVFGYSAFDFLNGKRAGPVATYLQTALARPNFTFKTNVMVSNVVRNGSQILGVQTNDPTLGPNGFIPVTPKGRVILSAGAFGTSRILFQSGIGPTDMIQTVQSNPTAAAALPPQNQWINLPVGMNAQDNPSINLVFTHPSIDAYENWADVWSNPRPADAAQYLANQSGVFAGASPKLNFWRAYSGSDGFTRYAQGTVRPGAASVNSSLPYNASQIFTITVYLSTGIQSRGRIGIDAALRGTVLTPPWLVNPVDKTVLLQALHDVVSNIGSIPGLTMITPDVTQTLEEYVDAYDPATMNSNHWVSSTTIGSSPQSAVVDSNVKVFGTNNLFIVDAGIIPHLPTGNPQGTLMSAAEQAAAKILALAGGP

SEQ ID NO: 661 - DNA, 3623 bp, Phanerochaete chrysosporium
ttttggtcgggtttacgtcgggcaacgccgcacaccgcgtcgccctcggtggaagatagctggcaacatctgcacgggctggcaccccatgctgctcacgcgcaccgtgaggtattctgggcttcctacgattttacctcggtgttatcaacgacatctgtcgcctttgcttaccctcatcacgaccgtgatcacgagcgggtacacgtatccgacgtgtctccgccgcgtccgtcagcgagctacattgcgcgccccgccggccacgaatacacatgtgccacgacgtccctctatagcggatctttttctgcgtacctcacgaggactgtcggccaatctctgaacatggatttgttttctcagctgccggcatatcttcgcccgtctcggaaagaaaatagagcaagcccgctttaaaaaccagagagagggcagcaacagcaggccaggtgcacttcggtcgagttcacgatgctaggtcgatcgttacttgcgcttctgccttttgtaggcctcggtacgcggttttaacgtcctcacagaaggcttcgcaactgacgcaaagcgcgcggccagcgttctcgcagagtgcctcacagtttaccgaccctaccacaggattccagttcactggtatcaccgaccctgttcatgacgtgacctacggcttcgttttcccccctctggccacctccggagcgcaatccactgagttcatcggagaggttgttgcccccatcgcatcaaaatggattggtattgccctcggtggcgccatgaacaacgacctgctacttgtggcttgggccaacggcaaccaaattgtttcctccactcgctgggctacgtacgttttcccacatactcgccgtataccaggagctaataagtctatagtggctatgtacagccgacgtgagtgctatagctcaacatcatactctgccttgctgaagttgtgttacagtgcatatacgggaactgccactttgacaacactccctgagacaaccatcaactccacgcactggaagtgggtcttcaggtgtcagggctgcactggtaagcggatccttctgctgacaaatgcattgcctgacaattgcactcacagagtggaacaatggcggcggaatcgacgtcactagccagggcgttctggcgtgggcattctccaacgtcgccgtcgacgacccctccgacccgcagagtaccttcagcgagcacaccgacttcggcttcttcggaattgactactcgaccgcgcacagcgccaactaccagaactaccttaatggcgactccggcaaccctacgaccacgagcaccaagcccacaagcacgagcagctcagtcacgactggacccactgtttctgtacgtgttggcaacttctgggtagggcatctagttgacttgtgatcataggctacaccttacgattacatcatcgtcggtgctggtcctggcggtatcattgcagctgatcgtctgtcggaggctggcaagaaggttctccttctcgagcgcggtggccctagcaccaagcagaccggtggaacgtatgtcgctccatgggctactagcagtggtgtaagcgcgatccatctctcgcaacgcgccaatgctaataattcactgtgtgtagctaacgaagttcgatattcccggactgttcgagtccttgttcactgattccaaccccttctggtggtgcaaaggtgagttcaccttactagcgagacaggctgcatcgctgacttcgggatcagacatcacagtcttcgctggttgcctggtcggcggcggtacttcggtcaacggagcgtgagtttcccccgtttccatcttatagcagccagactaaacggaactagtctctactggtaccctaacgacggcgacttctcctcgagcgttggttggccaagcagctggaccaaccacgccccgtacacgagcaagctttcgtctcgtctccccagtacggaccacccttcgactgatggccagcgctaccttgagcaatcattcaacgtcgtgtctcaacttctcaaaggccaaggctacaaccaggccaccatcaacgacaaccccaactacaaggaccacgtcttcggctacagcgcattcgatgtacgtgctttctcatgtcacgaagcatgccccgtctaagcatccttcagttccttaacggcaagcgtgctggtccagtcgccacctacctccagacggcattggctcgccccaacttcactttcaagaccaatgtcatggtctcgaacgttgtccgcaacggctcgcagatcctcggtgtccagacgaacgacccgacgctcggccccaacggtttcatccccgtgaccccgaaggggcgtgtcatcctctctgctggtgcatttggcacttcgcgcattctcttccaaagcggtattggccccacggatatgattcagactgttcagagcaacccgaccgccgccgccgcgctcccgccgcagaaccagtggatcaacctcccagtcggcatgaacgcacaggacaacccctcgatcaacgtgagcagcagtttttcctaccacgcctgtccgtaagactgacgttctgtgcagctggtcttcacccaccccagcatcgatgcctatgagaactgggctgacgtctggagcaacccgcgcccggctgacgctgcacagtacctcgcgaaccagtccggtgtcttcgcaggtgcttctcccaagtcagtatgctgccctgcatgatgtcactcccgtgtctaacagatcctccagactcaacttctggcgcgcatactctggttcggatggctttacccgttatgtacgtgatcgccgtcttcgtgcggaccccagactcaccgggatctgcaggcccaggggacggtgcgcccgggcgcagcctccgtgaactcctcgctgccgtacaacgcgagccagatcttcacgatcaccgtgtacctctctacgggcatccagtcgcgtgggcgcatcggcatcgatgcagcgctccgcggtacggtgctcacaccgccgtggctcgtgaatccggtcgacaagaccgtgctcctgcaggcgctgcacgacgtcgtctcgaacatagggtcgattcccggcctgacgatgatcacgcccgacgtcacgcagacactcgaggagtacgtcgatgcgtacgaccccgcgacgatgaactcgaaccactgggtctcgtccacgacgatcggctcatctccccagagcgcggtagtcgattcgaacgtcaaggtctttggcacgaacaacctggtgagtgtccgcggtcccgaaaggtatggcgtcgtggctgacgctgcatagtttatcgtcgacgcaggtatcattccccacctgcccacgggcaacccccagggcacgctcatgtctgccgccgagcaggcggccgcgaagatcctcgcgcttgcgggaggtccttgagcgaaattctttatattactgtcctcggggctgtagacgtaaaaacggatgttatactatcgatggaaaaaaatacgtttgtcccatctatcgggcgtgaggatcgatgctccgccatcgctggccgtcgcgcggccactgcgcgagctc

SEQ ID NO: 662 - protein, 773 aa, Phanerochaete chrysosporium; identical to SEQ ID NO: 660

SEQ ID NO: 663 - DNA, 2428 bp, Phanerochaete chrysosporium
cttcggtcgagttcacgatgctaggtcgatcgttacttgcgcttctgccttttgtaggcctcgcgttctcgcagagtgcctcacagtttaccgaccctaccacaggattccagttcactggtatcaccgaccctgttcatgacgtgacctacggcttcgttttcccccctctggccacctccggagcgcaatccactgagttcatcggagaggttgttgcccccatcgcatcaaaatggattggtattgccctcggtggcgccatgaacaacgacctgctacttgtggcttgggccaacggcaaccaaattgtttcctccactcgctgggctactggctatgtacagccgactgcatatacgggaactgccactttgacaacactccctgagacaaccatcaactccacgcactggaagtgggtcttcaggtgtcagggctgcactgagtggaacaatggcggcggaatcgacgtcactagccagggcgttctggcgtgggcattctccaacgtcgccgtcgacgacccctccgacccgcagagtaccttcagcgagcacaccgacttcggcttcttcggaattgactactcgaccgcgcacagcgccaactaccagaactaccttaatggcgactccggcaaccctacgaccacgagcaccaagcccacaagcacgagcagctcagtcacgactggacccactgtttctgctacaccttacgattacatcatcgtcggtgctggtcctggcggtatcattgcagctgatcgtctgtcggaggctggcaagaaggttctccttctcgagcgcggtggccctagcaccaagcagaccggtggaacgtatgtcgctccatgggctactagcagtggtctaacgaagttcgatattcccggactgttcgagtccttgttcactgattccaaccccttctggtggtgcaaagacatcacagtcttcgctggttgcctggtcggcggcggtacttcggtcaacggagctctctactggtaccctaacgacggcgacttctcctcgagcgttggttggccaagcagctggaccaaccacgccccgtacacgagcaagctttcgtctcgtctccccagtacggaccacccttcgactgatggccagcgctaccttgagcaatcattcaacgtcgtgtctcaacttctcaaaggccaaggctacaaccaggccaccatcaacgacaaccccaactacaaggaccacgtcttcggctacagcgcattcgatttccttaacggcaagcgtgctggtccagtcgccacctacctccagacggcattggctcgccccaacttcactttcaagaccaatgtcatggtctcgaacgttgtccgcaacggctcgcagatcctcggtgtccagacgaacgacccgacgctcggccccaacggtttcatccccgtgaccccgaaggggcgtgtcatcctctctgctggtgcatttggcacttcgcgcattctcttccaaagcggtattggccccacggatatgattcagactgttcagagcaacccgaccgccgccgccgcgctcccgccgcagaaccagtggatcaacctcccagtcggcatgaacgcacaggacaacccctcgatcaacctggtcttcacccaccccagcatcgatgcctatgagaactgggctgacgtctggagcaacccgcgcccggctgacgctgcacagtacctcgcgaaccagtccggtgtcttcgcaggtgcttctcccaaactcaacttctggcgcgcatactctggttcggatggctttacccgttatgcccaggggacggtgcgcccgggcgcagcctccgtgaactcctcgctgccgtacaacgcgagccagatcttcacgatcaccgtgtacctctctacgggcatccagtcgcgtgggcgcatcggcatcgatgcagcgctccgcggtacggtgctcacaccgccgtggctcgtgaatccggtcgacaagaccgtgctcctgcaggcgctgcacgacgtcgtctcgaacatagggtcgattcccggcctgacgatgatcacgcccgacgtcacgcagacactcgaggagtacgtcgatgcgtacgaccccgcgacgatgaactcgaaccactgggtctcgtccacgacgatcggctcatctccccagagcgcggtagtcgattcgaacgtcaaggtctttggcacgaacaacctgtttatcgtcgacgcaggtatcattccccacctgcccacgggcaacccccagggcacgctcatgtctgccgccgagcaggcggccgcgaagatcctcgcgcttgcgggaggtccttgagcgaaattctttatattactgtcctcggggctgtagacgtaaaaacggatgttatactatcgatggaaaaaaatacgtttgtcccatca

SEQ ID NO: 664 - protein, 773 aa, Phanerochaete chrysosporium; identical to SEQ ID NO: 660

SEQ ID NO: 665 - DNA, 2160 bp, Clostridium cellulolyticum
atcttccttactaggatttaaatagtactaatttttattctttcataatgttaaaaagcactttccagttcgacgcctccatgcttcttaaaattatataatgtatacaatttctagtattaatataatgataacacatataggtacttctgtggtataagaatttttaataattgagtaatatattacaattgagtgctatgtgacaattgtattcgaagatgtcagtttatataattaaattagataatatgtaaaattaatacaggggggatttttaatgaaaaagatattagcactgattatatcgtgcagtattattatgagctttttacctatgtctgtctatggtgctatcaattctcaggatatggtaaaaaagatgggaataggaatgaaccttggaaatacgtttgacgcaccaacggaaggttcttggtcaaaggcagctcaggagtactattttgatgattttaaacaggccggtttcaagcatgttagaattccaatccgttgggatcagcatacacttgcaaacagtccgtatactgttgacagcaacttcttaaacagaattgaaactgtaatagactggtcactttcccgtggatttgtgacggtaattaattctcatcatgatacttggcttatggataactatagtcagaatatcggacggtttgaaaaaatatgggaacaaattgcacaacgttttaaaggcaagtctgaaaatctggtttttgaaatattaaatgagccacatggtaatataacagatagccagataaacgatatgaacaaaagaattttaaatataataagaaagactaatccgactagaaatgtaattattggcgcaggttactggaatagctataattcattaagtcagttggaaattccaaacgacccaaatcttattgcaacttttcactactatgacccatactctttcactcaccagtggcagggtacatggggaaccaaaaatgatatggatgccatagcaatggtttttaaccatgttaaaaaatggtcagataaaaataacatacctgtatatcttggggaatatggtgtaatgggacattccgatagaacatctgctgtaaaatggtttgattttgtaagtgatcaggctatatcacatggattttcttgtggagcttgggataatggagtatttggctctgttgacaatgatatggcattttataatagagataccagacagtttgataaggaaatcttaaatgcaatattaactactgggacaacctatgattggactcctccaactgaaacaaatccagatcctcctcgtacacctgcaacaccagcctacggggaacagcttattgaagatttcgaaggtgctatgcagtgggctgcatattccggtgttgatgctactgcatcatgtaagatttctagtggcaaatcaaataacggtttggaaataacatatgcaggttcatcaaatgggtactggggtgttgtagacaatgaacatagaaatcaagattgggagaaatggcaaaaaatatcctttgatataaaatcctcaaacacaaatgaagttagactactaatagctgaacaaagtaagattgaaggagaagatggagaacactggacttatgtcataaaacctagtacctcttggactacgattgagattccattttcatcttttacaaaaagaatggattatcagccacctgcacaagatggtagtgaaacttttgacttatacaaagtaggttccttgcattttatgtatagtaacagtaattcaggtactttaaatattgataatattaagttgattggcttaccagaagaacaaattggaggaaaaattggagatgttaatgaagatggcaatattgatgcaatagattttgcattgttaaaaaaatacttgctagactcatctattagcataaataaagtgaatgcagacattaatttagatggagatatcaatgccattgactttgcaaagttgaaaatgatgttacttggagactaatttcataagcatatttgaaaatttaattgtgtgaaataaaccactggagataatcgagggactgaaaaagtcccttaggggtagtgaatataatgaatccaagaaactagacgacaaaatccaaa

SEQ ID NO: 666 - protein, 584 aa, Clostridium cellulolyticum
MKKILALIISCSIIMSFLPMSVYGAINSQDMVKKMGIGMNLGNTFDAPTEGSWSKAAQEYYFDDFKQAGFKHVRIPIRWDQHTLANSPYTVDSNFLNRIETVIDWSLSRGFVTVINSHHDTWLMDNYSQNIGRFEKIWEQIAQRFKGKSENLVFEILNEPHGNITDSQINDMNKRILNIIRKTNPTRNVIIGAGYWNSYNSLSQLEIPNDPNLIATFHYYDPYSFTHQWQGTWGTKNDMDAIAMVFNHVKKWSDKNNIPVYLGEYGVMGHSDRTSAVKWFDFVSDQAISHGFSCGAWDNGVFGSVDNDMAFYNRDTRQFDKEILNAILTTGTTYDWTPPTETNPDPPRTPATPAYGEQLIEDFEGAMQWAAYSGVDATASCKISSGKSNNGLEITYAGSSNGYWGVVDNEHRNQDWEKWQKISFDIKSSNTNEVRLLIAEQSKIEGEDGEHWTYVIKPSTSWTTIEIPFSSFTKRMDYQPPAQDGSETFDLYKVGSLHFMYSNSNSGTLNIDNIKLIGLPEEQIGGKIGDVNEDGNIDAIDFALLKKYLLDSSISINKVNADINLDGDINAIDFAKLKMMLLGD

SEQ ID NO: 667 - DNA, 2382 bp, Bacillus pumilus
ccatccttgaatatttagatcgtcaaggctgtttagaagcacttcctgatcaaaaccagctttctttattttaatgtgataaataagagcgccctaaaagggcgttcttttctctatatacaataattttattatgttaactaataaagatttcttatcaattggaattattttcttattccttcatatatcttgatttagcgtgatgttttaagagaagagattgtatgtcattctttctacccaaatagagctcaaaagagaatttcgccgtctgaaatgttctcaagcgacatatgatcattctgggtacagtcagaaggagaatcaagagaaaaccttcgatgagcgtaaagctgattgctgtttactatgcttatttttgaaacctatttgattcttttcaaaactgtacagatcacgaaacgaaggatagaaaggaggcggttgcgtctattgaatcaatgtttcactaaaaaggaaggggtgagcaatagagaaatggcatcttacaactatgtagaggttttacaaaaatccatgctgttttatgaagcgcagcggtcaggccggcttccggaaagtaatcgtcttaactggcggggagattctggactaaaggacgggaaggatgttgggcatgacttaactggcggctggtatgatgcaggagatcatgtgaaatttggacttccgatggcttactcagcagccgtgcttgcatggacagtatatgaataccgagaagcttatgaagaagcagaattgcttgatgagatcttagatcaaatcaagtgggcaacagattattttttgaaagcacatacaggaccgaatgaattttgggcgcaagtaggtgatggaaacgccgatcatgcttggtgggggccagcagaagtgatgccgatgaaccggccagcttttaaaattgatgaacattgtcctggcacagaagtagctgcacaaactgcggctgctttagcagcaggttctatcatttttaaagaaacagatgcgtcctatgcagcaaagcttttaacacacgccaaacagctatatgcatttgctgacaggtatcgcggcaaatatacagattgtgtcaccaatgcccagccattttacaactcctggagcggctatgttgacgaacttatttggggtggaatctggctgtacttggcgacaaatgaagaaacctatttaaacaaagcattaaaagcggtagaagaatggccgcaggattgggattatacgtttaccatgtcatgggacaatactttttttgcttcacaaatcttactagcaagaattacgaaagaaaacagatttatagaatcgacagagcgcaatcttgattactggaccacaggtcttgttcaaaatggaaaagtagaaagaatcacctatactcctggcggcttggcatggctggatcaatggggttcacttcgttatgccgccaatgcagcatttttagcctttgtctatgctgattgggtatctgatcaagaaaagaaaaatcgataccaatcgtttgcgattaagcaaacccactatatgttaggtgataatccactgaatagaagctacgtcgttgggtttggccagaattcgccgaagcacccgcaccaccgtactgcacatggctcatggtctaaccagctgacaaatcctccatctcaccggcacactctttatggagcgcttgtagggggtcctaatgcacaggatcaatatgatgatgatatctctgattatatatctaacgaggtggcgaccgattataatgccgcctttactggaaatatcgccaaaatggtgcagctgtttggtgaagggcaatcaaagctgccaaatttcccgcctaaagaacaagtggaggatgagttttttgtagaggcagctgtaatgcataacgatacaacatctactcaagtgaaagcagtgctgtacaacaggtccggctggccggcaagaagcagtcaaacactatcttttagatattacgtcaatctgagcgaggtttttgcaaagggattcactgaaaaggatattcaagtgacagcagcctacaatgaaggcgcttccttatcgcctttaaaagtatatgacgcatcaagccgcgtctattttgcagaaatcgattttacgggcgtagtcatttctcctagaggagaatctgagcataagaaggaaatacaatttcgattatctgctccaaatggatcgaatatatgggatgcctcaaatgattattcctatcaaggattaacatccaatatgcaaaaaacaacaaagattcctgtctttgaagatggtgttttagtatttggcacacttccagacaaataaaaatcaacgattttattgaaagggtgaagg

SEQ ID NO: 668 - protein, 659 aa, Bacillus pumilus
MLIFETYLILFKTVQITKRRIERRRLRLLNQCFTKKEGVSNREMASYNYVEVLQKSMLFYEAQRSGRLPESNRLNWRGDSGLKDGKDVGHDLTGGWYDAGDHVKFGLPMAYSAAVLAWTVYEYREAYEEAELLDEILDQIKWATDYFLKAHTGPNEFWAQVGDGNADHAWWGPAEVMPMNRPAFKIDEHCPGTEVAAQTAAALAAGSIIFKETDASYAAKLLTHAKQLYAFADRYRGKYTDCVTNAQPFYNSWSGYVDELIWGGIWLYLATNEETYLNKALKAVEEWPQDWDYTFTMSWDNTFFASQILLARITKENRFIESTERNLDYWTTGLVQNGKVERITYTPGGLAWLDQWGSLRYAANAAFLAFVYADWVSDQEKKNRYQSFAIKQTHYMLGDNPLNRSYVVGFGQNSPKHPHHRTAHGSWSNQLTNPPSHRHTLYGALVGGPNAQDQYDDDISDYISNEVATDYNAAFTGNIAKMVQLFGEGQSKLPNFPPKEQVEDEFFVEAAVMHNDTTSTQVKAVLYNRSGWPARSSQTLSFRYYVNLSEVFAKGFTEKDIQVTAAYNEGASLSPLKVYDASSRVYFAEIDFTGVVISPRGESEHKKEIQFRLSAPNGSNIWDASNDYSYQGLTSNMQKTTKIPVFEDGVLVFGTLPDK

SEQ ID NO: 669 - DNA, 6465 bp, Clostridium thermocellum
tttataaatatttataaaaaacatgtaagattgataaatgaaggctttttatattattttttgtaattattgcattttgcccccttaaaaaattttaaaattcgaaattaatttttgcgtatggattgtgcaataaaaatatgataatatttaggtgaatataaaaagattgtattaatcaattgcttacaggtataaaaattaagaaaattgcgcactgtgttggcgtaaccttaatcaacaattggaaatggggtttgggaagtatacttggaagcaactggttattattgaaatttacagacgatgtgaaagactgtgaacaaaccaatcaatgcccaaattatactttgcagcaaaatcatccttgcatatcccttcagatttaaaagccgcgacaattagcgtttccgatgaagctcatttatgtgaacctcgattccttcctataaaatttactctattttcatttcaatttttccagtttgcatgtggaattatttcccgaagctccgtatttctgttgttgatggtttgtatgtcaacatatgcgtgcattttaatataaaatgaattgttaaaggagtgtgaaatatggcaaagagaagattatcgctacttttggtacttgccataatgtttacgatggtcgttccacagatatctgcaagtgccgaaacagttgctcctgaaggctacaggaagcttttggatgtacaaattttcaaggattcgcctgtagtcggatggtcaggaagcggtatgggcgagcttgaaactatcggcgatacccttccggttgataccacagttacatataacggtttgccgactttaagactgaatgtccagacaaccgttcagtcaggatggtggatttctcttcttacattaagaggatggaacacccatgacctttcccagtatgtcgaaaacggttatcttgagtttgacatcaagggtaaggaaggcggagaagactttgttattggtttcagggacaaggtttatgaacgcgtttacggacttgaaattgatgttaccacagtaatatcaaattatgtaacggtaactacggactggcagcatgttaagattcctttgagagacctgatgaagattaataacggatttgatccttcatcagttacatgcctggtgttctcaaaaagatatgcagatccgtttacagtatggttcagtgatataaagattacatcagaagacaatgaaaagtccgctcctgcaatcaaggtaaaccagcttggctttattcctgaagctgaaaaatacgctttggttacaggttttgcagaagagctcgcagtatcggaaggtgacgaatttgccgttataaatgctgcggacaattctgttgcttataccggaaaattaactcttgtaacagaatatgaacctcttgattccggagaaaaaatacttaaggcagatttcagcgacttgactgtacctggcaaatactacattagtattgaaggtcttgacaattcacccaagtttgaaatcggtgaaggtatttacggtccactggttgttgacgctgcaagatatttctattatcagcgtcagggtatagaacttgaagagccttatgcgcagggatatccccgcaaggacgttactcctcaggacgcatatgctgtatttgcatccggaaagaaggatccgattgacataacaaagggttggtatgacgcaggagacttcggtaagtatgtaaatgccggagcaaccggtgtttccgatttgttctgggcatatgaaatgttcccttcccagtttgttgacggtcagttcaatattcctgaaagcggaaacggtgtaccggacatccttgacgaagctcgctgggagcttgaatggatgctgaaaatgcaggacaaagaaagcggaggattctatcccagagttcaatctgacaatgacgaaaacataaaatcaagaataatcagggatcagaacggctgtaccactgatgatactgcatgtgccgccggaatacttgctcatgcatacttgatttacaaggatattgaccctgattttgcacaagagtgcctggatgcggcaataaatgcatggaaattccttgaaaagaatcctgaaaacattgtttcacctccgggtccatacaacgtatatgacgacagcggagacagactctgggctgcagcttcgctgtacagagctaccggtgaagaggtttatcatacatactttaaacaaaactacaaatcttttgcacaaaagttcgaaagcccgactgcatatgctcatacatggggtgatatgtggcttacggcattcctttcgtatttgaaagctgaaaacaaggatcaggaagttgtagactggattgatacagagtttggaatctggcttgaaaacatactcacaagatatgagaacaatccatggaagaatgcaattgttcccggaaactacttctggggaatcaacatgcaggttatgaatgttccgatggatgctatcataggttcacagcttcttggaaaatacagtgacagaatagaaaaattaggttttggttcacttaactggctgcttggtacaaatccgcttcgcttcagctttgtatcaggatatggagaggattctgtaaaaggagtattcagcaatatttacaatacggacggcaagcagggaattccgaaaggatacatgcctggtggaccaaatgcttatgaaggtgcaggcctgtcaaggtttgcagcaaaatgctacaccagaagtaccggtgactgggtagccaacgaacatacagtatattggaactcagctttggtatttatggctgcttttgcaaaccagggttcagaggttaatccgggacctgcgccggaaccgggagtaactccgaatcctacagaacctgcaaaagtggttgacatcaggatagatacttctgctgaaagaaagccaatcagcccgtatatatacggaagcaatcaggaacttgatgcaacagttactgcaaagaggttcggcggaaacagaactacaggatacaactgggaaaacaacttctcaaatgcaggaagtgactggctgcattacagtgatacataccttttggaggacggcggagttcctaagggagagtggagtacacctgcttctgtagttaccacgttccatgacaaggcacttagcaaaaatgttccttacacacttatcactcttcaggcagcaggttatgtttccgcagacggaaacggaccggtttcccaggaagaaactgcaccgtcttcaagatggaaggaagttaagtttgaaaagggagcacctttctcacttacaccggacacagaagatgattatgtttacatggatgagtttgtaaactatcttgtaaacaaatacggaaatgcatccacacctacaggaataaagggttattcaatagataacgagccggcattgtggagtcatactcatccgagaattcatccggacaatgtaactgccaaagagcttattgaaaaatctgtagctctttccaaggcggttaaaaaggtagatccatatgcagaaatattcggacctgctttgtacggatttgccgcatatgagacacttcagtcagctcctgactggggaactgaaggagaaggatacaggtggtttatagattattacctcgataagatgaaaaaggcttctgatgaagaaggaaagagacttttggacgtacttgacgtacactggtatccggaagccaggggcggcggtgaaagaatatgctttggagccgatccaagaaatattgagacaaacaaagcaagattgcaggcgcccagaacattgtgggatcctacatatattgaagacagctggataggacaatggaagaaggatttcctcccgatattacctaatcttttggattccattgaaaaatattatccgggaacgaagcttgctataactgaatatgactatggcggaggaaatcatattacaggcggtattgctcaagccgatgttcttggtatattcggtaaatacggtgtttaccttgcaacattctggggagatgcaagcaataactatactgaggccggtataaacctttataccaactacgacggcaaaggcggcaaatttggagatacatccgtaaaatgtgaaacgtccgacatagaagtaagctctgcttatgcatccattgtcggtgaagatgacagcaaactccatatcattcttttgaacaagaactatgaccagccgacgacattcaatttctcaattgacagcagcaagaactacacaataggaaatgtatgggcatttgacagaggaagctccaatattactcaaagaactcctatagtgaacataaaggacaataccttcacatatacagtaccggctttgacagcgtgccatattgtgcttgaagctgcggagcccgtagtgtacggagacttgaacaatgactctaaagtaaacgcagtagacattatgatgctcaaacgatatattctcggaataatagataatataaatctgacagcagctgacatttattttgacggtgttgtaaattcaagtgactataatataatgaagagatatttgttaaaggcaatagaagatattccttatgttccggaaaaccaggcacctaaagcaatatttactttctcgcccgaagacccggttactgacgagaatgtagtgttcaatgcatcaaattcaatagatgaagacggaacaattgcctattatgcatgggatttcggtgacggatatgaaggaacttcaacaacaccgactattacctataagtataaaaaccccggaacatacaaagtaaaactgattgttacagacaaccagggggcttcaagttcgtttacagctaccataaaagtaacctcagctaccggggacaattccaaattcaactttgaagacggcacgctgggaggatttacaacatccggaacaaatgctacgggtgttgttgtgaacactactgaaaaagcattcaaaggcgaaagaggtcttaaatggactgtaacaagcgaaggagaaggaactgcagaattgaaacttgacggaggtactattgtagttcccggtaccactatgacgtttagaatctggataccttccggtgcgcctattgctgccatccagccgtatattatgcctcatacacctgattggtcggaagtcctctggaattcgacatggaaaggatacaccatggtgaagaccgatgactggaatgaaattaccctgacactgccggaagacgtggatccgacttggccgcagcagatgggtatacaggtacagaccatagatgaaggtgaattcactatctatgtagatgctattgactggtaagaaatttaattggtcaaacaaaaatcaaatcagttgcaagttataaggccgggcaaaaaaggaggaacctttgcggtttctccttttttgcttttaaaatttttttatcgagattagttcaaaaaacaaaaacgggaaacaggatttgacccacttaaaaatgtgtatgtgcacggattcctatttggagggaagcagaaattcataaaaactttaaaaatcttattaagtttggctgtgtaaagagagatggagttatgatataataatatttgaataatattatttatatcattaaacagtttaaataaataagcactatgcaaaacaaaacgccaatcagtttccatggtggtttccgctttctatacagcaaatctatttacacatattctccattttgattgaagcaagttttgtagttaaatgctatgggaaagttataatttttatataactttgttattgattttttatatttttcccttatggaggtgattttgtaaaatacaaacaataaatataatcaaatatattattaaattattttgaaggaggaatcatggtgaaaaagacattatgctttgtactgactttggctatgctgacggcatttattcttcctcaggggattgtgtccgcagcaggaagctataactatgcggaagcacttcagaaagccatttacttttatgagtgtcagcaggccggccctctacctgaatggaaccgcgttgagtggcgtggcgacgcaacaatgaatgatgaggtacttggtggatggtatgacgcaggtgaccatgtcaagtttaatctgcctatggcgtattcggcggcaatgcttggctgggctctttatgagtatggcgatgacattgaggcatcggggcagagacttcatcttgaaaggaaccttgcctttgcccttgactatcttgttgcctgcgacagaggtgacagtgtcgtttatcagataggtgacggtgccgctgaccataaatggtggggttctgcggaagttattgaaaaagaaatgacaagaccttactttgtaggaaaggatcc

SEQ ID NO: 670 - protein, 1601 aa, Clostridium thermocellum
MAKRRLSLLLVLAIMFTMVVPQISASAETVAPEGYRKLLDVQIFKDSPVVGWSGSGMGELETIGDTLPVDTTVTYNGLPTLRLNVQTTVQSGWWISLLTLRGWNTHDLSQYVENGYLEFDIKGKEGGEDFVIGFRDKVYERVYGLEIDVTTVISNYVTVTTDWQHVKIPLRDLMKINNGFDPSSVTCLVFSKRYADPFTVWFSDIKITSEDNEKSAPAIKVNQLGFIPEAEKYALVTGFAEELAVSEGDEFAVINAADNSVAYTGKLTLVTEYEPLDSGEKILKADFSDLTVPGKYYISIEGLDNSPKFEIGEGIYGPLVVDAARYFYYQRQGIELEEPYAQGYPRKDVTPQDAYAVFASGKKDPIDITKGWYDAGDFGKYVNAGATGVSDLFWAYEMFPSQFVDGQFNIPESGNGVPDILDEARWELEWMLKMQDKESGGFYPRVQSDNDENIKSRIIRDQNGCTTDDTACAAGILAHAYLIYKDIDPDFAQECLDAAINAWKFLEKNPENIVSPPGPYNVYDDSGDRLWAAASLYRATGEEVYHTYFKQNYKSFAQKFESPTAYAHTWGDMWLTAFLSYLKAENKDQEVVDWIDTEFGIWLENILTRYENNPWKNAIVPGNYFWGINMQVMNVPMDAIIGSQLLGKYSDRIEKLGFGSLNWLLGTNPLRFSFVSGYGEDSVKGVFSNIYNTDGKQGIPKGYMPGGPNAYEGAGLSRFAAKCYTRSTGDWVANEHTVYWNSALVFMAAFANQGSEVNPGPAPEPGVTPNPTEPAKVVDIRIDTSAERKPISPYIYGSNQELDATVTAKRFGGNRTTGYNWENNFSNAGSDWLHYSDTYLLEDGGVPKGEWSTPASVVTTFHDKALSKNVPYTLITLQAAGYVSADGNGPVSQEETAPSSRWKEVKFEKGAPFSLTPDTEDDYVYMDEFVNYLVNKYGNASTPTGIKGYSIDNEPALWSHTHPRIHPDNVTAKELIEKSVALSKAVKKVDPYAEIFGPALYGFAAYETLQSAPDWGTEGEGYRWFIDYYLDKMKKASDEEGKRLLDVLDVHWYPEARGGGERICFGADPRNIETNKARLQAPRTLWDPTYIEDSWIGQWKKDFLPILPNLLDSIEKYYPGTKLAITEYDYGGGNHITGGIAQADVLGIFGKYGVYLATFWGDASNNYTEAGINLYTNYDGKGGKFGDTSVKCETSDIEVSSAYASIVGEDDSKLHIILLNKNYDQPTTFNFSIDSSKNYTIGNVWAFDRGSSNITQRTPIVNIKDNTFTYTVPALTACHIVLEAAEPVVYGDLNNDSKVNAVDIMMLKRYILGIIDNINLTAADIYFDGVVNSSDYNIMKRYLLKAIEDIPYVPENQAPKAIFTFSPEDPVTDENVVFNASNSIDEDGTIAYYAWDFGDGYEGTSTTPTITYKYKNPGTYKVKLIVTDNQGASSSFTATIKVTSATGDNSKFNFEDGTLGGFTTSGTNATGVVVNTTEKAFKGERGLKWTVTSEGEGTAELKLDGGTIVVPGTTMTFRIWIPSGAPIAAIQPYIMPHTPDWSEVLWNSTWKGYTMVKTDDWNEITLTLPEDVDPTWPQQMGIQVQTIDEGEFTIYVDAIDW

SEQ ID NO: 671 - DNA, 707 bp, Ralstonia solanacearum
acggcggtaccgccagcctgagcacggcaagcgcgtccgacacggacaccacgactctgaagcccgccgccacctcgacgacctcgtccgtgtggctcaccatcgccaaggacagtgccgcgtttacggtgagcggcacgcgcacggtgcgctatggcgccggcagcacgtgggtggaaaagagcgtgagcggttccggccagtgcaccagcaccttcttcggcaaggacccggcggccggtgttgccaaggtgtgccagttgctgcagggcacgggtaccctgctgtggcgcggtgtcagcctggccggcgcggagttcggggagggcagcctgccgggcacctacggcagcaactacatctatccgtccgccgacagcgtgacgtactacaagaacaagggcatgaacctcgtgcgcctgccgttcaggtgggagcggctgcagcccacgctcaaccaggtgttcgatgcgaacgagctgtcgcgcctgaccgggtttgtcaacgccgtgacggcgaccggccagacggtgctgctcgatccgcacaactatgcgcgctattacggcaacgtgatcgggtcgagcgcggtgcccaacagcgcgtacgccgatttctggcggcgcctggccacccagttcaagggcaatccccgtgtcatcttcgggctgatgaacgagcccaactcgatgccgaccgagcagtgg

SEQ ID NO: 672 - protein, 235 aa, Ralstonia solanacearum
GGTASLSTASASDTDTTTLKPAATSTTSSVWLTIAKDSAAFTVSGTRTVRYGAGSTWVEKSVSGSGQCTSTFFGKDPAAGVAKVCQLLQGTGTLLWRGVSLAGAEFGEGSLPGTYGSNYIYPSADSVTYYKNKGMNLVRLPFRWERLQPTLNQVFDANELSRLTGFVNAVTATGQTVLLDPHNYARYYGNVIGSSAVPNSAYADFWRRLATQFKGNPRVIFGLMNEPNSMPTEQW

SEQ ID NO: 673 - DNA, 707 bp, Ralstonia solanacearum; identical to SEQ ID NO: 671

SEQ ID NO: 674 - protein, 235 aa, Ralstonia solanacearum; identical to SEQ ID NO: 672

SEQ ID NO: 675 - DNA, 3480 bp, Cellulomonas fimi
ggtgtcgcagggctggagcgccgagtggtcgcagtccggcaccgcggtgacggccaagaacgcgccgtggaacggcacgctcgccgccggctccagcgtgtcgatcggcttcaacggcacgcacaacggcacgaacaccgcgccgacggcgttcacgctcaacggcgtcgcctgcacgctcggctgacctgacggtgcccacggcaccgaccgcatgaccggcgggggtcctccggatgtcccggagggcccccgcacggcgtgcaccgcccggccgcaccaccgggtccccaccaccacgaaccgaggagaacccgtgcactccgcatcgcgcacccgcgcacgcacccgcgtgcggacggcggtctcgggcctgctggccgcgaccgtcctcgccgcacccctcaccctcgtcgccgcgcccgcgcaggcggcgaccggcgacgactggctgcacgtcgagggcaacacgatcgtcgactcgaccgggaaggaggcgatcctctccggcgtcaactggttcggcttcaacgcgagcgagcgtgtgttccacgggctgtggtccgggaacatcacgcagatcacgcagcagatggcccagcgcggcatcaacgtcgtgcgtgtgcccgtctccacccagctcctgctcgagtggaaggccggcacgttcctcaagccgaacgtgaacacgtacgcgaacccggagctcgagggcaagaacagcctgcagatcttcgagtactggctgacgctgtgccagaagtacgggatcaaggtgttcctcgacgtccactccgccgaggccgacaactcgggccacgtctacaacatgtggtggaagggcgacatcaccaccgaggacgtgtacgagggctgggagtgggccgcgacccgctggaaggacgacgacaccatcgtcggcgcggacatcaagaacgagccgcacggcacgcagggctccaccgagcgtgccaagtgggacggcacgaccgacaaggacaacttcaagcacttcgccgagaccgcgtcgaagaagatcctcgcgatcaacccgaactggctcgtgttcgtcgagggcgtcgagatctaccccaagccgggcgtcccgtggacgtcgacgggcctgaccgactactacggcacgtggtggggcgggaacctgcgcggcgtgcgcgaccacccgatcgacctcggcgcgcaccaggaccagctcgtgtactcgccgcacgactacggaccgctcgtgttcgaccagaagtggttccagaaggacttcgacaaggcgtccctgacggccgacgtgtggggacccaactggctgttcatccacgacgaggacatcgcaccgctgctcatcggcgagtggggcggacggctcggccaggacccgcggcaggacaagtggatggccgcgctgcgcgacctcgtcgcggagcggcgcctgagccagaccttctgggtgctcaacccgaactcgggcgacaccggcggcctgctgctcgacgactggaagacgtgggacgaggtcaagtactcgacgatgctcgagccgacgctgtggaagcacggcggcaagtacgtcgggctcgaccaccaggtcccgctcggcggtgtcggcagcacgaccggcacgtcgatctcgcaggtcggcggcggcacgcccgacaccacggcgccgaccgctcccaccgggctccgggcgggaacgccgaccgcgtcgaccgtcccgctgacgtggtccgcgtcgaccgacaccggcggctcgggcgtcgcggggtacgaggtgtaccgcgggacgacgctcgtcggcacgaccaccgccacctcgtacaccgtcacgggcctggccgcggactccgcgtacacgttctcggtccgggcgaaggacggcgccgggaacacgtcggcggcgtcggcggcggtcacggcccgcaccgcggccggcggcggtgacgtgaccgcgccgtccgtgcccacgggcctcacggccggcaccccgacggcgacctccgtgccgctgacgtggacggcgtcgaccgacaccgggggctcgggggtcacggggtacgaggtgtaccgcgggagcacgctcgtcgcgcgtccgaccggcacgagccacaccgtcaccggcctgtcggcggcgaccgcctacacgttcaccgtccgcgcggtcgacgcggcgggcaacgtgtcggccgcgtcggcgccggtcggcgtgacgacggcccccgacccgacgacgggctcgtgcgccgtgacgtacaccgcgaacggctggagcggtggcttcacggcggccgtcacgctcaccaacacgggcacgacggcgctgagcggctggacgctcgggttcgccttcccgtccgggcagaccctgacccagggctggagcgcgcggtgggcgcagtccgggtcgagcgtcacggcgaccaacgaggcctggaacgccgtcctcgccccgggggcgagcgtcgagatcggcttcagcggcacgcacaccggcaccaacacggcgccggcgacgttcacggtcggcggcgcgacctgcacgacgcgctgacgctgacggagccggcgggtcgggggacgcaccccgcacccgccggctccggccgtcagggcaggcgctccgcacccgacggttccggccgtcaggccgtggtgtccaggagccgcagcgtctcggcgacgaacgcgtcgacgtccgcctcggtcgtgtcgaacgcgcacatgagccgcacctcccgttggcgggccgccagtcgtagaaccgccacgtgcggcgcagcgcgtcggcgacaccgggcggcagggcggcgaacacgccgttcgcctgggtcggctggctgaaccggacccggtcgcccgccgtctccaggccggcgcgcagccgcgccgccatcgcgttcgcgtggcgcgccgagcgcagccacaggtcctgctcgaggagcgcgacgactgcgcggagacgaagcgcatcttcgacgcgagctgcatgtcggccttgcgcaggtacggcaggccgaccacggcgtcgtcgtcgagcaccacgacggcctcgccgaacagcaggccgttcttggtcccgcccagggacaccacgtcgacgccgacgtcggtcgtgaacgcccgcagcgggaggtcgagcgccgccgcggcgttcgcgatccgcgcgccgtcgacgtgcagccgcaggcccagcgcgtgcgcctggtcggccagcgcgcggatctctgcggcgtgtacagcgtgcccagctcggtgctctgcgtgatcgacacgacacccgctgcgcgcggtgctcgtcgccgaacccccacgcctggcgctcgacgagctcgggcgtcagcttgccgtccggggtgggcaccgtgagcagcttgagcccgccgacccgctcgggcgcgccgttctcgtcggtctggatgtgcgcctctccgcgcacacgacggcaccccagcgcggcaggagcgcctgcag

SEQ ID NO: 676 - protein, 747 aa, Cellulomonas fimi
MHSASRTRARTRVRTAVSGLLAATVLAAPLTLVAAPAQAATGDDWLHVEGNTIVDSTGKEAILSGVNWFGFNASERVFHGLWSGNITQITQQMAQRGINVVRVPVSTQLLLEWKAGTFLKPNVNTYANPELEGKNSLQIFEYWLTLCQKYGIKVFLDVHSAEADNSGHVYNMWWKGDITTEDVYEGWEWAATRWKDDDTIVGADIKNEPHGTQGSTERAKWDGTTDKDNFKHFAETASKKILAINPNWLVFVEGVEIYPKPGVPWTSTGLTDYYGTWWGGNLRGVRDHPIDLGAHQDQLVYSPHDYGPLVFDQKWFQKDFDKASLTADVWGPNWLFIHDEDIAPLLIGEWGGRLGQDPRQDKWMAALRDLVAERRLSQTFWVLNPNSGDTGGLLLDDWKTWDEVKYSTMLEPTLWKHGGKYVGLDHQVPLGGVGSTTGTSISQVGGGTPDTTAPTAPTGLRAGTPTASTVPLTWSASTDTGGSGVAGYEVYRGTTLVGTTTATSYTVTGLAADSAYTFSVRAKDGAGNTSAASAAVTARTAAGGGDVTAPSVPTGLTAGTPTATSVPLTWTASTDTGGSGVTGYEVYRGSTLVARPTGTSHTVTGLSAATAYTFTVRAVDAAGNVSAASAPVGVTTAPDPTTGSCAVTYTANGWSGGFTAAVTLTNTGTTALSGWTLGFAFPSGQTLTQGWSARWAQSGSSVTATNEAWNAVLAPGASVEIGFSGTHTGTNTAPATFTVGGATCTTR

SEQ ID NO: 677 - DNA, 1863 bp, Fibrobacter succinogenes
atgaagctcaattttggcttaaaacagtatatccccctcgccgctacggtactttcgcttgctacggtggcgaatgctgcgactgcctatatcaaccaaatcggttaccgtccggcagacccgaaggaatttgcgcttgtcgatggctcgggcgatatcgagattgtcaatgccgctggccagacggtgcttcaggtgactccgaaggcttcttcttattgggctccgagcacccagaatgttcagcttgttgattttacggcattgactgttcccggaacttattccatcaagcagggcggccaggtgctgcgttctgacttgaagattgccgacaagacttttgaagatgtcacaaaggcggcacttaagtggtattattaccagcgtgcctccatggaactggaagaacagtatgcgggacagtggaaacgtgctgccggccatacgaattcgacggtgacgctccataattctacaggtacttcgggtacgattcaatcgagcaagggctggtacgatgctggtgactatggccgttatatcgtgaactcgggtattacgacttacacgctcctttcgctttacgaacattttccggaatatttcaatacgctcaagtggaacatcccggccgaagggactttgccggatttgcttgccgaaatcaagtacaatcttgactggatgcttacgatgcaggctgcagatggtggcgtttaccacaagctttcgacgctccagttcccaggcgacgtgatgcctgcgaaggatacagaaaagctttatgtgattggtaagggaaccgcggcttcgtttgactttgctggtgtgatggctactacatatcgtgtattcaagacgttcgatgcgacttatgcagcccagtgccttgaggcggccaagaaggcttatgcctggggcctccagaatccgaacaaggcttttaccaacccgtctgatgttgctacaggttcctatagcgatggagaactttccgatgaaaaggcttttgcgagcatggagctgttcatttccacgggggatgcttcttataagccgacaatcgacccaaacaagatgagtattgttccggcttggcccgaaatgtatggtcttgcggtttatgccgctgctacccacgctacagaagttggggctgatgccgaaacggctaagcagatgctcttgcaatatgctaatgaatttgcctatgctgcgtcgtctggttttggtgttgtgatgtcgaatgaagactttgtctggggctccaatgctgttgccggtaaccaaggcgtgttccttctttacgcttattacgtcacgggcgaacagaagtattacgaagcagccaagaaggtcattgactacctgcttggcaaaaacccgctcgatatgtctttcttgactggctttggaacgaagtctccgaagcttccgcaccaccgtccgagtacggctgataagatcacggaccctgtgccgggtatgattgtgggcggtccgcagccgggtggtgaagatatcggttccaagtcttgggaatgcaaggattatagaacgggtgtcccagcgacatcttacacggataatcgttgcagctacgccacgaacgaagtcgctatcaactggaatgctccgtttgcatacattgcgggcgctctcgaagctttgaacgcaggctatgctccgtcttttgcagcaccgggtgttgcgaagggtggtacttcggcaatcaagcctgttgtttccagaaatcgtggtaaggttgaacatgcaccgcgtcttcgctttgacgaccagaaggtgttcatcgaaaagagcggcaagcgctttgacctcaagggcaaccatctgaagtaa

SEQ ID NO: 678 - protein, 620 aa, Fibrobacter succinogenes
MKLNFGLKQYIPLAATVLSLATVANAATAYINQIGYRPADPKEFALVDGSGDIEIVNAAGQTVLQVTPKASSYWAPSTQNVQLVDFTALTVPGTYSIKQGGQVLRSDLKIADKTFEDVTKAALKWYYYQRASMELEEQYAGQWKRAAGHTNSTVTLHNSTGTSGTIQSSKGWYDAGDYGRYIVNSGITTYTLLSLYEHFPEYFNTLKWNIPAEGTLPDLLAEIKYNLDWMLTMQAADGGVYHKLSTLQFPGDVMPAKDTEKLYVIGKGTAASFDFAGVMATTYRVFKTFDATYAAQCLEAAKKAYAWGLQNPNKAFTNPSDVATGSYSDGELSDEKAFASMELFISTGDASYKPTIDPNKMSIVPAWPEMYGLAVYAAATHATEVGADAETAKQMLLQYANEFAYAASSGFGVVMSNEDFVWGSNAVAGNQGVFLLYAYYVTGEQKYYEAAKKVIDYLLGKNPLDMSFLTGFGTKSPKLPHHRPSTADKITDPVPGMIVGGPQPGGEDIGSKSWECKDYRTGVPATSYTDNRCSYATNEVAINWNAPFAYIAGALEALNAGYAPSFAAPGVAKGGTSAIKPVVSRNRGKVEHAPRLRFDDQKVFIEKSGKRFDLKGNHLK

SEQ ID NO: 679 - DNA, 1980 bp, Bacillus sp. AC-1
atgcacatttttgaaacacgcttgattcttttcaacactgtacaaaacacgtacggaatgacaaggaggtggtcattttttgttcaatgtttcacgtttaagaaaaaagaaggggtgagaagtaggtacatgtcagattacaactatgtagaggtgcttcaaaaatccattttgttttacgaagcccagcgttccggaaagcttcctgaaagcaatcgtcttaactggcgaggggattctggactagaggatggtaaagatgttggtcatgatttaacaggcggctggtacgatgctggtgatcatgtgaagttcgggcttccgatggcttactctgcagccgtgcttgcatggacagtctatgagtaccgagaagcttacgaagaggcagagctgcttgatgatatgttagatcaaatcaagtgggcaaccgattattttttgaaagcccatacaggtccaaatgaattttgggcacaagtaggcgatgggaatgcggatcatggctggtggggtccagcagaagtgatgccgatgaaccggccggcatttaaaattgatgaacattgtccaggaacagaagtagccgcccaaaccgcagccgctttagcagcaggttcaattatttttaaagaaacagacgcgccttatgcagcaaagcttctcacccatgcaaagcagctttatgcatttgctgaccaatatcgcggtgagtatacagattgtgtcaccaatgctcagccattttataattcctggagcggctatattgatgagctcatttggggtggaatatggctgtacttggcgacaaatgaccagacctatttaaacaaagcactaaaagcagtagaagaatggccgaaggattgggactatacgtttacgatgtcgtgggacaataccttttttgcttcgcaaattttacttgcgagaatcacaaaggagaaaaggtttatcgaatcgacagagcgtaacctcgattactggtcgacgggttttgttcaaaatggaaaagtagaaagaatcacttatacgcctggcggactagcgtggttagatcaatggggttcacttcgttatacagcaaatgctgcatttttagcgtttgtgtacgcagattgggtctctgatcaagaaaaaaagaatcgataccaaacgtttgcgatcaggcaaacacactatatgttaggggataatccgcaaaatagaagctatgtcgttgggtttggcaaaaatccgccgatgcatccacaccatcgaactgcacatggctcatggtctaatcagctgacaactccttcttctcatcggcacacgctttatggagcgcttgttggggggcctaatgcacaggatcagtataccgatgacatctctgactatgtatccaacgaggtagcaacagactataatgccgcctttactggaaatgtagccaaaatggtgcagctgtttggtctggggcagtcaaagctgccgaattttccgcctaaagaaaaagtggaagatgagttttttgtagaggcagctgtcatgagtaacgatacaacatctactcagatcaaagccattctatacaatcgatcaggctggccggcaagaagtagtcaatcactttcttttagatattatgtcaatctaagcgagatatttgcgaagggattcactgataaagatattcaagtgacagctgtctacaatgaaggcgcttccttatctccgttaacggtgtatgacgcatcatcccatatctattttacagaaatcgattttactggcgtagctatttttccaggaggcgaatcgcttcataagaaggaaatacagttccggttatctgctccaaatggtgcgaatatatgggatgcctcaaatgattattcctttcaaggattaacatccaatatgcagaaaacagcgagaattcctgtttttgatcaaggtgatttagtatttggtacgcttccgaataaataa

SEQ ID NO: 680 - protein, 659 aa, Bacillus sp. AC-1
MHIFETRLILFNTVQNTYGMTRRWSFFVQCFTFKKKEGVRSRYMSDYNYVEVLQKSILFYEAQRSGKLPESNRLNWRGDSGLEDGKDVGHDLTGGWYDAGDHVKFGLPMAYSAAVLAWTVYEYREAYEEAELLDDMLDQIKWATDYFLKAHTGPNEFWAQVGDGNADHGWWGPAEVMPMNRPAFKIDEHCPGTEVAAQTAAALAAGSIIFKETDAPYAAKLLTHAKQLYAFADQYRGEYTDCVTNAQPFYNSWSGYIDELIWGGIWLYLATNDQTYLNKALKAVEEWPKDWDYTFTMSWDNTFFASQILLARITKEKRFIESTERNLDYWSTGFVQNGKVERITYTPGGLAWLDQWGSLRYTANAAFLAFVYADWVSDQEKKNRYQTFAIRQTHYMLGDNPQNRSYVVGFGKNPPMHPHHRTAHGSWSNQLTTPSSHRHTLYGALVGGPNAQDQYTDDISDYVSNEVATDYNAAFTGNVAKMVQLFGLGQSKLPNFPPKEKVEDEFFVEAAVMSNDTTSTQIKAILYNRSGWPARSSQSLSFRYYVNLSEIFAKGFTDKDIQVTAVYNEGASLSPLTVYDASSHIYFTEIDFTGVAIFPGGESLHKKEIQFRLSAPNGANIWDASNDYSFQGLTSNMQKTARIPVFDQGDLVFGTLPNK

SEQ ID NO: 681 - DNA, 1980 bp, Bacillus pumilus
atgcacatttttgaaacacgcttgattcttttcaacactgtacaaaacacgtacggaatgacaaggaggtggtcattctttgttcaatgtttcacgtttaagaaaaaagaaggggtgagaagtaggtacatgtcagattacaactatgtagaggtgcttcaaaaatccattttgttttacgaagcccagcgttccggaaagcttcctgaaagcaatcgtcttaactggcgaggggattctggactagaggatgggaaagatgttggtcatgatttaacaggcggctggtacgatgctggtgatcatgtgaagttcgggcttccgatggcctactcggcagccgtgcttgcatggacagtctatgagtaccgagaagcttacgaagaggcagagctgcttgatgatatgttagatcaaatcaagtgggcaaccgattattttttgaaagcccatacaggtccaaatgaattttgggcacaagtaggcgatgggaatgcggatcatggctggtggggtccagcagaagtgatgccaatgaaccggccagcatttaaaattgatgaacattgtccaggaacagaagtagccgcccaaaccgcagctgctttagcagcaggttcaattatttttaaagaaacagacgcgccttatgcagcaaaacttctcacccatgcaaagcagctttatgcatttgctgaccaatatcgcggtgagtatacagattgtgtcaccaatgctcagccattttataattcctggagcggctatattgatgagctcatttggggtggaatatggctgtacttggcgacaaatgaccagacctatttaaacaaagcactaaaagcagtagaagaatggccgaaggattgggactatacgtttacgatgtcgtgggacaataccttttttgcttcgcaaattttacttgcgagaatcacaaaggagaaaaggtttatcgaatcgacagagcgtaacctcgattactggtcgacgggttttgttcaaaatggaaaagtagaaagaatcacttatacgcctggcggactagcgtggttagatcaatggggttcacttcgttatacagcaaatgctgcatttttagcgtttgtgtacgcagattgggtctctgatcaagaaaaaaagaatcgataccaaacgtttgcgatcaggcaaacacactatatgttaggggataatccgcaaaatagaagctatgtcgttgggtttggcaaaaatccgccgatgcatccacaccatcgaactgcacatggctcatggtctaatcagctgacaactccttcttctcatcggcacacgctttatggagcgcttgttggggggcctaatgcacaggatcagtataccgatgacatctctgactatgtatccaacgaggtagcaacagactataatgccgcctttactggaaatgtagccaaaatggcgcagctgtttggtcaggggcagtcaaagctgccgaattttccgcctaaagaaaaagtggaagatgagttttttgtagaggcagctgtcatgagtaacgatacaacatctactcagatcaaagccattctatacaatcgatcaggctggccggcaagaagtagtcaatcactttcttttagatattatgtcaatctgagcgagatatttgcgaagggattcactgataaagatattcaagtgacagctgtctacaatgaaggcgcttccttatcttcgttaacggtgtatgacgcatcatcccatatctattttacagaaatcgattttactggcgtagctatttttccaggaggcgaatcgcttcataagaaggaaatacagttccggttatctgcgccaaatggtgcgaatatatgggatgcctcaaatgattattcctttcaaggattaacatccaatatgcagaaaacagcgagaattcctgtttttgatcaaggtattttagcatttggtacgcttccgaataaataa

SEQ ID NO: 682 - protein, 659 aa, Bacillus pumilus
MHIFETRLILFNTVQNTYGMTRRWSFFVQCFTFKKKEGVRSRYMSDYNYVEVLQKSILFYEAQRSGKLPESNRLNWRGDSGLEDGKDVGHDLTGGWYDAGDHVKFGLPMAYSAAVLAWTVYEYREAYEEAELLDDMLDQIKWATDYFLKAHTGPNEFWAQVGDGNADHGWWGPAEVMPMNRPAFKIDEHCPGTEVAAQTAAALAAGSIIFKETDAPYAAKLLTHAKQLYAFADQYRGEYTDCVTNAQPFYNSWSGYIDELIWGGIWLYLATNDQTYLNKALKAVEEWPKDWDYTFTMSWDNTFFASQILLARITKEKRFIESTERNLDYWSTGFVQNGKVERITYTPGGLAWLDQWGSLRYTANAAFLAFVYADWVSDQEKKNRYQTFAIRQTHYMLGDNPQNRSYVVGFGKNPPMHPHHRTAHGSWSNQLTTPSSHRHTLYGALVGGPNAQDQYTDDISDYVSNEVATDYNAAFTGNVAKMAQLFGQGQSKLPNFPPKEKVEDEFFVEAAVMSNDTTSTQIKAILYNRSGWPARSSQSLSFRYYVNLSEIFAKGFTDKDIQVTAVYNEGASLSSLTVYDASSHIYFTEIDFTGVAIFPGGESLHKKEIQFRLSAPNGANIWDASNDYSFQGLTSNMQKTARIPVFDQGILAFGTLPNK

SEQ ID NO: 683 - DNA, 1755 bp, Paenibacillus sp. KSM-N659
atgcagattcatgccgttcggcaatcttgccgcttgttattaacgctggttttgatgtgtggtctcctgttgcctatgggcgctcccaaaggctatgccgctccggctgttccttttggtcaattaaaagttcagggcaatcaattagtaggacagtccgggcagactgctcaactggtaggcatgagctcacatggattgcagtggtatggcaacttcgtcaacaaatcttcattgcaatggatgaaagataactggggcatcaatgttttccgcgctgccatgtatacggccgaagatggttacattacgaacccgtctgtcaaggacaaggtgaaggaagcggttcaggcatccattgacctcggattgtacgttatcattgattggcatatcttagctgacggcaatccaaatacgtacaagacacaagcgaaagcgttcttccaggagatggctactttgtacggcaacacgccgaatgtaatttatgaaatcgcgaacgagcccaatgggaatgtgtcctgggccgatgtcagatcatatgcgcaagaagtgatcacggccattcgtgcgattgatccggacggagtggtcatcgtcggcagtccaacctggagccaggatattcatctggcagcggacaatccggtctcacacagcaatgtcatgtatgcgcttcatttttatgcaggcacgcacggacagtttttgagagaccgaatcacttatgcgatgagcaaaggagcggcgattttcgttaccgaatggggcaccagcgatgcttctgggaacggcggaccatatttatctcaatccaaagagtggatcgactttctgaatgcccgcaaaatcagctgggtgaactggtcgctcgctgataaagtagaatcgtccgctgctcttatgccaggagcatcgcctaccggcggctggaccgatgctcagttgtctgcatcgggtaaatgggttcgcgatcaaatccggctagcaaccggagggggcagcggcaatccgacggttccgactgcaccggctggactctcggcaactgcaggcaacgcccaggtatctttgacctggaacgcagttagcggggcgacgagctataccgtgaagcgagcgacgacgagcggtggtccgtttacgaatgtcgctacgggcgtaacgggtacgagctacacgaacaccgggctgacgaatggtacgacatactactatgtcgttagtgcatccaatagcgcggggagcagcgcgaactccgcgcaggtgagcgcaacgccagctagcggcggcataagtacagggaatcttgttgtccaatacaaagccggcgacacaagcgccacggacaaccagatgaagccgtacttcaacatcaagaacaacggtacatcccccgttagcctgagcggcctcaaacttcgctattatttcacgaaggacggtgccggggatatgaacgcgtccatcgactgggcgcaaatcggcgcaagccatatcagcacagcatttgctaattttactggcagcagtacagatacttacgttgagctaagctttagcgcaggagcaggttcgatcccggcaggcggacaaacaggcgacatccaactgcggatgaacaaagccgattggtcaaatttcaacgaagcaaacgactattcttacgatggggcgaaaaccgcttttgcggattggaatcgtgtaacgctgcatcaaaacgggacgttggtatggggcacagcgccataa

SEQ ID NO: 684 - protein, 584 aa, Paenibacillus sp. KSM-N659
MQIHAVRQSCRLLLTLVLMCGLLLPMGAPKGYAAPAVPFGQLKVQGNQLVGQSGQTAQLVGMSSHGLQWYGNFVNKSSLQWMKDNWGINVFRAAMYTAEDGYITNPSVKDKVKEAVQASIDLGLYVIIDWHILADGNPNTYKTQAKAFFQEMATLYGNTPNVIYEIANEPNGNVSWADVRSYAQEVITAIRAIDPDGVVIVGSPTWSQDIHLAADNPVSHSNVMYALHFYAGTHGQFLRDRITYAMSKGAAIFVTEWGTSDASGNGGPYLSQSKEWIDFLNARKISWVNWSLADKVESSAALMPGASPTGGWTDAQLSASGKWVRDQIRLATGGGSGNPTVPTAPAGLSATAGNAQVSLTWNAVSGATSYTVKRATTSGGPFTNVATGVTGTSYTNTGLTNGTTYYYVVSASNSAGSSANSAQVSATPASGGISTGNLVVQYKAGDTSATDNQMKPYFNIKNNGTSPVSLSGLKLRYYFTKDGAGDMNASIDWAQIGASHISTAFANFTGSSTDTYVELSFSAGAGSIPAGGQTGDIQLRMNKADWSNFNEANDYSYDGAKTAFADWNRVTLHQNGTLVWGTAP

SEQ ID NO: 685 - DNA, 1755 bp, Paenibacillus sp. KSM-N440
atgcgtattcatgcaattcggcaatcttgccgtttggtattgacgatggttttgatgcttggcttattgctgcctgtgggcgcccccaaaggctatgccgctccggctgttccttttggccaattaaaagttcagggcaatcaattggtaggacagtccgggcaagctgttcaactggttggcatgagctcacatggattgcagtggtatggcaatttcgtcaacaaatcgtcgttgcagtggatgagagataactggggcatcaacgtcttccgtgccgctatgtatacggccgaagatggttacattacggatccttccgtcaagaacaaggtgaaggaggcggttcaggcatccatcggtctgggcttgtacgttattattgactggcatatcttgtctgatgggaatccgaatacgtacaaagcgcaatcgaaagcgttcttccaagagatggccacattgtacggcaacacgccgaatgtaatctatgaaatcgcgaacgagcccaacgggaatgtgtcctgggcagatgtcaagtcgtacgcggaagaagtgatcacggccattcgggcgattgaccccgacggagtggttatcgttggcagtccaacctggagccaggatattcatctggcggccgataacccggtatcacatagcaatgtcatgtatgcgcttcatttctattcaggcacgcatggacagtttttgagagaccgaattacctatgcgatgaacaaaggagcagcgatcttcgttaccgagtggggcaccagtgatgcatccgggaacggcgggccgtatttgcctcagtccaaagagtggatcgatttcttgaatgctcgcaagatcagctgggtgaactggtcgctcgctgataaagtagaaacgtctgctgctcttatgccaggtgcatcgcctaccggcggctggaccgatgcccaattgtccgaatcgggcaaatgggttcgcgatcaaatccggcaagcaactggaggcggcagcggcaatccaactgcaccggctgcccctactaacctctcggcaacggccggcaacgcccaggtatcattaacctggaacgcagttagcggggcgacgagctatactgtaaagcgagcaacgacgagcggcggtccgtacacgaatgtggcgaccggcgtcacggcgacgagctacacgaacaccgggctgacgaatggcacgacgtattattatgtcgtgagcgcatccaatagcgcgggcagcagcgcgaactccgcgcaagcgagcgcaacgccggctagcggcggcgccagtacggggaaccttgttgtccaatacaaagttggcgacactagcgccacggataaccaaatgaagccttcctttaacatcaagaacaacggtacaacccctgttaacctgagcggcctcaagcttcgctattacttcacaaaagacggtaccgcggatatgagcgcatcgatcgactgggcgcaaatcggcgcaagcaatgttagcgcggcattcgctaactttaccgggagtaatacggatacttacgtggagctaagctttagcgcagcggcaggttcgatcccggcaggcggacaaacgggcgacatccaactgcggatgtacaaaactgattggtcgaactttaacgaagcaaacgactattcttatgatggggcgaaaaccgcttatgcggattggaatcgtgtaacgctgcatcaaaacggaactttggtatggggcacgacgccttaa

SEQ ID NO: 686 - protein, 584 aa, Paenibacillus sp. KSM-N440
MRIHAIRQSCRLVLTMVLMLGLLLPVGAPKGYAAPAVPFGQLKVQGNQLVGQSGQAVQLVGMSSHGLQWYGNFVNKSSLQWMRDNWGINVFRAAMYTAEDGYITDPSVKNKVKEAVQASIGLGLYVIIDWHILSDGNPNTYKAQSKAFFQEMATLYGNTPNVIYEIANEPNGNVSWADVKSYAEEVITAIRAIDPDGVVIVGSPTWSQDIHLAADNPVSHSNVMYALHFYSGTHGQFLRDRITYAMNKGAAIFVTEWGTSDASGNGGPYLPQSKEWIDFLNARKISWVNWSLADKVETSAALMPGASPTGGWTDAQLSESGKWVRDQIRQATGGGSGNPTAPAAPTNLSATAGNAQVSLTWNAVSGATSYTVKRATTSGGPYTNVATGVTATSYTNTGLTNGTTYYYVVSASNSAGSSANSAQASATPASGGASTGNLVVQYKVGDTSATDNQMKPSFNIKNNGTTPVNLSGLKLRYYFTKDGTADMSASIDWAQIGASNVSAAFANFTGSNTDTYVELSFSAAAGSIPAGGQTGDIQLRMYKTDWSNFNEANDYSYDGAKTAYADWNRVTLHQNGTLVWGTTP

SEQ ID NO: 687 - DNA, 1755 bp, Paenibacillus sp.
atgcgtattcatgcaattcggcaatcttgccgtttggtattgacgatggttttgatgcttggcttattgctgcctgtgggcgcccccaaaggctatgccgctccggctgttccttttggccaattaaaagttcagggcaatcaattggtaggacagtccgggcaagctgttcaactggttggcatgagctcacatggattgcagtggtatggcaatttcgtcaacaaatcgtcgttgcagtggatgagagataactggggcatcaacgtcttccgtgccgctatgtatacggccgaagatggttacattacggatccttccgtcaagaacaaggtgaaggaggcggttcaggcatccatcgatctgggcttgtacgttattattgactggcatatcttgtctgatgggaatccgaatacgtacaaagcgcaatcgaaagcgttcttccaagagatggccacattgtacggcaacacgccgaatgtaatctatgaaatcgcgaacgagcccaacgggaatgtgtcctgggcagatgtcaagtcgtacgcggaagaagtgatcacggccattcgggcgattgaccccgacggagtggttatcgttggcagtccaacctggagccaggatattcatctggcggccgataacccggtatcacatagcaatgtcatgtatgcgcttcatttctattcaggcacgcatggacagtttttgagagaccgaattacctatgcgatgaacaaaggagcagcgatcttcgttaccgagtggggcaccagtgatgcatccgggaacggcgggccgtatttgcctcagtccaaagagtggatcgatttcttgaatgctcgcaagatcagctgggtgaactggtcgctcgctgataaagtagaaacgtctgctgctcttatgccaggtgcatcgcctaccggcggctggaccgatgcccaattgtccgaatcgggcaaatgggttcgcgatcaaatccggcaagcaactggaggcggcagcggcaatccaactgcaccggctgcccctactaacctctcggcaacggccggcaacgcccaggtatcattaacctggaacgcagttagcggggcgacgagctatactgtaaagcgagcaacgacgagcggcggtccgtacacgaatgtggcgaccggcgtcacggcgacgagctacacgaacaccgggctgacgaatggcacgacgtattattatgtcgtgagcgcatccaatagcgcgggcagcagcgcgaactccgcgcaagcgagcgcaacgccggctagcggcggcgccagtacggggaaccttgttgtccaatacaaagttggcgacactagcgccacggataaccaaatgaagccttcctttaacatcaagaacaacggtacaacccctgttaacctgagcggcctcaagcttcgctattacttcacaaaagacggtaccgcggatatgagcgcatcgatcgactgggcgcaaatcggcgcaagcaatgttagcgcggcattcgctaactttaccgggagtaatacggatacttacgtggagctaagctttagcgcagcggcaggttcgatcccggcaggcggacaaacgggcgacatccaactgcggatgtacaaaactgattggtcgaactttaacgaagcaaacgactattcttatgatggggcgaaaaccgcttatgcggattggaatcgtgtaacgctgcatcaaaacggaactttggtatggggcacgacgccttaa

SEQ ID NO: 688 - protein, 584 aa, Paenibacillus sp.
MRIHAIRQSCRLVLTMVLMLGLLLPVGAPKGYAAPAVPFGQLKVQGNQLVGQSGQAVQLVGMSSHGLQWYGNFVNKSSLQWMRDNWGINVFRAAMYTAEDGYITDPSVKNKVKEAVQASIDLGLYVIIDWHILSDGNPNTYKAQSKAFFQEMATLYGNTPNVIYEIANEPNGNVSWADVKSYAEEVITAIRAIDPDGVVIVGSPTWSQDIHLAADNPVSHSNVMYALHFYSGTHGQFLRDRITYAMNKGAAIFVTEWGTSDASGNGGPYLPQSKEWIDFLNARKISWVNWSLADKVETSAALMPGASPTGGWTDAQLSESGKWVRDQIRQATGGGSGNPTAPAAPTNLSATAGNAQVSLTWNAVSGATSYTVKRATTSGGPYTNVATGVTATSYTNTGLTNGTTYYYVVSASNSAGSSANSAQASATPASGGASTGNLVVQYKVGDTSATDNQMKPSFNIKNNGTTPVNLSGLKLRYYFTKDGTADMSASIDWAQIGASNVSAAFANFTGSNTDTYVELSFSAAAGSIPAGGQTGDIQLRMYKTDWSNFNEANDYSYDGAKTAYADWNRVTLHQNGTLVWGTTP

SEQ ID NO: 689 - DNA, 1755 bp, Paenibacillus sp.
atgcgtattcatgcaattcggcaatcttgccgtttggtattgacgctggttttgatgcttggcttattgctgcctgtgggcgcccccaaaggctatgccgctccggctgttccttttggccaattaaaagttcagggcaatcaattggtaggacagtccgggcaagctgttcaactggttggcatgagctcgcatggattgcagtggtatggcaatttcgtcaacaaatcgtcgttgcagtggatgagagataactggggcatcaacgtcttccgtgccgctatgtatacggccgaagatggttacattacggatccttccgtcaagaacaaggtgaaggaggcggttcaggcatccatcgatctgggcttgtacgttattattgattggcatatcttgtctgatgggaatccgaatacgtacaaagcgcaatcgaaagcgttcttccaagagatggccacattgtacggcaacacgccgaatgtaatctatgaaatcgcgaacgagcccaacgggaatgtgtcctgggcagatgtcaagtcgtatgcggaagaagtgatcacggccattcgggcgattgaccccgacggagtggttatcgttggcagtccaacctggagccaggatattcatctggcggccgataacccggtatcacatagcaatgtcatgtatgcgcttcatttctattcaggcacgcatggacagtttttgagagaccgaattacctatgctatgaacaaaggagcagcgatcttcgttaccgagtggggcaccagtgatgcatccgggaacggcgggccgtatttgcctcagtccaaagagtggatcgatttcttgaatgctcgcaagatcagctgggtgaactggtcgctcgctgataaagtagaaacgtctgctgctcttatgccaggtgcatcgcctaccggcggctggaccgatgcccaattgtccgaatcgggcaaatgggttcgcgatcaaatccggcaagcaactggaggcggcagcggcaatccaactgcaccggctgcccctactaacctctcggcaacggccggcaacgcccaggtatcattaacctggaacgcagttagcggggcgacgagctatactgtaaagagagcaacgacgagcggcggtccgtacacgaatgtggcgaccggcgtcacggcgacgagctacacgaacaccgggctgacgaatggcacgacgtattattatgtcgtgagcgcatccaatagcgcgggcagcagcgcgaactccgcgcaagcgagcgcaacgccggctagcggcggcgccagtacggggaaccttgttgtccaatacaaagttggcgacactagcgccacggataaccaaatgaagccttcctttaacatcaagaacaacggtacaactcctgttaacctgagcggcctcaagcttcgctattacttcacaaaagacggtaccgcggatatgagcgcatcgatcgactgggcgcaaatcggcgcaagcaatattagcgcggcattcgctgactttaccgggagtaatacggatacttacgtggagctaagctttagcgcagcggcaggttcgatcccggcaggcggacaaacgggcgacatccaactgcggatgtacaaaaccgattggtcgaactttaacgaagcaaacgactattcttatgatggggcgaaaaccgcttatgcggattggaatcgtgtaacgctgcatcaaaacggaactttggtatggggcacgacgccttaa

SEQ ID NO: 690 - protein, 584 aa, Paenibacillus sp.
MRIHAIRQSCRLVLTLVLMLGLLLPVGAPKGYAAPAVPFGQLKVQGNQLVGQSGQAVQLVGMSSHGLQWYGNFVNKSSLQWMRDNWGINVFRAAMYTAEDGYITDPSVKNKVKEAVQASIDLGLYVIIDWHILSDGNPNTYKAQSKAFFQEMATLYGNTPNVIYEIANEPNGNVSWADVKSYAEEVITAIRAIDPDGVVIVGSPTWSQDIHLAADNPVSHSNVMYALHFYSGTHGQFLRDRITYAMNKGAAIFVTEWGTSDASGNGGPYLPQSKEWIDFLNARKISWVNWSLADKVETSAALMPGASPTGGWTDAQLSESGKWVRDQIRQATGGGSGNPTAPAAPTNLSATAGNAQVSLTWNAVSGATSYTVKRATTSGGPYTNVATGVTATSYTNTGLTNGTTYYYVVSASNSAGSSANSAQASATPASGGASTGNLVVQYKVGDTSATDNQMKPSFNIKNNGTTPVNLSGLKLRYYFTKDGTADMSASIDWAQIGASNISAAFADFTGSNTDTYVELSFSAAAGSIPAGGQTGDIQLRMYKTDWSNFNEANDYSYDGAKTAYADWNRVTLHQNGTLVWGTTP

SEQ ID NO: 691 - DNA, 724 bp, Thermomonosporta sp. MTCC 5117
catgggagcgttcccatgcccggaacccccacatccggaatttggagatcagacaatgcatcgtcatgttcacgccgggacctcccggtggaccgtgcgcgctctggccgtgctgttcgcggccctgctgggcctgacccagtggaccgcccccgcggccgcccacgggtcggtcatcaacccggcgacgcgcaactacggctgctggctgcggtggggcaacgaccacctcaaccccaacatgcagcacgaagaccccatgtgctggcaggcctggcaggacaaccccaacgccatgtggaactggaacggcctgtaccgcgacaacgtgggcggcaaccaccgggccgcgctgcccgacgggcagctgtgcagcggcggtctggccgagggcggccgctaccgctccatggacgccgtgggcccgtggaagaccaccgacatcaacaacaccttcacgatccacctgtacgaccaggccagccacggtgcggactacttcgaggtctacgtcaccaagcagggcttcgacccgaccacccagccgctgacctggggcagcctggacctggtccaccggaccggcagctacgcgcccagccagaacatccagttcacggtcaacgcgcccaaccgcagcggccgccacgtggtcttcaccatctggaaggcctcgcacatggaccagacctactacctgtgcagcgacgtgaacttcgtctag

SEQ ID NO: 692 - protein, 222 aa, Thermomonosporta sp. MTCC 5117
MHRHVHAGTSRWTVRALAVLFAALLGLTQWTAPAAAHGSVINPATRNYGCWLRWGNDHLNPNMQHEDPMCWQAWQDNPNAMWNWNGLYRDNVGGNHRAALPDGQLCSGGLAEGGRYRSMDAVGPWKTTDINNTFTIHLYDQASHGADYFEVYVTKQGFDPTTQPLTWGSLDLVHRTGSYAPSQNIQFTVNAPNRSGRHVVFTIWKASHMDQTYYLCSDVNFV

SEQ ID NO: 693 - DNA, 687 bp, Ralstonia solanacearum
accctcagcacggcggccgctaccgacaccacgaccctgaagacggccgccgccacctcgatctcgccgttgtggctcaccatcgccaaggacagcgcggcgttcacggtgagcggcacgcgcacggtgcgctatggcgccggcagcgcgtgggtggcgaagagcatgtccggcacaggccagtgcaccgccgccttcttcggcaaggatccggcggccggtgtcgccaaggtatgccaggtggcgcagggcacgggcaccctgctgtggcgcggcgtcagcctggccggcgccgagttcggggagggcagcctgccgggcacctacgggagcaactacatctatccgtccgccgacagcgcgacctactacaagaacaagggcatgaacctcgtgcgcctgccgttccgctgggagcggctgcagcccacgctcaaccaggcgctcgacgcgaacgagctgtcgcgcctgaccgggttcgtcaacgccgtgacggcggccggccagacggtgctgctcgatccgcacaactacgcgcgctactacggcaacgtgatcggctcgagcgcggtgcccaacagcgcgtacgccgatttctggcggcgcgtggccacccagttcaagggcaatgcccgcgtcatcttcgggctgatgaacgagcccaattcgatgccgaccgagcagtgg

SEQ ID NO: 694 - protein, 229 aa, Ralstonia solanacearum
TLSTAAATDTTTLKTAAATSISPLWLTIAKDSAAFTVSGTRTVRYGAGSAWVAKSMSGTGQCTAAFFGKDPAAGVAKVCQVAQGTGTLLWRGVSLAGAEFGEGSLPGTYGSNYIYPSADSATYYKNKGMNLVRLPFRWERLQPTLNQALDANELSRLTGFVNAVTAAGQTVLLDPHNYARYYGNVIGSSAVPNSAYADFWRRVATQFKGNARVIFGLMNEPNSMPTEQW

SEQ ID NO: 695 - DNA, 3687 bp, Bacillus licheniformis
gtcctctccttcattgttttccaggtgaatgtgctgaaaaagatccgtttccaattcatcaagctttaagtaagtcagtgtatatgttgtgcatgccccttcaggaagggtatagtcattggtcactcttctcagttccttcaggatgctgcctgcggcttcatgctcttgttcaaggacgtcgatcgtctgaaccgcttctgctaagcggtccattgatcgcgtctcttcataggccatcactttcgggaaaatatgttcctcttcctggaagaggtgatgttcgagttctgttttcagctgatggaacaattgatggacctgggcgagctccggatgatggatgccatgaacccggtatacttttgtaacaaagcctgacagttcaggaagcacctcatacaggtaggcatggtgcgtatgaatcacatggtcgatcagctgtgaatacggggcttcactccagttcgtctcttttgcgtttaatgcctttgtctcttgatataatgtattgattctagctaagatctcttcttcatttaaatcctgctcttttatcgcttcaccgatcgggcggttgcccccgcagcaaaagtcgatgcgatattctttcagcagccggctggctcttggaaaacgtgtaacaatatcacccgtttttgtattttgatcaaaaactgcttccatttgtaaaacctcctgaagtgttttgtatgctataggttaaatgtaacgggttcaccgagggaaaatcgtgatctacatcacattctgaaaaaatgacagaaaaagcaataagtcagaagaaatcgggaaatagctatagataacttttcatgttggaggcccgcaatggagcatatatcctggcttacatttacgatgctgattctcgccagttaccggttaactcatttgattgtttttgataagatcacggagtttatccggaaaccgttcatgaagaagaagcagacgattgatgaacaagggcatgtagaaacgaaaaaagtgccgaaatcaaacttcggctatttgctgaattgctattggtgcgcagggatatggtgcgcgttgatcattgctgtcggatatctgattgccccaaaagcgatattcccgttgattttgattttgtcggtcgccggggggcaggcgattcttgaaacgtttgtcggtgtcgccacaaaacttgtcggctttttctccgatttaaagaagtaaaccattccaagcggatggttttatttttttgtcaataaagtgatacaaacagcagagagaacgtgtcagttttatgaacttttcacagcgatttttcccggatgcggcattttaggcagagaggaagcatctcattgtaaagatttcagtttttaaaatttagaattgagagaaaaaggatgtgcaaagtccccggccatttgttttaaaagcttgcggtcactagtattcagacctcccattttatacgaaaagaggaaatagatagattttttaagcgccaaaaaacaagaaatatggttgatagacaatcggtgaatagtttatttacaatcagttcgtgctacaggcaaggaaaggagtgaaaaatggctgcggaaaaagtattttcgaaaaataaaatcattggagggaaaagaatgtcatatatgaaacgttccatctctgtcttcatcgcctgttttatggtagcggcgcttggcatcagcggtatcattgcaccgaaagcggctgccgcttctaaaacacccgttgctgtaaacggacagcttaccttaaaaggtacgcagctcgtcaatcaaaacggaaaagcggttcagctgaaaggaatcagctcccacggtctacagtggtatggcgattatgtcaacaaagactcgttaaaatggctgagagacgactggggcatcaatgtcttccgcgcggccatgtatacagctgaaggcggctatattgacaatccgtcggttaaaaacaaagtgaaggaagccgtcgaagcggcaaaagaactcggaatctatgtgatcattgactggcacatactgagcgatggcaatccaaaccaaaacaaagcgaaagcaaaagaattttttaacgaaatgtcaagactttatggcaagacgccaaacgtcatttttgaaattgccaacgagccgaacggcgatgtcaactggaatcgcgacattaaaccttacgccgaagaaatcctgtccgtgattcgcaaaaactctccgaaaaatattgtgattgtcggaacaggcacctggagccaggatgtcaatgatgcggcggacaatcagctgaaagacggcaatgtcatgtacgcgctccatttttatgcgggcacgcacggtcagtctttgcgggataaagccgattatgcactcagcaaaggagcgccgattttcgtcacagaatggggaacgagcgatgcttcaggaaacggcggggtctaccttgaccaatccagggagtggctgaaatatttagacagcaaaaaaatcagctgggtaaactggaacttatccgacaaacaagagtcgtcagcagctttaaacccaggcgcctctaaaaacggaggatggtcgcaatccgacttgtccccatcaggcaaattcgtcagggataacatccgcagcgggtcaaacggttcgtcaggagactctggatcgaattcgaaagggtcagatcaaaaagaccaaaaaaaggatcaggataaaccaggtcaagacagcggcgctgcagccaacacgatagcagtacaatacagagcgggggacaacaatgtaaacggcaaccaaatccgccctcagctcaacattaaaaacaacagcaaaaaaaccgtctctttaaatcgaatcaccgtccgctactggtataaaacgaatcgcaaaggaaaaaattttgactgcgactatgcccaaatcggctgcagcaaaatcacgcacaaattcgtccaattaaaaaaagcggtaaacggagcagacacgtatcttgaagtagggtttaaaaatggtacattggcgccgggtgcaagtacaggtgaaatccagatccgtcttcacaatgacggctggagcaattatgcccaaagcggcgactattcatttttaaattcaaacacgtttaaaaatacgaaaaaaatcacgttgtatgagaacggaaagctgatttggggcactgaacctaaataacggcactttgacggacaccggatttggtgtccgttttcgtatatattataatggaaggaatgaggaatatttttgtaaacatgaaaggagatggatgtatgaatgaaacattgcagcaatacatgatgcttgtcaaggaacactatgacacgatcaatggaccggattacacaggcaaagaggaagacattgaaaagagaaaagagcaaatcgagctttacgccaaaacgctccagcaaggcttttcaacagatgacgactatgatgaattcgcagatgccgtgattaaatgcgcatacggagatctgacgatggaagaattggaaacggtttatcgggaattaacgtctccataatcaataaaataagggggaggaggagcatgaaagacatgatcatgaagacagaccggctkattttgcgaaaaatgaggcrygatgacgccgaaaacctgctcgaaatcttttctgacccgryagccatggaatat

SEQ ID NO: 696 - protein, 229 aa, Bacillus licheniformis
MEAVFDQNTKTGDIVTRFPRASRLLKEYRIDFCCGGNRPIGEAIKEQDLNEEEILARINTLYQETKALNAKETNWSEAPYSQLIDHVIHTHHAYLYEVLPELSGFVTKVYRVHGIHHPELAQVHQLFHQLKTELEHHLFQEEEHIFPKVMAYEETRSMDRLAEAVQTIDVLEQEHEAAGSILKELRRVTNDYTLPEGACTTYTLTYLKLDELETDLFQHIHLENNEGED

SEQ ID NO: 697 - protein, 123 aa, Bacillus licheniformis
MEHISWLTFTMLILASYRLTHLIVFDKITEFIRKPFMKKKQTIDEQGHVETKKVPKSNFGYLLNCYWCAGIWCALIIAVGYLIAPKAIFPLILILSVAGGQAILETFVGVATKLVGFFSDLKK

SEQ ID NO: 698 - protein, 517 aa, Bacillus licheniformis
MSYMKRSISVFIACFMVAALGISGIIAPKAAAASKTPVAVNGQLTLKGTQLVNQNGKAVQLKGISSHGLQWYGDYVNKDSLKWLRDDWGINVFRAAMYTAEGGYIDNPSVKNKVKEAVEAAKELGIYVIIDWHILSDGNPNQNKAKAKEFFNEMSRLYGKTPNVIFEIANEPNGDVNWNRDIKPYAEEILSVIRKNSPKNIVIVGTGTWSQDVNDAADNQLKDGNVMYALHFYAGTHGQSLRDKADYALSKGAPIFVTEWGTSDASGNGGVYLDQSREWLKYLDSKKISWVNWNLSDKQESSAALNPGASKNGGWSQSDLSPSGKFVRDNIRSGSNGSSGDSGSNSKGSDQKDQKKDQDKPGQDSGAAANTIAVQYRAGDNNVNGNQIRPQLNIKNNSKKTVSLNRITVRYWYKTNRKGKNFDCDYAQIGCSKITHKFVQLKKAVNGADTYLEVGFKNGTLAPGASTGEIQIRLHNDGWSNYAQSGDYSFLNSNTFKNTKKITLYENGKLIWGTEPK

SEQ ID NO: 699 - protein, 85 aa, Bacillus licheniformis
MNETLQQYMMLVKEHYDTINGPDYTGKEEDIEKRKEQIELYAKTLQQGFSTDDDYDEFADAVIKCAYGDLTMEELETVYRELTSP

SEQ ID NO: 700 - protein, 36 aa, Bacillus licheniformis
  misc_feature (18)..(18): Xaa can be any naturally occurring amino acid
  misc_feature (32)..(32): Xaa can be any naturally occurring amino acid
MKDMIMKTDRLILRKMRXDDAENLLEIFSDPXAMEY

SEQ ID NO: 701 - DNA, 1023 bp, Azoarcus sp. BH72
atgaacacgatgctacggcgcttcgtgcgcaccctcgccaccgtcgtgctcgcgggcaccgcctattccgccgccgcccagtgcgacctcagccgtcagctcgccggggtcaatctcgcgggcgcggagttcaacggcaagaagattccggcgcgctacggttacgactacatctacccgccggcgcaggatctcgcgtacttccagagcgtcggcatgaacaccatccggctgccgttccgctgggagcggctgcagccgctgctgggcgccggcctcgacaccgccgagctggggcgcatgcgcaccgtcaccgaagcggcgcgcagcctgggcatgtgcgtgatcctcgatgttcacaactatggcgcctatgcggggcagagcatcggcagcgccgcggtcagcgaggcggtgttcatcgacttctgggtgaagctcgcgcgcgagttcgccggtcaggcgcacgtggccttcgggctgatgaacgagccgaacctgatcacgatcccgcaatgggccagtctcgcccagcgtaccgtcgatgccttgcgcagcgccggggcgaacaacctgctgctggtttcgggcgggcgctggagcggcgtccacgagtggcagaagccgatcaacggcatctccaatgcgcaggccttcggcagcttccgcgatccgctcaacaacttcgtgttcgaagtgcatcagtacgccaacgccagctattccggcaccacggtggagtgcattccggccgagcagctgcgccagatcatgaccaatgccagcgcctgggcgcgcagcaccggggcccgcttcttcctcggcgaattcggcgtggccgccagcgagccctgtctcgccgcgctcgacgccatcctcgccgaggtggacaacaacccggtgtgggcggggtggacctactgggcggccgggcggtggtggggcacctatccgttcagcatccatcccgcggcctccggcgtggaggcgccgcagctgacgctgatccgcaagtacctgtaa

SEQ ID NO: 702 - protein, 340 aa, Azoarcus sp. BH72
MNTMLRRFVRTLATVVLAGTAYSAAAQCDLSRQLAGVNLAGAEFNGKKIPARYGYDYIYPPAQDLAYFQSVGMNTIRLPFRWERLQPLLGAGLDTAELGRMRTVTEAARSLGMCVILDVHNYGAYAGQSIGSAAVSEAVFIDFWVKLAREFAGQAHVAFGLMNEPNLITIPQWASLAQRTVDALRSAGANNLLLVSGGRWSGVHEWQKPINGISNAQAFGSFRDPLNNFVFEVHQYANASYSGTTVECIPAEQLRQIMTNASAWARSTGARFFLGEFGVAASEPCLAALDAILAEVDNNPVWAGWTYWAAGRWWGTYPFSIHPAASGVEAPQLTLIRKYL

SEQ ID NO: 703 - DNA, 1496 bp, uncultured Butyrivbrio sp
atggctttacttggggtatcgcttgcgctgacttctctgaaacctttacttcctgcaaagacggtttatgctgccggaacagataagaccgcgacagaagtagtttcagatatgacagtaggctggaacctgggaaacagtcttgattcttatggacagagttctaatttcccatacaccagctcaaatgaaacatattggggtaatcctaaaacaactaaggctctgatcgacgctgtcgcagaagcaggttttaatacaattcgtatacctgtttcatggggacagtacacaacaggttctgattatcagattcctgatttcttcatgagcagagttaaggaagtagttgattatgctattgctaatgatatgtatgtaatccttaatacacatcatgacatcaactcagactattgcttctatgttcctaacaatgcaaataaggatcgttcagaaaaatactttaattctatctggacacaggtagctaatgagttcaagaattatgattatcatctcgttttcgagacaatgaatgagcccagacttgtaggacacagcgaagagtggtggttccctagaaacaatccaagctcagacattaaagaagctgttgcatgtatcaatgattacaaccaggtagctcttgatgctattagagcaactggtggcaataacgctacaagatgcgttatggttcctggttatgatgcttcaattgaaggatgtatgacagatggctttaagatgccaaaggacagtgcaagtaacagactgatcctttcagttcatgcttacatcccttatacattcgctcttgcaagtgatacatatactaagacttttagtgacaaccttaagggcgacattgattcattctttaatgatcttgattccaagttcctttcaaagaacatccctgtagttgttggtgagacaagtgctaccaacagaaacaataaggatgagagagtgaagtgggctgattattactggggcgcagctgctaagcacagcaacgtagctatggtcctttgggataacaatgtatacgaaaacaattctgctggatcaaacggcgagtgccacatgtatatcgatagaaactcactccagtggaaagatcctgagatcatcagcgctatcatgaagcacgttgatggaacacctgcaactatcaatggtaagcagattccaacaactgatcctcagccacagccagatccacagccacagccggatcctcagccgcagccagatccacagccttctgatgatccagcacctgtaaataatggcgaccttaatgccacatacactatcaacaactggggttcaggttatcaggttatcatcaaggttaagaatgactctgcatctgctgtatcaaactggactgtaaaggttaagaagagccaggttaagatcgatacaagctggtgcgtaaacatcgaagagtctggtgattattatgtgatcacacctatgtcctg

SEQ ID NO: 704 - protein, 498 aa, uncultured Butyrivbrio sp
MALLGVSLALTSLKPLLPAKTVYAAGTDKTATEVVSDMTVGWNLGNSLDSYGQSSNFPYTSSNETYWGNPKTTKALIDAVAEAGFNTIRIPVSWGQYTTGSDYQIPDFFMSRVKEVVDYAIANDMYVILNTHHDINSDYCFYVPNNANKDRSEKYFNSIWTQVANEFKNYDYHLVFETMNEPRLVGHSEEWWFPRNNPSSDIKEAVACINDYNQVALDAIRATGGNNATRCVMVPGYDASIEGCMTDGFKMPKDSASNRLILSVHAYIPYTFALASDTYTKTFSDNLKGDIDSFFNDLDSKFLSKNIPVVVGETSATNRNNKDERVKWADYYWGAAAKHSNVAMVLWDNNVYENNSAGSNGECHMYIDRNSLQWKDPEIISAIMKHVDGTPATINGKQIPTTDPQPQPDPQPQPDPQPQPDPQPSDDPAPVNNGDLNATYTINNWGSGYQVIIKVKNDSASAVSNWTVKVKKSQVKIDTSWCVNIEESGDYYVITPMS

SEQ ID NO: 705 - DNA, 1724 bp, Streptomyces halstedii
cccgggcgaagaacggatcttcccccgagatgaccagggcggccgctcccgtctggcgggtggccagcgcgcgggcggttgaattgcgtgtgtaaccgagttgccgcacggcccgttcgacggcctcgcgttttgtgcggctcacgtgcggtgcgttgttgagggcacgggaggccactgagcgggaaacaccggcgtgttcggccacctcgtcgagcgtcggatgccgacgcggcgctgcttctgccatgactcgtgagtctttcacaggctgggaggcacacattgggaccgcttccggtgcagtggcctactgaggcctggtcactcgggagaatcgaatgctgcgccgcatattgacagccaaccgccccacccgcacgattgggaccgcttccagtgggagcgctcccaaagtcacgtcctctgaaatcgaggtactgtcttgagccgcaaacttcgtaccctgatggcagcgctctgtgcgctgccgctggcgttcgccgccgcaccccccgcccacgccgccgaccccaccaccatgaccaacgggttctacgcggatcccgactcgagcgcgagccggtgggcggccgccaaccccggcgacggccgggccgccgcgatcaacgcctccatcgccaacacacccatggcccgctggttcggctcctggagcggcgccatcggcaccgcggcaggcgcctacgccggagcggcggacggccgggacaagctgcccatcctcgtcgcctacaacatctacaaccgtgactactgcggcgggcactccgccggtggagccgcttcgccgtccgcgtacgccgactggatcgctcggttcgccggaggtatcgcggcccgcccggccgtcgtcatcctcgaaccggactctctcggagactacggctgcatgaacccggcccagatcgacgaacgcgaggccatgctcaccaacgccctcgtccagttcaaccgccaagctcccaacacctgggtctacatggatgccggcaacccgcgctgggccgacgcggcgaccatggcccggcgtctccacgaagccggtctgcgacaggcccacggcttctcgctcaacgtctccaactacatcaccaccgccgagaacaccgcctacggcaacgccgtcaacaatgaactggccgctcgctacggctacaccaagccgttcgtcgtggacaccagccgcaacggcaacggctccaacggcgagtggtgcaacccctccggccgccgcatcggcacgcccacccggacaggtggaggcgccgagatgctcctgtggatcaagactccgggcgagtccgacggcaactgcggtgtgggatccggctccacggccggccagttcctccccgaggtcgcctacaagatgatctacggctactgatccggggagtcccgccgtcgcccaggcgaccgcaatccgccggcggggcgggcactccccccgaccatctcaccggagaggggccgacgcgccccctccttgagagccggccccgcgatttcgtgaggcgggctgtccggcagacgggcaggagagcagaacacgcctctgagcggcaagaatgacgattgtcgaggtcttccttcctgccaccgtcggaggcacctccagggtgattacccactcgggtgaactggcggcctggcggccggtctcgttttcgaggggaggtccgggccgcgatcacgggatc

SEQ ID NO: 706 - protein, 321 aa, Streptomyces halstedii
MSRKLRTLMAALCALPLAFAAAPPAHAADPTTMTNGFYADPDSSASRWAAANPGDGRAAAINASIANTPMARWFGSWSGAIGTAAGAYAGAADGRDKLPILVAYNIYNRDYCGGHSAGGAASPSAYADWIARFAGGIAARPAVVILEPDSLGDYGCMNPAQIDEREAMLTNALVQFNRQAPNTWVYMDAGNPRWADAATMARRLHEAGLRQAHGFSLNVSNYITTAENTAYGNAVNNELAARYGYTKPFVVDTSRNGNGSNGEWCNPSGRRIGTPTRTGGGAEMLLWIKTPGESDGNCGVGSGSTAGQFLPEVAYKMIYGY

SEQ ID NO: 707 - DNA, 10782 bp, Clostridium thermocellum
gatcggcgaatcgctgcgaaagaaaccacggaacttattgagggaacaatcaagcggactgaaaatggtacaaagatagcccgggaaactgccgaagctctcaacaaaatagttgaaggcatatcaaaggctgctacgctggttaatgatatagctgttgcctccaacgaacaagctgcggcaattactcaaataaatcagggaattgcccaggtatcccaggtggtacagaccaactcggcaacatcggaagaaagtgctgctgcaagtgaagagctgtcaagtcaggctgagcttttgaaacggtccattgcaaaattcaagttaaaaaatatgggaaaaatgacatccaacagatataaggaagttagtcctgaaataatgaggatgcttgaagactatacggaaaacaagcaaccgaaaagttacagtaaggaagaaaatggagaatatagtgatggaaaggaaacagctgagaaggatgttggaggtttaaaacagaagatattgttgtctgacagtgagttcggtaaatactaggaaaacgtaaaataaaaatacgtaaagcagagtgaattttgacatttactctgcttttttaaaataccaaaaaaggcatgtccgaaaaatttttgaaatctatacggcaatttttctgaaatttggttttatcaaatttgacgaagcatatatgatataataaactaataaagcggataaatatagatttacttaaaattaaagttgtaaattgatttttattaattgaggcaggaggatgctatgaggctggttaacagtttgggaagaagaaaaattcttttgatacttgctgttattgtagctttcagcactgttctgttgtttgcaaagctatgggggcgaaagacttcaagtactttggatgaggttggttcaaaaactcatggtgatttgacggcagaaaataaaaacggcggatatttaccagaggaagagattccagatcagcctccggcaaccggggccttcaactacggtgaagcgttgcaaaaagcaatttttttctatgagtgtcaaagatccggaaagctcgatccctcaactcttcgcctaaattggcggggagattcgggactggatgacggaaaagatgcaggaattgatcttaccggcggatggtatgatgcgggagatcacgtaaaatttaatttgcccatgtcttattcggcggctatgctggggtgggcggtgtatgaatatgaagatgcgtttaaacagagtggacagtataaccacatattgaataacataaaatgggcttgtgattattttataaaatgtcatccggaaaaggatgtgtactattaccaggtgggcgacggtcatgctgaccatgcgtggtggggtcctgccgaagtaatgcctatggaaaggccgtcgtacaaagttgacaggtcatcgccgggttccacggttgtggcagagacgtcggcagctttagctatagcatcgataatatttaagaaagtggatggtgaatactcgaaagaatgtttaaagcatgcaaaagaactgtttgaatttgcggacaccacaaaaagcgatgatgggtacactgcagccaatggtttttataattcatggagcggattttatgatgagctttcctgggcagctgtatggctttatcttgctaccaatgattcttcatatttggataaagcggaaagttattctgacaaatggggttatgagccacagacgaacataccgaagtataagtgggctcaatgctgggatgatgtgacttatggcacttatcttcttttggccaggattaaaaatgacaacggaaaatataaagaagcgatagaaaggcatcttgattggtggacaaccggatacaacggtgaaagaattacatatactccgaagggacttgcatggctcgaccagtggggatcattgaggtatgcaaccacaacggcatttctggcatgtgtttattccgattgggagaacggtgataaggaaaaagcaaaaacttatctggagtttgcaagaagccaggcggattatgctttgggaagcacgggaagaagctttgttgtgggttttggagaaaatccaccgaaaaggccccatcacagaactgctcacggttcatgggcggacagtcagatggagcctcccgaacacaggcatgttctttatggtgcccttgtgggaggacctgacagcacggacaactacaccgacgacatcagtaattacacctgcaatgaagttgcctgtgactataatgcaggttttgtgggactgcttgcaaaaatgtacaagctttatggcggaagtcccgatcccaaatttaacggtatagaagaagttccggaggatgaaatattcgttgaagccggtgtgaatgcatcgggaaacaatttcattgaaataaaagcgatagttaataataaatcgggctggcctgcaagagtatgtgagaatttatcctttagatattttatcaacattgaagagattgtgaatgcgggaaaaagtgcaagcgacctgcaagtgagctccagctacaatcagggggcaaaactgtccgatgtaaagcactacaaggacaatatttattatgtggaagtggatttgtcggggacaaaaatatatcccgggggacaatcggcatacaagaaggaagtgcagtttagaatttccgcgccggagggcacggtgtttaatccggaaaacgactattcctatcagggactttcggcaggtacggttgtaaagtctgagtatattccggtatatgatgccggggtgctggtatttggaagggaaccgggctcagcatcgaaaagcacgtctaaagacaatggtttgtccaaggcaactcccacggtgaaaactgaatctcagccgacagcaaaacacactcaaaatcctgcctcagactttaaaactccagccaatcagaacagtgtaaaaaaagaccaaggcataaaaggagaagtggtattacagtacgcaaacgggaatgcaggtgctacgtcaaacagtattaatccgaggtttaaaataattaacaacggtacaaaagccataaatttgtccgatgtcaagattagatattattacacaaaagaagggggcgcatctcaaaacttctggtgtgattggagcagtgccggcaattcaaatgttacaggaaacttctttaatctttcttcaccgaaagaaggagcggacacctgtcttgaagttggtttcggaagtggggccggaacccttgatcctggtggaagcgttgaagtacagataaggttttcaaaggaagactggtcaaactataaccagtcaaacgattattctttcaatccgtctgcttccgattatacggattggaacagggtgacgttgtatatttcaaacaagcttgtttacggcaaagaaccttgatttatctgtacgcaacatggctaagataggcttttgcaataccgatgtaatattcggattctcttacaatgtgattaattacaacagaggctgtcaaattgtttgccactgcggcactctcttttgccatgcagtttaggaagtttacgaaggtttgactttgacgtagtgttatttcaataatatttgcaattttttgtaccaattcagaagttatcacatagcctgatctgttcagtgtctcaatatattgcagaattgtggcttctgtcgcgctgagaatcttttggtattcatccagcttttctgtgaacttctcttccaagtcctgtacaatttttctgattaccacggtatgctctgcttcttgtcttttccaaaattcagcttcctccagaattcttatgtgattcttgtcgccgtagcaaaactgcattgttcatacctccattttatatagttgctaaggtaaacgtaatttattatatgttggaagataaaggttttgtgacggcaaagaagaaatcaaggtatggggaaaaagagtagacaaaacggtgttcagagaaaattaaaattttgtcaatatttaagatttacatgtcaggttttgacctgataatatagaaagaaaagagtttaaaggaggtcaagcaaccatatgggattgaatgaaacaccatctgcaaaccgtcttcatataggattcttcggcaaaagaaacgcaggtaaatcaagtgttgtaaatgctgttacgggtcaaaatctggctattgtttcggacgttaaagggacaaccacaaaccctgtttacaaagcaatggagcttttacctttagggccggttgtgataattgacactcccggaattgatgacaagggaacattgggagaaatgcgtgtgaaaaggagccgccaggtacttaacaaaaccgatattgcagtattggtaatcgatgccacttgcggcaagtctgaagatgatgaaaaattgattgaattgtttgagaagaaggacataaagtatgttgttgtttacaacaaggcggatttggaaggacatgaagaaacggtgggcgataatgaaatttatgtcagtgccaaaacgggttacaacattaataaattgaaggaaaaaatcgcatctcttgctgttaccgatgatattacccacaaaatagtgggtgacctgattagtccttccgattttgtcgtacttgtcgtacctattgacaaggcagctcccaaaggacgtcttattctgcctcagcagcagaccattcgtgatattttggaatcggatgccgttgcgattgtggtaaaagagaacgaacttaaaaatacgttagacagccttggcaaaaagcctaagcttgtcattaccgacagtcaggcctttgaaaaagtggcggcggacacgcccgacgatatttatcttacttcgttttccattctttttgcacgatacaagggtaatctggaaattgcggtaaaaggagcaaagacgctcgattctttacaagacggtgataccgttctcatctccgaagggtgtacacatcacagacagtgcgatgatataggcacggtgaagcttccaaggtggataaataattacactaaaaagaatttaaactttgaatttacgtccggtacggagtttccggaggatttgacccgctataaattaattgtgcattgtggcggctgcatgctgaatgaaagggaaatgaaataccgttacaaatgtgcggtggaacagaatgttcccattaccaattacggaattttgattgcatatgtgcatggaattttaaaaagaagccttcaaatcttcccggacatacttgcagaaattctttagcggttaaattggttaaatttataattaatgaatatattaatgcggttaaattattaatatattatggaatcttactgtaaaatatttctgtttttaattgaagacaacaagacggatatgatataatttatatgaaatatatatacatataaaatgtatgcgaaaataaacagcaaatagaagtcgcatttccatatacttttctttatccttatatcatgcttcattttctgcaaacatccggaaacgaagattccatattttgtatattttgatttgtaatgaattaaaaattataaaaattgaaattataaaattataaaaattaatgtattgttaaattataaatgatttatataaaagtatgttttaaggggggttattattaatgaagaaaatggggttgggcagatttagcaataaatttgtcctgactgttttgctgttctttttgaccgccgtgctgctgccgtcgtcttcttttgaatcaaaagtacaggctgcttcttcgcctcgttacggcggtgcatattataattacggagaagctttgcaaaaagcgattcttttttacaaggccaatcgtcttggagatttgcccgatgattacatcctgccttacagggctgacgccgcaatgaccgacggtcaggatgtgggtctggatcttaccggaggatgggctgatgccggagacggaatcaaatttacccatcccatgtcctatgccgcgggccaattgggctgggctgtgtatgaatatcgtcaggcctttgaaaaggcagggctgttggatgatattctggacgaaataaaatgggctacggactttttcattaaagctcatccggagccaaatgtattgtattatatgtgcggctacaatgattccgaccactcggtatgggttccccacgaacttttggattatgtgacggacagaaagtcctttgtgttaaacccgtcaaccccgggctcggatgtggcaggacaaactgcggcgtgtctggctattgcactaataatatttgagccgacagaccccgaatatgccgaaacctgtttgacccatgcaaagcagatttttgagtttggtgataaatacagagcgaaaaaatcctctggatgtttttataccccgtccggaggttatctggatgatttggcctggggtgccgtgtggctctacataaaaaccggagattccacttatcttgagaaagcaaaatccttcctgcctgttacttcattgggcggagggcatacccattgctgggatgatgtcagctacggtgctgcgcttaaaatagcccagcttactcatgacgaaggatatgccgccatggtcgaaaagaaccttgatttctggttgcccggaggaggaatcacttacactccgggaggcctggcatggctttcaccgtggggttctttgcgttatgcatccacagctgcgtttttggcctttgtgtgggctgacgacccaacggttggaacaccgtcaaagaaagaaacttaccgtgcttttgcggaaaaacaaataaactatattctcggagataaccctcgaaaaggaagttatgtggtgggatttggcgagaattctccaaaacatccgcatcacagaacggctcatggttcgtgggtaagtatgcttgaagtgccgagtttccatcgccacattctctacggcgcattggttggtggaccgacggacgatgacagctgggaagatgatatttccgattatacccggaatgaagtggcaaccgattacaatgcaggttttgtaggggctttggcaaaaatgtatgacatgtatggaggagaaccccttgaaaattggcctcaacctgaagatttcagagcaccgggagacgacattgttgaatacttctgccgtggctggataatttacgaaggctatggaaccttaaacttgctgcttcaggttaacaacagttccggatggcctccgacaatgaaggataagttgtctgtccgttacttcatggatttaactgaagtgtttgagtccggaggaactgtggatgacgttcagataagtcttggacagaacgagggagcaaaacttataggtttgaagcattacagggacaacatttactactttacggttgactttacgggaaccatgattatgcctgccgagtgggagatgtgtgaaaaagatgcccatgtaacaatcaaatacagagacggcataacaggttctaatgaaaacgactggtcatatcagaacttgagaaaggatccggattatgatgctacatcctttgcaggactgactccttatatacctgtatatgacaacggtgtgcttttgtggggtgaagaaccgcctgccgtcgatgatcccgggtcttcgccgccgccgactccaactgagccggtaattgtgtatggtgatttgaacggcgacggaaatataaattccacggattttacgatgttaaagagagcaatattgggtaatccggctcccggtacaaatttggcagccggtgatttgaacagggacggtaatacaaattcaacagacttgatgattttaagaaggtatttgctaaagttaattggttcgttacctatataacttatgtgaattttaatcaggtgttgcagaaaaaatcctacggatggaatggtcatccgtagatttttgttatgcctgtattttttgagcatctgaacaagttaatatataataaacatatattataaggatggaatggcttttgcaatatatttctttaatattgaagcatcagtagagtttaccgaaccgtcattatttacatcggcgttttcaagttgtttgccggagagagtcgttattctgagaatatgccttttaagtgcggacaaatctgtcgagtttatcttgccgtcgagattgatatcgccctttggcttttttggtgttggacttgggaagggtgtcggagttcgttcaggaataggtgtataatagttaaccgaggacagataagacctggcttctctgtgccttgtgctgatatgctctataaattgggtgagagcctggttaaattgtgcttcaccgttggtgagataagtgtagccttttatttctccctcgcttcccacggtgtatgggcggattagctcgtgaagcctgcgagctttttcgattacattaaattccctgaagtagatgttcagtgtgttttctatttcggtgtggtagatgtgcttgtagaccggatcatctattaaattgcgaatcagcggccagtttctgctaatttcatctaaagagaagctgggcggttttatgccccatggattggtggaggaaagggagaggttataatcccatgggataaataccaaacgaccgttatcggccaaatcttggtaaagataatggttttttgtgacccagccataagtgtcaaaatttacgatagtagtattgattgccagccattttaagaaagaatcggtattgaaaacagcttcaaggtccgctctccatttggctgggtcggttttgggagcgttcaatgcggcgacaagggcttgaaggtcactccagtcgtcagctttttcattggttttcttttcatatccgcgtttatcaaatattgtcaggtctcctccaggtgcttgctgacctttatagagatttccgttggggttttcgaattgatattcgagcatcttgtcggaaggatcctcgaacactgtgtataatccccaataaacagggccgtttcccgtatcaacgtacactctgtagaaagcgcagcgaggtgcgggaatgccggcatcgcggaaaatgtcactggtgagtttatccctcaggaatgaaggatcataccagttgttgttgaatatcacttcgtcaaagccgtaaaatctttggttgtctatttcaggatagtcatcttcgaacttgtcaaagtttaagcggaaaggatatttgtggctcatgctcatcatggccccggtcaatgtactctgtcccttgtatctgattcccacgtgccaccaggtgtgattgttgaattttaccgttgcaggcacataaataggatcttcgttgctcatcataaatactttgaagacatcattttccatgcgctgaaaattttcgggactgatgatgatatcgatacggtttactttgtcttcgggaaataccactgaatagttgggcgttgcttttttgccgtgggtttcttccgtccagccctcaggtctggatgcagcccaaacttgtggtccggtcagacacacaacaagaagcatcatgcttgttgtcagtgccgtcaacttaaaaaatttacgcataattttacctcccataaattaattttatcgataataattgatttattgcttccggtttgattcgaaaacacttggcagtcggtttttaagtatacggatgccttgtaaaaaacataaaaaatgttatatatcttcaatatatattcgtagaaaaaataattttgtggcttaaagtagagcgaactaaaaatgagttgggtttcattatgttattataacttgaaaagagtgacagattatagtattttaattatatagtattttaatattatatggtattacttcaatgcaaaaggtttttgtttgcgataaaactattacacagaaaatatagggattggaggagaagataatgaaaaaaatagccattacgatattaacggtatttatgttaactgtttttttggcaaatgtgggttatgcaattgatataccgcttcgcgtagttgtaaatggggaagaggtgaatttcccggatgcaaagccgtttattgatgcaaacggaagaacacagacaccggcaaggtttattggagaagctctgggagcgacggtaacatgggacggaaatgcgaagaaggctgtatttaagatgaatggaacaacgttggagttgtttattgggaaaaaggaatatcagctgaacgggcaaaagaagcagatggatacggaagcattgttgatagagggaaggacgtttgtaccggctcgttatgtggcggaagcatttggcgcaacggttagttggaatgctgcaattaagacggtgtatataaatatggataagacgggtaaggtggaaaatgaaggtgatactagggaagtagccggatttatagtgccgaaggggatagatttaatggttgcaggtgcagatgaagattctggttatgaagcggtttttacgatctcctttttaaggaagaatgttgaaaagcagaaagatgatatggagaagatattattacaaaagtttagtgaagatacggtaaaagaaattatgagtgttgtgagatcaaaggtaaattatacagatgttattgaagagaggtatttttacgacaaaaaaactgaccaatatatgtatatgcctaagtcatggccgactagaacatccacaattaagttta

SEQ ID NO: 708 - protein, 179 aa, Clostridium thermocellum
DRRIAAKETTELIEGTIKRTENGTKIARETAEALNKIVEGISKAATLVNDIAVASNEQAAAITQINQGIAQVSQVVQTNSATSEESAAASEELSSQAELLKRSIAKFKLKNMGKMTSNRYKEVSPEIMRMLEDYTENKQPKSYSKEENGEYSDGKETAEKDVGGLKQKILLSDSEFGKY

SEQ ID NO: 709 - protein, 887 aa, Clostridium thermocellum
MRLVNSLGRRKILLILAVIVAFSTVLLFAKLWGRKTSSTLDEVGSKTHGDLTAENKNGGYLPEEEIPDQPPATGAFNYGEALQKAIFFYECQRSGKLDPSTLRLNWRGDSGLDDGKDAGIDLTGGWYDAGDHVKFNLPMSYSAAMLGWAVYEYEDAFKQSGQYNHILNNIKWACDYFIKCHPEKDVYYYQVGDGHADHAWWGPAEVMPMERPSYKVDRSSPGSTVVAETSAALAIASIIFKKVDGEYSKECLKHAKELFEFADTTKSDDGYTAANGFYNSWSGFYDELSWAAVWLYLATNDSSYLDKAESYSDKWGYEPQTNIPKYKWAQCWDDVTYGTYLLLARIKNDNGKYKEAIERHLDWWTTGYNGERITYTPKGLAWLDQWGSLRYATTTAFLACVYSDWENGDKEKAKTYLEFARSQADYALGSTGRSFVVGFGENPPKRPHHRTAHGSWADSQMEPPEHRHVLYGALVGGPDSTDNYTDDISNYTCNEVACDYNAGFVGLLAKMYKLYGGSPDPKFNGIEEVPEDEIFVEAGVNASGNNFIEIKAIVNNKSGWPARVCENLSFRYFINIEEIVNAGKSASDLQVSSSYNQGAKLSDVKHYKDNIYYVEVDLSGTKIYPGGQSAYKKEVQFRISAPEGTVFNPENDYSYQGLSAGTVVKSEYIPVYDAGVLVFGREPGSASKSTSKDNGLSKATPTVKTESQPTAKHTQNPASDFKTPANQNSVKKDQGIKGEVVLQYANGNAGATSNSINPRFKIINNGTKAINLSDVKIRYYYTKEGGASQNFWCDWSSAGNSNVTGNFFNLSSPKEGADTCLEVGFGSGAGTLDPGGSVEVQIRFSKEDWSNYNQSNDYSFNPSASDYTDWNRVTLYISNKLVYGKEP

SEQ ID NO: 710 - protein, 144 aa, Clostridium thermocellum
MQFCYGDKNHIRILEEAEFWKRQEAEHTVVIRKIVQDLEEKFTEKLDEYQKILSATEATILQYIETLNRSGYVITSELVQKIANIIEITLRQSQTFVNFLNCMAKESAAVANNLTASVVINHIVRESEYYIGIAKAYLSHVAYR

SEQ ID NO: 711 - protein, 400 aa, Clostridium thermocellum
MGLNETPSANRLHIGFFGKRNAGKSSVVNAVTGQNLAIVSDVKGTTTNPVYKAMELLPLGPVVIIDTPGIDDKGTLGEMRVKRSRQVLNKTDIAVLVIDATCGKSEDDEKLIELFEKKDIKYVVVYNKADLEGHEETVGDNEIYVSAKTGYNINKLKEKIASLAVTDDITHKIVGDLISPSDFVVLVVPIDKAAPKGRLILPQQQTIRDILESDAVAIVVKENELKNTLDSLGKKPKLVITDSQAFEKVAADTPDDIYLTSFSILFARYKGNLEIAVKGAKTLDSLQDGDTVLISEGCTHHRQCDDIGTVKLPRWINNYTKKNLNFEFTSGTEFPEDLTRYKLIVHCGGCMLNEREMKYRYKCAVEQNVPITNYGILIAYVHGILKRSLQIFPDILAEIL

SEQ ID NO: 712 - protein, 742 aa, Clostridium thermocellum
MKKMGLGRFSNKFVLTVLLFFLTAVLLPSSSFESKVQAASSPRYGGAYYNYGEALQKAILFYKANRLGDLPDDYILPYRADAAMTDGQDVGLDLTGGWADAGDGIKFTHPMSYAAGQLGWAVYEYRQAFEKAGLLDDILDEIKWATDFFIKAHPEPNVLYYMCGYNDSDHSVWVPHELLDYVTDRKSFVLNPSTPGSDVAGQTAACLAIALIIFEPTDPEYAETCLTHAKQIFEFGDKYRAKKSSGCFYTPSGGYLDDLAWGAVWLYIKTGDSTYLEKAKSFLPVTSLGGGHTHCWDDVSYGAALKIAQLTHDEGYAAMVEKNLDFWLPGGGITYTPGGLAWLSPWGSLRYASTAAFLAFVWADDPTVGTPSKKETYRAFAEKQINYILGDNPRKGSYVVGFGENSPKHPHHRTAHGSWVSMLEVPSFHRHILYGALVGGPTDDDSWEDDISDYTRNEVATDYNAGFVGALAKMYDMYGGEPLENWPQPEDFRAPGDDIVEYFCRGWIIYEGYGTLNLLLQVNNSSGWPPTMKDKLSVRYFMDLTEVFESGGTVDDVQISLGQNEGAKLIGLKHYRDNIYYFTVDFTGTMIMPAEWEMCEKDAHVTIKYRDGITGSNENDWSYQNLRKDPDYDATSFAGLTPYIPVYDNGVLLWGEEPPAVDDPGSSPPPTPTEPVIVYGDLNGDGNINSTDFTMLKRAILGNPAPGTNLAAGDLNRDGNTNSTDLMILRRYLLKLIGSLPI

SEQ ID NO: 713 - protein, 533 aa, Clostridium thermocellum
MRKFFKLTALTTSMMLLVVCLTGPQVWAASRPEGWTEETHGKKATPNYSVVFPEDKVNRIDIIISPENFQRMENDVFKVFMMSNEDPIYVPATVKFNNHTWWHVGIRYKGQSTLTGAMMSMSHKYPFRLNFDKFEDDYPEIDNQRFYGFDEVIFNNNWYDPSFLRDKLTSDIFRDAGIPAPRCAFYRVYVDTGNGPVYWGLYTVFEDPSDKMLEYQFENPNGNLYKGQQAPGGDLTIFDKRGYEKKTNEKADDWSDLQALVAALNAPKTDPAKWRADLEAVFNTDSFLKWLAINTTIVNFDTYGWVTKNHYLYQDLADNGRLVFIPWDYNLSLSSTNPWGIKPPSFSLDEISRNWPLIRNLIDDPVYKHIYHTEIENTLNIYFREFNVIEKARRLHELIRPYTVGSEGEIKGYTYLTNGEAQFNQALTQFIEHISTRHREARSYLSSVNYYTPIPERTPTPFPSPTPKKPKGDINLDGKINSTDLSALKRHILRITTLSGKQLENADVNNDGSVNSTDASILKKYIAKAIPSL

SEQ ID NO: 714 - protein, 259 aa, Clostridium thermocellum
MKKIAITILTVFMLTVFLANVGYAIDIPLRVVVNGEEVNFPDAKPFIDANGRTQTPARFIGEALGATVTWDGNAKKAVFKMNGTTLELFIGKKEYQLNGQKKQMDTEALLIEGRTFVPARYVAEAFGATVSWNAAIKTVYINMDKTGKVENEGDTREVAGFIVPKGIDLMVAGADEDSGYEAVFTISFLRKNVEKQKDDMEKILLQKFSEDTVKEIMSVVRSKVNYTDVIEERYFYDKKTDQYMYMPKSWPTRTSTIKF

SEQ ID NO: 715 - DNA, 3780 bp, Eubacterium cellulosolvens
agtgtatacaaaatcgtgacaattacgaaaagaaaatagacaatttcgcgtcgaaaacgattgcgtcagtcaaaaaccgttgatataattataaatattctagggcaatgggtgaagtatgcgcatctgagcgttgggaaatacgatgtttgcaggctttatttcagtgctctaaaaaatacaaatgggggattttttatgaaaggaaactggttgaaagatgtgctgcgtagattcgcagtcatcgcaatgatgctggtgatggtatttaccttgttgccggcaaccgctcagggcactgaggctgcatccggggatattgttcttttctccggcagcaaacatgtggaattcacagactggggcggtacggactggccgagcgcttatgagcttcagccgccgtatcagacaatgccctttgatctcaacaagaatttcgagatcaaagtggactacagcggcgctgatattgttctgatctttgcgcgttgggagcatggctctaaaccgcagatctgggcacagatctctccgtactatgtagttgacggaactgcagtattcacaaaagaacagatcgcaaaagcatacggaagcgatgacttcagcgatctggattacatcggcgtaaaacccttaccctccgcagatggtatgacagtgacaaaaattgttgcatcctacacaagcggaagctccgatgatgtagacatcaatctcaagggtattgccggtgagtgggcaaacggcgtgaacatcggatggaacctgggaaataccctggatgcctacgataccaaccgtttcaaaagctcaaagggacacaataatccggcagatatcgagacctgctggggcaatccggtgaccacaaaggccatgatcgatgacatcaaggcacagggcttcaacgcagtccgtgtaccggttacctgggatttcgagatcgatgacaacgacggctacaaagtgaacgaggcgtggatggctcgtgtcaaagaagtagtagactacgtcatggacaacgatctgtactgtatcctgaacgttcatcatgacaccggtgagcagggatggctcaaagcttccactgcaaactacaacaagaacgtgaaaaagttcaaagctctctggaaacagattgcagccgagttcaaaaactatgacaacaagctggctttcgagggcttcaatgagatgctcgacgagaagaacagctggaactatccgggaactgacgcaggtgatgccatcaacctctacaaccaggcatttgtagacgttgtacgtgccagcggcggaaagaacggcaaacgtcctctgatctgcaacacttacgcaggatgtacagaggccggagcgcttaattctttcaagattccgaatgatacggttgataacgcgatcatcgctcaggtacatttctatcagcccacaggctactgcttcgacatgaatccgaatcaggggcagaacatggatgtggactacaagacctgcggtggagagagcgcagctgatacactcgccatgatgctctacaagagattcacagagaagggaattccctgtatcgtcggtgagttcgctgccagccacaagaagaacgatgataaccgtgcagagtgggttgactacgtagtaagaaagaccggtacatacggcgtgaaatgcttctggtgggacaacggcggcactttcacaccgaactactccacaggactggactactacaacagcatgggtatctacaacagaaacaccatgcagttcgagtatccgaaggtagctgacgcccttgtaaatgctgcaaacggcggagcaaaacccacaactgcaccgacaaagaaaccgacttccacaccgaagccgacagcaacactgaaacccacaaccaaacctacaacaaaacctacaacgaaaccgaatccgacttcaggagctgattccggcgaaatcattttgttctccggaagcaaccatgcggatttcaaagcctggggcggcgacgactggcccagcgcattcgaaatttcgccgaagtatgagccgatgaagcttgatctgaacaagaattttgagatcaaagtggattacaacggtgcggatattgttctgattttcgcacgttgggataaggacatctgggcacagatttctccgtactatgttgtagacggaacagcagtattcacaaaagagcagatcgccaaggcctatggaagcgatgacttcagtggtcttgattatatcgcggttaaaccgctgccttccgaagaaggtgtgacagtgacaaaagtttccggaatctacacaaacggaggttcggaagacgtagacatcaacctcaagggaattgccggcgagtgggcaaacggcgtgaatatcggatggaacctgggtaataccctggatgcctacgacaccaaccgtttcacaaggacaaagggacacaacaatcctgctgatatcgagacctgctggggcaatccggtgaccacaaaggccatgatcgatgatatcaaggcacagggcttcaacgcagtccgtgtaccggtaacctgggattatgagatcgacgacaacgacggctacaaagtaaacgaggcgtggatggctcgtgtcaaagaagttgttgattacgtaatggacaatgatatgtactgtatcgtaaacgttcatcacgacaccggtgagcagggatggcttaaggcttccactgcaaactacgcaaagaacgagaagaagttcaaagcactctggaaacagattgccgctgaattcaagaactacgatcataagctggccttcgagggcttcaacgagatgctcgatgagaagaacagctggaactatccgggcgctgacgcaggtgaggctatcaacctctacaaccaggcatttgttgatgttgtacgcgccagcggcggaaagaacagcgaccgtcctctgatctgcaacacctacgcaggatgtacagaggcaggagctctcaactccttcgagattccgaacgataccgtagagaatgcgatcatcgctcaggttcacttctatcagccgacaggctactgcttcgacatgaacccgaatcaggggcagaacatggatgtggactacaagacctgcggtggagagagcgcagctgatacacttgccatgatgctctacaagagattcacagagaagggaattccctgtatcgtcggtgagttcgctgccagccacaaacagaacgatgacaaccgtgcggcatgggtagactacgtagtaagcaagaccggaaaatacggcgtgaaatgcttctggtgggataacggtggaacattcacaccgaactactccacaggactggactactacaacagcatgggtatctacaacagaaacaccatgaagttcgagtatccgaaggtagctgacgcccttgtaaaagcagcaaacggcggaacaatgcctaccgttgcacctacaaagaaaccgacagcaacacctacacctacaaagaagccgacttccacaccgaagcctacggtgaaacctacacagacaccgaagcctacaagaaaaccgggcaaacgcgtgaaatattccgcacttgacctcgacggaaacgtaagctccggcaacctgatcccgtaatataaaaattacaggaaccgtctttgtagaaccataggatggttatgtaaaaccaatctaacaaaaaacagacggccacgtcgcaaacggggattccttagtgaatacccgacggcgcggccgtcttttatgtga

SEQ ID NO: 716 - protein, 1148 aa, Eubacterium cellulosolvens
MKGNWLKDVLRRFAVIAMMLVMVFTLLPATAQGTEAASGDIVLFSGSKHVEFTDWGGTDWPSAYELQPPYQTMPFDLNKNFEIKVDYSGADIVLIFARWEHGSKPQIWAQISPYYVVDGTAVFTKEQIAKAYGSDDFSDLDYIGVKPLPSADGMTVTKIVASYTSGSSDDVDINLKGIAGEWANGVNIGWNLGNTLDAYDTNRFKSSKGHNNPADIETCWGNPVTTKAMIDDIKAQGFNAVRVPVTWDFEIDDNDGYKVNEAWMARVKEVVDYVMDNDLYCILNVHHDTGEQGWLKASTANYNKNVKKFKALWKQIAAEFKNYDNKLAFEGFNEMLDEKNSWNYPGTDAGDAINLYNQAFVDVVRASGGKNGKRPLICNTYAGCTEAGALNSFKIPNDTVDNAIIAQVHFYQPTGYCFDMNPNQGQNMDVDYKTCGGESAADTLAMMLYKRFTEKGIPCIVGEFAASHKKNDDNRAEWVDYVVRKTGTYGVKCFWWDNGGTFTPNYSTGLDYYNSMGIYNRNTMQFEYPKVADALVNAANGGAKPTTAPTKKPTSTPKPTATLKPTTKPTTKPTTKPNPTSGADSGEIILFSGSNHADFKAWGGDDWPSAFEISPKYEPMKLDLNKNFEIKVDYNGADIVLIFARWDKDIWAQISPYYVVDGTAVFTKEQIAKAYGSDDFSGLDYIAVKPLPSEEGVTVTKVSGIYTNGGSEDVDINLKGIAGEWANGVNIGWNLGNTLDAYDTNRFTRTKGHNNPADIETCWGNPVTTKAMIDDIKAQGFNAVRVPVTWDYEIDDNDGYKVNEAWMARVKEVVDYVMDNDMYCIVNVHHDTGEQGWLKASTANYAKNEKKFKALWKQIAAEFKNYDHKLAFEGFNEMLDEKNSWNYPGADAGEAINLYNQAFVDVVRASGGKNSDRPLICNTYAGCTEAGALNSFEIPNDTVENAIIAQVHFYQPTGYCFDMNPNQGQNMDVDYKTCGGESAADTLAMMLYKRFTEKGIPCIVGEFAASHKQNDDNRAAWVDYVVSKTGKYGVKCFWWDNGGTFTPNYSTGLDYYNSMGIYNRNTMKFEYPKVADALVKAANGGTMPTVAPTKKPTATPTPTKKPTSTPKPTVKPTQTPKPTRKPGKRVKYSALDLDGNVSSGNLIP

SEQ ID NO: 717 - DNA, 481 bp, Pectobacterium carotovorum (Erwinia carotovora)
tgcaggcggcattaaagcatggcaggcggcattaaagcatgcaggcggcattaaagcatggctggcgcgcattttgtttcagttaaaaagctggggaatggcagaaatcttcctcgccggcgtgctggtgagctttgttaagctgatggcctacggcgatatcggcgtgggcagcagctttattccgtggtgcttcttttgcgttttacagttgcgtgcatttcagtgcgttgaccgtcgctggctatgggatgatattgcgccaatgcctgtcataaagcaggccttaaaacctggcgtgcctggtattcgacagggactgcgttcctgctcttgctgcactgcaatacttcccgctgatgaacgggtgtgcccacgttgtcagacgaaaggttatgtgcggcgtaaaaacagtctgcaatggacgttggcattactgtttacgtcgatcatgcttaaatgccgcctgcatgctttaatg

SEQ ID NO: 718 - protein, 160 aa, Pectobacterium carotovorum (Erwinia carotovora)
AGGIKAWQAALKHAGGIKAWLARILFQLKSWGMAEIFLAGVLVSFVKLMAYGDIGVGSSFIPWCFFCVLQLRAFQCVDRRWLWDDIAPMPVIKQALKPGVPGIRQGLRSCSCCTAILPADERVCPRCQTKGYVRRKNSLQWTLALLFTSIMLKCRLHALM

SEQ ID NO: 719 - DNA, 3306 bp, Cellulomonas fimi
gtggtttctcgcaggtcatcacaggcgcgcggcgcgctcacggccgtcgtcgcgacgctcgccctcgcgctcgccgggagcggcaccgcgctcgccgcgtcgccgatcggggagggaacgttcgacgacgggcccgaggggtgggtcgcgtacggcaccgacggccccctcgacacgagcacgggcgcgctgtgcgtcgccgtgccggccggatccgcgcagtacggcgtcggcgtcgtgctcaacggcgtcgcgatcgaggaagggaccacctacacgctccggtacaccgcgacggcctcgaccgacgtcaccgtgcgggcgctcgtcgggcagaacggcgccccctacggcaccgtgctcgacacgagcccggccctgacgtccgagccgcggcaggtgaccgagacgttcacggcctcggcgacgtaccccgcgacacccgccgccgacgaccccgaggggcagatcgccttccagctcggcgggttcagcgccgacgcgtggacgttctgcctcgacgacgtcgcgctcgactccgaggtcgagctcctgccgcacacgtcgttcgccgagtcgctcggcccgtggtccctgtacggcacgagcgagccggtgttcgccgacggccggatgtgcgtcgacctgcccggcgggcagggcaacccctgggacgcgggcctcgtctacaacggcgttcccgtcggcgagggcgagagctacgtcctgtcgttcaccgcgagcgcgacgcccgacatgccggtgcgcgtgctcgtcggcgagggcggcggcgcctaccggaccgccttcgagcaggggtcggcaccgctgaccggcgagcccgcgacccgcgagtacgcgttcacctcgaacctgacgttcccgcccgacggcgacgcacccggccaggtcgcgttccacctcggcaaggccggtgcgtacgagttctgcatctcgcaggtgtcgctcaccacctcggcgacgccgccgcccgggtacgagcccgacaccggcccgcgcgtgcgggtcaaccaggtgggctacctgccgttcgggccgaagcgcgccaccctcgtcaccgacgcggccgagccggtcgcgtgggagctgcgcgacgccgacggcgtggtcgtcgccgacgggaccagcgagccgcgcggcgtcgagccgtcggccgcgcaggcggtgcacgtgctcgacttctccgacgtcacgacgcagggcgcggggtacacgctcgtcgccgacggcgagacgagccgccccttcgacatcgacggcgacctgtaccagcagctccggtacgacgcgctcaactacttctacctcgcgcgctccggcaccgagatcgaggcggacgtggtcggcgaggagtacgcccgcgaggcgggccacgtcggcgtcgcgcccaaccagggcgacaccgacgtgccgtgcatcggcccgcgcgactactacgacggctggacgtgcgactaccggctcgacgtgagcggcggctggtacgacgccggcgaccacggcaagtacgtcgtcaacggcggcatcgcggtcgggcagctcctgcagacgtacgagcgggcgctgcacgcgggcaccgccgacgcgctcgcggacggcaccctcgacgtgcccgagcacggcaacgacgtgcccgacgtcctggacgaggcgcgctgggagctcgagtggatgctctcgatgatcgtgcccgagggggagtacgcggggatggtgcaccacaaggtgcacgacgagggctggaccgggctgccgctgctgccggccgacgacccgcaggcgcgctcgctgcaccggccgtcgaccgcggcgacgctcaacctgtccgccgtcgcggcgcagggggcgcgcctgctcgagccgtacgacccgcagctcgcgcagacgctgctggaggcggcacgcacgacctgggctgcggcccaggagcacccggcgctgtacgccccgggcgaggccggcgcggacggcggtggcgcgtacaacgactcccaggtggccgacgagttctactgggcggccgccgagctctacctgacgacgggcgaggacgcgttcgccaccgcggtgacgacctcgccgctgcacaccgcggacgtgttcaccgcggacgggttcggctgggggagcgtcgccgcgctgggtcgcctcgacctcgcgacggtgccgaacgagctgccgggtctcgacgcggtgcaatcgtcggtcgtcgagggggcgcaggagtacctcgcggcgcaggcggggcagggattcggctcgctgtactccccgcccggcggcgagtacgtctggggctcgagctcgcaggtcgcgaacaacctcgtcgtcgtcgcgaccgcgtacgacctcacgggcgacgagcggttccgggcggcgacgctcgaggggctcgactacctgttcggccgcaacgcgctcaaccagtcgtacgtgacgggctggggcgaggtcgcctcgcaccagcagcacagccggtggttcgcgcaccagctcgacccgtcgctcccgagcccgccgcccggctcgctcgcgggcggcccgaactcgcaggccgcgacgtgggacccgacgacgaaggcggcgttccccgacggctgcgcgccgtccgcgtgctacgtcgacgagatccaggcgtggtcgacgaacgagctcaccgtcaactggaactccgcgctgtcctgggtcgcctcgtgggtggccgaccagggctcggccgagccggtgccgacggcgccggtggtgacgcggcagcccgtcgacgcgaccgtcgcgctcggtgccgacgccacgttcaccgcggaggcgagcggcgtgcccgcgccgaccgtccggtggcaggtgcgggccggccgcggctggaaggacgtcgccggcgcgaccgggaccacgctcacggtccgcgcgaccgcccgcaccgacggcacgcggtaccgggcggtgttcaccaacgcggccggctcggtcgagagcgccgtcgtgcggctcaccgtcgagcgcgcggcacccgtcgtgacgcagcacccggccgacgtccgggcacgggtcggcacgcgtgccgtgttccgcgcggccgccgacgggtaccccacgccctgcgtcgtgtggcaggtgcggtggggcggcgggagctggcggccgatcccgtgggccacctcgacgacgctctccgtgccggtcacggtgctcgcggcgggcacggagtaccgcgcggtgttcaccaacgccgtcggcaccgcggcgaccgagcctgccgagctcgccgtgcagcgtccgcgcagctga

SEQ ID NO: 720 - protein, 1101 aa, Cellulomonas fimi
MVSRRSSQARGALTAVVATLALALAGSGTALAASPIGEGTFDDGPEGWVAYGTDGPLDTSTGALCVAVPAGSAQYGVGVVLNGVAIEEGTTYTLRYTATASTDVTVRALVGQNGAPYGTVLDTSPALTSEPRQVTETFTASATYPATPAADDPEGQIAFQLGGFSADAWTFCLDDVALDSEVELLPHTSFAESLGPWSLYGTSEPVFADGRMCVDLPGGQGNPWDAGLVYNGVPVGEGESYVLSFTASATPDMPVRVLVGEGGGAYRTAFEQGSAPLTGEPATREYAFTSNLTFPPDGDAPGQVAFHLGKAGAYEFCISQVSLTTSATPPPGYEPDTGPRVRVNQVGYLPFGPKRATLVTDAAEPVAWELRDADGVVVADGTSEPRGVEPSAAQAVHVLDFSDVTTQGAGYTLVADGETSRPFDIDGDLYQQLRYDALNYFYLARSGTEIEADVVGEEYAREAGHVGVAPNQGDTDVPCIGPRDYYDGWTCDYRLDVSGGWYDAGDHGKYVVNGGIAVGQLLQTYERALHAGTADALADGTLDVPEHGNDVPDVLDEARWELEWMLSMIVPEGEYAGMVHHKVHDEGWTGLPLLPADDPQARSLHRPSTAATLNLSAVAAQGARLLEPYDPQLAQTLLEAARTTWAAAQEHPALYAPGEAGADGGGAYNDSQVADEFYWAAAELYLTTGEDAFATAVTTSPLHTADVFTADGFGWGSVAALGRLDLATVPNELPGLDAVQSSVVEGAQEYLAAQAGQGFGSLYSPPGGEYVWGSSSQVANNLVVVATAYDLTGDERFRAATLEGLDYLFGRNALNQSYVTGWGEVASHQQHSRWFAHQLDPSLPSPPPGSLAGGPNSQAATWDPTTKAAFPDGCAPSACYVDEIQAWSTNELTVNWNSALSWVASWVADQGSAEPVPTAPVVTRQPVDATVALGADATFTAEASGVPAPTVRWQVRAGRGWKDVAGATGTTLTVRATARTDGTRYRAVFTNAAGSVESAVVRLTVERAAPVVTQHPADVRARVGTRAVFRAAADGYPTPCVVWQVRWGGGSWRPIPWATSTTLSVPVTVLAAGTEYRAVFTNAVGTAATEPAELAVQRPRS

SEQ ID NO: 721 - DNA, 1957 bp, Thermobifida fusca
tccagtgaagttttctccttccattcgggagcgcaccctgcgcttttggtccccccacgcttctgcggaggcgtgttccccgaaaggactaccggcagtgggcagaatgacccccctgacgcgacgactgcgtgccggagcagccgcgatcgcgatcggagcgtctgctcttatccccctgacttcctcccccgcagccgcctcaggcaccgctgactggctgcacacggacggcaaccggatcgtggactccgcgggcaacgaggtgtggctcaccggagccaactggttcggcttcaacaccagcgaacggatgttccacgggctgtgggccgccaacatcgaggacatcaccagtgcgatggccgagcgcggcatcaacatggtgcgtgtccccatcagcacccaactgctgttggagtggaagaacggccaggccggaccgagtggagtcaacgagtacgtcaaccccgaactggcggggatgaacaccctcgaagtgttcgactactggctgcaactgtgcgaagagtacggcctcaaagtcatgcttgacgtgcacagcgcggaggccgacaactccgggcactactacccggtctggtacaagggcgatatcaccaccgaggacttctacacggcctgggagtgggtcaccgagcggtacaagaacaacgacaccatcgtcgccgcagacatcaagaacgagccccacggcaaagccaacgagaccccgcgcgccaagtgggacggctccacggacatcgacaacttcaagcacgtctgcgagaccgccggtaagcgcatcctcgcgatcaacccgaacatgctcatcctgtgcgaggggatcgagatctaccccaaggatgggcaggactggtcctccaccgatgggcgggactactactccacctggtggggcggcaacctgcgcggcgtcgccgaccaccccgtcgacctgggcgcccaccaggaccagttggtctactcgccgcacgactacggtcccagcgtgttcgagcagccctggttcgaaggcgagtggaaccggcagaccctgaccgaggacgtgtggcgtcccaactggctctacatccacgaagacgacatcgctccgctgctcatcggcgagtggggcggcttcctggatgggggcgacaacgagaagtggatgacggcgctgcgctcgctcatcatcgacgagaagatgcaccacaccttctgggcgctgaacccgaactcgggtgacaccggcggcctgctcaactacgactggacaacctgggacgaggccaagtacgcgttcctcaagcctgcgttgtggcaggacgccaacggcaagttcgtcggcctggaccacgatgtgccgctgggcggggtgggctccaccaccggtgtgtcgctgaaccagtactacggcgggggcggaccgagccagccgcccacggaacccacggagccgccgacggagcccacggagccgccgacggagccgacggagccgcccgccaaccccacgggtgcgctcgaggtctactaccgcaacaacagtcttgcggccgacgacagccagatcgcgccggggctgcgtctggtcaacaccggaagcagcacggtcgacctggctgacgtggaaatccactactacttcaccaacgagcccggcggtaccctccagttcacctgcgactgggctcaagtgggctgcgccaacgtcaacgcgtccttcacgtcgctgtcggctccgggcgccgacacctccctggtgctcaccctcagcggcagcctcgctcccggggcgagcaccgagctccaaggccggatccacaccgcgaactgggcgaacttcgacgaaagcgacgactacagccgcggcaccaacactgactgggagctcagcgaggtgatcaccgcatacctcggcggcaccctggtctggggtacgcctcccgcctaa

SEQ ID NO: 722 - protein, 616 aa, Thermobifida fusca
MTPLTRRLRAGAAAIAIGASALIPLTSSPAAASGTADWLHTDGNRIVDSAGNEVWLTGANWFGFNTSERMFHGLWAANIEDITSAMAERGINMVRVPISTQLLLEWKNGQAGPSGVNEYVNPELAGMNTLEVFDYWLQLCEEYGLKVMLDVHSAEADNSGHYYPVWYKGDITTEDFYTAWEWVTERYKNNDTIVAADIKNEPHGKANETPRAKWDGSTDIDNFKHVCETAGKRILAINPNMLILCEGIEIYPKDGQDWSSTDGRDYYSTWWGGNLRGVADHPVDLGAHQDQLVYSPHDYGPSVFEQPWFEGEWNRQTLTEDVWRPNWLYIHEDDIAPLLIGEWGGFLDGGDNEKWMTALRSLIIDEKMHHTFWALNPNSGDTGGLLNYDWTTWDEAKYAFLKPALWQDANGKFVGLDHDVPLGGVGSTTGVSLNQYYGGGGPSQPPTEPTEPPTEPTEPPTEPTEPPANPTGALEVYYRNNSLAADDSQIAPGLRLVNTGSSTVDLADVEIHYYFTNEPGGTLQFTCDWAQVGCANVNASFTSLSAPGADTSLVLTLSGSLAPGASTELQGRIHTANWANFDESDDYSRGTNTDWELSEVITAYLGGTLVWGTPPA

SEQ ID NO: 723 - DNA, 1987 bp, Pectobacterium carotovorum
taccccagcattacgtttgttatcggtagcactgaagccgttaggaaccccatagtcagtatggaaatgagaaaaattctcaacaaagtgctttacagatgatactgataactattatcatcattttgcacttcagcagtggcttctcgcaggcactgaaggagagcacgacattgctcacattgcttccagtattattttagccagcctacgtgctggcttttttttgcctgaaaaatggcttctttagatgcttatctcgctttctatttctatgtaaataattaataaaatcaatctgattgggatatttcctaaattatttgcgggaacgagaatctcccttatcatgcctatacccaacttatgggtgttcacaatggagataaggaatatgtggctcagaaggaagcaaatcgtcaggaaattgacgctcggtgtagtaacaacgatgctgggcatgtcgctcagtttctccgcattatccgccaccccggtggaaacgcatggccagttgtccatcgaaaatgggcgattggtggatgaacagggaaagcgggtacaactaagagggatcagttcgaatggattgcagtgggttggtgactatgtcaacaaagattcgatgaaatggctgcgtgacgattggggtataaatgtgttccgcgtcgctatgtacacggcggagaatggttatattgctaacccttctctcgccaataaagtaaaagaggccgttgcagcggcgcaaggcctcggtgtctatatcatcatcgattggcacaccttgtcggataacgatcccaatacttataaagcacaggcaaaaatcttctttgccgaaatggcggggctgtatggcaactcgccgaatgtgatttatgaaatcgccaatgagccaaacggcagtgtgacatggaacgggcagattcgaccttatgcgctggaagtcactgacaccatccgtagcaaagatcccgataaccttattatcgtcggcagcgggacctggagccaggatatccatgatgcggcagacaatcagttgcccgatccgaatactctgtatgcgctgcatttctatgctggcacgcacgggcagttcctgcgcgatcgcattgactatgcacaaagccgcggtgctgcaattttcgtcagcgagtggggaaccagcgatgcgtccggcaatggcgggccgttcctgccagaatcgcagacctggatcgatttcctgaataaccgtggtataagctgggtgaactggtcgcttagcgataagtctgagacatccgcggcgctggtagcgggcgcgagtaaatcaggcggctggacggagcagaatttgtcaacgtcaggcaaatttgtcagagagcagattcgtgcgggggcgggtctgagcggtggtgatacgccgacgatgccaacagagccgacgaacccaggtaacggaaccacgggtgacatcgtgctgcaatatcgtaatgtggataacaacccttccgatgatgcgattcgtatggcctttaatatcaaaaatactggaagtacaccgatcaaactcagcgatctgcaagtacgttactacttccatgatgatggtaagcccggcgcaaacctctttgttgactgggcgaacgtcggccctaacaacatcgtgaccagtacagggacacctgctgcaagtaccgataaggccaatcgctatgttctggtgactttcgccagcgggggttcccttcaaccgggcgcggaaacaggtgaagtgcaggtgcgtatccacgcgggtgactggagcaacgtgaatgagacgaatgactattcatacggccctaacatcacgagctacacaaactgggataagatcactgtgcatgataaaggcacgctggtctggggcactgagccgtaatagcgcgttgttaatgtattaacccatcataagtgcttgtaatgcgcccgcattttctttccaatgtctcactcattc

SEQ ID NO: 724 - protein, 504 aa, Pectobacterium carotovorum
MWLRRKQIVRKLTLGVVTTMLGMSLSFSALSATPVETHGQLSIENGRLVDEQGKRVQLRGISSNGLQWVGDYVNKDSMKWLRDDWGINVFRVAMYTAENGYIANPSLANKVKEAVAAAQGLGVYIIIDWHTLSDNDPNTYKAQAKIFFAEMAGLYGNSPNVIYEIANEPNGSVTWNGQIRPYALEVTDTIRSKDPDNLIIVGSGTWSQDIHDAADNQLPDPNTLYALHFYAGTHGQFLRDRIDYAQSRGAAIFVSEWGTSDASGNGGPFLPESQTWIDFLNNRGISWVNWSLSDKSETSAALVAGASKSGGWTEQNLSTSGKFVREQIRAGAGLSGGDTPTMPTEPTNPGNGTTGDIVLQYRNVDNNPSDDAIRMAFNIKNTGSTPIKLSDLQVRYYFHDDGKPGANLFVDWANVGPNNIVTSTGTPAASTDKANRYVLVTFASGGSLQPGAETGEVQVRIHAGDWSNVNETNDYSYGPNITSYTNWDKITVHDKGTLVWGTEP

SEQ ID NO: 725 - DNA, 5561 bp, Clostridium cellulovorans
tctgctcacatgctagcagcagagaatagctggactacctgaaagacaccgatacatccatttcaactcaccagtagtttacctgagatatgctgatgctatgatgtgatgaaagatatgggcagctgcccactgtttaagccaaccagtgaccagctaaatatgaccaagcctttagaccaatgttaaataccaaaatatgaaagtggattttatggtcagatgtaggtacactcgggaaatctggcatatatatgcagcagcaggatgctgatcagaatagcagtctgcgaatattaagaatcgtataatagatgaagctcaagatatcgtagcattctctagaaatgatgggtataacagttctactcccttctatttttatttttgggggtggaaaggttagaagaaccacaatgctgtagtttttgccgaggccatataaatttctccttattccagaattctttagagatatgcaaaagaacatgttaactattgcttagggtaaaaatctcattaggtaaatgttttattacaggttacggtactgatggtgtagagactccgacatcatcagaccatcaatggcacaggggaaagcaatacctggtatgattgttgtgtggaccaaataaatatttacaagatccaacagcaaaaattagtttagtaggggaagcaccagctagatgttatattgatgattcagaaagttattcttgtaatgaagtagatattaactggaattcaccacttatttgtgctatgtctgaattagatatgaggtagaaacggtaaatatataagttctgataatgttactacattaacttaatatgtggcatataaagttaatgtagttttctatcggagaatctatatcgtatcttgctttttttacaaatagactttgaaattacggaattatttggatttattatagtatagttaactttagttctattaaataagtataattacaatttttataataaagttattgcaatatcatagaaaatggtgtaatattacagtatgaacacgtgtttacgctgtgtaaaattcgtatattgtgaaaacatatacataaaatccatatataagtcgtattaactcataaaaacattgagagtggctatttttatttagtagaaaatagcctaaatcacccatatatatacatatagcttcagttttggaacttatatgttatctatagtattaagtatatttacaatttgttaacacgcgtttacagagataaataaagcaattattaaaaaaaaggggaatagtgatatgaaaaagagattattaacagcgttgattgctgcagtagtatttactggaagttatgctagtttttcaacgggaataaaagctggcgaattaagtggcactacagttattaattgtaactttgatactaacatgaaaggatggagctatttcacagctagcggcggtgacggagaagtaactttagctgatggagctcttaaagctcaagttaatgagtgcggagaagtatcatatggtgtgcaggcttattatgatggttttaagatgtacaaaaatggtacatatcgtttagagtttgatataagctctaccactgatagaatagttgattatagaattcaacttaacggtggagattatcgtgcttatgttgatggacaaataaatacaacaagcgcagttcaaagtatatcaaaagagtttgttatgacagaggaaaatgacgtggctccaagacttgcatttaaccttggaagtataactggagaagcacttccagctcactctgttaaaattgataatgttaaattagttcttgttgatgatactggagttgttgggatagaaaaaccaaaggtagaacaaaaaatcgttttaaatcaacttgggtataagccaaatgataagaagaaggtagtatttagagcagaaactacagatagaaactttaaggtagtttctactgctacaaatgaagttgtttatacaggtaacatcgaagggtgtagatacaatgaagcagctggtgaaataaatagatttggagatttttcttcttttacaacaccaggaacttataagattcaaacagatagcttaggaagttcatatgattttactatatcagaagatatttataataatgtatttaaggatgctgtgagatttttctatatgcaaagatgtggacaagagcttccagcaatatacgctggtaaatgggcacatcctgcttgtcatacagagcttgctagaatctatggaacagataaaaaaattgacgtatctggaggttggcatgatgctggtgactatggccgttatgtagttgctacttcaaaagctgttgctgacttattatcagcatataatgataataaagctgcctttggagatgattttaatatacctgaaagtggaaatggagtttccgatgttttagatgaagtaaaatatcaattacagtggttattaaaaatgcaagagccaacaagtggtggagtttatcataaggtaacttgtgctggattccctggacacattatgccacaatttgaaaaagatgcacttatagtatcacctatttctacaactgcaacagcagattttgcagcagttatggcaatgggctatgaaaactttaaggatatagatgcagaacttgctcaaaaatgtttagcagcaggagaattagcttggagctaccttgaaaaaacaccaactattccgtttacaaatccaaaaggtatttcaacaggagaatatggtgacggttatgatggtgatgaaagatattgggcagccgctgaattgcttaaggctacaggtaatagtaaatacgatgatgcctttaagaaaatgcttaacttaaaatttgaaaatggttatggttgggctagcgtaggtcattatggaaacaaagcatatttaacagcaaaagctgctgaccaaaatgtagctggtaacattagaaaccacgttttaaacgaagcacaacaaatagtgtctttagctaaaaatgatgggtataacatttccaatggaacaaattactattggggcagcaatatgaatgtaactaataatgctatattactagcagaagcatataagcttagtcctaatccagaatatttagaatatgctaaagaacatatcaattattgctttggtaaaaactcattaggattctcctttgtttcaggttatggaacagattacttaaaaaatccacaccacagaccatctattgctcaaaaagcagcaataccaggtatgcttgctggtggaccaaatgacaatttggaagatccatatgcacaaggtatcctagaaggtcaagcgcctgctagatgctatgttgaccatgcagaaagttactcaacaaatgaagtagatatttattggaattcaccatttgtttatgcaatggctgcattaaatatgaaataaataccgttagttagttttgatgaaagtatagtgtttttgatttcaaataaggcttaattaataacatagaagatcccttaataacatagaatatcccttaataataagaaatatcctttaataactttatagagctataaattaaaaacttataaaatgtaataaaaatacttttgtcaaatacataacaaaatatttctacctagaaactaattctaggtagattttttttgtgtaataatcggttaaagccttgtaattaggcctttgggaaaaatattaaggtgtttttaagataagcttggtataaataatggagttttatttatggagtgatgggtttatgatgaaaattttattggttgaagataataaggagattagtgataatgtagctaactatctagagaaagtcatggaagtgcaacctgtttatagcggtggtgaagctattgaatatttgaaaacttataactatgatgttgtaatactagatctcatgctgccagaaatagatgggatgactattctaagttacatttccaaaagggctttaaatacaggggttattgttcttactgcaaaagaaggtcttggtgataagctaaaagcctttaatttaggtgcaaatgattatctaactaagccattttttcttgaggagctaaaggctagaattattgcaattttaaaaagcatgggtaagataaaaaaagaaaatctaattgagtttatggatatacagattgatattaaaacaaaaactgcttatataggtgatgaaaaactagatatcaatgagaagtcatataagctactagaatatttagtcattaacaaaggggttttactatttaaagaacaaatttttgataatgtatgtggctatggaagtgatgcatccactgaaataatagaggtatatataagtcgtttaagaaagcagttagctccatttaattatgataaatacataagtaaataagagaggaatgggggtatatgctagatgctagcgtagataaaaaataatgaaaaagaaagatattttttattacacaaaaagaaaaataatagctataagcgtatcaatagttttttgtttgtcttttaatctttgcagtaataacgcaaattctaatatcaatcaaaagtttttaatgatattgataaacagcttattcgtcaagaacatataattttaacgatgcctcctgttgtgtttaatggaaacatgcctaggtttgcagatgaactttttttcagaaacccaatgccaatagttcaagagtttattgttgttgtatatggagaagaaaccgtgcaatttataagccctaatccatattttaatggagaaaattttccgtacattcttaatgcatcagagggtgaaatacaaaaaataagatataaggatcatgattttagaggtattagatttaagcttaatggatatgatattgaaatctttaaaaacgttgattcggaattacagtcaataaatcaactacgtaattctataaccattggattgatatcattgattgtaattgcagtattgctttctgctatattagcttctaggattctaaagcctgtaagagaaaattatgataaacaagttttctttgtgcaagatgcttctcatgaaatgcgaacacctttagctgttattaaaggaaaattagaaatattagcaaactcttgggacgttaatattgatagcaattttgaacacatttccaaaattatgagtgaagtagtaggtcttgagaaattgaacaataatctattgttactaacaaaagaaaatatagacttgaatattagtgtaacaaaggtcagcttgagcacctttattgaaggtataggtgacttttactgcgacttagctgagctacaaaacaaagaatttcaagtgataaagcccagaagaagaaattattcttcaatgggattatgataaggtgaaacagataatggtgattttacttgaaaatgcttttaaatatacaagggacgatgggaaaatatttgttaagttttaaagatgaagggaaattacattaggacaagttttt

SEQ ID NO: 726 - protein, 724 aa, Clostridium cellulovorans
MKKRLLTALIAAVVFTGSYASFSTGIKAGELSGTTVINCNFDTNMKGWSYFTASGGDGEVTLADGALKAQVNECGEVSYGVQAYYDGFKMYKNGTYRLEFDISSTTDRIVDYRIQLNGGDYRAYVDGQINTTSAVQSISKEFVMTEENDVAPRLAFNLGSITGEALPAHSVKIDNVKLVLVDDTGVVGIEKPKVEQKIVLNQLGYKPNDKKKVVFRAETTDRNFKVVSTATNEVVYTGNIEGCRYNEAAGEINRFGDFSSFTTPGTYKIQTDSLGSSYDFTISEDIYNNVFKDAVRFFYMQRCGQELPAIYAGKWAHPACHTELARIYGTDKKIDVSGGWHDAGDYGRYVVATSKAVADLLSAYNDNKAAFGDDFNIPESGNGVSDVLDEVKYQLQWLLKMQEPTSGGVYHKVTCAGFPGHIMPQFEKDALIVSPISTTATADFAAVMAMGYENFKDIDAELAQKCLAAGELAWSYLEKTPTIPFTNPKGISTGEYGDGYDGDERYWAAAELLKATGNSKYDDAFKKMLNLKFENGYGWASVGHYGNKAYLTAKAADQNVAGNIRNHVLNEAQQIVSLAKNDGYNISNGTNYYWGSNMNVTNNAILLAEAYKLSPNPEYLEYAKEHINYCFGKNSLGFSFVSGYGTDYLKNPHHRPSIAQKAAIPGMLAGGPNDNLEDPYAQGILEGQAPARCYVDHAESYSTNEVDIYWNSPFVYAMAALNMK

SEQ ID NO: 727 - protein, 223 aa, Clostridium cellulovorans
MEFYLWSDGFMMKILLVEDNKEISDNVANYLEKVMEVQPVYSGGEAIEYLKTYNYDVVILDLMLPEIDGMTILSYISKRALNTGVIVLTAKEGLGDKLKAFNLGANDYLTKPFFLEELKARIIAILKSMGKIKKENLIEFMDIQIDIKTKTAYIGDEKLDINEKSYKLLEYLVINKGVLLFKEQIFDNVCGYGSDASTEIIEVYISRLRKQLAPFNYDKYISK

SEQ ID NO: 728 - protein, 252 aa, Clostridium cellulovorans
MPPVVFNGNMPRFADELFFRNPMPIVQEFIVVVYGEETVQFISPNPYFNGENFPYILNASEGEIQKIRYKDHDFRGIRFKLNGYDIEIFKNVDSELQSINQLRNSITIGLISLIVIAVLLSAILASRILKPVRENYDKQVFFVQDASHEMRTPLAVIKGKLEILANSWDVNIDSNFEHISKIMSEVVGLEKLNNNLLLLTKENIDLNISVTKVSLSTFIEGIGDFYCDLAELQNKEFQVIKPRRRNYSSMGL

SEQ ID NO: 729 - DNA, 2535 bp, Ruminococcus albus
ctgcagtatccctgtaagtgccagctcttcgcttcgatatcgtctgcaagtattatcctgcccatttatgtatgcccccttttttacttatatcatatatcatcataccataacggcggatatttttcaacacctgtctcacctcatttctttgttgttcttgtacatatcccgtatacgagcattgtacaaacaaatgattttaaatttaactcggacatatttctgcaaaagttgtacaaaaacgtacaacttttggcagtttttcgctgtatatagaagggtataaaaactccggcaccccaagtgccgtttacatatatagatttctgtgcgcacgatggcaggctgacgctgactatgactacgaggatatgaagcgacgtgttatactgtacagaggtcatcagcagcttgacaacagaataataatatctccggtccaaatgaatttttatgatcaggcaaactcccatgacccgataccgtgtaaatattatcgcagatagtatcaaaaagatgtctgtgattttgaataaaattatctgccgcttattgaaaaaaataacactttgtggtataatcatatatattacatttttatgaaaggagctttttatgaaagcatattttaaaaagatacttagccttgtaacggcaggcattataactgcctccgcactgccttttgtaagtgcacaggctaaggacgtatcctccatgaccgctgtggagatagctaaagatatgggtcttggctggaacctcggcaatacacttgaagcccatgacggtactaaccacaaaaagatgggtcttgaatccgagaccttctggggcaatcccaaagcttcaaaggcactttttgatgccgttaaggcaaagggtttcaggactatacgtatacccgtcacctggtatccccatgcagatgcaaattacaatatcgacaccgcatggatgaacagagtaaaacaggtagtcgattgggctgtggatgagaatacatacgttatactcaatatccatcacgaggaatggaacacccccaccaatgccaactacgcagctgcttcaaaggagctgaaagctttctggaaacagatagccaccgagttcagggattatgaccgtcaccttatatttgagggcatgaacgagccccgtaattacggaggtgcacatgagtgggacggcggtaccgatgatatgcgcaaggtgataaacaagcttgataaggatttcgtggataccgtaagatcaacgggcggaaaaaacaagacacgctgcctgatgatacctacctatgccgcaagctccactaccgttgcgatgcgtgcactcagcatacccgatgaccctaatgtcatggtatccatacacgcctattcaccttataatttcacaatgaatacaggcagcggtgccacaagtgtattcggcagcgctcaggaaaatgagctcaaacagctgttcaataatatcaacagtatcttcctctccaatggcaaggctgttgttataggtgagttcagttcttcaaacaagaacaataccgatgagcgcgtcaagtgggctaaaagctatgcaacgcttgcaaagcagaagggtataccgatagtgctctgggataataactctcccaaggataattacaataacggtgaaggtcatggttatataaacagaaagaccctcgcgtggtacagcaccgctgaacctgttgtagattctctggtcaagaattattacggcagttctgtttcaaagaccgacctcagcaaatgcaaggctgtcctttcacagactaagtacttctatgacggcactcagcataagccctcagtcactgttacctacaacggcaagaccctgacaaacggtaccgattataccgcagcttacagcggcggtaaagctataggtacgggtactgtcaccttgacgggcaagggcagctataccggcactgtaaagctgacattcacagtcgctgaaaagaccataggtgattgcaagataactctttcgcagaattcatatacatatgacggcaatgaacacaagcctgccgttacagtcacctttgagggcaaaaggctcaatgagggcagcgattacactatcgcatacgaaaactgcaggaatataggtgatgcatacgtcacagttaccggtacaggctcattcaagggctcatctaaagtcagatactgtattgatcctgccgatctttcgggctacaagcttggtgatgtcaacttcgacagtaagataactgttaccgatgtcacactgacctcagcacaggtaaaagctaagatattcatgtcggaaagccgccgcagagcagcagatatcaacggggacggcagggtgaatgtttcggatctatcccttatggcagcccatgtaaagtccaaaaagagccttcccgacaagaatatagcttgatagatgatcctgtcagataaagcataacttgctttacggtctgatacagctttttctactattcacggacgaacgaattgt

SEQ ID NO: 730 - protein, 611 aa, Ruminococcus albus
MKAYFKKILSLVTAGIITASALPFVSAQAKDVSSMTAVEIAKDMGLGWNLGNTLEAHDGTNHKKMGLESETFWGNPKASKALFDAVKAKGFRTIRIPVTWYPHADANYNIDTAWMNRVKQVVDWAVDENTYVILNIHHEEWNTPTNANYAAASKELKAFWKQIATEFRDYDRHLIFEGMNEPRNYGGAHEWDGGTDDMRKVINKLDKDFVDTVRSTGGKNKTRCLMIPTYAASSTTVAMRALSIPDDPNVMVSIHAYSPYNFTMNTGSGATSVFGSAQENELKQLFNNINSIFLSNGKAVVIGEFSSSNKNNTDERVKWAKSYATLAKQKGIPIVLWDNNSPKDNYNNGEGHGYINRKTLAWYSTAEPVVDSLVKNYYGSSVSKTDLSKCKAVLSQTKYFYDGTQHKPSVTVTYNGKTLTNGTDYTAAYSGGKAIGTGTVTLTGKGSYTGTVKLTFTVAEKTIGDCKITLSQNSYTYDGNEHKPAVTVTFEGKRLNEGSDYTIAYENCRNIGDAYVTVTGTGSFKGSSKVRYCIDPADLSGYKLGDVNFDSKITVTDVTLTSAQVKAKIFMSESRRRAADINGDGRVNVSDLSLMAAHVKSKKSLPDKNIA

SEQ ID NO: 731 - DNA, 1788 bp, Ruminococcus albus
ctgcagtatattatgaactcccccatcattgaacgaaatgatatatcattagtttctgaaagctgttccagaacataattcaggtattccttgcttgaagacattacctcatccctcccgttttttatctgaatgtcaattaatatctgttatacgattataccataaaagaaaataataagcaactgtccatggtcatattaaatttatattttttgtagaaaaaatccatattattactttataattaaaatggaaatatataggataatgtagcattaggcactcaaaaggagctgatactatgttggataaacttaaagtaataaatggaaaactgacagccggtgagaaaccagtaagacttttcgggttatcaactcacggtatagcctggtatccggaatatatttgtgaagaatcattcaatgccctaaaaaaagactggcgtacaaactgtataaggatagcaatgtacacagacgaattcagagggtactgcaaggacggcaacaaacagcatctgaaagagctgatcgagaaaggcgttgttattgcagaaaaactggatatgtatgtaatagtagactggcacgttctgtgtgatcaggatccgatgaaatatattgatgaagctgaagagtttttcagtgatatgtcaaagaggttcgccaataaaacaaacgttatatacgagatatgtaacgaacctaactgcagcggcacatgggataaaataacagaatatgcagacaggataatcccgataatccgcagtaactcccccgatgcacttattgtcacaggaacatcaacgtggtcgcaggacatacactgtgcgcttgaaaagccgctgaaatgggacaatgttatgtactctctgcatttctatgctgctacacacaagggtacactgcgcagcagactggaacgatgtattgaagccgggcttccggtttttatcaatgaattcaatctgtgtgaagctagcggtaagggcgatatcgatatagatgaagcaaatgcatggtatgaggtaatagacagactcgggctgagctgcataagctggtgcctttcaaacagtggagatacctgcggcgtttttacccaaaattgtacaaagctttcaggctggacggatgaagatataaaaacatcgggcaaaataataaaaggctggtttgaggcatttgcagatgaggagaatacaaatgaacaatgttttcgaattgataaatgagcgtaaaagcgtcaggacctttgacggcagtgaaataacaccttcagtgcgagaagatatactcagttacgcacatagtataaaaaccccgtacgaacaggatatagagatacgtattctggataatggtgtacatggtctgtcaagccctgttattgttggtactgacacttatatcggcggaaagatgaagcgtgctgatcatgcagaggaagctttcggttactattttgaacagcttgtgctctacatccaatcactggggctgggtactacatggataggcggcactatggacagaaaagcatttgaggatgctatggagattgcagacggagaggtaatgccctgcgttactcctataggtacccctgcggataaacgctcactcagagagataatgatgcgcaaaggcatcaaagctgacagtcgtaaaaattttgaggagctcttttttgacggaagtgccggcacaccactcagtgaaggcagatatcccgaactcaccgagatactggaagcagtaaggcttgcaccctcagctg

SEQ ID NO: 732 - protein, 312 aa, Ruminococcus albus
MLDKLKVINGKLTAGEKPVRLFGLSTHGIAWYPEYICEESFNALKKDWRTNCIRIAMYTDEFRGYCKDGNKQHLKELIEKGVVIAEKLDMYVIVDWHVLCDQDPMKYIDEAEEFFSDMSKRFANKTNVIYEICNEPNCSGTWDKITEYADRIIPIIRSNSPDALIVTGTSTWSQDIHCALEKPLKWDNVMYSLHFYAATHKGTLRSRLERCIEAGLPVFINEFNLCEASGKGDIDIDEANAWYEVIDRLGLSCISWCLSNSGDTCGVFTQNCTKLSGWTDEDIKTSGKIIKGWFEAFADEENTNEQCFRIDK

SEQ ID NO: 733 - DNA, 3942 bp, Myxococcus xanthus
ggtgcggccaacgcggcgggcaaggcggcgggcggtatcgcgggcgcgctgggcggtatcggcaaggcgctgggcggcatcggcaaggcggtaggcggcctggcgaacagcatcggcggcatcgccggcaagattggcagcgcgctgagccaggtatccggcctcgtcgacaaggcgatgagcgccatcaccggccccctcaagagcatgattggcggcctgctggacaagatgcccttcggcatcggccagctcgccaagccgttcgtcgacaagttcatcgacaacgggctggccatggtcgccggcggtccgctgggtggcgttgcctcgatgttcggcaaggccggcaccgtgggcaagctggcggacatggtggagacggtccgcacgggcgcgaagacggtgggcgacatcgccgagggccgcttcaacgcccagcagatggcggccttcgcccaggcccagctgatgcgcggcctgtaatcccgaatcgacgggtgaagcccccagggccagctcccacgcacgtgggggttggcccttcgttcgtttccgagtccgtgtgcgcccgcacgctgagtgaccacccggggcgcgaggccgcttgttgctggcgacccccgcccgcagccgttaaggagggcctctcccgcgtcggcgtcttcatgcgaaccactcatcgtcccctcaccaccttggccctggccttgagcctcttcatggccgccttggaagccactgtcgtttccacggccatgcccacggtggtgggcgagttgggcggcatccagcactacgcgtgggtcttcaccgcgtacatgttgtcctccaccatcaccgtgcccatctacgggaagctggcggacctctacggccgcaagcccgtgctcgtgttcggcatcgtgctgttcctcgtgggctccatcgccagtggcctgtccacgtccatggccatgttgatcggcttccggacgctccagggcctgggcgcgggcgccatgcagccggtggcgctcaccgtcatcggggacatctacacgctggaggagcgcgcgaaggtccagggcgcgttcagcgcggtgtggggcatcgcgggactgatcgggcccatcaccggtggcttcctcgtgaagtacctcacgtggcactgggtcttcttcatcaacgtcccggtgggcgtgggctgcctcgtcctgctcctgagctacttccatgagcgcgtggagcggaagccccagaagctggactacgcgggcgccgcgctgctcaccggctgggtggtggcgctgctcgtcggcgtgcaaggtgtgggcgtgaatctgtggggcttgcccgtggcggccgtgctgctcgtcggcgtgcaaggtgtgggcgtgaatctgtggggcttgcccgtggcggccgtgctgctcgcggccttcgtcgcggtggagcgcaaggtggccgagcccatcatccccatgtccatcttcaaggtgccggccatcgtcatctcctccatcgcgggagcgctcttctccgcggcgatgttcggggccaccacctacgttccgctcttcgtccagggcgtcctgggcggaacgcccaccgaggccggcgggatgattacgccgatgattgtcggctggccgctggcggccttcgtggccgggaagctgctgctcaagacgggcttcccccccttcatcgtggacgggctgggattgacggtggtggacacgtcgctgatggcgctgctcctgggggcccaggcgcccaggctgctgccggaggtggccatgggcctgttcggcatcggcatgggcttcgcgtccaccgcgctgctcatcgccgtgcagaccagcgtgggctgggagctgcgcggagtggccaccgccagcaacatgttcttccgcaccatcggcggcgccattggcgtggggctgatgggcggcgtcatggtgtcgcagctcctcaaggacccgacggtgccgatttcggcggccaacgccttgatgagccccgaccacggccaggacttgcccgcggatctgctggcgacgctgagcggcgcgctgggcaccgggctgagcatcaacttctggctgatctgcgccttcaccgtggccgccttcgccgcagggctgttcttccccaaggtgtcgcgcaccacgacggtgtcctccaccgaggtggtggcgccgcactgacgtccgtgcggcgccccgtgcgtcgctcagaggccgtcaatcatccgcagggccacgtccggcacgaacgtgctgcgggtgtgttgggcgcgacgccgcactggccatcggagtccccggggaccttgatccacacggtcatctccgcgccgcccacgcccacctggttcgtcgtgccaatcttccggccggcggggttgcaccactcaccgttggagccattgccgttacggctggtgtccaccacgaagggcttggtgtagccgtaccggctgctcagcgagctgttgacggagcccgcgtacgaggccgactgcgcggtggtgtagaagttcgacacgttgagcgcgaagccacgcacgttgcgcacgcccatgttctccagccgctgggccatggtgtccgcgttgatccacaaggcgttgcccgcgtccaggtaggcccacgtgttcggcgcgcgatcccggaactgctcggtggcgtagcgaatgaggctgatgcgcgtctgacgctcggcgtcgttcgccaggcagtcgagctgggcgacggcgtccggctcgatgatgacgacggcgggacggttgccaatggcggcggcgaaggacgaaatccacgtccggtacgcctctggcgaccccgcgcctccgcccgagtggcttccgcagtcccggccagggatgttgtacgccaccagcaccggcagcttgtccgccgcgtccgcggccgagacgaagctggacaccgccgtggtgatgtctccgctccaagcggcgaaccaacgtgcggccaggttgttcgcgacggaggactggatgcgcgcagcgcgcgagtccccgctgttggcccggacccagttggcggggttggagttcgggtcgatgtagaagccgttcgtcatcgacagcggcccgccgcctccgccgccgtcctccgtggtgagcgagatgtcatcgatgaacgcgctgaaccccgtcgcgcggcctcccatctggaaggtgacctgtcctgcctgcgtggccagcgtcgacgtgaaggggaacgtgaagcgccgtgacgtgccgtccaacgtaatctgccggtccagcggcgcggtgtacggcgcgctctccaactgcaccgtcacacggaccgtcgtcgacactgaagcagaagcggtgaaggacagcgtgtacgcccggccattcaccagcggaatgtcatcctggccaatcagcgcgtcccaggggttggccgtcccgccccccacatccacgcgcaggcgggcgttctccacgcgggactgcgtattggggccgctccaccagggcgacacggtgccgccgttgaaggtgccattggagacgagctcggtcagcgcgtcggtgcgactgccgagcgcctcggcctccgccggggcgggtggctccgagggaccacaggcagtcgtgagggccgccgcgagcatcagcgcggccggagcggtgaagcgacgaaacggcgaaccggcggagttactgggttgcacgaagccattcctcccgcccgcgcgaggacgccagggagcggcgcccggagtgacgcgggctgtgtcgagtgcgtggcccgtgggtggccccgcgagcacgcgggccaacttacacggtttactcgtttttcagcccttcaatccaccgcggctcaccgaagtgcgcgcagatgaacaggcgggagcgggtactcggaggcctgctccaccacccggcccaggcgcacgagcaggtgctcctcatag

SEQ ID NO: 734 - protein, 507 aa, Myxococcus xanthus
MRTTHRPLTTLALALSLFMAALEATVVSTAMPTVVGELGGIQHYAWVFTAYMLSSTITVPIYGKLADLYGRKPVLVFGIVLFLVGSIASGLSTSMAMLIGFRTLQGLGAGAMQPVALTVIGDIYTLEERAKVQGAFSAVWGIAGLIGPITGGFLVKYLTWHWVFFINVPVGVGCLVLLLSYFHERVERKPQKLDYAGAALLTGWVVALLVGVQGVGVNLWGLPVAAVLLVGVQGVGVNLWGLPVAAVLLAAFVAVERKVAEPIIPMSIFKVPAIVISSIAGALFSAAMFGATTYVPLFVQGVLGGTPTEAGGMITPMIVGWPLAAFVAGKLLLKTGFPPFIVDGLGLTVVDTSLMALLLGAQAPRLLPEVAMGLFGIGMGFASTALLIAVQTSVGWELRGVATASNMFFRTIGGAIGVGLMGGVMVSQLLKDPTVPISAANALMSPDHGQDLPADLLATLSGALGTGLSINFWLICAFTVAAFAAGLFFPKVSRTTTVSSTEVVAPH

SEQ ID NO: 735 - protein, 487 aa, Myxococcus xanthus
MQPSNSAGSPFRRFTAPAALMLAAALTTACGPSEPPAPAEAEALGSRTDALTELVSNGTFNGGTVSPWWSGPNTQSRVENARLRVDVGGGTANPWDALIGQDDIPLVNGRAYTLSFTASASVSTTVRVTVQLESAPYTAPLDRQITLDGTSRRFTFPFTSTLATQAGQVTFQMGGRATGFSAFIDDISLTTEDGGGGGGPLSMTNGFYIDPNSNPANWVRANSGDSRAARIQSSVANNLAARWFAAWSGDITTAVSSFVSAADAADKLPVLVAYNIPGRDCGSHSGGGAGSPEAYRTWISSFAAAIGNRPAVVIIEPDAVAQLDCLANDAERQTRISLIRYATEQFRDRAPNTWAYLDAGNALWINADTMAQRLENMGVRNVRGFALNVSNFYTTAQSASYAGSVNSSLSSRYGYTKPFVVDTSRNGNGSNGEWCNPAGRKIGTTNQVGVGGAEMTVWIKVPGDSDGQCGVAPNTPAARSCRTWPCG

SEQ ID NO: 736 - DNA, 1867 bp, Bacillus sp. BP-23
tccaatcccaggaccgtctcgtgcgagaagcactggagcagcctttgcctgagcaggtagatgaggttcacatcccagtctatttgctgatgggtcagtatgattacatgactacattgaaagaggcggacgtttacttaaacaagctgaaagctcccaagaaagagctgattgtttttcatcattctgcgcattatccgcaattcgaagagaatgatagatttaccgcctggctgtatgaatatttcggatcgagttaaaaaaaggtgtagtaacatgtcaaaatagacaaaaatatgaactttattttccataaatgtgttattatgttgttagcggaccgctttttcgcttatggattgatatccattgagaagggaggattacatctccatttacatgctgaacagaggtttagaggtttcgttagactagaggcaacggcactgcttgttaaccaataaaataagcggaggttaggttatgacgaaaacgtttaaaaaatttagtatcgccggtttagcactgctcttcatggctacagcggcattcgctggctggagcaccaaggcatcggctgcggatatgagatcgttaacggctgctcagattacagcggagatgggcgcaggctggaatctgggcaatcagcttgaagcgacggtaaatggaacaccgaatgaaacgtcatggggcaatcctacaattacacctgaactgatcaaaaaagtaaaagcggcaggcttcaaaacgattcgtattcccgtttcttatctcaattatattggaagcgctcccaactacactgtgaatgcgtcatggcttaatcgtatccagcaggtcgtagattacgcttataatgaaggactttatgtcgtcattaatatgcatggcgacggattccactcgattccaggttcgtggctgcatgtgaacagtagtaatcagaacgtaattcgggacaagtatcaaaaggtatggcaacaagttgctaccaggttcagcgcgtataatgaacgtctcattttcgagtccatgaatgaggtgtttgacggcaattataacaacccgaatacatcatattatggcaacttgaatgcatataatcagatttttgtagataccgttcggaagacggggggcaacaacaatgccagatggctgctcgttccaggctggaacacgaacattgattacacggtagggaattatggctttgtcgttccaacggataatttccgttcctctgccattcctagctcgcagaaacgcatcatgatctcggcgcactactattcgccgtgggattttgccggtgaagaaaatggaaacattacgcaatggggtgcaacagcgaccaatcctgccaaacggtcaacatgggggcaggaggattatctggattcccagttcaaatctatgtacgacaagtttgtaacgcagggctaccctgttgtgatgggagagttcggttctattgataagtcttcctatgactccagcaataataactatcgtgccgtgtatgccaaggcggttacggctacagccaaaaagtacaagctggttcctgtttattgggacaatggctttaacggacagcatggatttgccctgtttaaccgatttaacaatacggtaactcagcaaaatattattaatgccatcatgcagggcatgcagtaattacattcatttcattggataaaaaagggcgtactccagaataagaggagtgcgtcctttcaatgtcttctaaaccgtcaagtaatgcttgtcatcgcatacccgtaaacgatagaagaacggtcgagacattcaactttgatcacatttctgtctatggattttacataagccttgagca

SEQ ID NO: 737 - protein, 400 aa, Bacillus sp. BP-23
MTKTFKKFSIAGLALLFMATAAFAGWSTKASAADMRSLTAAQITAEMGAGWNLGNQLEATVNGTPNETSWGNPTITPELIKKVKAAGFKTIRIPVSYLNYIGSAPNYTVNASWLNRIQQVVDYAYNEGLYVVINMHGDGFHSIPGSWLHVNSSNQNVIRDKYQKVWQQVATRFSAYNERLIFESMNEVFDGNYNNPNTSYYGNLNAYNQIFVDTVRKTGGNNNARWLLVPGWNTNIDYTVGNYGFVVPTDNFRSSAIPSSQKRIMISAHYYSPWDFAGEENGNITQWGATATNPAKRSTWGQEDYLDSQFKSMYDKFVTQGYPVVMGEFGSIDKSSYDSSNNNYRAVYAKAVTATAKKYKLVPVYWDNGFNGQHGFALFNRFNNTVTQQNIINAIMQGMQ

SEQ ID NO: 738 - DNA, 2800 bp, Ruminococcus flavefaciens
aacatttatgccctatttaccgcgatttgactatacatatatactaaatacttcgccataaattctatgcttcttttgttgcattttgcacaaaccgtcttgactttattctgtaattatgctaaactttagttgtaaaagaacttcagagtcttctgcactggactctgaaaaataacaatattattatatcagggaggaatattatgttcatcaattcaaagacagtgaagcgctttgtgagcatctccgcagcagcggtatgtctgttctcattcgctccgctcgacgataccgccgacgcagcagacaacataatgacagcattccagatcacagaaaacatgaaagtaggctggaatctcggtaatactcttgatgcttacgctcagaaggctaatcccaaagacccctcaaagcctatcccgctggacagcgccggtcttgagacagagacctgctggggctgccccgaggcaagtcaggagctcttcgacgccatcaaggcaaagggcttcaacacagtccgcatacctacaacatggttccagcacctcgacgaaaacgacaacattgatcccgcctggatggcaagagttcatcaggtggttgattacgcatacaacatcggtctgtatgttatcatcaacctccaccacgaacagaactggatcaacagagccgatcttgccacagcttatgacgatatcaaccccagactcatgaagctctggactcagatagcaacagaattcaaggattacgatcagcacctcatcttcgagtgcatgaacgagccccgtgcaatggacacaccctgggaatggtggtctgcaacacctgtcgaggaagcagacgttatcaacagactggaagccaacttcgtagagctcatcagaggtatggacggtccctacgcaaagaccagacttcttatgctccctggctatgttgcaagctcggacaagaccttcctcaatcagatcgttcttcccgagaatgacgacttcattgcggtttccatccacgcttatactccttacaacttcacaatgaacacaaagacagaggagggtgcttaccacgacaccttcacaaaggagttcagcaacgatcttgcttacaacctccagaacttccgcgatatgttcatcaataaggacattcccgtagtaatcggcgaaatgggtacttccgacttcggaaacacacaggctcgtgttgagtggaccactcagtacttcgagacaacgaagaaatacggatacccctgcgttctctgggacaacggacagaaaaaggatcccagcggtcccaatcagaaccccggtgaggtacacggctatatcgaccgtaaaacaggcgaatggtatgaaaacaaccttcctatcatcaacaagatgatggagatcatgaatgatgcctccatcgtatggggcagcgaaggcaagatgcctacctatgatcatcaggatctctcagcaggaacattgctccttgagaattcagatatcgacgttgctctcgcagaaacatacggcgactcaactcccggcaaggagatctcatgggatgacctcaagggcaaggaagttgctatcaagtatacaggcgacactcctgtagttgctgtttcagacgcaaaatacggtaactggacagcaatatctccttacacagttgacgaggaaaacggaatcgcttactaccttgtagacaagcaggttcccagttcttaccccgcagatctttctactcttaaccacatacaggcaaaaactccgggcaagacaactgtcataaagatggttactcttacagctcccgatgtaactgttgagcttcctgttgacaagacaaagaagactcctatcagctttgcaaacgctcaggcaggcgacaaccttatcatcaagatcaagggcgagcccaacacagacacaaacggctgcgtaggcttcaacggcactggctgggagcagatcgagtgggaaggcaagaccgacgcaaacggaaatctcacagttgagatccccgtaagcaagttccccgcaggtctccagtcagctgaggctcagatctggtatcagcccgagctcgtagacttcgacggttacagcttcggtcaggcagaagtaaccacaacaacttctaccacaaccacaacagagacaacaacaaccacaactactacaacagcacctatttcttcgtcgacaacatccacaactacttctactgttccccagaagaagagcacaggaaacggcgacgctaacggcgacggtgttgtagatctggcagacgctatcttcatcatgcagtgtcttgctaaccccaacaagtaccagctctcagatgcaggccgtgtggctgctgacgtttacggtgatgacggagtaacaggtgacgacgctatggctatccagctcctcctcatcaagaagatcagctcccttcccgttccatcaggcacagtactctgatagcttttaagaagtttttcttaaatagacctccgaatgcagctgctttatgcagctgcattttcgttatatgggcattatatacataaccaaacagatgtatagaattataatatattgttaaacttttgtaacctattgacaaaacaatacaacctgttatataattatagcagtatcgctgcaacggatatggtctgtgcagctcattcaagaaacagatatttaacaaaagcaaagaaatatatatgcttttatcagttataaaccactatactcaagaacaaaaggatgacaattgaatatgcttactg

SEQ ID NO: 739 - protein, 759 aa, Ruminococcus flavefaciens
MFINSKTVKRFVSISAAAVCLFSFAPLDDTADAADNIMTAFQITENMKVGWNLGNTLDAYAQKANPKDPSKPIPLDSAGLETETCWGCPEASQELFDAIKAKGFNTVRIPTTWFQHLDENDNIDPAWMARVHQVVDYAYNIGLYVIINLHHEQNWINRADLATAYDDINPRLMKLWTQIATEFKDYDQHLIFECMNEPRAMDTPWEWWSATPVEEADVINRLEANFVELIRGMDGPYAKTRLLMLPGYVASSDKTFLNQIVLPENDDFIAVSIHAYTPYNFTMNTKTEEGAYHDTFTKEFSNDLAYNLQNFRDMFINKDIPVVIGEMGTSDFGNTQARVEWTTQYFETTKKYGYPCVLWDNGQKKDPSGPNQNPGEVHGYIDRKTGEWYENNLPIINKMMEIMNDASIVWGSEGKMPTYDHQDLSAGTLLLENSDIDVALAETYGDSTPGKEISWDDLKGKEVAIKYTGDTPVVAVSDAKYGNWTAISPYTVDEENGIAYYLVDKQVPSSYPADLSTLNHIQAKTPGKTTVIKMVTLTAPDVTVELPVDKTKKTPISFANAQAGDNLIIKIKGEPNTDTNGCVGFNGTGWEQIEWEGKTDANGNLTVEIPVSKFPAGLQSAEAQIWYQPELVDFDGYSFGQAEVTTTTSTTTTTETTTTTTTTTAPISSSTTSTTTSTVPQKKSTGNGDANGDGVVDLADAIFIMQCLANPNKYQLSDAGRVAADVYGDDGVTGDDAMAIQLLLIKKISSLPVPSGTVL

SEQ ID NO: 740 - DNA, 1420 bp, Anaerocellum thermophilum
aaggtatttatccaaaaccaaatataaactactacgttaatccagagcttgagggcaaaaacagtcttgaagtatttgacatagttgtacaaatatgtaaagaagttggtttgaaaattatgttggatattcacagcataaaaacagacgcaatgggacatatctatccagtatggtatggacttgataaatttactccagaggatttttataaggcgtgtgagtggattacaaatagatataaaaatgatgatactattatagcttttgacctaaaaaatgagccacatggaaaaccatggcaagacacaacatttgcaaaatgggataattcaacagatattaataattggaaatatgcggctgaaacatgtgcgaaacgtatactaaatataaatccaaaccttcttattgtaatagaaggaattgaagcgtatccaaaagatgacgttacatggacatcaaaatcctatagcgattactattcaacatggtggggcggtaacttgcgaggtgttaaaaagtatcctattaatctgggtaaatatcaaaataaagtagtatattcacctcatgattacggaccctctgtttaccagcagccgtggttttatccaggcttcacaaaagaatctttactacaagattgttggcgtccgaattgggcttacatcatggaagaaaacattgcgccgctgctgataggtgaatggggtggttatcttgatggagctgataacgaaaagtggatgagatatctacgagattatattatagagaatcatattcatcacacattttggtgctttaatgctaactcaggtgacactggaggtatggttggatacgattttacgacatgggatgaaaaaaaatactcatttttaaagccggctctttggcaagacagtcaaggtaggtttgttggattagatcacaagcgacccttaggtacaaatgggaaaaacattaatattacaatatactacaacaataatgaaccagcgccagttccagccgcaaaatgataaaatacggtaaatgggaatttgtagatatataagaaagatttgaggacagtaaaggactgcaaagttgaagttataaacaagtaaatttaaaaaaaagaaggggtgatctaaaacagatagaaatatatgtaattatattaagtaactattaaacatttatttgtgggaacaaagtatgagtttcgaaatcataacatccaatacgattaattaaaaattaactatcagatcaaaaaagggggttaggattaaaaatgcttaaactaaaaagagcaataaaaatgattacattttgtgttgctatggtatttctattgcaggttttctttctattttcaggatataataacagtgaagtaaaagcagcaacaacctttaactatggtgaa

SEQ ID NO: 741 - protein, 341 aa, Anaerocellum thermophilum
GIYPKPNINYYVNPELEGKNSLEVFDIVVQICKEVGLKIMLDIHSIKTDAMGHIYPVWYGLDKFTPEDFYKACEWITNRYKNDDTIIAFDLKNEPHGKPWQDTTFAKWDNSTDINNWKYAAETCAKRILNINPNLLIVIEGIEAYPKDDVTWTSKSYSDYYSTWWGGNLRGVKKYPINLGKYQNKVVYSPHDYGPSVYQQPWFYPGFTKESLLQDCWRPNWAYIMEENIAPLLIGEWGGYLDGADNEKWMRYLRDYIIENHIHHTFWCFNANSGDTGGMVGYDFTTWDEKKYSFLKPALWQDSQGRFVGLDHKRPLGTNGKNINITIYYNNNEPAPVPAAK

SEQ ID NO: 742 - DNA, 4867 bp, Anaerocellum thermophilum
aagctttcaagtatggtacaccaccgcatggtggtatagcttatggatttgataggctttgcatgctgcttttaggtttagattctatcagagatacaattgccttcccgaaggtaaaagattcgtcatgcccgttgactgatgcaccctctgaggttgaaccaaaacagcttcgagaacttcacatcaaagttgatgttgtaaaataacaaagaaattttcgcggctccgtgtccctaaaatagttaaagatttttggtggggcaggagccttattttttgcaaaatttttaccttatcttagaacaagatgctacaaaaagcaggtcaaaaatttcaaacagatatgaaatttttttaagtttaaaactttctgacatggaatatattaaacttataacgagatgataacgattacataggagggatttgcattatgaggaaaattattttaaagttttgtgcactcatgatggtagtgattttgattgtttccattttacaaatattacctgtatttgcccagagcatactgtatgaaaaggaaaaatatccacatcttcttggcaatcaggtagttaaaaaaccatcggttgccggcagactgcagattattgaaaaggacggaaaaaagtatttagctgaccagaaaggagaaataattcagcttcgtggtatgagtacacatggacttcagtggtatggtgatattataaacaaaaatgcatttaaagctctttcaaaagattgggagtgcaacgttataaggcttgcgatgtatgtgggtgaaggcggatatgcttcaaacccaagtattaaagaaaaagttatagaagggattaagcttgctattgagaatgacatgtatgtaattgttgactggcatgtattaaatcccggtgacccgaacgcagaaatttataaaggggcaaaagactttttcaaagagatagctacaagttttcccaatgactatcacataatatatgaactttgcaatgaaccaaatccaaatgaaccgggagtagaaaatagcttggatggctggaaaaaagtaaaggcttatgcacagcccatcataaaaatgctcagaagtttggggaatcagaacattataattgtaggttcgccaaactggagtcagagacctgactttgcaattcaagaccctataaatgataagaatgttatgtattcagttcatttttactctggaactcacaaagttgatggatatgtttttgaaaacatgaaaaatgcgtttgaaaatggcgtgccaattttcgtgagtgaatggggaacaagtttggcaagcggtgatggtggaccgtatcttgatgaagcagataagtggcttgaatatttaaattcaaactatattagctgggtgaactggtcgctgtcaaacaaaaatgagacatcagctgcttttgttccatatataaatggtatgcatgatgccacaccacttgaccctggtgatgataaggtgtgggacatagaagagcttagtatttctggagagtatgtgagggcaaggataaaaggaattgcttatcagccaattaagagagataacaaaataaaagaaggagaaaatgcacctttaggcgaaaaagtcttaccatccacgtttgaagatgacactcgtcagggctgggattgggatggaccatctggtgtgaaaggtcctattactatcgaaagtgcgaatggttcaaaagcgctatcttttaatgttgagtatccagagaaaaaaccacaagatggctgggcaacagctgcaaggcttatacttaaagacataaatgtagaaaggggaaataataaatatttggcttttgatttttatttgaaaccagatagggcttcaaaaggtatgattcagatgtttttagctttttcaccaccttccttaggttactgggctcaggtacaagacagttttaatattgaccttggcaaaactgtcaagtgcaaaaaagatagaagaacagaagtttataagttcaatgtattttttgacttagacaagatacaagataataaagtactgagtccagacacactcttgagagatataatagtagtcatagcagatggcaatagcgattttaaggggaaaatgtatatagataatgttagatttaccaataccctttttgaggatatcaattttgaaaatagcctttatgatgttatagacaagctttattctaaaggaatcataaaaggaatttcagtatttaagtacttgccagataaaaacattacaagggctgaatttgctgcactttgtgtcagggcactgaacctgaaaattgaaaaatacgatggtagattttctgatgtgaaaagcggcaactggtattcagatgtagtttatacggcgtataaaaacaaattgtttgaaataaaagagaataaattctttcctgaaaatattttaaaaagagaagaagcagtagctttggcaattgaagtgtataaaagattgactggtaagatagaagttaatacagacgatgttccaattgctgatgaaaaacttataaatcctcaatacagagaaagcgtgaagttagcaattaagctcggtattgttgacctgtattcagacggaacatttgaaccaaataagagcgtttcaagaggggaggtggcaacaattctctataatctctgaacttagcaggcaagctatgatacatgaatttgaaaagttttaacaaatgctgctggctaaatgctggcagcttttttatattattttgacccttcaatatgacaaaatattgcacattttaatatcaacatttcacaaaaaaactgcaattttttcaattcattttgaaaaatataggttgtaaactataattgaaaagttcaaagaacaattcaaaagtttcaataaacaacttgagaaaggagacggcatcagaaatggcaaacaatcagcgcacatatcgaagcggttttttgagagaattgaataaaaactttcctctattcttgatggcactgccgggggttgttcttttaatagcattttcttacttacctctgtttgggcttatcatagcatttaaagatgtgcactatgatgtaggaattcttaaaagtccgtgggtgggtttaaagaattttgaatttctttttaaaacacctgatgcgtttattataacaagaaatacacttctttacaactttgcttttatagtctttgggaacttggctgcaattgcaactgctggtgcgttgagcgaaatgagatcaagatttatggcaaaattttaccagtcagtaatgtttttaccatattttttggcttgggttgtggttgcgtatatggcatttgcatttttgagtatagacttagggattttaaatacaatggttcttccaaagttggtttacaaccaattgcatggtattttgaaacaaaacgtggccggtgatattaatacttgcaaatttgtggaaatatactggttacaatgcagtcatatatttagcagcaattacaggaatgatcctgagtattatgaagcagctttgattgatggtgcatcaaaatggcagcagataaaacatattacaattccgcttttgtcaccgcttgttgttgttcttgttcttttgggtataggtagaatattttatgcagactttggacttttttatcagcttcctatgaacagtggtgcactttatgatgttacaaatgttattgacacttatgtttatagaactcttatgggtatgaacgatataggaatggcgtctgctgcaagcttttatcagtcgataatggggtttattttggttcttacatcaaatcttattgttcgaagacttgacccagaaaaagcgttgttttaagaacttttatagacaaacagcaaagaaaggggatgatatagtatgcattcaaaaagcagatttttacagatttctgcattatcagaagccattttacacatcttctttggaattgtaactcttgcatgtttaattccgctgtggtctgttatatcaatttcgcttagtaatgataacaaaattagacaaattggatatagattttggccggttggttttagtacaaaatcatatgattttcgttttatctcagggaagaccaattttgcatgcgtatggtattactattttggttactattgttggaacagtgctatgtgtgttggtagtttcaatgtacgcttatattatattctattcagaaaagattttaaatacagaaaattcttcacattctttggttttttcacaatgttaatcaatgcaggtcttgttccatggtatatagtgtgtgtaaatattcttcacttaaaaaatactatttatgcattaattttaccgtatgtaatgaatatgtggtatgttttaatttttagaacatatctttcgatgtctttacctgattctattatagaatctgcaaagattgatggagcaggggaatttacaacattttttaggattgttataccgcttgtaaaacctggacttgcgacaatagcattattttcagctatcacatattggaatgactggtggctaccattcatgttgatagatactgaaaaactttataatcttcaatatatgatgtatagagttcaacaaaagattcagtatttagcagaaattgcaggaaagcttggagcatcgggtattgttcctaccgacctaccaacagagtctgcgcgaatggcaatggcagtacttggaatggggccaatagttttagcgtatcctttcttccagcgctattttgtaaaaggtcttaccataggtgccattaagggctgatgtgtggttgtattaatgcggctataagctt

SEQ ID NO: 743 - protein, 68 aa, Anaerocellum thermophilum
AFKYGTPPHGGIAYGFDRLCMLLLGLDSIRDTIAFPKVKDSSCPLTDAPSEVEPKQLRELHIKVDVVK

SEQ ID NO: 744 - protein, 749 aa, Anaerocellum thermophilum
MRKIILKFCALMMVVILIVSILQILPVFAQSILYEKEKYPHLLGNQVVKKPSVAGRLQIIEKDGKKYLADQKGEIIQLRGMSTHGLQWYGDIINKNAFKALSKDWECNVIRLAMYVGEGGYASNPSIKEKVIEGIKLAIENDMYVIVDWHVLNPGDPNAEIYKGAKDFFKEIATSFPNDYHIIYELCNEPNPNEPGVENSLDGWKKVKAYAQPIIKMLRSLGNQNIIIVGSPNWSQRPDFAIQDPINDKNVMYSVHFYSGTHKVDGYVFENMKNAFENGVPIFVSEWGTSLASGDGGPYLDEADKWLEYLNSNYISWVNWSLSNKNETSAAFVPYINGMHDATPLDPGDDKVWDIEELSISGEYVRARIKGIAYQPIKRDNKIKEGENAPLGEKVLPSTFEDDTRQGWDWDGPSGVKGPITIESANGSKALSFNVEYPEKKPQDGWATAARLILKDINVERGNNKYLAFDFYLKPDRASKGMIQMFLAFSPPSLGYWAQVQDSFNIDLGKTVKCKKDRRTEVYKFNVFFDLDKIQDNKVLSPDTLLRDIIVVIADGNSDFKGKMYIDNVRFTNTLFEDINFENSLYDVIDKLYSKGIIKGISVFKYLPDKNITRAEFAALCVRALNLKIEKYDGRFSDVKSGNWYSDVVYTAYKNKLFEIKENKFFPENILKREEAVALAIEVYKRLTGKIEVNTDDVPIADEKLINPQYRESVKLAIKLGIVDLYSDGTFEPNKSVSRGEVATILYNL

SEQ ID NO: 745 - protein, 312 aa, Anaerocellum thermophilum
MANNQRTYRSGFLRELNKNFPLFLMALPGVVLLIAFSYLPLFGLIIAFKDVHYDVGILKSPWVGLKNFEFLFKTPDAFIITRNTLLYNFAFIVFGNLAAIATAGALSEMRSRFMAKFYQSVMFLPYFLAWVVVAYMAFAFLSIDLGILNTMVLPKLVYNQLHGILKQNVAGDINTCKFVEIYWLQCSHIFSSNYRNDPEYYEAALIDGASKWQQIKHITIPLLSPLVVVLVLLGIGRIFYADFGLFYQLPMNSGALYDVTNVIDTYVYRTLMGMNDIGMASAASFYQSIMGFILVLTSNLIVRRLDPEKALF

SEQ ID NO: 746 - protein, 303 aa, Anaerocellum thermophilum
MHSKSRFLQISALSEAILHIFFGIVTLACLIPLWSVISISLSNDNKIRQIGYRFWPVGFSTKSYDFRFISGKTNFACVWYYYFGYYCWNSAMCVGSFNVRLYYILFRKDFKYRKFFTFFGFFTMLINAGLVPWYIVCVNILHLKNTIYALILPYVMNMWYVLIFRTYLSMSLPDSIIESAKIDGAGEFTTFFRIVIPLVKPGLATIALFSAITYWNDWWLPFMLIDTEKLYNLQYMMYRVQQKIQYLAEIAGKLGASGIVPTDLPTESARMAMAVLGMGPIVLAYPFFQRYFVKGLTIGAIKG

SEQ ID NO: 747 - DNA, 2059 bp, Pectobacterium carotovorum (Erwinia carotovora)
tgcgtaatgcgttgattaatccgctacatcccgcgttaagcagctacgtctgattgaggcgattccggatttttacagtcataggctgtttaacccggtcggacactaggcctgctatcgacagcaatgaggctggcaggaaccccataatcagtatggtaatgagaaaaattctcaacaaagtgctttacagatgatactgataactattatcatcaatttcgcacttcggcagtagcttctcgcaggcactgaaggagagcacgacattgctcacattgcttccagtattattttagccagccgacgtgctgcttttttttgcctgaaaaatgacctcgccagatacttaccttgctttctattttcctgtaaataattaataaaatcaatatgattgggatatttcctaaattgtttgcgggaacaaaaatctcccttatcatgcctatacccaagatcatgtgggttcacaatggagataaggaatatgtggatgagaaggaatcaaatcgtcaggaaattgacgttaggtgtggtaacaacggtgctggggatgtcactcagtttttcagcattatccgccacgccagtagaaacgcatggtcagctgtccatcgaaaatggacgactggtggatgaacaggggaaaagggtgcaactgagagggatcagttcgcacgggttgcagtggtttggtgactatgtcaataaagattcgatgaagtggctgcgtgatgactgggggattaacgtattccgcgtcgccatgtacacggcggcggatggctatatttccaacccctccctcgccaataaggtaaaagaggccgttgcggcggcgcaaagcctcggtgtttacatcatcatcgactggcatatcttgtcggataacgatcccaatatttataaagcacaggcaaaaaccttctttgccgaaatggctgggctgtatggcagttcgccgaacgtgatttatgaaatcgccaatgagccaaacggtggcgtgacatggaacgggcagattcggccttatgcgctggaagtgactgacaccatccgtagcaaagatcccgataacctcatcatcgtcggtacgggcacctggagtcaggatatccacgacgcagcggataatcagctgcccgatccgaatacgatgtacgcgctgcatttctatgcgggtacgcacgggcagttcctgcgcgaccgcattgattatgcacaaagtcgcggcgcggcgattttcgtcagcgaatggggcaccagcgatgcgtccggcaacggcggaccgttcctgccagaatcgcagacctggatcgatttcctgaataaccgtggcgtaagctgggtgaactggtcgcttaccgataagtcagaggcgtctgccgcgctggcaccgggggcgagcaaatcaggcggctggacggagcaaaatctgtcgacgtcagggaaatttgtcagagagcagattcgtgcaggtgcgaatctgggcggtggcgatacgccgaccacaccaacggaaccgaccaacccgggtaacggaacaacgggtgacgtcgtgctgcaatatcgcaatgtggataacaacccgtccgatgatgcgattcgtatggccgtcaacatcaaaaataccggcagtacgccgatcaaactgagcgatctgcaagtacgttactacttccatgatgatggcaaacctggcgcgaacctctttgttgactgggcaaacgtcggccctaacaacatcgtgaccagcacggggacgccagccgccagcactgataaggctaatcgctatgttctggtgaccttcagcagcggagccggctcccttcagccgggcgcggaaaccggtgaagtgcaggtgcgtatccacgcgggtgactggagcaacgtgaatgaaacgaatgactattcatacggcgctaacgtcacgagctacgctaactgggataagatcaccgtgcacgataaaggcacgttggtatggggtgtggagccgtaatcgtgagttgttaacttattaagctattgattatcgtgcgggcgtgaattc

SEQ ID NO: 748 - protein, 505 aa, Pectobacterium carotovorum (Erwinia carotovora)
MWMRRNQIVRKLTLGVVTTVLGMSLSFSALSATPVETHGQLSIENGRLVDEQGKRVQLRGISSHGLQWFGDYVNKDSMKWLRDDWGINVFRVAMYTAADGYISNPSLANKVKEAVAAAQSLGVYIIIDWHILSDNDPNIYKAQAKTFFAEMAGLYGSSPNVIYEIANEPNGGVTWNGQIRPYALEVTDTIRSKDPDNLIIVGTGTWSQDIHDAADNQLPDPNTMYALHFYAGTHGQFLRDRIDYAQSRGAAIFVSEWGTSDASGNGGPFLPESQTWIDFLNNRGVSWVNWSLTDKSEASAALAPGASKSGGWTEQNLSTSGKFVREQIRAGANLGGGDTPTTPTEPTNPGNGTTGDVVLQYRNVDNNPSDDAIRMAVNIKNTGSTPIKLSDLQVRYYFHDDGKPGANLFVDWANVGPNNIVTSTGTPAASTDKANRYVLVTFSSGAGSLQPGAETGEVQVRIHAGDWSNVNETNDYSYGANVTSYANWDKITVHDKGTLVWGVEP

SEQ ID NO: 749 - DNA, 1470 bp, Streptomyces rochei
ctgcgacttcgaaagacattcgacgggttgccgcgcacagggttgtcagggacatgggcgccttctacagtcccctcccggaacaccattgggagcgctcccatcaatggggaggcgggagcgctcccgtcggtagcccgcaccccctcccgagaggtcccccacatgccacggttacggcaccacccccgcaccctgcgcgccgtgtcggcggcgctcctcaccgccctcgccgccctcgcggcgctgctgaccgcgaccgcccccgcacaggccgacaccacgatctgcgaagagttcggctcgaccgtcatccagggccgttacgtcgtccagaacaaccgctggggcaccagcgccacccagtgcgtcaccgcgaccgactccggcttccgggtcacgcaggccgacggctcggtgccgaccaacggcgcgccgaagtcgtacccgtcggtcttcaacggctgtcactacacgaactgttcgccgggcaccgcgctccccgcgcggatcagcggcatctcctccgcgcccagcagcatctcgtacggcttcgtcgacaacgccgtgtacaacgcctcgtacgacatctggctggacccgacgccccgcaccgacggggtgaaccggaccgagatcatgatctggttcaaccgggtggggcagatccagccgatcggctcgcaggtcggcacggcctccgtggccgggcgcacctgggaggtgtggtccggcgggaacggcaccaacgacgtgctgtcgttcgtcgctccgtccgcgatgagcagctggagcttcgacgtgatggacttcgtccgggcgaccgtcgcccgcgggctggcgggcaacgactggtacctgacgagcatccaggccggtttcgagccctggcagaacggtgcgggtctcgcggtcaactccttctcgtcgaccgtgaacacgggcggctcgcagaaccctggtgacccgaacggcccgggtgatccgggcacgccggccgcctgcacggtgtcgtacgcgacgaacgtgtggccgggcggcttcaccgcgaacgtcaccgtcaccaacaacggttcggctcccgtggacggctggcggctcgccttcaccctgccctccgggcagagcgtcgtgcacgcctggaacgcgtccgtctccccctcctcgggcgcggtcacggccaccggaccggccgagagcgcacggatcgccgccggcggcagccagagcttcggcttccagggcgcctacagcggcagcttcgcgcagccggccgccttccagctgaacggcaccgcctgcagcaccgtgtgaggaccgcggcgggccccctcccgccgtgaccccgacgcttccggggcccgctcttccctccctgcgccgacggggcgggccccgcaagcccgtacgtcccgcccagggggcggcccgtgagccgcgaccgccgccccctcccgtccgcgccgcgga

SEQ ID NO: 750 - protein, 382 aa, Streptomyces rochei
MPRLRHHPRTLRAVSAALLTALAALAALLTATAPAQADTTICEEFGSTVIQGRYVVQNNRWGTSATQCVTATDSGFRVTQADGSVPTNGAPKSYPSVFNGCHYTNCSPGTALPARISGISSAPSSISYGFVDNAVYNASYDIWLDPTPRTDGVNRTEIMIWFNRVGQIQPIGSQVGTASVAGRTWEVWSGGNGTNDVLSFVAPSAMSSWSFDVMDFVRATVARGLAGNDWYLTSIQAGFEPWQNGAGLAVNSFSSTVNTGGSQNPGDPNGPGDPGTPAACTVSYATNVWPGGFTANVTVTNNGSAPVDGWRLAFTLPSGQSVVHAWNASVSPSSGAVTATGPAESARIAAGGSQSFGFQGAYSGSFAQPAAFQLNGTACSTV

SEQ ID NO: 751 - DNA, 1380 bp, Ruminococcus albus
cacgtggaacattctgaaaataaggctgaatgttcccgacggcaaaaccatgacagatgccatatgatagctaagataggaaaacagtaaaaggaggatatttatgaaactgaaaagaattgcagccctgctgactgcggcagttatgagcgttggtgtgatggcttcatgcggcggcagcaagagtgacgacaagtcaaaggcggatacaaagtctgcggcagaaacaagcggtgccgagggtgacagctccgaaagcgaagagatacccgtttcacagacacataccaacgaccccatgaccgtaacttctgcaaaggacttagttgccaagatgtccaacggctggaatctcggaaataccatggacgcaacaggtgagggtcttgaatccgagataagctggcttcccaccaaggtatatacaaacaagttcatgatagatatgctgcccgaggcaggcttcaatgtacttcgtatacccgtaagctggggaaatcatcttatagacaacaactataccatcgaccctgcatggatggacagagttcaggagatagttaactacggtatcgatgacggtatgtatgttatactcaacactcatcacgaggaatggtatatgcccaagcccagtgagaaagacggcgatatcgaggaattaaaggcgatatggtcacagatagcagaccgcttcaagggctatgacgaacaccttatattcgagggactgaatgaacccagactccgcggagagggcgctgaatggacaggtacttccgaagcgagagagataatcaacgagtacgaaaaagcctttgttgaaactgtaagggcatcggggggcaacaacggtgacagatgcctgatgataacaggctatgcggcttcttcgggatacaacaacctttcggcgatagaacttcccgaggacagcgacaagctgataatctcggtacacgcatacctgccttattcttttgcacttgataccaagggcactgacaagtacgaccccgaggatacagctatacccacccttttcgagagtctcaatgagcttttcataagcagagatatacccgttatcgtgggcgaattcggttccatgaacaaggataacatcgacgaccgtgtaaaatgccttgacgattatctcggtaatgcggctaagtacgatatcccatgtgtatggtgggataactatgcacgtatcggcaacggcgagaacttcggacttctcaacagacaggagtacgactggtacttccccaagctgatggatgtattcaagaaatacgccgaaagcgacccttctgcggcagcagcataacaacgtaaacagcggcgtcacagaaatgtgcccgccgctttcatgtt

SEQ ID NO: 752 - protein, 409 aa, Ruminococcus albus
MKLKRIAALLTAAVMSVGVMASCGGSKSDDKSKADTKSAAETSGAEGDSSESEEIPVSQTHTNDPMTVTSAKDLVAKMSNGWNLGNTMDATGEGLESEISWLPTKVYTNKFMIDMLPEAGFNVLRIPVSWGNHLIDNNYTIDPAWMDRVQEIVNYGIDDGMYVILNTHHEEWYMPKPSEKDGDIEELKAIWSQIADRFKGYDEHLIFEGLNEPRLRGEGAEWTGTSEAREIINEYEKAFVETVRASGGNNGDRCLMITGYAASSGYNNLSAIELPEDSDKLIISVHAYLPYSFALDTKGTDKYDPEDTAIPTLFESLNELFISRDIPVIVGEFGSMNKDNIDDRVKCLDDYLGNAAKYDIPCVWWDNYARIGNGENFGLLNRQEYDWYFPKLMDVFKKYAESDPSAAAA

SEQ ID NO: 753 - DNA, 1200 bp, Ruminococcus albus
aaatacactgttgacgatgatggcatatctttatttaatgactttgatggcatgaaaaccatctgtcaccagcctatcataccgtttcgagatctcagtgttgagatgagaaagcctgataaagatgcggacagactcacaactctggatcttgccagaagcggagaggtaagggacatatccgctatggaacttgtaggcgagatgaaaacaggatggaatcttggcaactccctggatgcaacaggtgcaccgggcaatgcttcggaagtaaactggggcaacccaaaaacaaccaaggaaatgatagatgcggtctataacaaaggcttcgatgttatacgcatacccgttacctggggcggtcacgtaggcgatgcacccgactacaagatagacgatgaatggatagcccgcgtgcaggaggtagtaaactatgcatacgatgacggcgcatacgtcatcatcaactcccatcacgaggaagactggcgtatccccgataacgagcatatcgatgcagttgacgaaaagacagccgctatctggaaacaggtagcagagcgtttcaaggattacggcgaccacctgatattcgagggtctcaacgaaccccgggtaaaaggctcaccacaggaatggaacggcggcaccgaagaaggcagacgctgtgttgacaggctcaacaagactttccttgatacagtccgtgcaacaggcggcaataacgagaagcgccttctgctgatgaccacctatgcatcatcgagtatgagcaatgtcataaaggatacagctatacccgaggacgaccacatcggtttctcgatacacgcttataccccctacgcatttacatataatgcaaatgctgactgggagcttttccactgggacgattcccatgacggtgaattggtatctctgatgaccaatctgaaagagaattatcttgataaggatatacccgttattatcaccgaatacggcgctgtcaataaggacaacaacgacgaagaccgtgcaaaatgggtatccagctatatcgaatatgccgagctgcttggcggcataccctgcgtatggtgggataacggatactattcatcgggcaatgagcttttcggtatctttgacagaaacacctgcacatggttcaccgatacagttaccgatgcaataatcgaaaatgccaaataa

SEQ ID NO: 754 - protein, 364 aa, Ruminococcus albus
MRKPDKDADRLTTLDLARSGEVRDISAMELVGEMKTGWNLGNSLDATGAPGNASEVNWGNPKTTKEMIDAVYNKGFDVIRIPVTWGGHVGDAPDYKIDDEWIARVQEVVNYAYDDGAYVIINSHHEEDWRIPDNEHIDAVDEKTAAIWKQVAERFKDYGDHLIFEGLNEPRVKGSPQEWNGGTEEGRRCVDRLNKTFLDTVRATGGNNEKRLLLMTTYASSSMSNVIKDTAIPEDDHIGFSIHAYTPYAFTYNANADWELFHWDDSHDGELVSLMTNLKENYLDKDIPVIITEYGAVNKDNNDEDRAKWVSSYIEYAELLGGIPCVWWDNGYYSSGNELFGIFDRNTCTWFTDTVTDAIIENAK

SEQ ID NO: 755 - DNA, 2144 bp, Cellvibrio japonicus
ttctcgacgcttaacgaacgcattcgctttgagtggccattaaacgctgggtgcggagccggatacgtcacagaaagagtgagccttttccaatcaggacttttttgcgctaggctatcacccacaacaataaagtattggctcgctctcacgaaatacccatcaacccgtagtgcatagcttgtttatggatggcattttttccataggctgctgcacgcgcatcgtctgaaaacacctgcatattattgtgggggtgttttttacatcggctggtattaacaaaagaggaataacacgatgaacttgctatcaggttgggtaagacctctgatgctggggtgtggtttgctcggagccgcattatcggcggggagcatacaggcagcagtgtgtgaatatcgggtgacgaatgaatggggcagtggttttaccgccagtattcgaatcaccaacaatggcagcagtacgattaacggttggagtgtcagttggaattacaccgatggctcccgcgttaccagtagctggaatgcgggactgagtggtgccaatccctatagtgcgacaccggtgggttggaatacctctattccgatcgggtcgagtgtggaatttggagtgcagggcaacaatggcagcagtcgcgcacaagtgccggcagtgaccggggcgatttgcggtggacaaggttccagtgcaccgtccagtgttgcgtcttcatcttcatccagcagtgttgtttccagtactccccgctccagctcatcgtcagtgtcgagttctgtacctggcacttcgtcgagcagttccagctctgtgttaaccggggcccaggcgtgtaactggtatggcacactgacccctttatgcaacaacaccagcaatggttggggctatgaggatggtcgcagttgtgtggcgcgaaccacctgtagtgcgcaaccagcgccttacggcatagtatcgacctcatccagtacgccgctatcctcaagcagctcatcgcgctcctcggttgccagcagttcctccctcagtagtgcaacctccagcagtgcatcgtcagtgagcagcgtccctcctattgacggtggctgtaatggctatgccacacgctattgggattgctgcaagccgcactgtggctggagtgccaatgtgccctcgctggtatcgcccctgcaaagttgttcggccaacaatacccgtttgagtgatgtgagtgtcggcagcagttgcgatggcggtggcggttatatgtgttgggacaagattccctttgcggtcagtccaacactggcttacggttacgcggcgacctccagtggggatgtgtgcggtcgctgttatcaattgcaatttaccggcagttcctacaatgcgccgggcgatcctggttcagcggcactggcgggaaaaaccatgatcgtgcaggccaccaatattggctacgatgtttccggtggccagtttgacattctggttcccggcggtggtgttggagccttcaatgcctgctcggcgcaatggggtgtttccaatgcggagttgggcgcgcaatacggtggatttctggctgcctgtaagcagcagttgggttacaacgccagcctgtcgcaatacaaaagctgtgtgctcaatcgctgtgacagtgtgtttggttcgcgcggcctgacccaattgcaacaggggtgtacctggtttgccgagtggtttgaagcggcggacaatccttcactcaaatacaaagaagttccctgccctgcagagttaacaacccgctccggaatgaatcgcagtatcctgaatgatattcgcaacacctgtccctgagtgattacacaggatagaaacggcccttttgtggcagtttctcattttaagtacacaggagccgatcaatagagaaaggtatatcaactccatagcctatccttatcaacccgcctaaaaaatactcatcgcttatgttttataaattttgattatgagaaccgcggtgtcattcaattagccctgattcctccaactccctaatctgtgccccgtcgaaactttctctggcgacattaaccacagaccttcaggagttacattcatggcaagtatcaattcggaaattaaacctttcagtgcccagg

SEQ ID NO: 756 - protein, 511 aa, Cellvibrio japonicus
MNLLSGWVRPLMLGCGLLGAALSAGSIQAAVCEYRVTNEWGSGFTASIRITNNGSSTINGWSVSWNYTDGSRVTSSWNAGLSGANPYSATPVGWNTSIPIGSSVEFGVQGNNGSSRAQVPAVTGAICGGQGSSAPSSVASSSSSSSVVSSTPRSSSSSVSSSVPGTSSSSSSSVLTGAQACNWYGTLTPLCNNTSNGWGYEDGRSCVARTTCSAQPAPYGIVSTSSSTPLSSSSSSRSSVASSSSLSSATSSSASSVSSVPPIDGGCNGYATRYWDCCKPHCGWSANVPSLVSPLQSCSANNTRLSDVSVGSSCDGGGGYMCWDKIPFAVSPTLAYGYAATSSGDVCGRCYQLQFTGSSYNAPGDPGSAALAGKTMIVQATNIGYDVSGGQFDILVPGGGVGAFNACSAQWGVSNAELGAQYGGFLAACKQQLGYNASLSQYKSCVLNRCDSVFGSRGLTQLQQGCTWFAEWFEAADNPSLKYKEVPCPAELTTRSGMNRSILNDIRNTCP

SEQ ID NO: 757 - DNA, 1920 bp, Clostridium thermocellum
tttcactggtgcaattacctcttttatttttgcttcattggcccggttaacaattttcaataatatattttttattgaacaaattattttttggggggaaggtatttttatgaaaaaagcaaaagcaattttttcgctggttgttgctttgatggtattggccattttctgctttgcacagaataccggttcaacagctacgacagcagcggccgccgtcgacagcaacaacgatgactggttgcactgtaaaggcaacaaaatttacgacatgtatggaaacgaagtctggctcacaggcgccaactggtttggtttcaactgcagtgaaaactgtttccacggtgcctggtatgatgttaaaaccattctgaccagcattgcagacagaggtatcaaccttctgagaataccaatttcaacagagcttctgtacagctggatgattggaaaacccaacccggtttccagtgttaccgccagcaacaatcctccatatcatgtggtcaaccctgacttttatgatcccgaaaccgacgatgtaaaaaacagtatggaaatcttcgatatcataatgggatactgcaaagaactcggaataaaagtaatgattgatatacacagtcctgacgccaacaactccggacacaactatgagttgtggtacggaaaggaaacaagcacctgtggtgtggttaccacaaagatgtggatagacactttggtttggcttgccgacaagtacaaaaatgatgacaccataatagcttttgacttgaaaaacgagcctcacggaaagcgtggatatacggctgaggtgcctaaattgcttgcaaaatgggacaattccacagacgaaaacaactggaaatacgctgccgaaacctgcgcaaaagctattttggaagtaaatcctaaagtgcttatagtaattgaaggtgttgaacaatatcctaaaactgagaaaggttatacctatgacacaccggatatctggggagcaacaggagatgcttctccatggtacagtgcatggtggggaggaaacttaagaggtgttaaagactatcctatcgatttaggtcctttgaacagccagattgtatattctccgcatgactacggtccttcagtatatgctcagccgtggtttgaaaaagactttacaatgcaaaccttgttggatgactattggtatgatacctgggcatatattcacgatcagggaatcgctccaatcctaatcggtgaatggggcggacatatggacggcggcaaaaaccaaaaatggatgacattgctcagagattacatagttcaaaaccgcattcatcatacattctggtgcataaatcccaactccggtgacaccggcggattgctcggaaacgactggtcaacttgggatgaggcaaaatacgcattgttaaaacctgctttgtggcagaccaaggacggaaagttcattggacttgaccacaaaattcctctcggttcaaagggaatttccctgggcgagtactacggaacaccacaagcttcagatcctccggcaacaccgactgcgacgcctacaaagcctgcagcttcatcgactccttcatttatttacggcgacattaacagcgatggtaatgtcaattcaacagatcttggtatattaaagagaataatagtaaaaaatcctccggcaagtgccaacatggatgctgcagacgtaaatgcggacggtaaagtgaattcaactgactataccgttctaaagagatatttgctgaggtcaattgacaaactgccgcacaccacctgacaatcaacaggacttataataaaattaaaggttgactgccaaacaaaggcagtcaaccttttttaatatccataatttaaaatcattcttccttcattcccgtataaatc

SEQ ID NO: 758 - protein, 566 aa, Clostridium thermocellum
MKKAKAIFSLVVALMVLAIFCFAQNTGSTATTAAAAVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYGTPQASDPPATPTATPTKPAASSTPSFIYGDINSDGNVNSTDLGILKRIIVKNPPASANMDAADVNADGKVNSTDYTVLKRYLLRSIDKLPHTT

SEQ ID NO: 759 - DNA, 2155 bp, Clostridium thermocellum
caaaatgattttgttttagtttttggcatggtcaagtaaccatgctttttttatggctggaaaggcttggtgtatggtgcttgtgagatatgatattagtttattgtatttaaaaaaataatatgatatgataagattggaaatcagtttacaaacaagtattacccagataatactttttacatatacttgtgaaatttaatattttatgggggtgacggatttaaaatttttagagaaaagtatttgcctgtatattttaaccttaatttaattagtttgtttaggaggaaaaatgcaatgaaaaaatttcttgttttattgattgcattaataatgattgcaaccttattagtggttcccggtgtgcaaacatcggcagaagggtcatatgctgatttggcagaaccggatgacgactggctgcatgtggaaggtacgaatattgttgacaagtacggcaataaagtttggataacaggagccaactggtttggattcaattgtagagagagaatgcttttggattcataccatagcgatattatagcagatattgaattggttgcggataaaggtataaatgtggttagaatgccgattgcgacagatttgctctatgcatggagccaggggatatatccgccttcaaccgatacaagctacaacaatccggctttggctggattaaacagctatgagttgtttaatttcatgctggaaaatttcaaaagagtcggtatcaaagttatacttgatgtgcacagcccggaaactgacaaccaggggcataactatcctctttggtacaataccactataacggaggagatattcaaaaaggcctgggtatgggtggctgagcgctataaaaatgatgacacaataatcggatttgacctaaaaaatgagccccataccaataccggcaccatgaaaataaaagctcaaagtgccatatgggatgactccaaccatccgaacaactggaaaagagtggctgaggaaactgccttggcaatattggaagtacatccaaatgtattgatatttgttgaaggtgtggagatgtatcccaaagacggcatatgggatgacgaaacttttgacacaagcccgtggacaggaaacaatgactattacggaaactggtggggcggtaacttaagaggcgtgaaggattatccgattaatcttggaaaatatcagtcgcagcttgtttattcacctcatgattatggcccgatagtttatgagcaggattggtttaaaggcgattttatcactgccaatgatgaacaggcaaaaaggattctgtatgagcaatgctggagagacaattgggcatatatcatggaagaaggaatatcaccgttgctccttggcgaatggggaggtatgaccgaaggcggccacccgcttcttgacctgaacttgaagtatttaagatgcatgagagattttatattggaaaacaaatataaattgcatcatactttctggtgcataaacattgactcggcagataccggcggattgtttacccgtgatgagggaacaccgttcccggggggaagagatcttaagtggaatgacaacaagtacgacaattacttgtatcctgttctttggaaaaccgaggacggaaagtttataggtcttgaccacaagattcctctcggcagaaacggtatatcaataagtcagctttcaaactatacaccgtcggttactccgtctcccagcgcaactccttctccgacaacaataactgcaccgccgacggataccgttacatacggagatgtgaacggagacggaagggtaaactccagcgatgtggcattgttgaaaagatatttgttgggtttggttgaaaatatcaataaagaagcagcggacgtaaatgtcagtggaactgtaaattcaacggatttggcaattatgaaaaggtatgttttgcgtagcataagtgagttgccgtataaataagacaataaaaaacggtggaaaaaaggggactttggccgctggctaaagtccctgaattttaaggagagaaaagatgccaaagatattaattgttgaagatgataaagatattgtaaataatttaaccgaatacttgcgtgacgaaggctttgacgtggattct

SEQ ID NO: 760 - protein, 563 aa, Clostridium thermocellum
MKKFLVLLIALIMIATLLVVPGVQTSAEGSYADLAEPDDDWLHVEGTNIVDKYGNKVWITGANWFGFNCRERMLLDSYHSDIIADIELVADKGINVVRMPIATDLLYAWSQGIYPPSTDTSYNNPALAGLNSYELFNFMLENFKRVGIKVILDVHSPETDNQGHNYPLWYNTTITEEIFKKAWVWVAERYKNDDTIIGFDLKNEPHTNTGTMKIKAQSAIWDDSNHPNNWKRVAEETALAILEVHPNVLIFVEGVEMYPKDGIWDDETFDTSPWTGNNDYYGNWWGGNLRGVKDYPINLGKYQSQLVYSPHDYGPIVYEQDWFKGDFITANDEQAKRILYEQCWRDNWAYIMEEGISPLLLGEWGGMTEGGHPLLDLNLKYLRCMRDFILENKYKLHHTFWCINIDSADTGGLFTRDEGTPFPGGRDLKWNDNKYDNYLYPVLWKTEDGKFIGLDHKIPLGRNGISISQLSNYTPSVTPSPSATPSPTTITAPPTDTVTYGDVNGDGRVNSSDVALLKRYLLGLVENINKEAADVNVSGTVNSTDLAIMKRYVLRSISELPYK

SEQ ID NO: 761 - DNA, 1983 bp, Butyrivibrio fibrisolvens
gttacaaacagattgaatgatagcaccagacagtttgttaatatctgatatcgttttcagataataacgaataaagttgaatattttacgaatatattacggaattgttaatggaatattgacaattccgttttttcgttaataattaatatgtcgcgacaaaataaatgggaggtgcttaagatgcacaagtctaaatgcattaagagggtatttacttttttattggctttatttgtttttgttatggcgataccggcaactaaagtttctgccgctggcggaactgacaggtctgcaacacaggttgtatctgacatgagagtggggtggaatataggaaacagccttgattcttttggtcagagctacaatttcccttacacaagtcttaatgagacttattggggaaatcccgcaacaaccaaagcacttattgatgaagttgccaaggccggttttaacacaatccgtattcctgtttcatggggacagtatactactggttcagattatcagattcctgattttgttatgaacagggtaaaagaagtagttgattactgtatcgttaacgatatgtatgtaattctgaattcacaccatgatatcaactcagactactgcttctatgttcctaacaatgcgaacaaggatcgttctgagaagtacttcaagtcaatctggacacagattgccaaagagttcaagaattatgactatcaccttgtatttgagacaatgaatgagccaagacttgttggacatggtgaagagtggtggttcccaagaaacaatccaagcaatgatatcagagaagctgttgcctgcatcaatgattataaccaggtagctcttgacgcaatcagagcaacaggcggcaataatgcaacaagatgcgttatggttcccggatatgatgcttctatagaaggctgcatgacagatggattcaagatgccaaatgatacagcaagtggcagacttattctttcagtacatgcttatattccttattattttgcacttgcaagcgatacatatgttacaagatttgatgataacctcaaatatgatattgattcattctttaacgaccttaattccaagttcctttcaaggaacattcctgttgtagtaggtgaaacaagtgctacaaacagaaacaacacagcagagcgtgttaagtgggcagattattactggggaagagcagctagatacagcaatgtagctatggtactctgggacaataacatttatcagaataattctgctggatcagatggcgaatgtcatatgtacatagacagaaattctcttcagtggaaggatcctgaaatcatcagcacaatcatgaagcatgttgatggaactcctgcaacaataaatggtaaggaaatcccttcaactgagcagccagatcctacaccggtagatccagatccaacaccggtagatccggacccaacaccggtagacccagatcctacacctgtagacccggatccacagcctgtagatcctactcctgtatccggcgctcttaaggcagagtatacgatcaataactggggttcaggataccaggttctgatcaaggttaagaatgattctgcttccagagttgatggatggacattaaagatcagcaagagcgaagttaagatagattccagctggtgcgtaaatatagctgaagaaggcggctattatgtgatcactcctatgtcctggaattcatctcttgagccttcagcttctgtagactttggtattcagggctcaggttcaatcggaacatccgttaatatttcagttcagtaaataagcacttttttcacgaaaggcagtccgcaagggctgcctttttctgctgtttttttggtgtaaaatgtgattgacttttacgtgggttattgtttaaaatctttaattgtgtgcttatttatgaaggggaaatattaggaaaaggtatagaaa

SEQ ID NO: 762 - protein, 547 aa, Butyrivibrio fibrisolvens
MHKSKCIKRVFTFLLALFVFVMAIPATKVSAAGGTDRSATQVVSDMRVGWNIGNSLDSFGQSYNFPYTSLNETYWGNPATTKALIDEVAKAGFNTIRIPVSWGQYTTGSDYQIPDFVMNRVKEVVDYCIVNDMYVILNSHHDINSDYCFYVPNNANKDRSEKYFKSIWTQIAKEFKNYDYHLVFETMNEPRLVGHGEEWWFPRNNPSNDIREAVACINDYNQVALDAIRATGGNNATRCVMVPGYDASIEGCMTDGFKMPNDTASGRLILSVHAYIPYYFALASDTYVTRFDDNLKYDIDSFFNDLNSKFLSRNIPVVVGETSATNRNNTAERVKWADYYWGRAARYSNVAMVLWDNNIYQNNSAGSDGECHMYIDRNSLQWKDPEIISTIMKHVDGTPATINGKEIPSTEQPDPTPVDPDPTPVDPDPTPVDPDPTPVDPDPQPVDPTPVSGALKAEYTINNWGSGYQVLIKVKNDSASRVDGWTLKISKSEVKIDSSWCVNIAEEGGYYVITPMSWNSSLEPSASVDFGIQGSGSIGTSVNISVQ

SEQ ID NO: 763 - DNA, 1778 bp, Alicyclobacillus acidocaldarius
cggtgccggccgacgttcgcggcgcgcgcgcgggtcgccatcgagcggatggtggccatcggctgacgtcgagaggcggaggcaggtatcggcacgcgaggcgtcgaatcctctctcctgcaagccggtgggaggggattcgacatgccgtctcgcgtgcccaaatcgattttttataatcaagttgggtatctgatcagcggcgacaagcgcttttggattcaggctcacgagcctcagcctttcgcgctgcgcacgccggaagggcaggccgtgttcgcgggaatgacgaagcccgtcggcgggaattggtacgtcggcgattttaccgcgcttcgcgtgccggggacctacacgttgacggtagggactctcgaggcgcgggtcgttatccatcgccgcgcgtatcgtgacgtgctcgaggccatgctgcgcttcttcgactatcagctctgcggcgtcgtgctgcccgaggatgaagccgggccgtgggcgcacggcgcctgtcacacgagcgacgccaaggtgtttggcaccgagcgcgccttggcctgcccaggcggttggcacgacgctggcgattacggcaaatacacggtccccgccgccaaggccgtggccgatctcctgctcgcccacgagtacttcccggcggcactggcgcacgtccgccccatgcgctcggtgcatcgggcgcctcatctgccgccggcgctcgaggtggcgcgcgaggagattgcctggcttctcaccatgcaggatcccgcgacaggcggcgtgtaccacaaagtcaccacgccttcctttccgccgctcgacacgcgccccgaagacgacgatgcgcccctcgtcctcagtcccatctcctacgccgccacggccacgttttgcgccgccatggcgcatgccgccctggtgtaccgccctttcgatccggccctatcctcgtgctgtgcggacgccgcccgtcgcgcgtacgcgtggctcggcgcgcacgagatgcagccgtttcacaatcccgatgggatcctcacgggcgaatacggcgacgcggaactccgcgacgagctgttgtgggcgtcctgcgccctgcttcgcatgaccggcgattccgcgtgggcacgcgtgtgcgagccgcttctcgatctcgacctcccgtgggagttgggatgggcggacgtcgcactctacggcgtcatggattacctgcgcactccgcgcgccgccgtatcggacgacgtgcgaaacaaggtgaaaagccgccttctccgagaactcgacgccctcgccgcgatggctgagtcgcatccgttcggcattcccatgcgggatgacgatttcatctggggcagcaacatggtgctcttgaaccgcgccatggcgttcctgctggccgaaggcgtcggtgtccttcatcccgctgcacatacggtggcccagcgcgcggcggactacctgtttggcgcaaatccgctcgggcagtgctacgtcacgggctttggccaacgccccgtgcgccatccgcatcatcgcccgtccgtcgcggatgatgtggaccatcccgtccctggcatggtcgtcggcggcccaaaccgccacctgcaggacgagatcgcccgcgcacagcttgcggggagacctgcgatggaggcgtacatcgatcaccaggacagctactcgaccaacgaggtcgccgtctactggaattcgcctgccgtgtttgtcatcgcggctttgctcgaggcgcgcgggaggtgacggatggctttccaggcaca

SEQ ID NO: 764 - protein, 537 aa, Alicyclobacillus acidocaldarius
MPSRVPKSIFYNQVGYLISGDKRFWIQAHEPQPFALRTPEGQAVFAGMTKPVGGNWYVGDFTALRVPGTYTLTVGTLEARVVIHRRAYRDVLEAMLRFFDYQLCGVVLPEDEAGPWAHGACHTSDAKVFGTERALACPGGWHDAGDYGKYTVPAAKAVADLLLAHEYFPAALAHVRPMRSVHRAPHLPPALEVAREEIAWLLTMQDPATGGVYHKVTTPSFPPLDTRPEDDDAPLVLSPISYAATATFCAAMAHAALVYRPFDPALSSCCADAARRAYAWLGAHEMQPFHNPDGILTGEYGDAELRDELLWASCALLRMTGDSAWARVCEPLLDLDLPWELGWADVALYGVMDYLRTPRAAVSDDVRNKVKSRLLRELDALAAMAESHPFGIPMRDDDFIWGSNMVLLNRAMAFLLAEGVGVLHPAAHTVAQRAADYLFGANPLGQCYVTGFGQRPVRHPHHRPSVADDVDHPVPGMVVGGPNRHLQDEIARAQLAGRPAMEAYIDHQDSYSTNEVAVYWNSPAVFVIAALLEARGR

SEQ ID NO: 765 - DNA, 3060 bp, Xanthomonas campestris pv. campestri
gcggccgcattggccaggcccaggccggtgcattcgcggttcttgttgctgggcgtgtcggtgagttcatcgaccacgcgcgcggtcatcatcgattcgagcaggcccaccattgcgatggccagcgccggcagcgcgatgatgcgcaaggtctccagcgtcaacggcacgccgggccattgcaggaacggcagcgcggtgggcagcttgcccaggtcggccaccgtcttcagcggcaggtgcagcgcgctgctggccaccgtgagcagcaggatgcacagcagcggcgacggaatggctgagacaccgggcagccgcaaccgcggcaggccgtagatgatggccaggcccacgcccagcgtgacccaggtggtggggttggcaccgagcaggtgcggcagctgcgcggcgaagatcagcaccgccagcgcgttgacgaacccggtccgcaccgagctgctgacaaagcgcatcagcacgcccaggcgcagcagcccgaacacgatctgcaccagcccggcgagcagcccggcggcgagcagatacggcaacccatgcgtggccaccagcggcgcagccaccagcgccaccgagccggcggctgcggaaatcatcgccggccgtccgccacaaaacgcgatcacgatgccgatcacaaacgacgcgaacaagccgacctgcgggtccacgcctgcgacgaacgcaaaggcgatgacttcgggaatcagggcgaacgtggcaacggcgccagccatcagttcgcgcgcaggcgaggcgcgccattgcgccagttcggtgcgcaggaaggacatgggggacactccagggacaagaacgacatgcctgcggacagcgcgcagggggcactagtgtgcgggaaagcgaccgctcccgcagccgcgatgtgatcggtgcggcaatggtgttttctgtggggacgatcacaccacgcgacgcgcgcacagaccaagatgcccgccttaccgcgctcgggtgtcgagcccggttctctagggagatcaccatgtccatattcaggaccgcaagcacgctcgctttggccaccgccctcgcactggccgccgggccggccttcagctattccatcaacaacagcaggcagatcgtcgacgacagcggcaaggtcgtgcagctcaagggtgtgaacgtgttcggcttcgaaaccggcaaccacgtgatgcatggcctgtgggcacgcaactggaaggacatgatcgtgcagatgcagggcctgggcttcaacgccgtgcgcctgccgttctgcccggccacgctgcgtagcgacaccatgccggccagcatcgactacagccgcaacgccgacctgcagggcctgacctcgctgcagatcctcgacaaggtgatcgccgaattcaatgcgcgcggcatgtatgtgctgctggatcaccacacccccgattgcgccggcatttccgagctctggtacaccggctcctataccgaggcacagtggctggccgacctgcgctttgtggccaaccgctacaagaacgtgccgtatgtactcggcctggatctgaagaacgaaccgcacggcgccgccacctggggtaccggcaacgccgccaccgattggaacaaggctgccgagcgcggctcggccgcggtgttggcggtcgcgccgaaatggctgatcgcggtggaaggcatcaccgacaacccggtgtgctccaccaacggcggcatcttctggggcggcaacctgcagccgctggcctgcaccccgctcaacatcccggccaaccgcctgctgctggccccgcacgtgtacggcccggacgtgttcgtgcagtcgtacttcaacgacagcaacttccccaacaacatgcccgccatctgggaacgccatttcggtcagttcgccggcacgcatgcgctgttgctgggcgagttcggtggcaagtacggcgaaggcgacgcacgcgacaagacctggcaggacgcgctggtgaagtacctgcgcagcaagggcatcaaccagggcttctactggtcgtggaatcccaacagcggcgacaccggcggcatcctgcgcgatgactggaccagcgtgcgccaggacaagatgaccctgctgcgcacgctgtggggcaccgccggcaataccacgccgacgccgactcccacacctacgcccacaccgacaccgacgcctacccccacgccgacgcccaccccgggcaccagcaccttcagcaccaaggtgatcgtggacaacagctggaacggcggctattgcaaccgcgtgcaggtgaccaacaccggcaccgccagcggcacctggtcgatcgcggtgccggtcaccggtacgtcaacaacgcctggaatgcgacctggtcgcagagcggcagcacgctcagagccagcggcgtggacttcaaccgcaccctggcagccggcgccaccgccgagttcggcttctgcgccgcgagctgagtgcactgtggcgggtacggctcccgtgtccgctacctttgcaacatgcagtggcattgtggaggcgctgcgtagcaggttgatgatcacctgcggcgcctaacccacgacctcgtaggacgcccttgggcgcgatgggcattcccgataaagcccacctgcccaagggcgctcctacgtttttttggcgttggaacgttgtccagcgtctgcacggtcatctggttgacgaagacgccgcaagatcgcagcgacagccgtgatcgagtagcaacatcgcaaaaccacgcaatcttcctgtaggacggccctcgggcgcgatgaggcattccctataagccccaatctcgcccaagggcgctcctacgacgctgcaaccttggaatgcaatcgaatcgctgttcgcacatgtcgtgacggcaacggcgccgcatgatcggatgcacgacgcactcatccaatcacacgcgatgccccgtaggacgccctcgggcgcgatgaggcattgccgataacgcccatcccgcccaaggccgctcctaccggtttccgtgcggctgcagacaagcaggcgcggccgca

SEQ ID NO: 766 - protein, 518 aa, Xanthomonas campestris pv. campestri
MSIFRTASTLALATALALAAGPAFSYSINNSRQIVDDSGKVVQLKGVNVFGFETGNHVMHGLWARNWKDMIVQMQGLGFNAVRLPFCPATLRSDTMPASIDYSRNADLQGLTSLQILDKVIAEFNARGMYVLLDHHTPDCAGISELWYTGSYTEAQWLADLRFVANRYKNVPYVLGLDLKNEPHGAATWGTGNAATDWNKAAERGSAAVLAVAPKWLIAVEGITDNPVCSTNGGIFWGGNLQPLACTPLNIPANRLLLAPHVYGPDVFVQSYFNDSNFPNNMPAIWERHFGQFAGTHALLLGEFGGKYGEGDARDKTWQDALVKYLRSKGINQGFYWSWNPNSGDTGGILRDDWTSVRQDKMTLLRTLWGTAGNTTPTPTPTPTPTPTPTPTPTPTPTPGTSTFSTKVIVDNSWNGGYCNRVQVTNTGTASGTWSIAVPVTGTSTTPGMRPGRRAAARSEPAAWTSTAPWQPAPPPSSASAPRAECTVAGTAPVSATFATCSGIVEALRSRLMITCGA

SEQ ID NO: 767 - DNA, 4161 bp, Bacillus sp. BP-23
ggatctcaggagccgccaataaggtagcaggagagattgaagaagtatcagctggttctgaggaaatgtcagcaagtacgaatgaggtcgtaagttatgtgagccagatttcgaacattgcgggagaagcggcaggctccgcgcacaacgtatctgctgcaacacaagagcagcttgcatccatggaagagattgcttcttccgccagcctgttgtccaagatggctgaggaattgcagggtcaagtcaacaaattcagagtatagctttcaaatacaaagaagaaaagagctgtttctcccgaaactttcggtgaagaaacagcttttttgtcataacacgcaatccgaaggtcacaacaatgttatttcagaagtcaccaatgtggatattgcaagttgacacaaaacactataatggtaattaatggtggaagttatatagagttaccaccatagagaggagcgcatgtacttcgtcaattacaggtattcaagcggaactttcaagaaaaggagatgaatagtaacaatgaaagggagctggtggagacgagttgctatagtgacattatcggcagggctgctggcagggagcttttctatgaatacaggattacgtcaggcggatgcggccgctggagatcataattatgccgaagctcttcagaaggcaatttatttctatgaagcgcagcggtcaggcccattacctgcgaataatcgggttgaatggcgtggtgactcaggaatgcaggacggggcggatgttggcgtagatcttaccggcggttggtatgatgcgggggatcacgtgaaatttggttttccgatggccgcttcagccacgatgcttgcatggtctgtagtggaatacgcggatggttatgaacaagccggacaattggaggagatcaaggataatatacgctgggcaaccgactattttatgaaagcgcatacgaagccaaacgaattatggggacaagtcggagcaggtaatacggatcatgcctggtggggacctgcggaggtcatgcaaatgaaccgtccttcgttcaagattgatgcgtcctgtccgggaagtgatttggcggcagaaacggctgctgcacttgcggcttcctccatcgtgtttgcagatagtgacccggtatactcggcgaagctgctccagcatgcgaaagaattgtacaactttgcagatacatatcggggaaaatataccgattgtattaccgatgctgctgcgttctataattcctggaccgggtatgaggatgagctggcatggggcggagcatggctttatttagcgacaaatgataacgcttacttgtccaaagcgctttctgctgcagatcgctggtctacgagtggtggctcggctaactggccgtatacctggacacagggctgggatagcaagcattatggtgcccagattcttcttgcccggataacttccaatctgaatatgccggaagcaacaaagttcattcagtctaccgaacgaaatctggattactggacggtgggtacgaatggagggcgtgtcaaatatacccctggaggtttggcttggcttgaccaatggggttcactccgatatgcggcgaatgcagcctttatctcatttgtatattccgattgggtcagtgaccctgtgaaaaaatccagatatcaaaattttgctacttcacagatcaattacattttaggggataaccctcgtcagagcagctacgttgtcgggtatgggcaaaattcaccgcagcatccccatcaccgtaccgctcatagctcatggatgaataatgaggacatcccggcaaatcaccgccatattttatacggtgcgatggtgggaggaccgaatgcgtcagatcaatataccgatgatatcggagattatgtgagcaatgaggtagcaacggattacaatgcaggatttaccggagcacttgcgaagatgaatctgctgtacggacagaatcatcagccgcttgcgaacttccctgcaccggaggtcaaaggtgacgagtattttgtggaggccgctgtacgctcatccggctccaattatacggaaattcgcgcattgcttaacaaccgttcaggttggcctgcacgtatgggcgatcagctttcgttcaaatatttcctggatttgagcgaggtatatgctgcgggacgcaccgtatctgatgttcaggttactgtctcgtctagcgaaggggcaaccgtgtcacagcctgttgtggtggatgccgccaagcggatctatgccattacggccaatttcagcaacaccaaaatctaccctggcggggaagggaattatcgcaaagaagttcagttccgaattacaggaccacagggggcatggaatccagctaatgatccgtcctaccagaaccttacgacaggcaatccggtgaaaagtaattacattcctgtctacgatgccggagtgaaggtgtctggacaggagccgggagtaacacctgttgctgttccagctgctcctgccggtgtgcaggcggtagccgggaatagccaagttgcgctgaactggtcagcttctgcaggagctgtatcgtatacagtaaagcgtgccgaggttagcggaggtccttacactaccgtggcagctggggtgaacggactgacttacaccaatacaggactaacgaatggcaaaacgtattattacgtagtgaccgccgtgaattccgccggggaatccccagcttctgttcaggtgtcaggtatgcctcaagcggcaacgactgtgcctggagcagtgacattaagcggaacagcgggcaataaccaaaacatgttgtcttggaccgcagcatcaggggcatcgagctacacggtgcaacgtgctgttgcaggcggtacgtatactgatgtggcaactggattggctgtgctgaactacaacgacacgaccgcccttaatggaacgtcatacagttatcgcgtggctgctgtaaacgcaagcgggcagacgttgtccaacgtagttatgctgacaccatccgggccacctgtctcgacaggtacgcttgaggtgcagtatcgaagcgggggttcaggcaattccagcaatgcagttactccgcaattcaatctgaagaataccggcacacaggcgattgatctgagtacggtgaaaattcgttattactttaccaaagacggcacggaggagctgtccttctggtgtgattatgcgcaggtgggctcagcgaacgtacaaggaatgtttgtagcagtgaatccggcgaaaggtacagcggatacgtatgtggagatcagcttcacctctggagcaggaagtttggctgcgggggcagagacaggcgttattcagacacgtttttccaaaaacaactggagtgcgtttgatcaaagcaatgactattcctatgatgcttccaaaacggcttttgctgcctggaacaaggtgacggcgtatcagggcaatacccaggtatgggggctggagccataaaccaatgcatacaggtgcaagtgcaggtgcaggtgcaggtgcgaaaggctgaacaatatttcaaaattgaatagctcaaaggtggagcaatcaaaagaacagacgaccagcattgatattatttttcactattccagggaggtatatattcatgttgaaaacagctgcaaaaaagagtttaactgccatgctggcgggaactgttatgctgaccggttacacgggactctggaccggctctcaaacggcgcatgcttccgatcaggcgattgaaattcaggcagatggcattaacgaagcacgctttctgcaattatatgcacagttgaaggacccggcgaacgggtacttctctgccgaagggattccgtatcactccattgaaacgctgctgagtgaggccccggattacggacatatgtctacttcagaagcatacagctactggttatggcttgaaacgatgtatggtcactacacgggagactggtctaaacttgaagcagcctgggataacatggagaagtatattatcccggtcaatgaaggcgacggtaatgaagaacagccaacaatgagcaagtacaatccgaacagtcctgcaacctatgcagcggagaaaccattccctgatcc

SEQ ID NO: 768 - protein, 997 aa, Bacillus sp. BP-23
MKGSWWRRVAIVTLSAGLLAGSFSMNTGLRQADAAAGDHNYAEALQKAIYFYEAQRSGPLPANNRVEWRGDSGMQDGADVGVDLTGGWYDAGDHVKFGFPMAASATMLAWSVVEYADGYEQAGQLEEIKDNIRWATDYFMKAHTKPNELWGQVGAGNTDHAWWGPAEVMQMNRPSFKIDASCPGSDLAAETAAALAASSIVFADSDPVYSAKLLQHAKELYNFADTYRGKYTDCITDAAAFYNSWTGYEDELAWGGAWLYLATNDNAYLSKALSAADRWSTSGGSANWPYTWTQGWDSKHYGAQILLARITSNLNMPEATKFIQSTERNLDYWTVGTNGGRVKYTPGGLAWLDQWGSLRYAANAAFISFVYSDWVSDPVKKSRYQNFATSQINYILGDNPRQSSYVVGYGQNSPQHPHHRTAHSSWMNNEDIPANHRHILYGAMVGGPNASDQYTDDIGDYVSNEVATDYNAGFTGALAKMNLLYGQNHQPLANFPAPEVKGDEYFVEAAVRSSGSNYTEIRALLNNRSGWPARMGDQLSFKYFLDLSEVYAAGRTVSDVQVTVSSSEGATVSQPVVVDAAKRIYAITANFSNTKIYPGGEGNYRKEVQFRITGPQGAWNPANDPSYQNLTTGNPVKSNYIPVYDAGVKVSGQEPGVTPVAVPAAPAGVQAVAGNSQVALNWSASAGAVSYTVKRAEVSGGPYTTVAAGVNGLTYTNTGLTNGKTYYYVVTAVNSAGESPASVQVSGMPQAATTVPGAVTLSGTAGNNQNMLSWTAASGASSYTVQRAVAGGTYTDVATGLAVLNYNDTTALNGTSYSYRVAAVNASGQTLSNVVMLTPSGPPVSTGTLEVQYRSGGSGNSSNAVTPQFNLKNTGTQAIDLSTVKIRYYFTKDGTEELSFWCDYAQVGSANVQGMFVAVNPAKGTADTYVEISFTSGAGSLAAGAETGVIQTRFSKNNWSAFDQSNDYSYDASKTAFAAWNKVTAYQGNTQVWGLEP

SEQ ID NO: 769 - DNA, 3406 bp, Bacillus licheniformis
gatcttctctatgagcatagcgtcgttttcagaaaagacccgtgcagcttctgctgaagaatatcctcataattatgctgaactgctgcaaaagtctttgttattttatgaagcacagcgctcgggaagacttccggaaaacagccggctgaattggagaggagactccgggcttgaggacggaaaagacgttggcctcgatttaacgggagggtggtatgatgccggcgaccacgtgaagttcggtctgccgatggcttattctgccgcaatcctgtcatggtcggtctatgagtaccgagatgcctacaaagaatcgggtcagcttgatgcggcgctggacaatattaaatgggcgacagactactttcttaaagcccatacggctccttatgaattgtggggccaagtcggaaatggcgctctagaccacgcatggtgggggccggccgaagtaatgccgatgaagcgccctgcctataagatcgatgccggctgtccggggtcagaccttgctggtggtacagccgcagcgctagcatcagcatcaattattttcaagccgacagattcttcttactctgaaaaattactggctcatgccaagcaattgtatgattttgccgaccgctaccgcggcaaatattcagactgcattacagacgcacagcaatattataattcgtggagcgggtataaagatgaactgacatggggagctgtctggctctacttggcaacagaagaacaacaatatttggataaagcccttgcttcggtctcagattggggcgatcccgcaaactggccttaccgctggacgctttcctgggatgacgtcacttacggagcacagctgctgctcgctcgtctgacaaacgattcccgttttgtcaaatctgtcgaacgcaatcttgattattggtcgacaggctacagtcataatggaagcatagaacggatcacgtatacgccgggcggtttggcctggcttgagcagtggggatcattgcgatacgcttcgaatgccgcttttctcgctttcgtttattccgattgggtggatacagaaaaagcgaaaagatatcgggattttgctgttcggcaaacggagtatatgctaggagataatccgcagcagcgaagctttgtcgttggatacggtaaaaatccgccgaaacatccgcatcaccgtacagcacacggttcatgggccaatcagatgaatgtgcctgaaaaccatcgccataccctatacggcgcattagtcggcggtccgggaagggacgattcgtaccgagatgacataacagattatgcgtcaaacgaagttgcgatcgattataatgccgcttttaccggcaacgtagcgaaaatgtttcagctgttcgggaaaggccatgttccgctgcctgattttccggagaaggaaacacctgaggacgaatattttgcagaggcatcaatcaacagctccggaaacagctatactgaaatccgggcgcagctcaataaccgttcgggatggccggcaaagaaaaccgatcaattgtctttccgctactacgttgacttgacggaagctgtagaagcgggatattccgccgaagatataaaagtcacagccggctataacgaaggggcctcggtatcagagctgaagccgcatgacgcttcaaagcacatttactatacagaagtcagcttcagcggggttttgatttatccaggcggtcaatccgcccataaaaaagaagtgcagttccgcctttcggcaccagacggaacgtctttttggaacccggaaaatgaccactcttatcagggtctgtcacatgcgcttctgaagacgcggtatattcctgtttatgatgatggacggctcgttttcggacatgagcccggttactagatattgaacttcaagaggaggaacatcatggataataaaacacgttttatgcagctgtatgagcaaattaaaaatccgaacaacggttatttctcacccgaaggaattccctatcactcggttgaaacgctcatatgtgaggcgcccgactacggtcatatgacgacatctgaagcgtacagctattggctgtggcttgaagcgatgtatggccggtacacacaggactggtcaaagctagaagccgcctgggacaatatggagaaatatattatcccggtcaatgaaggagacggaaacgaagaacagccgaccatgaactactacaacccctcaagtccagccacttatgctgcagaacacccctacccagatctgtacccttcagcgctgaccggacagtatccggcaggaaatgacccgctcgatgccgagcttaaagcgacatatggaagcaacgaaacgtatttaatgcattggctgttagatgttgacaactggtatggcttcggaaatcttctgaacccttcgcacactgccgtttatgtgaacacttaccagcggggcgaacaggaatccgtttgggaaacggttccgcatccgtctcaggataatcagacgttcggaaaaccgaatgaaggtttcatgagcctttttacaaaagaaaatcaggctccagcaccgcaatggcgctacaccaatgcaacggatgcagatgcgcgcgccgttcaggcgatgttctgggccaggcaatggggctacagcaatactaattatttagaaaaagctaaaaaaatgggggactttctccgttacggcatgtatgacaaatactttcaagagattggaagtgccgctgacggctcgccttcccgcggtgctggaaaaaatgcatgtcattatttaatggcgtggtacaccgcttggggaggcggattgggacagtatgcaaactgggcgtggcggatcggtgcgagccatgtgcatcaaggttatcaaaaccctgttgcctcttatgcactgtcaacggctgaaggcggattgattccaaattcatccacagcgcgaagcgattgggaaaaggcgctgaaaaggcagctagaactttacacatggctgctttcttcagaaggagccgttgccggcggcgccacgaacagctggaacggcaactacagcgcatatccgcagaatgtcagcacattttacgaaatggcctacacagaagcgcctgtatatcacgatcccccttctaacaattggttcgggatgcaagtctggccgctggaaagggtggcggaactgtattatattttcgcagagaaaggtgacaaatcgtctgaaaacttccacatggcaaagcatgtgattgaaaaatggatcgcatattcacttgattatgtgtttgtgggcgaacggccggttactgacgaagaaggctattatttaaatgatgcgggagaacgcgtccttggcggccaaaacccgcagatc

SEQ ID NO: 770 - protein, 633 aa, Bacillus licheniformis
MSIASFSEKTRAASAEEYPHNYAELLQKSLLFYEAQRSGRLPENSRLNWRGDSGLEDGKDVGLDLTGGWYDAGDHVKFGLPMAYSAAILSWSVYEYRDAYKESGQLDAALDNIKWATDYFLKAHTAPYELWGQVGNGALDHAWWGPAEVMPMKRPAYKIDAGCPGSDLAGGTAAALASASIIFKPTDSSYSEKLLAHAKQLYDFADRYRGKYSDCITDAQQYYNSWSGYKDELTWGAVWLYLATEEQQYLDKALASVSDWGDPANWPYRWTLSWDDVTYGAQLLLARLTNDSRFVKSVERNLDYWSTGYSHNGSIERITYTPGGLAWLEQWGSLRYASNAAFLAFVYSDWVDTEKAKRYRDFAVRQTEYMLGDNPQQRSFVVGYGKNPPKHPHHRTAHGSWANQMNVPENHRHTLYGALVGGPGRDDSYRDDITDYASNEVAIDYNAAFTGNVAKMFQLFGKGHVPLPDFPEKETPEDEYFAEASINSSGNSYTEIRAQLNNRSGWPAKKTDQLSFRYYVDLTEAVEAGYSAEDIKVTAGYNEGASVSELKPHDASKHIYYTEVSFSGVLIYPGGQSAHKKEVQFRLSAPDGTSFWNPENDHSYQGLSHALLKTRYIPVYDDGRLVFGHEPGY

SEQ ID NO: 771 - DNA, 1218 bp, Erwinia carotovora subsp. carotovora
atatctctgacaccatccatattatgactattcattaccgctcttattattattcacatgaataagattttcattctactcatgattaatgcattgaattattctgacactggatggaataaccataaaatgttacgcaccccacactttacattcaaccaatcgtagacaactgatgaatacgtgttagattttaacgtgaaatacccaagcatatatttaaaaggagatttattatgcttacagtgaataagaagccacagcgtattttccgtacattattccccgtgttattttctgccttgttactctcacccctaaccgtttctgcggtcagctcatccaaagacgcagacaaactctattttgagaataataaatattacgtattcaataacgtctgggggaaggatgaagtaaaaggatggcagcaaacggttttctataatagccctaccagcatggggtggaactggcactggccaagcagcagctccagcgttaaagcttatccatcgctggtaagcggctggcactggactgcaggttatacggaaaatagtgggttgccgataaaattatccagtaataaaagtattaccagtaatgtcacttattctatcaaatctaccggcacttataacgccgcttatgatgtatggttccacactaccgataaagccagttgggattcgacaccgaccgacgaattaatgatctggctaaataataccaatgcaggtccagcgggggattatattgaaacggtattcctcggtggtagcagctggaacgtattcaaaggttggataaatgctggtaatggcaaagggtggaatgtcttttcctttgttcgtacctccaataccaacagtgcatcgctcaatattcgtcatttcaccaactatctggttggcaccaagaaatggatgagtaatacaaaatatatcagcagcgttgagtttggtaccgagatctttggcggtgatgggcagattgatatcaccaagtggagcgtagacgtaaaataacggcgctgtcgtcgccttcatttcttccggttcagccccgtatcaatgcgatcgttagggctggaccgaatttattccaccccacacgccttttcatgctcagtctggacggccttgttcaccctttaagcaggcgagtcttcccttccccaacaagattcgtgagctgtggcacgtaaactcgaga

SEQ ID NO: 772 - protein, 264 aa, Erwinia carotovora subsp. carotovora
MLTVNKKPQRIFRTLFPVLFSALLLSPLTVSAVSSSKDADKLYFENNKYYVFNNVWGKDEVKGWQQTVFYNSPTSMGWNWHWPSSSSSVKAYPSLVSGWHWTAGYTENSGLPIKLSSNKSITSNVTYSIKSTGTYNAAYDVWFHTTDKASWDSTPTDELMIWLNNTNAGPAGDYIETVFLGGSSWNVFKGWINAGNGKGWNVFSFVRTSNTNSASLNIRHFTNYLVGTKKWMSNTKYISSVEFGTEIFGGDGQIDITKWSVDVK

SEQ ID NO: 773 - DNA, 2851 bp, Thermomonospora fusca
ggatctcccccgctgctccgtgtcagcgcacgcgaagggcgactacttaaggttcacccattgaacgcaatcggtcaccacgtcgcaccatgctggagacgtcacttcacagagagccaacaccaaactgggagcgctcccacaccggtgtgttcgcacaatccccctggagaccccatgtccgtcactgaacctcctccccgccgacgcggccgtcacagccgggcgcgccgcttcctcacttccctgggagctaccgcggccctcaccgcgggcatgctgggcgtccccttggccacgggaaccgcccacgccgaaccggcgttcaactacgccgaagccctccagaagtcgatgttcttctacgaggcccaacgctccgggaaactcccggagaacaaccgggtctcctggcgcggcgactccgggctcaacgacggcgcggacgtgggactcgacctcaccggcggctggtacgacgccggcgaccacgtgaaattcggcttccccatggccttcaccgcgaccatgctcgcctggggcgccatcgaaagcccggaaggctacatccgctccggccagatgccctacctcaaggacaacctgcgctgggtcaacgactacttcatcaaagcccacccctcgcccaacgtgctgtacgtgcaggtcggcgacggcgacgccgaccacaagtggtggggtccggccgaagtcatgccgatggagcggcccagcttcaaagtggacccctcctgcccgggcagcgacgtcgcagccgaaaccgccgcggccatggccgcgtcctccatcgtgttcgccgacgacgaccctgcgtacgcggccaccctcgtgcagcacgccaagcagctctacacgttcgccgacacctaccgcggcgtgtactccgactgcgtgcccgccggagcgttctacaactcctggtcgggctaccaggacgagctcgtctggggcgcctactggctgtacaaggccaccggggacgactcctacttggcgaaggccgagtacgagtacgacttcctctccaccgagcagcagaccgacctccgcagctaccggtggaccatcgcctgggacgacaagtcctacggcacctacgtgctgctcgccaaggaaaccggcaagcaaaaatacatcgacgacgccaaccggtggctcgactactggacggtcggcgtcaacggccagcgcgtgccctactcccccggcgggatggctgtgctcgacacctggggagccctgcgctacgccgctaacaccgcgttcgtcgccctcgtctacgccaaggtgatcgacgaccccgtccgcaagcagcggtaccacgacttcgcggtgcggcagatcaactacgcgctcggcgacaacccgcggaactccagctacgtggtgggcttcggcaacaacccgccgcgcaacccccaccaccgcaccgcgcacgggtcgtggaccgacagcatcgcctcgcccgcggagaaccggcacgtcctctacggcgccctcgtcggcggtcccggctccccgaacgacgcctacaccgacgaccggcaggactacgtcgccaacgaagtcgccaccgactacaacgccggattctccagcgcgctggccatgctggtcgaagagtacggcggcaccccgctggcggacttcccgcccaccgaggagcccgacggaccggagatcttcgtggaagcccagatcaacacgccgggcaccacgttcaccgagatcaaagccatgatccgcaaccagtcgggctggccggcccggatgctggacaagggcaccttccggtactggttcaccctcgatgaaggcgtggaccccgcggacatcacggtgagctccgcctacaaccagtgcgccaccccggaggacgtccaccacgtctccggcgacctgtactacgtggagatcgactgcaccggggagaagatcttccccggcggccagtcggagcaccgccgcgaagtccagttccgcatcgccggcggccccggatgggacccctccaacgactggtccttccaaggcatcggcaacgaactcgcccccgccccgtacatcgtgctctacgacgacggtgtaccggtgtggggcaccgcccccgaggaaggggaagagcccggcggcggagaaggaccgggaggcggcgaagaacccggcgaggacgtgaccccgccgagcgcgcccggctcccccgcggtccgggacgtcacctccaccagcgccgtgctcacctggtccgcgtccagcgacaccggcggcagcggcgtagccgggtacgacgtcttcctccgcgccggcacaggccaggagcagaaggtgggatccaccacccggaccagcttcaccttgaccggtctagaacccgacaccacctacatcgcggctgtcgtggcccgggacaacgcgggcaacgtctcccagcggagtaccgtctccttcaccacgctggccgagaacggcggcgggcctgacgcctcctgcacggtgggctacagcaccaacgactgggactccggattcaccgcttcgatccggatcacctaccacggcacggccccgctctccagctgggagctctccttcaccttccccgctggccagcaggtcacccacgggtggaacgccacgtggcgccaggacggggccgccgtgaccgccacccccatgtcctggaacagctccctggcgcctggagccaccgtcgaggtcggcttcaacggctcctggagcggcagcaacacacctcccaccgatttcaccctcaacggcgagccctgcgccctcgcctaacacggcaaccgcggccgtccgccccgcgggc

SEQ ID NO: 774 - protein, 880 aa, Thermomonospora fusca
MSVTEPPPRRRGRHSRARRFLTSLGATAALTAGMLGVPLATGTAHAEPAFNYAEALQKSMFFYEAQRSGKLPENNRVSWRGDSGLNDGADVGLDLTGGWYDAGDHVKFGFPMAFTATMLAWGAIESPEGYIRSGQMPYLKDNLRWVNDYFIKAHPSPNVLYVQVGDGDADHKWWGPAEVMPMERPSFKVDPSCPGSDVAAETAAAMAASSIVFADDDPAYAATLVQHAKQLYTFADTYRGVYSDCVPAGAFYNSWSGYQDELVWGAYWLYKATGDDSYLAKAEYEYDFLSTEQQTDLRSYRWTIAWDDKSYGTYVLLAKETGKQKYIDDANRWLDYWTVGVNGQRVPYSPGGMAVLDTWGALRYAANTAFVALVYAKVIDDPVRKQRYHDFAVRQINYALGDNPRNSSYVVGFGNNPPRNPHHRTAHGSWTDSIASPAENRHVLYGALVGGPGSPNDAYTDDRQDYVANEVATDYNAGFSSALAMLVEEYGGTPLADFPPTEEPDGPEIFVEAQINTPGTTFTEIKAMIRNQSGWPARMLDKGTFRYWFTLDEGVDPADITVSSAYNQCATPEDVHHVSGDLYYVEIDCTGEKIFPGGQSEHRREVQFRIAGGPGWDPSNDWSFQGIGNELAPAPYIVLYDDGVPVWGTAPEEGEEPGGGEGPGGGEEPGEDVTPPSAPGSPAVRDVTSTSAVLTWSASSDTGGSGVAGYDVFLRAGTGQEQKVGSTTRTSFTLTGLEPDTTYIAAVVARDNAGNVSQRSTVSFTTLAENGGGPDASCTVGYSTNDWDSGFTASIRITYHGTAPLSSWELSFTFPAGQQVTHGWNATWRQDGAAVTATPMSWNSSLAPGATVEVGFNGSWSGSNTPPTDFTLNGEPCALA

SEQ ID NO: 775 - DNA, 2979 bp, Alicyclobacillus acidocaldarius
cattgacattatagacaaccgacgctataacgaaagtaaatcgattttactaaatcgttttgaagttcatgaaaccgctttctctgtggagggatcgccttgaagagaccttggtctgctgcgctggccgcactcatcgcgctgggaaccggcgcgtcgcccgcgtgggccgccgcccatccgtcgccgaaagtacctgcaggagccgccggccgcgtgcgcgccgccgacgtcgtgtcgacgccgatttcgatggagatccaggtgattcatgacgcgctcacggtgcccgagctcgccgccgtccaggccgcagcgcaggcagcgtccaacctgtcgacatcgcagtggctccagtggctgtatccgaatgccacgccgacgacgagcgcgcagtcccaggctgcgcaggccgtcgccaacctgttcaacctggccacatacggcgctgtatcgacccgcgggagcaacgccgcgcagattttacagacgcttcagtccatttctcccttgctctcgccgcgcgccgttggcctcttctatcaatcgtttttgaccgagatcggccaatcgtccaaagccatcttggcccgccaagcctctagctccattgtcggcaacgcgctcgcgcaggccgcgtcgctctcgcccaccatctccgcctacctgcgccagaacgggctgtctccgtccgatctcgcccgcacctggtcgagctttgaaacgcaggtcgacccgcagggcgccgcgcagaccgcgctcgcgacccgcatctgcacgaacgcgctcggcttcggcgcgcccaccgccagcgccaccatcaccgtgaacactgccgcccgcctccggaccgttcctgccaccgcctttgggctgaacgcggccgtgtgggacagcgggctcaactcgcagaccgtcatctccgaggtgcaggcgctccatcccgcgctcatccgctggcccggcggctccatctcggacgtgtacaactgggagaccaacacgcgcaacgacggcggctacgtcaaccccaacgacacgtttgacaacttcatgcagttcgtgaacgccgtgggcgcctcgcccatcatcaccgtcaactacggcaccggcacgccccagctcgcggccgactgggtcaagtacgccgacgtcacccatcacgacaacgtcctatactgggaaatcggcaacgagatctacgggaacggctactacaacggcaacggctgggaagcggacgatcacgccgtcccgaaccaaccgcagaaaggtaaccccggcctgagcccgcaggcttacgcgcagaacgccctgcagttcatccaggccatgcgcgccgtcgatcccaacatcaaaatcggcgcggtgctcaccatgccgtacaactggccctggggcgccaccgtgaacggcaacgacgactggaacacggtcgtgctcaaggcgctcggcccatacatcgacttcgtcgacgtgcactggtacccggagacccccggccaggagaccgacgccgggctcctcgccgacacggatcagatccccgccatggtggcggagctcaagcgcgagatcaacgcgtacgccggatcgaacgcaaaaaatatccaaatcttcgtgaccgagaccaacagcgtgtcctacaacccggggcagcagtcgacgaatctgcccgaggcactctttttggcggacgatctcgccggcttcgtgcaggcgggcgcggccaacgtcgactggtgggacctcctgaacggcgccgaggacaactacacgagtccgagcctctacggccagaacctgtttggcgattacgggctgctgtcgtccgggcaggccacgcccaagggcgtccaggagccgcctcaatacaccccgctgccgccgtactacggcttccagctcgtgtccgacttcgcgcggccgggtgacaccctcctgggctccgcctcttcccagagcgacatcgacgtgcacgcggtgcgggagcccaacggcgacatcgccctgatgctcgtgaaccgcagtccgtcgaccatctacagcgcagatctgaacgtgctcggcgtgggaccgtacgccatcaccaaggcgctcgtgtacggcgaaggctcgagcgcggttagcccagcgctgacgctgccaaccgcccactcggtcaaactcatgccgtacagcggcgtggatctcgtcctgcacccgctcatccccgcgccgcacgccgctgcgtcggtgacggacaccttggcgctctcctcgcctaccgtgaccgccggcggctccgagaccgtcaccgcgtcgttcagctcggataggcccgtacgcgatgcgacggtggaactcgagctgtacgattcgacgggcgatctcgtcgcgaatcacgaaatgacgggcgtggatatcgcgccaggccagccggtgagcgaatcctggacctttgcggccccggccgccaacgggacctacaccgtcgaggcgttcgccttcgatccggccacaggcgccacgtacgacgccgatacgacgggcgcgaccatcaccgtgaatcagcctcccgcagccaagtacggcgacattgtcacaaagaacacggtcatcacggtgaacggcaccacgtacaccgtgcccgcgcctgacgcaagtggccactatccgtcgggaaccaacatctccattgcgccgggtgacacggtcaccatccagaccacgttcgccaacgtctcgtcgaccgacgcgctccagaacgggctcatcgacatggaggtggacgggcaaaacggcgctatcttccaaaagtactggccgagcaccacgctccttcccggccagaccgagaccgtgaccgccacctggcaggtgccgtcatcggtgagcgcaggcacgtatccgctcaacttccaggcgtttgacacgagcaactggacgggcaactgttacttcaccaacggcggcgtggtcaactttgtggtgaactga

SEQ ID NO: 776 - protein, 959 aa, Alicyclobacillus acidocaldarius
MKRPWSAALAALIALGTGASPAWAAAHPSPKVPAGAAGRVRAADVVSTPISMEIQVIHDALTVPELAAVQAAAQAASNLSTSQWLQWLYPNATPTTSAQSQAAQAVANLFNLATYGAVSTRGSNAAQILQTLQSISPLLSPRAVGLFYQSFLTEIGQSSKAILARQASSSIVGNALAQAASLSPTISAYLRQNGLSPSDLARTWSSFETQVDPQGAAQTALATRICTNALGFGAPTASATITVNTAARLRTVPATAFGLNAAVWDSGLNSQTVISEVQALHPALIRWPGGSISDVYNWETNTRNDGGYVNPNDTFDNFMQFVNAVGASPIITVNYGTGTPQLAADWVKYADVTHHDNVLYWEIGNEIYGNGYYNGNGWEADDHAVPNQPQKGNPGLSPQAYAQNALQFIQAMRAVDPNIKIGAVLTMPYNWPWGATVNGNDDWNTVVLKALGPYIDFVDVHWYPETPGQETDAGLLADTDQIPAMVAELKREINAYAGSNAKNIQIFVTETNSVSYNPGQQSTNLPEALFLADDLAGFVQAGAANVDWWDLLNGAEDNYTSPSLYGQNLFGDYGLLSSGQATPKGVQEPPQYTPLPPYYGFQLVSDFARPGDTLLGSASSQSDIDVHAVREPNGDIALMLVNRSPSTIYSADLNVLGVGPYAITKALVYGEGSSAVSPALTLPTAHSVKLMPYSGVDLVLHPLIPAPHAAASVTDTLALSSPTVTAGGSETVTASFSSDRPVRDATVELELYDSTGDLVANHEMTGVDIAPGQPVSESWTFAAPAANGTYTVEAFAFDPATGATYDADTTGATITVNQPPAAKYGDIVTKNTVITVNGTTYTVPAPDASGHYPSGTNISIAPGDTVTIQTTFANVSSTDALQNGLIDMEVDGQNGAIFQKYWPSTTLLPGQTETVTATWQVPSSVSAGTYPLNFQAFDTSNWTGNCYFTNGGVVNFVVN

SEQ ID NO: 777 - DNA, 282 bp, Clostridium thermocellum
tatataatattcaattaatgttcaaatttgatgtaaatcaatagaaattaatcgaagtaataccattcagcaatccgtttttcctgtcatcactgtaaaaacaaagtatccgttaaatgttgaaaaatttccttgtaagaaatgcatagtgttgaaaaaacagagtttgtgaaaggggagatgcagcaaaaccgatattacgaaaaaaataaatggttaaataatttattaataatttttaaagtttttaataaaagggggagatttaagttgaagaaaatt

SEQ ID NO: 778 - protein, 2615 aa, Clostridium thermocellum
GAATTCGACTTGTGATTTGGGCCGGTGTCTTAAGATGCCGGCTTTTGTTATAAATATTTAATTAGTGAGCAAATCAATTGTAATATGAAGAAAAATATAGTAAGATATTAATAAAAGAATAAAATAATATATTGGTATAATATGTAAATCGGTTGCAGTAATGCTATTCCAATAAAAGATGAAAGATTTCCGTTAATTCATTGAAAGAAACGTTCTGCTGCATTCTATATTCCAAATTATGTTCTTGCTTTATTCTATGTTTTAGCATTCTATGTTTCATTAGTCAAAACAATTTCATTAAGTTAGTTTAAAATAAATATTAACATAAAAATCAATATTTAAGAAAAGGAAGGGATATGATGAGAAAAAATCTTTTTGCAAAAAGAGCGGTGGCTTTCCTGCTCGGTATTGTGATTACGGCTGCAGGGATTGTCTCTTTCAACACCGTAAGCACCAGTGCCGCCGGAGAATACAATTATGCAAAGGCGCTGCAGTATTCCATGTTCTTCTATGATGCGAACATGTGCGGTACAGGTGTTGACGAGAACAGCCTTTTGTCATGGAGAGGAGACTGCCACGTATATGATGCAAGACTTCCTCTGGATTCCCAGAACACCAACATGTCCGATGGTTTTATAAGCAGCAACAGAAGTGTGCTTGACCCTGACGGAGACGGCAAAGTTGACGTGTCAGGCGGTTTTCATGACGCCGGCGACCATGTGAAGTTTGGTTTGCCTGAGGCTTATGCCGCTTCAACAGTGGGTTGGGGTTACTATGAATTTAAAGACCAGTTCCGTGCAACGGGACAGGCCGTCCATGCTGAAGTAATTTTAAGATACTTCAATGACTATTTTATGAGATGTACTTTCAGAGACGCTTCCGGAAATGTTGTGGCGTTCTGTCATCAGGTGGGCGACGGAGATATCGACCATGCATTTTGGGGTGCTCCGGAAAATGACACCATGTTCAGAAGAGGTTGGTTTATTACCAAAGAAAAGCCTGGAACTGACATTATTTCGGCAACAGCAGCTTCTTTAGCAATAAACTACATGAATTTTAAAGACACAGACCCTCAATATGCGGCAAAAAGCCTTGATTATGCAAAAGCTTTGTTTGATTTTGCGGAGAAAAATCCAAAAGGGGTAGTTCAGGGAGAGGACGGACCAAAAGGTTATTATGGTTCAAGCAAATGGCAGGATGACTACTGCTGGGCTGCCGCATGGCTTTATTTGGCAACGCAGAATGAGCACTATTTGGATGAAGCATTTAAATATTATGATTATTATGCTCCGCCGGGATGGATACATTGCTGGAATGACGTGTGGTCGGGAACCGCATGTATTTTGGCGGAAATAAATGATTTGTACGACAAGGACAGCCAGAATTTCGAAGACAGGTATAAAAGAGCTTCCAATAAGAATCAGTGGGAGCAGATAGACTTCTGGAAACCCATACAAGATTTGCTTGACAAGTGGTCGGGTGGCGGTATTACAGTTACACCGGGCGGATACGTTTTCCTCAATCAGTGGGGTTCTGCAAGATACAATACTGCCGCTCAGCTGATAGCTCTTGTTTATGACAAGCATCATGGTGACACACCGTCAAAATATGCTAACTGGGCACGGTCGCAGATGGATTATCTGTTGGGTAAAAACCCGTTGAATCGCTGCTATGTTGTAGGCTACAGCAGCAATTCGGTCAAATACCCGCACCACAGAGCGGCTTCCGGACTGAAAGATGCCAATGATTCTTCTCCGCACAAATATGTGTTGTATGGTGCCCTGGTCGGAGGGCCGGATGCAAGTGACCAGCATGTGGATAGAACAAATGATTATATTTACAATGAGGTTGCCATTGACTATAATGCCGCTTTTGTGGGAGCATGTGCAGGTCTTTACAGATTCTTCGGGGATTCTTCAATGCAGATAGACCCGTCAATGCCGTCGCATAACGTACCTGTACCACCGACACCCACACCTCCTGATACGCAAATTGTATATGGAGATTTGAACGGCGACCAGAAAGTGACTTCCACAGACTATACGATGCTCAAGAGGTATTTGATGAAAAGCATTGATAGGTTTAATACTTCCGAACAAGCTGCGGATTTGAACAGAGACGGCAAAATCAATTCCACGGACTTGACAATATTGAAAAGATATTTGCTTTACAGCATACCGTCTCTCCCTATATAAAACAACCTGTTGTGTCTAAAATAAATAGTTGAAACGATTAATACATATTGAAAATTCTGTTGTGTTAAAAATGAAACGGGTGGCTTTTGGCTGCCCGTTTTGTTTACATTTAACTGCAAATTAAACTTTTCAGATTTGTGCCTGATGTTGAAAAAGATTAATTTACAGATTGATTTTAAGAAAAGTTTAAGAATTTTGTGAAGTTTTTTGTAAGGTTTGCCTGCTATACTGTAAAATAAAAAAGGCAGGTGAGAAAAAATGACAGAAGAAAAAATAAACGGGGGCCGGTACATATGGACAAATATAATATTCTGGTATGCGACGATGACAAAGCTATAGTGGATGCACTGGAAATTTATCTGAAACAGGAAGGGTACAATGTTGTTAAGGCACATACAGGAAAACAGGCATTGAAAGCTT

SEQ ID NO: 779 - protein, 611 aa, Clostridium thermocellum
MRKNLFAKRAVAFLLGIVITAAGIVSFNTVSTSAAGEYNYAKALQYSMFFYDANMCGTGVDENSLLSWRGDCHVYDARLPLDSQNTNMSDGFISSNRSVLDPDGDGKVDVSGGFHDAGDHVKFGLPEAYAASTVGWGYYEFKDQFRATGQAVHAEVILRYFNDYFMRCTFRDASGNVVAFCHQVGDGDIDHAFWGAPENDTMFRRGWFITKEKPGTDIISATAASLAINYMNFKDTDPQYAAKSLDYAKALFDFAEKNPKGVVQGEDGPKGYYGSSKWQDDYCWAAAWLYLATQNEHYLDEAFKYYDYYAPPGWIHCWNDVWSGTACILAEINDLYDKDSQNFEDRYKRASNKNQWEQIDFWKPIQDLLDKWSGGGITVTPGGYVFLNQWGSARYNTAAQLIALVYDKHHGDTPSKYANWARSQMDYLLGKNPLNRCYVVGYSSNSVKYPHHRAASGLKDANDSSPHKYVLYGALVGGPDASDQHVDRTNDYIYNEVAIDYNAAFVGACAGLYRFFGDSSMQIDPSMPSHNVPVPPTPTPPDTQIVYGDLNGDQKVTSTDYTMLKRYLMKSIDRFNTSEQAADLNRDGKINSTDLTILKRYLLYSIPSLPI

SEQ ID NO: 780 - DNA, 1672 bp, Bacillus circulans
gaattctgtctgcgaaactattaatttacaataatatacaattctattatactcgtagtagatatggataatatctcattttatatggagacaattacatatctattcttcttggtattcatacatacaagcagcagttccctcgtttccatcgattcattggaagggtggtggtttattcgaaaccggtttaccagactgtagtggtaatggctttccaattcgaaaaacaaaggagcgaagcgtgatgaaagtattccgaaattcgatcatccgtaagtcggctgtgttgttctgtgctgttctactgatcttgccagccggattgtctctggcggccaacaagccgtttccccagcatacgtcgtatacgagcggttcgattaaaccaaacaatgtgacgcagtccgcgatggacaatgcggtcaagagcaaatggaacagctggaaagggtctttcttgaagcctgcagctacagggcaatattacgtaaaatacaattcggcgggcgagacggtgtccgaggctcatggctacgggatgctcttcaccgttctgatggcgggttacgacagtaacgcacagtcgtatttcgacggactttatcgctattacaaggcgcatccgagtaataacaatccgtatctgatggcttggaagcagaacagcagctttcagaatatagggggggccaattcggcaacggacggcgatatggacattgcttacgcactcctgcttgcggacaagcagtggggaagcagcggatcgattaattacctccaggcagctaaggatatgatcaatgcgatcatgagcaatgacgtgaatcagtcgcagtggacgctgcgcctaggcgattgggcaaccagcggcattttcgacaccgccacgcggccatcggatttcatgctgaaccatatgaaggcattccgtgcggctaccggcgatgcccgttgggagaacgtcattaacaaaacctatacgatcatcaactccatctataacggttacagctccaataccggtttgcttccggatttcgtcgtcatgtcgggcggcaattatcagcctgcggcagcggaattcctggagggggcgaacgacggaaaatactattacaattcgtcccggactccttggcggattacgaccgactatctgatgaccggcgatacgcgcgcgctgaatcaattgaacaagatgaacacgttcattaaatcagccactagcagtaatccagccaacgtcaaggcagggtataacctgaacggcaccgcgctggtgacatataacagtggggcgttctatgctccttttggcgtaagtgcgatgacttcgtccagccaccagagctggctgaattcggtatggagttacacggcgaacgcatctgcagagggatattatgaggaaagcatcaagctgttctcgatgatcgtcatgtcgggtaactggtggacatattaaaacattacgttgtttaatttcatgtaaatataaaacaaaaccccgatccgtattggatcggggttttggtaggactttcctaccaataattgatttataacaaaaaatgataagaattcgcattgatatttcgtgttgagcagtggtaatatcttatcaaaatataaaatggtttatattattttaaattaaacaaccaga

SEQ ID NO: 781 - protein, 407 aa, Bacillus circulans
MKVFRNSIIRKSAVLFCAVLLILPAGLSLAANKPFPQHTSYTSGSIKPNNVTQSAMDNAVKSKWNSWKGSFLKPAATGQYYVKYNSAGETVSEAHGYGMLFTVLMAGYDSNAQSYFDGLYRYYKAHPSNNNPYLMAWKQNSSFQNIGGANSATDGDMDIAYALLLADKQWGSSGSINYLQAAKDMINAIMSNDVNQSQWTLRLGDWATSGIFDTATRPSDFMLNHMKAFRAATGDARWENVINKTYTIINSIYNGYSSNTGLLPDFVVMSGGNYQPAAAEFLEGANDGKYYYNSSRTPWRITTDYLMTGDTRALNQLNKMNTFIKSATSSNPANVKAGYNLNGTALVTYNSGAFYAPFGVSAMTSSSHQSWLNSVWSYTANASAEGYYEESIKLFSMIVMSGNWWTY

SEQ ID NO: 782 - DNA, 2152 bp, Bacillus amyloliquefaciens
ctcagtcgactcatgtgtgtcttattcaatagagatagagcaaattgacaggcttttacacctctcaaaaacaagaaattaggttgatagacaatcatgagaaagatttttacaatgagttcgagctcataagaagtgaagagccaaaatgatgcgaaggaggaaaagatcagatatgaaacggtcaatttctatttttattacgtgtttattgattgcggtattgacaatgggcggcttgctgccttcgccggcatctgcagcagggacaaaaacgccagtagccaagaatggtcagcttagcataaaagatacacaactcgtaaaccgagacggcaaagcggtacaactgaaagggatcagttcacatggattgcaatggtatggcgatttcgtcaataaagacagcttaaaatggctgagagacgattggggcatcaccgttttccgcgcggcgatgtatacggcagatggcggttatattgacaacccgtccgtgaaaaataaagtaaaagaagcggttgaagcggcaaaagaacttgggatatatgtcatcattgactggcatatcttaaatgacggcaacccaaaccaaaataaagagaaggcaaaagaatttttcaaggagatgtcaagtctttacggaaacacgccaaacgtcatttatgaaattgcaaacgaaccaaacggtgacgtgaactggaagcgtgatattaaaccgtatgcagaagaagtgatttccgttatccgcaaaaatgatccagacaacatcatcattgtcggaaccggtacatggagccaggatgtgaatgatgctgcagatgatcagctaaaagatgcaaacgtcatgtacgcgcttcatttttatgccggcacacacggccaatctttacgggataaagcaaactatgcactcagtaaaggagcgcctattttcgtgacggaatggggaacaagcgatgcgtctggaaatggcggtgtattccttgaccaatcgcgggaatggctgaattatctcgacagcaagaacatcagctgggtgaactggaatctttctgataagcaggaatcatcctcggctttaaagccgggagcatctaaaacaggcggctggccgcttacagatttaactgcttcaggaacattcgcaagagaaaacattcgcggtaccaaaggttcgacgaaggacggccctgaaacgccagcacaagataaccccacacaggaaaaaggcgtttctgtacaatacaaagcagggtatgggcgtgtgaacagcaatcaaatccgcccgcagcttcacatgaaaaataacgggaataccaaggttgatttaaaaggtgtcactgcccgttactggtataacacgaaaaacaaaggccaaaactttgactgtgactacacgcagattggatgcggcaatctgacccacaaatttgtgacgctgcataaacctaagcaagatgcagatacctatctggaactggggtttaaaacaggaacgctgtcaccgggagcaagcacagggaatattcagcttcgtcttccaatgatgactggagcaattatgcacaaagcgacgattattcctttttccaatcaaatacatctaaaacaacgagaaaaatcacattatatcagtcaaggaaaactgatttggggaacagaacccaattagtaagctttaggcggacatcagcaacgatgtccgcttttatcatcttaaacagcaatacaaggaggtttacgtggcggatgaaactctgaaacagcatatgggcctgtacaaatgttgttagcaatctcaagaaagccaaggagtagatgtgattcactgaacatatgatgtaatgaaaagcgtttgtagcgcaatgtatgtatttcacatccgccacttttattacgtaagggggaacaagagaatgaaaaagtatgacgcatttccagagccaattggcggctatactgtcggccgaacccagatggattttgagtacacggcatcagatcatacaaaaagagaactgacggtgtttgtgtactatccgtccgacagcagcgaagggaaggctacatcaacgtacatgtttcctgaagtctgcgaaatgcttgatgagcagcccgcttctcactgcgttgtggatggagctcactc

SEQ ID NO: 783 - protein, 499 aa, Bacillus amyloliquefaciens
MKRSISIFITCLLIAVLTMGGLLPSPASAAGTKTPVAKNGQLSIKDTQLVNRDGKAVQLKGISSHGLQWYGDFVNKDSLKWLRDDWGITVFRAAMYTADGGYIDNPSVKNKVKEAVEAAKELGIYVIIDWHILNDGNPNQNKEKAKEFFKEMSSLYGNTPNVIYEIANEPNGDVNWKRDIKPYAEEVISVIRKNDPDNIIIVGTGTWSQDVNDAADDQLKDANVMYALHFYAGTHGQSLRDKANYALSKGAPIFVTEWGTSDASGNGGVFLDQSREWLNYLDSKNISWVNWNLSDKQESSSALKPGASKTGGWPLTDLTASGTFARENIRGTKGSTKDGPETPAQDNPTQEKGVSVQYKAGYGRVNSNQIRPQLHMKNNGNTKVDLKGVTARYWYNTKNKGQNFDCDYTQIGCGNLTHKFVTLHKPKQDADTYLELGFKTGTLSPGASTGNIQLRLPMMTGAIMHKATIIPFSNQIHLKQREKSHYISQGKLIWGTEPN

SEQ ID NO: 784 - DNA, 1797 bp, Clostridium saccharoperbutylacetonicum
tgttagtattctctttaaaaaaattaatgagaaatgtttcttactatttggataatatttattatctttactttggccgttttttttatacaaatactttaaaccacaaaacaaactgcttcccctaattccccatttttatatatatttgtattaaattaactttaatgttacaatgttcttagtatattttccttaatattacattagttctataaactttattgttcttaatatttaaataaaaatccatgaagggaggaaaaaactatcttttaaaagtttatagtaaataaaaaaaaattattaatgtaaaaatatactaagtatagaatatttataatagggggtattaacttgttttcaaaaatcaaaaaaattaatttttttaaaaaaacattttcttttttaattgctgttgtaatgatgttgtttacagtattaggaacaaatacttataaagctgaagctgcaacaacatcttttggtggacagctcaaggtagttggaagccaattatgcgactcaaatggtaaacctattcagcttaagggaatgagttcacatggtcttcaatggtatgtcaattttgtaaattatgatagtatgaaatttttaagagataagtggggcgttaatgttattcgtgctgctatgtatactaatgaaggtggatatatctctaatccatcatcccaaaaagagaaaataaaaaaaatagttcaagatgctatagatttaaatatgtatgtaataattgactggcatatattaagtgataataatcctaatacctataaggaacaagcaaaatcatttttccaagagatggctgaagaatatggaaaatattcaaatgtaatatatgaaatatgtaatgaaccaaatggtggcactaattgggctaacgatataaaaccttatgccaattacataattcctgctataagagcaattgatcctaataatataataatagtaggtacaagtacttggagccaagatgtcgacattgctgctgataatccattacgttattcaaacataatgtacacttgccacttttatgctggaacacatactcagtcgcttagagataaaataaattatgcaatgtcaaaaggcatagctatatttgttacagaatggggaacatctgatgcctcaggtaatggcggaccatatttagatgaatcacaaaaatgggttgactttatggcaagtaaaaatataagttggactaactgggcattgtgtgacaaaagtgaagcttctgctgctttaaaatctggttcaagcacaactggaggatggacagattctgatcttactacttcaggcttatttgtaaagaaaagcataggaggaagtaatactacttctcaaacatcagctccaacttttagtttacagtcaggaacatacgattcagctcaaactgtaaccttaacttcttctgataatgattctgttatacattacactacagatggaacaactcctacaagttcttcacctgtatatactagtcctataactatatcaaagactacaacagttaaggcttttactacaaaaactggcatgactgattctaacataacatcagctgtttacactatttctaatactgatcctgttaagcaagtttcagctccaacttttagttacaatcaggaacatacaattcagctcaaactgtaacattaacttcttcggataatgactctgttatacattacactacagatgggacaactcctacaagtttttcacctgtatatactgttcctatat

SEQ ID NO: 785 - protein, 448 aa, Clostridium saccharoperbutylacetonicum
MFSKIKKINFFKKTFSFLIAVVMMLFTVLGTNTYKAEAATTSFGGQLKVVGSQLCDSNGKPIQLKGMSSHGLQWYVNFVNYDSMKFLRDKWGVNVIRAAMYTNEGGYISNPSSQKEKIKKIVQDAIDLNMYVIIDWHILSDNNPNTYKEQAKSFFQEMAEEYGKYSNVIYEICNEPNGGTNWANDIKPYANYIIPAIRAIDPNNIIIVGTSTWSQDVDIAADNPLRYSNIMYTCHFYAGTHTQSLRDKINYAMSKGIAIFVTEWGTSDASGNGGPYLDESQKWVDFMASKNISWTNWALCDKSEASAALKSGSSTTGGWTDSDLTTSGLFVKKSIGGSNTTSQTSAPTFSLQSGTYDSAQTVTLTSSDNDSVIHYTTDGTTPTSSSPVYTSPITISKTTTVKAFTTKTGMTDSNITSAVYTISNTDPVKQVSAPTFSYNQEHTIQLKL

SEQ ID NO: 786 - DNA, 1509 bp, Erwinia chrysanthemi
gatcaaccggcaatttatccacggcatcaaattcgatctgtcttttcccgtatcattggcaataccggcattctgattacaggccgtgttttgaatgcggtatgcagttttgtctatgtcgcatggacatcccagacattgggattgaacctgtttggtgtcatgcttttgattacgacttttgctaccctgatttcggatattacccgttttcagtcatggcaaaccttgctgcattacggttcaaaagcttttcaggaaaaagattttaaccaatttgatgatgtccttgccttttgcatcagagccgatttttttagtgcggcgataggtatgttggtagggttaggcggtatcttgattttaggcacttcaagattgggatggcctgccgaggtcaagccagatgccttgctttgtatgctgattatactttttatgaatatcggctggtccaaccgggatgttgcggctgtgtaaccgctttaaactggtcactatttatgagtttattacgacctgcgtcagaaccggaggttgtggcattggttattggcttcatatgcctttggggtattttttgtttatatggtgcctgacgcaattcacgctttttgtcacctgtagttacgctggcatttatctctttcaccaatatacggagcgagcatttccgataagaaaaatatttcagagaaaaacgcccgttgaagggatgtggaaattcactttaagcgtcagttttaatgaaatcctagactccattttccagcagggtggcacccttgctattggtagctcactgggggctggggaagccgctgtctatcgggtcgcgcgccagattagtaacggtttatccaaaccagcacagatgatgatcggctaacatgcatccaccggcagcaccggccgttttatgcttgggattattgatatgccgaaaaggatacaacatctggaagaaaaagacgaaggccggaataagcgcccattctgcaaaattgttacaacttagtcgcgccatcagggaatgaaaaatcaatccgtctttttcggcatgagcaaccaacattttcaaggtatcatcctgatgcgcaatatcggcatcggttagccataaccattttacctgtccggcggccttaataccttgatcagatggttcgtggtgttgttaccttgccgaagggcaccggtaaaaatgttcgcgtcggtgttttcgcccgtggcccgaaagctgaagaagctaaagctgctggtgcagaagttgtcggcgcagaagacctgatggaagccattcagggcggcagcattgatttcgatcgtgatgccctttatactgaaattgccttgcgctgccataatgaagcagcctccggtgttttggcagatttaagcgctgcctgattttcgtgatcctctagagtctatgaaatggagattcatttatgcctctctcttattcggataaccatccagtcatccgcaagcttggccgtaatccat

SEQ ID NO: 787 - DNA, 1797 bp, Clostridium saccharoperbutylacetonicum; identical to SEQ ID NO: 784

SEQ ID NO: 788 - protein, 448 aa, Clostridium saccharoperbutylacetonicum; identical to SEQ ID NO: 785

SEQ ID NO: 789 - DNA, 2450 bp, Pseudomonas sp. YD-15
cccggggatcctctagagtcgacctgcaggtccggggtcggcgtcgcgctgccgggtcgcggcgtcgcgccagccgtcggcggcgtgcggcggcggcccagcgcgcgacgtcacgcaggccccgcgcgtcgagcaggtggtcccagtgggggtgcgtcgaccacaccgcgaccggccgccagccccgcgcgcgcacgcgtcgcgcgccggacctcacgcgccgtgaccgccgggtcgacgaccaggcagcggccgtcgcgctcgacgacggtcgtggtggtcgcgtagacggacgacaccgcgacgtggacgccgtcggccacctcgacgagggcgcgcggccgggtcatccgggtctcctcgcggtcggtgcggcgccgtcggcgctggtcagggacgcgtccaggctagacggcggtgctcccggcgccggtgggcccggtcccggcacctgcgcgcgggcttaatcgattccgacgccaccgacccccgggcgcggcgcactcccccacctaccgtggtcgaagcgctcccgccacggccggaccccagcgtcggggtggccccgccgcacgtcacccgtcgtctgccaccagaggagcagccatgtcaccgatcacccgacggcgcgcgcggcgccgcgcctgggccgcgggcctgccggtcgccaccgcgctcacggtcgcgggcgtcaccgcccccgcggccgtcgccgcacccgaccccggcacgcccgtcaaggtcaaccaggtcgcgtacgtgcccggcgtcgccaaggtcgcgacgctcgtgagcacgtcgaccacgcccgtcgcgtggaccctgaaggacgcgtccgggcgcaccgtcgcgcagggcacgtcgaccgtcaagggcgccgacgcgctgtccggcgaccgcacgcacctcatcgacttctcgtcgtacgacaccgccggtgccggctacgtgctgtcggcgggcggcgccaccagccacccgttcgacatctcggccgacccggtgaagaagctgcgcgccgactcgctcgcgttcttctaccaccagcgctcgggcatcgcgatcgaggcgcagtacgtcggcagcacgtacgcacgcgccgccgggcacctgggcgtggcccccaaccagggcgacacgagcgtcggtgccggcagctcgtgcgggtacagcctggacgtgcgcggcggctggtacgacgcgggcgaccacggcaagtacgtcgtcaacggcggcatcgcgacgtggcagctgcagaacacgtacgagcgcacgctgcacgtcgcgggtgccgaccgcgcggcgctgggcgacggcaaggccgcgatcccggagcgcggcaacggggtcccggacgtgctcgacgaggcacggtgggaggtcgagttcctgctgcgcatgcaggtccccgcgggccgcaccgacgccggcatggtgcaccacaagatgcacgacgagaactggacgggcatcccgacgatcccggacccacagcagcggcgcatcctcgcgcccgtcagcacggcggccacgctcaacatggcggccgtcgcggcgcaggcgtcgcctgtgggcgccgtcgacgcgggcttcgccgcggggccgctgtccgccgcgcgcaccgcgtacgccgcggccaaggcgaacccgaaccgcatcgcctccgacgccgacggcacgggcggcggctacggcgacccgtcggtgaccgacgagttctactgggccgccgccgagctgttcgcgaccacgggcgaggccgggtaccgcgccgacgtcacgggctcgccgttctaccggggcacgagcttcgcggagcgcggctacgactggggctggaccggcggggctgggcgacacgacgtcgcgctcgtcccgaccgacctgcccgcggccgacgtggcgcgacgcgcgccgcgatcgtcgtccttcgccgacgcgacgctgggccggctcgcgaaccaggcgtaccccgcgcccaacaacgcgggcaccgtgtactactggggctccaacggccaggtcgtgaacaacgcgaacgcgctggccctcgcgtacgacttcacgggccagacgaagtaccgcaccgccgtgtacggcgcgctggactacctgcagggccgcaacccgctcaaccagtcgtacatcacgggctacggcgagaacccggtgcgcaacgtgcaccaccggttctgggcgcaccaggccgacgcgtcgctgcccacggctcccccggggtcgctcgccggcgggcccaacagcgagctgcaggacccgctcgcggccgcgcagctcgcggcctgcgcgccgcagaagtgctacgtcgaccacatcgaggcgtactcggtgaacgaggtggccatcaactggaactcggcgctggtgtggctcagcgcgtgggcgccgagcaggcgggcggcagacgcccgagcctgatcgaattcactggc

SEQ ID NO: 790 - protein, 609 aa, Pseudomonas sp. YD-15
MSPITRRRARRRAWAAGLPVATALTVAGVTAPAAVAAPDPGTPVKVNQVAYVPGVAKVATLVSTSTTPVAWTLKDASGRTVAQGTSTVKGADALSGDRTHLIDFSSYDTAGAGYVLSAGGATSHPFDISADPVKKLRADSLAFFYHQRSGIAIEAQYVGSTYARAAGHLGVAPNQGDTSVGAGSSCGYSLDVRGGWYDAGDHGKYVVNGGIATWQLQNTYERTLHVAGADRAALGDGKAAIPERGNGVPDVLDEARWEVEFLLRMQVPAGRTDAGMVHHKMHDENWTGIPTIPDPQQRRILAPVSTAATLNMAAVAAQASPVGAVDAGFAAGPLSAARTAYAAAKANPNRIASDADGTGGGYGDPSVTDEFYWAAAELFATTGEAGYRADVTGSPFYRGTSFAERGYDWGWTGGAGRHDVALVPTDLPAADVARRAPRSSSFADATLGRLANQAYPAPNNAGTVYYWGSNGQVVNNANALALAYDFTGQTKYRTAVYGALDYLQGRNPLNQSYITGYGENPVRNVHHRFWAHQADASLPTAPPGSLAGGPNSELQDPLAAAQLAACAPQKCYVDHIEAYSVNEVAINWNSALVWLSAWAPSRRAADARA

SEQ ID NO: 791 - DNA, 4126 bp, Bacillus subtilis
ctcgagtggagcaagaggcttcttaactcgttcatgaatgtagaatagaaacaatggaaaagctaaattaaagaaaaaactttggggttattgcatcaatctgcgataaccccttaaatgctaactacatagataaaggaagataaaatgaacaattataaactaatgattcaatatgatggtggtcgatacaaaggttggcagcgtcttgggaacggtgaaaatacgattcaaggtaaaattgaaacggttttatcagagatggtaggtagaaaaatagagattatagggtctggtagaacagatgctggtgtccatgctcttggacaagtggctaatgtaaaattaagcgaaaattttacagtaaaagaggttaaagagtatttgaatcgttatttgcctcatgatatcagtgtgactgaggtgacgctagttccagatcgttttcactcaaggtataacgcaaaggacaaaacctatctttataaaatttggaatgaggattatactcatccgtttatgcgtaagtacagcttgcacatcgaaaagaaattacatattgataacatggtaaaagcaagtcaacttttcgtaggagaacatgattttacagctttttctaatgctaaatctaaaaagaagacaaatacgagaacgattcactctataactattcaagataatcaaggatttatagacattagggtttgtggagatggttttctttataacatggttagaaaaatggtagggactttgattgaggttggtctaggtgaaaaggaacctgaacaagtacttaccattttagagtcaaaagatagaagccaagcaggatttgccgatgcaaccggcttatatttagagggaatttctttttaaattgaatacggaataaaatcaggtaaacaggtcctgattttatttttttgaatttttttgagaactaaagattgaaatagaagtagaagacaacggacataagaaaattgtattagttttaattatagaaaacgcttttctataattatttatacctagaacgaaaatactgtttcgaaagcggtttactataaaaccttatattccggctctttttttaaacagggggtgaaaattcactctagtattctaatttcaacatgctataataaatttgtaagacgcaatatacatcttttttttatgatatttgtaagcggttaaccttgtgctatatgccgatttaggaagggggtagattgagtcaagtagtcataatttagataacttataagttgttgagaagcaggagagaatctgggttactcacaagttttttaaaacattatcgaaagcactttcggttatgcttatgaatttagctatttgattcaattactttaataattttaggaggtaatatgatgttaagaaagaaaacaaagcagttgatttcttccattcttattttagttttacttctatctttatttccgacagctcttgcagcagaaggaaacactcgtgaagacaattttaaacatttattaggtaatgacaatgttaaacgcccttctgaggctggcgcattacaattacaagaagtcgatggacaaatgacattagtagatcaacatggagaaaaaattcaattacgtggaatgagtacacacggattacaatggtttcctgagatcttgaatgataacgcatacaaagctcttgctaacgattgggaatcaaatatgattcgtctagctatgtatgtcggtgaaaatggctatgcttcaaatccagagttaattaaaagcagagtcattaaaggaatagatcttgctattgaaaatgacatgtatgtcatcgttgattggcatgtacatgcacctggtgatcctagagatcccgtttacgctggagcagaagatttctttagagatattgcagcattatatcctaacaatccacacattatttatgagttagcgaatgagccaagtagtaacaataatggtggagctgggattccaaataatgaagaaggttggaatgcggtaaaagaatacgctgatccaattgtagaaatgttacgtgatagcgggaacgcagatgacaatattatcattgtgggtagtccaaactggagtcagcgtcctgacttagcagctgataatccaattgatgatcaccatacaatgtatactgttcacttctacactggttcacatgctgcttcaactgaaagctatccgcctgaaactcctaactctgaaagaggaaacgtaatgagtaacactcgttatgcgttagaaaacggagtagcagtatttgcaacagagtggggaactagccaagcaaatggagatggtggtccttactttgatgaagcagatgtatggattgagtttttaaatgaaaacaacattagctgggctaactggtctttaacgaataaaaatgaagtatctggtgcatttacaccattcgagttaggtaagtctaacgcaacaagtcttgacccagggccagaccaagtatgggtaccagaagagttaagtctttctggagaatatgtacgtgctcgtattaaaggtgtgaactatgagccaatcgaccgtacaaaatacacgaaagtactttgggactttaatgatggaacgaagcaaggatttggagtgaatggagattctccagttgaagatgtagttattgagaatgaagcgggcgctttaaaactttcaggattagatgcaagtaatgatgtttctgaaggtaattactgggctaatgctcgtctttctgccgacggttggggaaaaagtgttgatattttaggtgctgaaaaacttactatggatgtgattgttgatgagccgaccacggtatcaattgctgcaattccacaagggccatcagccaattgggttaatccaaatcgtgcaattaaggttgagccaactaatttcgtaccgttaggagataagtttaaagcggaattaactataacttcagctgactctccatcgttagaagctattgcgatgcatgctgaaaataacaacatcaacaacatcattctttttgtaggaactgaaggtgctgatgttatctatttagataacattaaagtaattggaacagaagttgaaattccagttgttcatgatccaaaaggagaagctgttcttccttctgtttttgaagacggtacacgtcaaggttgggactgggctggagagtctggtgtgaaaacagctttaacaattgaagaagcaaacggttctaacgcgttatcatgggaatttggatacccagaagtaaaacctagtgataactgggcaacagctccacgtttagatttctggaaatctgacttggttcgcggtgaaaatgattatgtaacttttgatttctatctagatccagttcgtgcaacagaaggcgcaatgaatatcaatttagtattccagccacctactaacgggtattgggtacaagcaccaaaaacgtatacgattaactttgatgaattagaggaagcgaatcaagtaaatggtttatatcactatgaagtgaaaattaacgtaagagatattacaaacattcaagatgacacgttactacgtaacatgatgatcatttttgcagatgtagaaagtgactttgcagggagagtctttgtagataatgttcgttttgagggggctgctactactgagccggttgaaccagagccagttgatcctggcgaagagacgccgcctgtcgatgagaaggaagcgaaaaaagaacaaaaagaagcagagaaagaagagaaagaagcagtaaaagaagaaaagaaagaagctaaagaagaaaagaaagcaatcaaaaatgaggctacgaaaaaataatctaataaactagttatagggttatctaaaggtctgatgcagatcttttagataacctttttttgcataactggacatagaatggttattaaagaaagcaaggtgtttatacgatattaaaaaggtagcgattttaaattgaaacctttaataatgtcttgtgatagaatgatgaagtaatttaagagggggaaacgaagtgaaaacggaaatttctagtagaagaaaaacagaccaagaaatactgcaagctt

SEQ ID NO: 792 - protein, 244 aa, Bacillus subtilis
MNNYKLMIQYDGGRYKGWQRLGNGENTIQGKIETVLSEMVGRKIEIIGSGRTDAGVHALGQVANVKLSENFTVKEVKEYLNRYLPHDISVTEVTLVPDRFHSRYNAKDKTYLYKIWNEDYTHPFMRKYSLHIEKKLHIDNMVKASQLFVGEHDFTAFSNAKSKKKTNTRTIHSITIQDNQGFIDIRVCGDGFLYNMVRKMVGTLIEVGLGEKEPEQVLTILESKDRSQAGFADATGLYLEGISF

SEQ ID NO: 793 - protein, 821 aa, Bacillus subtilis
MLRKKTKQLISSILILVLLLSLFPTALAAEGNTREDNFKHLLGNDNVKRPSEAGALQLQEVDGQMTLVDQHGEKIQLRGMSTHGLQWFPEILNDNAYKALANDWESNMIRLAMYVGENGYASNPELIKSRVIKGIDLAIENDMYVIVDWHVHAPGDPRDPVYAGAEDFFRDIAALYPNNPHIIYELANEPSSNNNGGAGIPNNEEGWNAVKEYADPIVEMLRDSGNADDNIIIVGSPNWSQRPDLAADNPIDDHHTMYTVHFYTGSHAASTESYPPETPNSERGNVMSNTRYALENGVAVFATEWGTSQANGDGGPYFDEADVWIEFLNENNISWANWSLTNKNEVSGAFTPFELGKSNATSLDPGPDQVWVPEELSLSGEYVRARIKGVNYEPIDRTKYTKVLWDFNDGTKQGFGVNGDSPVEDVVIENEAGALKLSGLDASNDVSEGNYWANARLSADGWGKSVDILGAEKLTMDVIVDEPTTVSIAAIPQGPSANWVNPNRAIKVEPTNFVPLGDKFKAELTITSADSPSLEAIAMHAENNNINNIILFVGTEGADVIYLDNIKVIGTEVEIPVVHDPKGEAVLPSVFEDGTRQGWDWAGESGVKTALTIEEANGSNALSWEFGYPEVKPSDNWATAPRLDFWKSDLVRGENDYVTFDFYLDPVRATEGAMNINLVFQPPTNGYWVQAPKTYTINFDELEEANQVNGLYHYEVKINVRDITNIQDDTLLRNMMIIFADVESDFAGRVFVDNVRFEGAATTEPVEPEPVDPGEETPPVDEKEAKKEQKEAEKEEKEAVKEEKKEAKEEKKAIKNEATKK

SEQ ID NO: 794 - DNA, 2839 bp, Clostridium thermocellum
tttcccttatggaggtgattttgtaaaatacaaacaataaatataatcaaatatattattaaattattttgaaggaggaatcatggtgaaaaagacattatgctttgtactgactttggctatgctgacggcatttattcttcctcaggggattgtgtccgcagcaggaagctataactatgcggaagcacttcagaaagccatttacttttatgagtgtcagcaggccggccctctacctgaatggaaccgcgttgagtggcgtggcgacgcaacaatgaatgatgaggtacttggtggatggtatgacgcaggtgaccatgtcaagtttaatctgcctatggcgtattcggcggcaatgcttggctgggctctttatgagtatggcgatgacattgaggcatcggggcagagacttcatcttgaaaggaaccttgcctttgcccttgactatcttgttgcctgcgacagaggtgacagtgtcgtttatcagataggtgacggtgccgctgaccataaatggtggggttctgcggaagttattgaaaaagaaatgacaagaccttactttgtaggaaagggatccgccgttgtaggtcagatggctgcagctttggctgtaggttccatagttcttaaaaatgatacatacctcagatatgcgaagaagtatttcgaacttgcagatgcaacaagaagtgacagcacttatactgctgcaaatggtttctacagttcccacagcggattctgggatgagctgttgtgggcttccacttggctctatcttgcaacaggtgatagaaattatcttgataaagctgagtcctatattccaaaattaaaccgtcagaatcagaccacagatatagaatatcagtgggcacattgctgggatgactgccactatggagcaatgatcttgcttgcaagagctacaggtaaagaagagtatcacaaatttgcacaaatgcatctggattggtggacacctcaaggttataacggaaagagagttgcatatactcccggcggacttgcgcatcttgatacctggggaccgttgagatatgctacaactgaagcattcctcgcttttgtatatgccgattcaataaatgacccggctctcaagcaaaaatattataattttgcgaaaagccagattgactatgcattgggttcaaatcctgacaacagaagctatgtagtcggatttggaaacaatccgccacagcgtcctcaccacagaaccgctcatggaacttggttggataaaagagatattccggaaaagcacagacatgtactttacggtgctctggtcggaggacccggaagagatgacagttatgaagacaatatagaggattatgtaaaaaatgaagttgcctgcgactacaatgcaggttttgtaggcgcgctctgcagattgactgctgaatacggcggaactcctcttgcgaacttcccgccaccggaacaaagagatgatgagttcttcgtagaagcggctataaatcaggcaagtgatcatttcactgaaataaaagcattgctcaacaaccgttcatcctggccggcaagacttattaaggacctttcatacaactattatatggatttgactgaagtttttgaggcaggttacagtgttgacgatattaaagtaacaataggctattgcgaaagcggtatggatgtcgagatttcgccgattactcatttgtatgacaatatttattacataaaaatatcatatatcgacggaaccaatatttgtccgataggtcaggaacagtatgccgctgagcttcagttccgtattgcggcacctcaaggtactaaattctgggatccgacaaatgacttctcatatcagggacttaccagagagttggcaaagacaaaatatatgcccgtttttgacggagcaacaaaaatctttggagaagttccaggcggctttgaaccggttccttcaccttcgccgactcctgctcaatataaagtcggtgacttaaacggtgacggagtggttaattcaactgacagtgtaatattgaaaagacatataattaaattttctgaaataacagatccagttaaattgaaagctgctgatcttaacggagatggcaatataaactccagcgatgtttcattaatgaagagatatctgctccgtataatagataaatttccggtagaatagtttggcatttgaaatactctttgagtacgggctgtcctgaaaaacaggacggctcttttgtttatttttattaatgttgagaattgaaataaaataattatcatggtatactttttcattatatttcttcatttgacaagtttagcgtaagaattttaattttatcggagaatgtttgagcaagaggaaatatgatgtgaagggtgagtgtaatgaagttataccttgttgccggttcaaaaagcgatatgctgaaaagatccctggaagaaaaccaggatattgaagtggtatatattgcaaactcttttgaagaagctcttaattatttgattagaaacagcctggattttgacagcatgctgttgatggatgccggcattgtcgaaaatacagaaagttttacggataccctgaacactttaagagagttgatgaacagctcatatccaaatattacaataaagttcattacaaaagatccggtatatcttaataattacaataatattgtgtccggggacgataggtttgaagtgtattttgttgacaatgtgagaataccgatatcatatattcaggaagtctgcttgaagaaccagaacaaaaaatcttcaagaattc

SEQ ID NO: 795 - protein, 710 aa, Clostridium thermocellum
MVKKTLCFVLTLAMLTAFILPQGIVSAAGSYNYAEALQKAIYFYECQQAGPLPEWNRVEWRGDATMNDEVLGGWYDAGDHVKFNLPMAYSAAMLGWALYEYGDDIEASGQRLHLERNLAFALDYLVACDRGDSVVYQIGDGAADHKWWGSAEVIEKEMTRPYFVGKGSAVVGQMAAALAVGSIVLKNDTYLRYAKKYFELADATRSDSTYTAANGFYSSHSGFWDELLWASTWLYLATGDRNYLDKAESYIPKLNRQNQTTDIEYQWAHCWDDCHYGAMILLARATGKEEYHKFAQMHLDWWTPQGYNGKRVAYTPGGLAHLDTWGPLRYATTEAFLAFVYADSINDPALKQKYYNFAKSQIDYALGSNPDNRSYVVGFGNNPPQRPHHRTAHGTWLDKRDIPEKHRHVLYGALVGGPGRDDSYEDNIEDYVKNEVACDYNAGFVGALCRLTAEYGGTPLANFPPPEQRDDEFFVEAAINQASDHFTEIKALLNNRSSWPARLIKDLSYNYYMDLTEVFEAGYSVDDIKVTIGYCESGMDVEISPITHLYDNIYYIKISYIDGTNICPIGQEQYAAELQFRIAAPQGTKFWDPTNDFSYQGLTRELAKTKYMPVFDGATKIFGEVPGGFEPVPSPSPTPAQYKVGDLNGDGVVNSTDSVILKRHIIKFSEITDPVKLKAADLNGDGNINSSDVSLMKRYLLRIIDKFPVE

SEQ ID NO: 796 - DNA, 3058 bp, Clavibacter michiganensis subsp. sepedonicus
gtcgacgtcggcggaggcatgttccgcggccgccgtctccgccggcccccggctggctgacgcgagcgcgccgcgaaggcgatgagctcggcgctgtgctgcaccatccacgccacggccgtattcagcgacggctcgcgacggatccagatgcgttggccctggccgttgcgggcatcggcgtagagctcgaaggtgaacggatccccgagctccgcccggtgccggatcacgtacccgagcacggggcggtcctcgacctggatccgccagtagccgacctcgaggtgcgcccacgggtgcgcgccgacgttacgcacgaggctgtcgatgccgtcgagcttgctcttgaccttgctcaccgggtgctgtccttcgtcgattcgatcgagtgggagcgtccggccgcgctcgtcggcgagcgtaaggatgtccactgacgtccaggccacaacatccgcgccgaagccctgggtgggtcatacatttcaggcatccacgcggttaggtagtttcgatgcgtgcggattcatgccggtcggagaagactgtcttgatcgcatcgcatcgcatctcacgctccggggccgcattccgtctctcagtcattgtaagatgatcggcttctgagggggttacgctggcggcgcaccgtacccctcaaggaatgacctgctgggtaatgtttcgggcttcaggagtgcgtgtgaaaagcgtctgtggaagtggttttgagagcggtcgaatggttttcgtatgatccttacatgactgttcgacaagttagtgtacccttagtgtccaagctcttccttttctttgcattggcggtcggcgccacgtttggcgcattcgcggcgcctgccttagccgccaccgcagcggggaccggtgcggtggcctcgccgcctggatggctgcacacggcgggtgggaagatcgtcaccgcctccggcgctccgtacacaatccgtggcatcgcgtggtttggcatggagacgtcatcctgcgcgccgcacggcctggacaccatcaccctcgcgggtggcatgcagcacatcaagcagctgggattcacgaccgtgcggctgccgttctcgaaccagtgcctcgcggcatctggcgtcacgggtgtcgatgcggacccatcgcttgccggtctcacaccgctgcaggtcatggatcacgtcgtggcttcggcgaaggccgccggacttgacgtgatcctcgaccagcaccggccggactcgggcggccagtccgagctctggtacacctcggagtaccccgagtcacggtggatctccgactggcggatgctcgcgaagcggtacgcctccgaccccacggtcatcggtgtcgatctccacaacgagccgcacggggcggcgacgtggggtaccggggcagccacgaccgactggcgggcggcggccgagcggggcgggaacgcggtattggccgagaacccgaagctcctcgtgctcgtcgagggaatcgaccaccaggccgacggaaccggcacctggtggggcggtgcgctggactccgcggccactgcatccgtgcgcttgaccgtcgcgaatcgcgtcgtctattccccgcacgactacccctcgaccatctacggccagccctggttctccgcatcgaattatccgacgaatcttccgggaatctgggacgcccactggggatacctggcaaagaaggacatcgcccccgtcctcgtgggcgagttcggtacgaagctcgagacggcgagcgacaagcagtggctcaacaccctcgtcggatacctgtcgagcacggggatcagctcatcgttctgggccttcaacccagacagtggcgacaccggcggcattgtgaagtccgattgggtgaccccggagcaggcgaagctcgacgcgctggcgccgatcctgcatccggcacccggagcgggtccgggatctagcggatccgggtcgcagccaggtccggcgaagccgggcgcggtatcagtgaagtggcagcctggcgggtcctgggcatccggctacgtggcgaaccttgacgtcaccgcgacaggcgctgtcacgggatggaccgtctcatgggccagcccgaaaaccaccagcgtcgtcaacagttggggcatgcgctgtagcgtcgcctccaacaccgtgacctgcaccagcacggactgggcaagcaagctcgccgccggccagaccgttcgcgtcggcgtgcagttggcgggtggacccgctcccgcttcgcctcgaatcagtgtcacggcggccggaacgcctccgtcccaagccacgcctccgtcccaggccacgcctccgtcccaggccacgacgcacggccgtgccacgcactactcgctcggtaccggtaacacgatcgcgaacggcaactgctccatgccggctgtccccgccgaccgaatgtacgttgcggtcagcagccccgagtacggcggagccgccgcgtgcgggtcgcacctcctcgtcacgggccccaagggcaccgtccgcgtccaaatcgtcgaccaatgccacgaatgcgagatcggacatctcgatctgagcgaagaagcgttccgtgccattggcgacttcgatgccggtatcatcccaatcagctacaccaccgtccgggatccgtccgtgcccgccgtcgccgtccgggtcaaggagggctcatcccgatggtgggcaggtctgcagattctgaacgccggcaaccgcatcgaccgtgttgaagtccgagccggtgggcagtggctgcccctgagtcgcactgactacgggtactgggtgacaccttcaccaattccggacggcccgatgaccgttcgcgtgactgaccaatacggtcgctcggtcgttctccccggaatccgaatagcaccaggggagacccagagtacggcgcgccggatctatcagatgcactgagccctgatcgcacgacctccacatgtacgcggcgatggctccagggatgcgtccccggagccatcgcgcgttagtcgccgcactcgcctgctgtgaaggctgagctc

SEQ ID NO: 797 - protein, 727 aa, Clavibacter michiganensis subsp. sepedonicus
MTVRQVSVPLVSKLFLFFALAVGATFGAFAAPALAATAAGTGAVASPPGWLHTAGGKIVTASGAPYTIRGIAWFGMETSSCAPHGLDTITLAGGMQHIKQLGFTTVRLPFSNQCLAASGVTGVDADPSLAGLTPLQVMDHVVASAKAAGLDVILDQHRPDSGGQSELWYTSEYPESRWISDWRMLAKRYASDPTVIGVDLHNEPHGAATWGTGAATTDWRAAAERGGNAVLAENPKLLVLVEGIDHQADGTGTWWGGALDSAATASVRLTVANRVVYSPHDYPSTIYGQPWFSASNYPTNLPGIWDAHWGYLAKKDIAPVLVGEFGTKLETASDKQWLNTLVGYLSSTGISSSFWAFNPDSGDTGGIVKSDWVTPEQAKLDALAPILHPAPGAGPGSSGSGSQPGPAKPGAVSVKWQPGGSWASGYVANLDVTATGAVTGWTVSWASPKTTSVVNSWGMRCSVASNTVTCTSTDWASKLAAGQTVRVGVQLAGGPAPASPRISVTAAGTPPSQATPPSQATPPSQATTHGRATHYSLGTGNTIANGNCSMPAVPADRMYVAVSSPEYGGAAACGSHLLVTGPKGTVRVQIVDQCHECEIGHLDLSEEAFRAIGDFDAGIIPISYTTVRDPSVPAVAVRVKEGSSRWWAGLQILNAGNRIDRVEVRAGGQWLPLSRTDYGYWVTPSPIPDGPMTVRVTDQYGRSVVLPGIRIAPGETQSTARRIYQMH

SEQ ID NO: 798 - DNA, 14184 bp, Clostridium cellulovorans
aaagttcctttaaaatccaaaatccttgatataaataaaatcaatcaatcaattaatcaatcaatgaatttaattttaggagggtctatgaatgcgtagtaaaaaattaatagcttgcgtaacagcattagccacagtactaagtgtttcaacagttgctacttcagttgctactactaaaactgttagtgcagcaacaatggtaagtgttggagaattaatcagaaacaataaatttgacaatggtgttgggttaccatggacagttgttgagtcttacccagcaaaatctagctttgaaatcaaagatggaaaatactatgtaacagttcttcaagacggtgtagaaggaagatgggatgttcaattccgtcacagaggtcttgttatagaacaaggacataaatacagagttaaatttactgtaactgctgataaagattgttacgtttatccaaaaataggtgaccaaggtgaaccttataaagaatattggaactataactcatatcaaagagtacaattaagagctggtgttccaacaacaattgatcaaacttttgaaatgagagatgcaacagctagaacagctgaatttgcaattcaccttgctggtgactgtaaggcagcaacattcccttatacatttacttttgatgatatgtatgtatcagatccacaattcccaggatatgtagctgaaactccagaaccaacaaacgcaataagagttaaccaagtaggttacttaccaggcgtagcaaagaaagctacagttgttacaaaagcaacaactccaataaactggtacttaaagaatagttcaggtgttcaagttgctactggcacaacaacagttaaaggcttagatagcgcttcaggagataatgtacatattatagatttctcaaattacacaactccaggaactggctacacattatcagttgattcaacaaacgttgattcaacaattaatgattctgcttcaagtatgccttttactataggaacagatttatattctaaaatgaaacatgaatcaataaaatacttctacttaaacagaagtgctattccaataacaatgccatatgctgaacgtactgatttaactcgtgcagcaggacatacaacggatttgatgccaactgatgcaagttcaagtgatccaagtccttggtataaagaaaattatagtctagatgttacaggtggatggtatgacgctggagaccacggtaagtacgttgttaacggtggtatctctgtttggacaatgatgaaccaatatgaaagagctaagaaattaggacaagctaatgtagctccatttgcagataatacaatgaatatcccagaaagcggaaacggctatccagatattcttgatgaatcacgtttccaaatggatttaatgatgaagatgcaaattccagctggtaaaacttacgctggtatggctcaccataaaggtcatgatgaaagatggacagctcttgcaatccgtccagaccaagatccaatgaaacgttacttaaaagcaccaagtacagctgcaacattaaaccttgctgctacagctgcacaagcttcacgtttatggaaaggtattggtgatgcatattctgctaagtgtttagcgtctgctgaaactgcatggaaagcagctaaggctagtccagcaatatatgcaccatttgaaaatggtcctggtggtggagcttacggtgatgacaacgtaacagatgaattctactgggcagcagcagaactttatgaaacaactggaacatcagaatatcttgactacatgaagaataattcttcagataaattcttaaagatgccaactacattaactggtggagaagacaaaggattatcaggtgctttcgactggggtaatgttgctggtttaggaacaatttctcttgctattggtgataaattagatgctacatcaaaagcaactgtaagagctaatgttgctgccgctgctgatgtatttgtagctaatacaaatagtgaaggttatggtactccaatggttcaaggaccagcatttgaggaaaaggatgcaagtggaaaagttataagaacaataactggctatccatggggttcaaactcattcgtagctaaccaagctatcgttatgggttacgcttatgactttacaaaaggcgatgcagataagaaaaaatctaattcgtactttaatgggttaacaagtgctatggactatttattaggacgtaacccaatggtacaatcatacgttactggatatggttctaacccactagaaaatccacatcaccgtttctgggcataccaagctgacaacacattccctaaagctccagcaggatgtttatcaggtggtcctaacacaggattacaagatccatgggttaaaggctcaggttggggagttggtactaagccagctgctaaatgcttcatggacaatatagaatcatggtcaactaatgaaatcacaatcaactggaatgcaccaattgcatggatgtcttcatacatggatttaaataaggatgcaaaaacaatagatattactattccacctactacatcaggtgatgtaaacggagatactaagataaatgctatcgatttagctatgttaaagaaatatatcctagacaattcaactgtaatcaaaacagctaacgctgatatgaataatgatggaaaaattaatgctatagatttagctttattaaagaagaaacttctttcttaataaaaatagctaagaattaagtttttcctaagagattactagataaataataaaataaaaactgtagaaagttcacctttttacagtttttattctaaagatttttattaaaagatgtaaggactaattaataaaggagatacagacatgaaaaaaaacattcttataattacattagtagtgagtattggcgtagtagttgcaggcgttgcaatgattaattcaaacagtaaagattctagtagtgcagttgtagaaccagtagattctaataaaactacgactgatgacactaatagtactgatactaataacacttcttcaaaggctagtgaaaatactgataatagtacaaataatactgataatactgaaaatagtactccagctaccaataataatccatctggggagactgttagtaatccaggacaatcaagtgaagttaaagcatctaatgaatcagtttcagtagcaattggtgaagtaaatggttctgtaggaagtgaaattattgttccggttactattacagatacaccaaaatcaggaataggaagttgtgattttaaggttaattatgataccacagcacttgaattaattgagattactcctggagatgtattagtaaatcctgaagcaaattttagtagtagttcagatcaaaatttaggaatagctagttttttatatttagataatacttttgaaaaagaagcaataactaaaaatggtgtctttgctaatataaaatttaaggttaaggatggagctacaggtgctaaagaagtagcgtttaaatctattggagctttcaccgataacgcacttagcagccatgaagtaaaaactacaaatggaaagtaaatattaattagtatctttactgagacattcatcactttagaaaaaatataaataataggctctttgtataaaggagcccaataattatcttatcaatctagatgaaaatagaaatgtttaagaatgtaaacggtataggagaaatttatcaggatataacggggagaaaaaataattctgagatttaaactattctgagaaaaattagaaatatataaatagggggattttttatgaaaaagattatagcaacggcaacgtcgttgtgtttatcagcaggaataatattaccagcaactgaagctgccgcagcacctaaatttgactattctgatgcttttgggaaatcaattatgttctatgaagctaattggagcggaaaggtagaaaataatagatttgattggagaggagatgcctttttaaaggatggtgccgatgttggacttgacctttcaggaggtttttttgacgcaggagatcatgtaaagtttggattaccacaagcttatgccgcttcaactcttggttgggggtattttgcgtttaaggatgcttataagtcaaatggacaagatgcatatatgcttaaaattttaaaacattttacagattatttcttaaagtgttacccagataataatacattctattatcaagtgggagatggagatttagaccatgcttactggggaccaccagaaattcaaccaacagcaagacctacaaaatttaaagcaactccatcagatccagcttcagatgtatgtggtaatactgctgcagcacttgcaataatgtatttaaattataaggatgtagatgctacctatgcaaacaaatgtttaacagctgcaaagaatctatattcattaggtaaaaattataaaggattaagtcacggccaaagctattatgtatctacaagctattatgatgatttggcttggggtgctgtttggctatatcaagcaacaaacgataatagctatatgactgatgcaaattcattccttagtcaaataaatgctgatggtgacaaagtttatacatcatattggacacattgttgggataatgtatggactggagtaatttataagatggcagaggttacaggaaaagcaaactataaagcttcagttgaaaacaatttaaattattggatgaataatataaaaactactgctggtggattaaagtttgctacagattggggttcgttaagatactcatcaactcaagccatgttagctttaatacagtacaacagaactaaggaacaaaaatatttagactttgcaacacgtcaaatagattacatattaggagataatccaagaagcagttcttatgtagttggatttggaaataactatcctaagttcccacatcatagaggagctagcggaagacttgaaccaggtgaaatgaaaactatgccagaaaagcatattcttactggagcgttagttggtggacctgacggaaatgatcaatacaaagatgatataaataattatcaacaaacagaagttgctatagattatagtgctggttttgtaggtgcaatggcaggtattacaaagtatttggatcctgcaccaataataatagatccaataacatatgcgctaggtgatgtaaataaagatggtaaagtaaatgccatagacttagctattcttaaaaagaaccttttaaatggtattactggagacttaactgtttctgatatgaataaggatggcaaggtaaatgcaatagatttagcacttcttaaaaagttacttcttggttaaatttattattaaaattttattaagaagataaaaataaggtgtatataaagagagactccaatgtctaatttctataactaacaatagttttccaattgctttagaattaactaaagcaattggagacttagaatagagttctaaaaagcttatcaatagcagagaaactaccatcgtattaatagcgatattgaactagaaattgagaaaagcttaggaatagttcatatgttgtaggctttagaaataactatccgagggttcaatattataagaattatagaggaatgcttttaaactgtaagtttattaaaataagaaatacttttaaagaatttttataaagatttagtttggacactatagtctgcggatagttattctgatgaggaagttagctatttatgaggagagacttttattattacgtgtttatatattgaatagtaaacttattttgtaaaataaggaattgatatttattaagtggatacgaataaggatggagagtttaacacttttaatttagtgttaaaataaataatttatgaaaatgtggagggtaaagaaatgaaaaggagaattttatcaattttaactgctgcgttagtaacagctactattattccttttagtgccagtgcagcaacaactttaggtgatgtcaatgttgatggaaaagtaaattccatagacatggcgattgtaaaacaatacatattaggaacaaaaactttttcagatgctgaattgaaggcggcagatgtcgatgcaaacggcaaagtaaacgctatagatttagctttgtacaaacagtacatattaggaagtataactaagtttccaggagataaaggtgtagttgacaatagaactactacaggacctggaataacatggatggatggttataaattattccctgtaggtgtaaactacggttggaacaattggtgctatgagttttctgatagcaattgggatacaaactttgctaagatgaagagcgatatggatgctatgaatttaaaaggagttaagtctcttagatggtgggtattccctgatcttgcatttggtccaacttggtcaggtactggaaaaggaagcttatgtactggtcttccaaataattgggtaaaccatatgaaggcggtttgtgattacgcacttacaaaaaacattaaaatttattggacattaactagttttgatgctgcaagacaagatggaacagatcatcattcagatatattcacaaatgaagctgtaagacaaagtttctttgataatgctgttaaaccaattgttactgcacttggaaatcatgaagctgttatgggttgggattgtataaatgaaccagaatggatcatcaaaaaagaggacaatggtgaaccaaaagccagtggatatgatatatatgctctttctgatataagaaattatgttcaatcaacaacagctttaattcatcagtatgcaaaacaacctgtaagtgtaggtagtgcaagtatgaagtggagtggagcacaatttagtctttggacaggtttaggattagatttctatgatttccattggtatgattgggcaacaccatggtttaatccaatgacaacaccagcgtcatctttaaagcttgataagccagtaattataggtgaaatgatgtcagatactttaagttcttctttgaaagttgatcataaagttgttatggatgctattatggctaatggatattcaggatatatgacttgggcatggaatgatggtagttgtggaaactttattggtagcaatttcactaattttggagctcaacatactgatattgttaggtaaaattatttaataagtttttttatggtatatttcctacgagtgttatggaaagtctttataacacttgtaggagtaaataatattttttgcaactttttaaatctatttcaaaaagttaatgctaattctcagtacaaatataagttttatatctatattgattttacccatataagaatgaagtagctgtaatctttagggtatatctgtatagttttttgcatatttttaaactcttttatattgggtttgaaagggtttataaatataaacctactggagataagaagtatcatacaacaccaaggtagtttatttggtaaaaaagagaacaaaaacttggacaccattaactgactgggtagattttcaggattggaaccttcttggttgtgaaagtatggcagctgaccctgttgaaactaatcgtgtatacatagccgttggtacatacaacaatgattggacagatatgaatggcgataaagtagtaaatgtaattgattttgcattattaaagaaaaaactattagcttagtaataaaaaagacgctgctgtagaaatacggcagtgtttttgttgtatagtcttagaatatagttaactaaaaatacgtgtaagtaaatatattcaaaaattataaataatttataaacaaatttaaaataggcacctaaatttaaaaatgaaaacgaataactatagtggagtgtttattttacataaaagtgtttatttttacataataacatttaattaataaaatgtaaaatatacagagaaggatgattaatatataaataatcataagtgcatttaaagggggagtataaatgaatagaaaaaaaataacagcatacgcaactgcaatagtaacagtactaagtattccgacagttgctacttctgttgtgactagcaaatctgttagtgcagcaacgaattttgattacagagaaataatagcaaacaatacattcgataacaataatgcgacaccatggacccttgttcagaattatccagcaatagctaaaatggtagcaaaagatgggaaatgctctgtaacagtccttaatgatggagtagagggaagatgggatgttcaattacgtcacagaggtatagttttagaccaagggcataagtatagagttagattcacagtaactgctgacaaagattgttacatatatcccaaaataggtgaccaaggtgaaccatatagagaatactggaactataactcatatcaaaggatacaattgaaagctggtgttccaacaactgttgatcaaacttttgaaatgaaggatccaacagctaaaacagctgaatttgcatttcatcttgcaggtgactgtaaagcggctacttttccttatacattcacattcgatgatatttatttaacagacccaaatcgtataccaccaccgccaccaccagaagagccaacaaatgcggtaagagttaatcaagttggatattttacaaatcttcaaaagaaagctactgtggttactaaagcaactagtccaataacttggtatctaaaaaacagtgctggtgttcaagtggctactggtgaaacaaaagttttgggagctgatgctgcttcaggtgataatgtgcatattatagatttctctaattatacaaccgaaggctcagactatacattatcagttgaccaatcaaatattgattcattaatttgtaattcagcttcaagtttaccttttgctataggcaaagaattgtataataaattgcaaaaggatgctatgaaatatttctacttaaatagaagtggaattcctataacgatgccttatgctgaacgcactgatttaactcgtgtagcaggacatacattagatgtgatagcaactgatgcaagttcaactgatccaagtccttggtataaagaaaattatagtttagaggttacaggtggatggtatgatgatactagatataataagtctgttattaatggtagtatctctgcttggacaattatgaatcaatatgaaagagctttaaaagcaaataaggttagtgttataccatttgctgataatacaatgaatattcctgaaagtggtaatggatatccagatatccttgatgaagtacgtttccaaatggaaatgatgatgaagatgcaaataccagctggtaaaacttactctggtatggttcatcatagggcgaaagatgagaggtggataccacttgcaactcggccagatcaggaccaaatgaaacgctacttagagccgccaagtacagcagcgacactagaccttgctgctacagctgcacaatcttctcgcttatgggcaaaatatgattctacatttgctaaccagtgtttggtttctgctgaaactgcatgggctgcagccattaagaatccagcaatatatgcaccacttcaaagtagtttttctggaacttatggtgataccaatatagcagatgaattttattgggcagcagctgagctttatgaaacaactggaaagcaacagtaccttgactaccttaagaataattgtcaagataaattcttaaaaataccaactaaaatagtaggtggagaagccaacggagtatcaggttgtttcgactcgggggatgttactgggctgggaactatttctcttgctattggggataagttagatgttgcatcaaagactactgcaagagctaatattgcagcagcagctgatgtttttgtggctaatacacaaaaagaaggttatggtactccaatggatcaaggaattgtaggacaagtagtggatcagaacggatatgtaacaaaaccaatagaaggttatccatatgcatcaaattcttatgtaactaacgaagctatagtcatgggttatgcttatgactttacaaaaaatagaaattatttaaatggtgtagttagtgcaatggattatatattagggcgtaatccaatggtacaatcctatgttacaggatatggatcaaatccagttgaaaatccacataacgttttttgggcataccaatatgacaatacatttcctaaggcaccagcaggctgtatggccagtggtcctaattcaggtttacaagattcatgggttaaagcttcaggctggacacctggaagtagaccagcagctaagtgcttcatggataacatagagtcttggtcaacaaacgacttatcaaatagctacaatgcatcactggcttgggtttcttcatatgtgaatttaaattcgttaccagaatcaataaaaggtgacattaataatgatgcaaaaattaatgctatagatttagctttgctaaagaaatatattctaaacaatgacataccaatcgttgcaattaatggtgatatcaacggtgatggtatcattaatgctattgatttattactattaaagaaacaactgcttgcataagtttaaaaacaaagaagcatctctataaaatatggagatgtttctttgtttttgtatagaagttctatactatataaaaatgatatattaggatatcaaaggtgctttaagaattttttgttagaatttatgctgtttacatttaagtatataagattaacttttataacaatttatgaataagtttaaaaatgcaccgaaatttaaaaatgagaacgaataactatagcgaagtgtttattttacataagagtgtttatttttacaaattagaaatatttacatggaatgtaaatagcgcagaaaaagcagttgatatatcaacaattataggtttatttaaagggggagtataaatgaacaagaaaaaaataatggcttacgcaacagcgttcgtaacattactaagtgttccaacagttgttacttctgttgtggctactgaatctgttagtgcattcacaaggatcaatttaggggaattaatcagaaataacacatttgattataatgttgcaacaccatggcaacttacaaaaatttctccagcagaagctagtattgaagttaaggatggaaaatgctatgtgacaatacttaaaaatggtgaagatggaagatgggatattcaattgcgtcacagaggtatagttttagaccaaggtcataaatacagagttagatttacagtaactgctgataaggattgctatatctatccaaaaatagctgatcaaggtggaagttttaatgaatattggaattataacacatatcaaaagatacaattaaacgctggtgttccaacaacaattgatcaaatttttcaaatgaacaatgcaacaactaggtcagctgaattcgtatttgatcttgcaggtgattgtcaagcggctacttttccgtataaacttacatttgatgatatttatttgacagatctaaaccatatacagtactaatacaaccaaaatagcaaatgcggtaagaattaattaagttggctatttgatattaaagaagcaaatgactgtttaagctgaaaaaaataaaatagaggagtattgctatagaatgtggcagtactcctctattgtgctttaatggaaaattataaactgttttacaataatgcattagatagtggattaatataaaagatgttttggcgattttacctaacctttttaattaaagaataaaatataaaggttaggtatatttatgatagaatcttcataatttaacctgttgtgctagcagataagttttcattaaaaggatatttataccatgattttaggcagtcctatcctattgtctcatatactgtttttggaaattattatccgaatactaattctttaatctttgatatttctatacctatattaaaaaatttatttataaaatagcaaagattatgagctaatattttatttgatattcttgtggcaaatccccaagttgattttgtaagaaccctctgcatatttaattgctcggagagctgagaaaaagtagtttctactctacgacgagccttgaatatcaactgcctaaaaggttttaaaagtttagttttactattgttacgatttattgttaaaagacgaatgtaccttgtttcttttaattgcgaagcaactttttgacctatatatcctttatcacctattagtatatcaatctctgaattagctgtgagttcccagacgacatctctgtcatcaatatttgctgctgttacagtaaaatctgtgatatagccatcgagggctactaaagcatgtaatttgaatccataatatgtttcttttttcgaagcgcatcgcccgtaggcagcctccggcttaaaagctttatggaaatgagctctcccaaacttacacacaggaattggcatactatctgcaattctcattcggtcatattgatagttaagaaatttcgttaactctttacgaatttcatcaatgactcgaaataatgactttctaactctatgaaacctcggcctactacaaaagttgggaaataagtctcgtaggtttttagagcaaaatccaaaccatgctttttcagagtcaatggttaagagttcacctactaaagaaatcgtaattatttcgctatcagtcattactgatttagcgatgttacgacgatttttaataaatgttggagttactttttggtaaaagtcatcaattataacataagtgacaacaataaaatcttttaagtcatttattgttatggtagaatctttattaaactctggcatataggttagcctcctatcattagattagtggtgttttttaatgataggttagcaaatatgctggagtttttctatttgtaagtattgccagcgtatttaactagcacaacgggttaatttagagcctcaaggtttacaaatcagtgaaaaagtaataggattagtaaaggataaaatattaaagtaattaacgaaacttggtaattttaatatttatataagcttaagaaagggaatttcccagataaactattatttaaggagagaaaacatggtaataattcaatcaatccaaagtataatgactatacttttgatgatttctgtcggctacatattagataggaaaaaatggtttaatgaagaatctaaaaaacttttatcaaagcttgtagtaaatatttcacttccagcatatatgctgcaaaacatagtaacaaatttcacgagagaaaagctttttgaaatgtcaggtgggttattaataccatttgtatcaataggaatttgttatatagttgcagtggttatagctaaggcaataaaggtacccaaaaaaagatttgggacttttgtaactttattctttgtatcaaacacgatttttattggactacctgtaaatttagctttatttggagagcagagtataccatatgtattcttgtactatattgcaaatactacgttcttttggacattaggagtttattcaataagtaaagatggtgatgctgaagatacgaaattatttagtatagcatcattaaaaaaatgcttttctccgccaatgctaggatttattataggaatcatatttgttattataaatcttaaaattccattttttattctggatacatgtaagtatttgggaaatttaacaacgcctttgtcgatgctttttataggagcaactatggctgctgttgatttaaaaacaattaggatagataaggaaatgatattcttaaatatcggtaggagtgttatttcaccacttatagtaataatattaggattatttataaaaggacctatgcttatgaaagaagtttttatcatacaagcagctatgccaggaatgataaatatatcaattatttctaaggcatataatgcagattatgaatatgctgcag

SEQ ID NO: 799 - protein, 892 aa, Clostridium cellulovorans
MRSKKLIACVTALATVLSVSTVATSVATTKTVSAATMVSVGELIRNNKFDNGVGLPWTVVESYPAKSSFEIKDGKYYVTVLQDGVEGRWDVQFRHRGLVIEQGHKYRVKFTVTADKDCYVYPKIGDQGEPYKEYWNYNSYQRVQLRAGVPTTIDQTFEMRDATARTAEFAIHLAGDCKAATFPYTFTFDDMYVSDPQFPGYVAETPEPTNAIRVNQVGYLPGVAKKATVVTKATTPINWYLKNSSGVQVATGTTTVKGLDSASGDNVHIIDFSNYTTPGTGYTLSVDSTNVDSTINDSASSMPFTIGTDLYSKMKHESIKYFYLNRSAIPITMPYAERTDLTRAAGHTTDLMPTDASSSDPSPWYKENYSLDVTGGWYDAGDHGKYVVNGGISVWTMMNQYERAKKLGQANVAPFADNTMNIPESGNGYPDILDESRFQMDLMMKMQIPAGKTYAGMAHHKGHDERWTALAIRPDQDPMKRYLKAPSTAATLNLAATAAQASRLWKGIGDAYSAKCLASAETAWKAAKASPAIYAPFENGPGGGAYGDDNVTDEFYWAAAELYETTGTSEYLDYMKNNSSDKFLKMPTTLTGGEDKGLSGAFDWGNVAGLGTISLAIGDKLDATSKATVRANVAAAADVFVANTNSEGYGTPMVQGPAFEEKDASGKVIRTITGYPWGSNSFVANQAIVMGYAYDFTKGDADKKKSNSYFNGLTSAMDYLLGRNPMVQSYVTGYGSNPLENPHHRFWAYQADNTFPKAPAGCLSGGPNTGLQDPWVKGSGWGVGTKPAAKCFMDNIESWSTNEITINWNAPIAWMSSYMDLNKDAKTIDITIPPTTSGDVNGDTKINAIDLAMLKKYILDNSTVIKTANADMNNDGKINAIDLALLKKKLLS

SEQ ID NO: 800 - protein, 240 aa, Clostridium cellulovorans
MKKNILIITLVVSIGVVVAGVAMINSNSKDSSSAVVEPVDSNKTTTDDTNSTDTNNTSSKASENTDNSTNNTDNTENSTPATNNNPSGETVSNPGQSSEVKASNESVSVAIGEVNGSVGSEIIVPVTITDTPKSGIGSCDFKVNYDTTALELIEITPGDVLVNPEANFSSSSDQNLGIASFLYLDNTFEKEAITKNGVFANIKFKVKDGATGAKEVAFKSIGAFTDNALSSHEVKTTNGK

SEQ ID NO: 801 - protein, 522 aa, Clostridium cellulovorans
MKKIIATATSLCLSAGIILPATEAAAAPKFDYSDAFGKSIMFYEANWSGKVENNRFDWRGDAFLKDGADVGLDLSGGFFDAGDHVKFGLPQAYAASTLGWGYFAFKDAYKSNGQDAYMLKILKHFTDYFLKCYPDNNTFYYQVGDGDLDHAYWGPPEIQPTARPTKFKATPSDPASDVCGNTAAALAIMYLNYKDVDATYANKCLTAAKNLYSLGKNYKGLSHGQSYYVSTSYYDDLAWGAVWLYQATNDNSYMTDANSFLSQINADGDKVYTSYWTHCWDNVWTGVIYKMAEVTGKANYKASVENNLNYWMNNIKTTAGGLKFATDWGSLRYSSTQAMLALIQYNRTKEQKYLDFATRQIDYILGDNPRSSSYVVGFGNNYPKFPHHRGASGRLEPGEMKTMPEKHILTGALVGGPDGNDQYKDDINNYQQTEVAIDYSAGFVGAMAGITKYLDPAPIIIDPITYALGDVNKDGKVNAIDLAILKKNLLNGITGDLTVSDMNKDGKVNAIDLALLKKLLLG

SEQ ID NO: 802 - protein, 425 aa, Clostridium cellulovorans
MKRRILSILTAALVTATIIPFSASAATTLGDVNVDGKVNSIDMAIVKQYILGTKTFSDAELKAADVDANGKVNAIDLALYKQYILGSITKFPGDKGVVDNRTTTGPGITWMDGYKLFPVGVNYGWNNWCYEFSDSNWDTNFAKMKSDMDAMNLKGVKSLRWWVFPDLAFGPTWSGTGKGSLCTGLPNNWVNHMKAVCDYALTKNIKIYWTLTSFDAARQDGTDHHSDIFTNEAVRQSFFDNAVKPIVTALGNHEAVMGWDCINEPEWIIKKEDNGEPKASGYDIYALSDIRNYVQSTTALIHQYAKQPVSVGSASMKWSGAQFSLWTGLGLDFYDFHWYDWATPWFNPMTTPASSLKLDKPVIIGEMMSDTLSSSLKVDHKVVMDAIMANGYSGYMTWAWNDGSCGNFIGSNFTNFGAQHTDIVR

SEQ ID NO: 803 - protein, 876 aa, Clostridium cellulovorans
MNRKKITAYATAIVTVLSIPTVATSVVTSKSVSAATNFDYREIIANNTFDNNNATPWTLVQNYPAIAKMVAKDGKCSVTVLNDGVEGRWDVQLRHRGIVLDQGHKYRVRFTVTADKDCYIYPKIGDQGEPYREYWNYNSYQRIQLKAGVPTTVDQTFEMKDPTAKTAEFAFHLAGDCKAATFPYTFTFDDIYLTDPNRIPPPPPPEEPTNAVRVNQVGYFTNLQKKATVVTKATSPITWYLKNSAGVQVATGETKVLGADAASGDNVHIIDFSNYTTEGSDYTLSVDQSNIDSLICNSASSLPFAIGKELYNKLQKDAMKYFYLNRSGIPITMPYAERTDLTRVAGHTLDVIATDASSTDPSPWYKENYSLEVTGGWYDDTRYNKSVINGSISAWTIMNQYERALKANKVSVIPFADNTMNIPESGNGYPDILDEVRFQMEMMMKMQIPAGKTYSGMVHHRAKDERWIPLATRPDQDQMKRYLEPPSTAATLDLAATAAQSSRLWAKYDSTFANQCLVSAETAWAAAIKNPAIYAPLQSSFSGTYGDTNIADEFYWAAAELYETTGKQQYLDYLKNNCQDKFLKIPTKIVGGEANGVSGCFDSGDVTGLGTISLAIGDKLDVASKTTARANIAAAADVFVANTQKEGYGTPMDQGIVGQVVDQNGYVTKPIEGYPYASNSYVTNEAIVMGYAYDFTKNRNYLNGVVSAMDYILGRNPMVQSYVTGYGSNPVENPHNVFWAYQYDNTFPKAPAGCMASGPNSGLQDSWVKASGWTPGSRPAAKCFMDNIESWSTNDLSNSYNASLAWVSSYVNLNSLPESIKGDINNDAKINAIDLALLKKYILNNDIPIVAINGDINGDGIINAIDLLLLKKQLLA

SEQ ID NO: 804 - protein, 201 aa, Clostridium cellulovorans
MNKKKIMAYATAFVTLLSVPTVVTSVVATESVSAFTRINLGELIRNNTFDYNVATPWQLTKISPAEASIEVKDGKCYVTILKNGEDGRWDIQLRHRGIVLDQGHKYRVRFTVTADKDCYIYPKIADQGGSFNEYWNYNTYQKIQLNAGVPTTIDQIFQMNNATTRSAEFVFDLAGDCQAATFPYKLTFDDIYLTDLNHIQY

SEQ ID NO: 805 - protein, 313 aa, Clostridium cellulovorans
MPEFNKDSTITINDLKDFIVVTYVIIDDFYQKVTPTFIKNRRNIAKSVMTDSEIITISLVGELLTIDSEKAWFGFCSKNLRDLFPNFCSRPRFHRVRKSLFRVIDEIRKELTKFLNYQYDRMRIADSMPIPVCKFGRAHFHKAFKPEAAYGRCASKKETYYGFKLHALVALDGYITDFTVTAANIDDRDVVWELTANSEIDILIGDKGYIGQKVASQLKETRYIRLLTINRNNSKTKLLKPFRQLIFKARRRVETTFSQLSEQLNMQRVLTKSTWGFATRISNKILAHNLCYFINKFFNIGIEISKIKELVFG

SEQ ID NO: 806 - protein, 290 aa, Clostridium cellulovorans
MVIIQSIQSIMTILLMISVGYILDRKKWFNEESKKLLSKLVVNISLPAYMLQNIVTNFTREKLFEMSGGLLIPFVSIGICYIVAVVIAKAIKVPKKRFGTFVTLFFVSNTIFIGLPVNLALFGEQSIPYVFLYYIANTTFFWTLGVYSISKDGDAEDTKLFSIASLKKCFSPPMLGFIIGIIFVIINLKIPFFILDTCKYLGNLTTPLSMLFIGATMAAVDLKTIRIDKEMIFLNIGRSVISPLIVIILGLFIKGPMLMKEVFIIQAAMPGMINISIISKAYNADYEYAA

SEQ ID NO: 807 - DNA, 4652 bp, Clostridium cellulovorans
taatatataaataatatttaaaatcaataaatcaatcggggaaaatttaaaaaaagagagggataatcaatgagaaaaagattaaataagatcgttgctgttgctttaactgcaacaactatatcatcagtagcagctactgttaatacagctcaagtttcagctgcaccagtagtgccaaataatgagtatgttcaacactttaaggatatgtacgctaagatccataatgcaaacaatggatacttcagtgatgaaggaataccttatcacgcagttgaaacattaatggttgaagcaccagactatggtcatgaaactacaagtgaagctttcagttactatatgtggcttgaagctatgaacgctaagcttactggagatttctcaggattcaaaaaagcttgggatgtaactgaaaagtacataattccaggtgagactgatcaaccaagcgcaagtatgagcaattatgatccaaataagccagctacatatgcagctgaacatccagatccaagcatgtacccatctcaattacaatttggtgctgctgtaggtaaggatccattatacaatgaattaaaatctacttatggaactagccaagtatatggtatgcattggttactagatgttgataactggtatggttttggtggtgcaacaagcacaagcccagtatacatcaacactttccaaagaggtgttcaagaatcttgttgggaaactgtgccacaaccatgtaaagacgaaatgaagtacggtggaagaaacggtttcttagatctattcactggtgattcacaatacgcaactcaatttaaatatactaacgctccagacgcagatgctcgtgcagttcaagctacttactatgcacaattagctgctaaagaatggggagtagacatcagctcatatgtagcaaaatctactaagatgggtgacttcttaagatattcattctttgataaatactttagaaaagttggaaattcaacacaagcaggaactggatatgattcagctcaatacctattaaactggtactatgcttggggtggtggaatcagctcaaactggtcttggagaattggatcaagccataaccatttcggataccaaaacccaatggcagcatggatattatcaaatacatctgactttaaaccaaagtcaccaaatgctgctacagattggaataacagtttaaagagacaaatagaattctatcaatggttacaatctgctgaaggtggtatcgctggaggagctagtaactcaaatggaggaagctatcaagcatggccagcaggtactcgaacattctacggaatgggatatactcctcacccagtatacgaagatccaggtagtaacgaatggtttggtatgcaagcatggtcaatgcaacgtgtggctgaatactactacagttcaaaagatccagcagctaaatcattacttgataaatgggctaaatgggcttgtgcaaatgttcaattcgatgatgcagctaagaaatttaagattcctgctaaattagtatggactggacaaccagatacttggactggatcatatacaggaaattcaaatcttcatgttaaagttgaagcttatggagaagatcttggagtagcaggttcactttctaatgcattatcatattatgcaaaagctcttgaatctagcacagatgctgcagataaagtagcatataacactgcaaaagaaacttctagaaagatacttgattacttatgggcaagctaccaagatgataagggtatagcagttactgaaacaagaaatgatttcaaacgtttcaatcaatctgtatatattccatcaggttggacaggaaaaatgcctaatggagatgtaatccaaagtggagctactttcttaagcatacgttcaaaatacaaacaagatccatcatggccaaatgttgaagctgctttagcaaatggtactggtgttgatatgacataccacagattctggggtcaaagtgatatcgctatagcatttggaacatacggtacattattcacagaccctactccaggattaaaaggtgatgttaactctgatgctaaagtaaatgctatagatttagctatattaaagaaatacatcttagattcaacaactaaaattaacactgctaattctgatatgaacggtgatggaaaagttaatgcaatggatttagctttattaaagaaagcacttcttgcttaagattaaataactttagatcgaaattgtaaggttatttaaggctggacaatatcaagtatattgtccagctactttaaaaaatattgggaaacactgtgtaaggtaaacttaaaccatggatatgaaatatagtaagattaatgccattgctatggcaaacttaaaataaatatattagagcataaacatgaaatttaagtaaaaggcgaataaataaattccctaatcaaaaaaattaaggggtggaactagtgtttaacatatctaagaaaaaagcgcaagctcttcttttatcaggaatcttgggtgcaacttcatttacaccagctgtattggtaaaaggtgaaacaacagcgactccaacattcaattatggagaagcattacaaaagtcaataatgttttatgaattccaacgttctggaaagttaccaacggatattcgtagtaattggcgtggtgattctggaacaaaagatggctctgatgtaggagttgatttaactggtggatggtatgatgctggagaccacgttaaatttaatctgccaatgtcttatactgtggcaatgcttgcatggtcattaagtgaagacaaagcagcttacgaaaaaagcggccaattagattaccttgttaaggaaataaaatgggctacagattatctaatgaagtgccatacggcaccaaatgaatactattatcaagttggtgatggtggagctgatcacaaatggtggggacctgcagaagtaatgcagatggcaagaccggcttataaagtagatttgcaaaaaccaggatcatcagttgtcgctgaaacagcagcagcattagcttctacagcttttgcattaaaagacatagataaagcgtattcagaacaatgtattcagcatgcaaaagaactttataactttgctgatacaacaaagagtgatgctggttatacagcagcaaatacatattacaattcatggagtggatactatgatgaattatcatgggctgcagcatggctttacatggcaacaaatgatgcatcatatctagaaaaagcggaatcatatgttccattttggaaggttgaacagcaaacaaccactatagcatatagatgggcgcattgttgggatgatgtacatttcggagctcaattactccttgccagattaacaggaaaatcaatatacaaagaatcagttgaaagaaaccttgattattggacaactggttatgatggaaataaaataaagtacactccaaaaggtttagcttggatggattcttggggctcattaagatatgcaactacaacggcattccttgccgatgtttatgcaagctcagatgtttgttctatttctaaggtagatacatataagaattttgctaagagtcaagctgattatgctttaggaagtactggaagaagttttgtggtaggatttggtgaaaatgctccaaagaaaccacatcatagaactgcccatagttcatggtcagatcaacaagtaaatccaacagaccatagacatgttttatatggtgctttagttggaggaccagatgccagtgatggttatactgatgctattgacaattttactaataatgaggtggcttgtgattataatgcaggatttgtaggacttttagctagacaatattctaaatatggcggagatccaatacctgattttaaagcgatagaaaagccaaccaacgatgagttctttgtcgaagcaggagtaaattgtacaggtccaaattttgtagaaattaaagctttagttaataatagaacaggatggccagcaagaatgggagataaactttcattcaaatacttcataaatgtaagtgaatttgttaatgctggttacagtgcagatgatttaaaggttactgttggttacaatactggcggaactgtatcaaacctaatcccatgggataaggaaaataatatttattatgtaaatgttgatttcacaggggtaaagatttatccaggtggacaatcagattataaaaaagaaattcaatttagaatttcaggaattcaaaatgttaatatttgggataattctgatgacttctcttatgaggggattacaaaaactccaggtgaaacacctgtgaaggttacaaacatcccagtttatgataatggagttaaggtattcggaaatgaaccaggaactactaagccacctgttatagctggtgatgtaaacaataatggtatcgtgaattcaatggatttagcgatgttaaagaaatatatacttggatacgaagtagaaatgaataaagaggcttcagatttaaataaagatggtaagattaatgccattgatttcgctcttttaaagaaactacttttatcacagtag

SEQ ID NO: 808 - protein, 727 aa, Clostridium cellulovorans
MRKRLNKIVAVALTATTISSVAATVNTAQVSAAPVVPNNEYVQHFKDMYAKIHNANNGYFSDEGIPYHAVETLMVEAPDYGHETTSEAFSYYMWLEAMNAKLTGDFSGFKKAWDVTEKYIIPGETDQPSASMSNYDPNKPATYAAEHPDPSMYPSQLQFGAAVGKDPLYNELKSTYGTSQVYGMHWLLDVDNWYGFGGATSTSPVYINTFQRGVQESCWETVPQPCKDEMKYGGRNGFLDLFTGDSQYATQFKYTNAPDADARAVQATYYAQLAAKEWGVDISSYVAKSTKMGDFLRYSFFDKYFRKVGNSTQAGTGYDSAQYLLNWYYAWGGGISSNWSWRIGSSHNHFGYQNPMAAWILSNTSDFKPKSPNAATDWNNSLKRQIEFYQWLQSAEGGIAGGASNSNGGSYQAWPAGTRTFYGMGYTPHPVYEDPGSNEWFGMQAWSMQRVAEYYYSSKDPAAKSLLDKWAKWACANVQFDDAAKKFKIPAKLVWTGQPDTWTGSYTGNSNLHVKVEAYGEDLGVAGSLSNALSYYAKALESSTDAADKVAYNTAKETSRKILDYLWASYQDDKGIAVTETRNDFKRFNQSVYIPSGWTGKMPNGDVIQSGATFLSIRSKYKQDPSWPNVEAALANGTGVDMTYHRFWGQSDIAIAFGTYGTLFTDPTPGLKGDVNSDAKVNAIDLAILKKYILDSTTKINTANSDMNGDGKVNAMDLALLKKALLA

SEQ ID NO: 809 - protein, 715 aa, Clostridium cellulovorans
MFNISKKKAQALLLSGILGATSFTPAVLVKGETTATPTFNYGEALQKSIMFYEFQRSGKLPTDIRSNWRGDSGTKDGSDVGVDLTGGWYDAGDHVKFNLPMSYTVAMLAWSLSEDKAAYEKSGQLDYLVKEIKWATDYLMKCHTAPNEYYYQVGDGGADHKWWGPAEVMQMARPAYKVDLQKPGSSVVAETAAALASTAFALKDIDKAYSEQCIQHAKELYNFADTTKSDAGYTAANTYYNSWSGYYDELSWAAAWLYMATNDASYLEKAESYVPFWKVEQQTTTIAYRWAHCWDDVHFGAQLLLARLTGKSIYKESVERNLDYWTTGYDGNKIKYTPKGLAWMDSWGSLRYATTTAFLADVYASSDVCSISKVDTYKNFAKSQADYALGSTGRSFVVGFGENAPKKPHHRTAHSSWSDQQVNPTDHRHVLYGALVGGPDASDGYTDAIDNFTNNEVACDYNAGFVGLLARQYSKYGGDPIPDFKAIEKPTNDEFFVEAGVNCTGPNFVEIKALVNNRTGWPARMGDKLSFKYFINVSEFVNAGYSADDLKVTVGYNTGGTVSNLIPWDKENNIYYVNVDFTGVKIYPGGQSDYKKEIQFRISGIQNVNIWDNSDDFSYEGITKTPGETPVKVTNIPVYDNGVKVFGNEPGTTKPPVIAGDVNNNGIVNSMDLAMLKKYILGYEVEMNKEASDLNKDGKINAIDFALLKKLLLSQ

SEQ ID NO: 810 - DNA, 4306 bp, Bacillus pumilus
gatcattttgggtacagtcacatgaagaatcaggagaaaaccctcggtgagcgtcaagctgatggctgtttactatgcacatttttgaaacacgcttgattcttttcaacactgtacaaaacacgaacggaatgacaaggaggtggtcatttcttgttcaatgtttcacgtttaagaaaaaagaaggggtgagaagtaggtacatgtcagattacaactatgtagaggtgcttcaaaaatccattttgttttacgaagcccagcgttccggaaagcttcctgaaagcaatcgtcttaactggcgaggggattctggactagaggatgggaaagatgttggtcatgatttaacaggcggctggtacgatgctggtgatcatgtgaagttcggacttccgatggcctactcggcagccgtgcttgcatggacagtctatgagtaccgagaagcttacgaagaggcagagctgcttgatgatatgttagatcaaatcaagtgggcaaccgattattttttgaaagcccatacaggtccaaatgaattttgggcacaagtaggcgatgggaacgcggatcatggctggtggggtccagcagaagtgatgccgatgaaccggccagcatttaaaattgatgaacattgtccaggaacagaagtagccgcccaaactgcagccgctttagcagcaggttcaattatttttaaagaaacagacgcgccatatgcagcaaagcttctcacccatgcaaaacagctttatgcatttgctgaccaatatcgcggtgagtatacagattgtgtcaccaatgctcagccattttataattcctggagtggctatattgatgagctcatttggggtggaatatggctctacttggcgacaaatgaccagacctatttaaacaaagcactaaaagcagtagaagaatggccgaaggattgggactatacgtttacgatgtcgtgggacaataccttttttgcttcgcaaattttacttgcgagaatcacaaaggagaaaaggtttatcgaatcgacggagcgtaatctcgattactggtcgacgggttttgttcaaaatggaaaagtagaaagaatcacttatacgcctggcggactagcgtggttagatcaatggggttcacttcgttatacagcaaatgctgcatttttagcgtttgtgtacgcagattgggtctctgatcaagaaaaaaagaatcgataccaaacgtttgcgatcaggcaaacacactatatgttaggggataatccgcaaaatagaagctatgtcgttgggtttggcaaaaatccgccgatgcatccacaccatcgaactgcacatggctcatggtctaatcagctgacaactccttcttctcatcggcacacgctttatggagcgcttgttggggggcctaatgcacaggatcagtataccgatgacatctctgactatgtatcaaacgaggtagcaacagactataatgccgcctttactggaaatgtagccaaaatggtacagctgtttggtcaggggcagtcaaaactgccgaattttccgcctaaagaaaaagtggaagatgagttttttgtagaggcagctgtcatgagtaacgatacaacatctactcagatcaaagccattctatacaatcgatcaggctggccggccagaagtagtcaatcactttcttttagatattatgtcaatctgagcgagatatttgcgaagggattcactgataaagatattcaagtgacagctgtctacaatgaaggcgcttccttatctccgttaacggtgtatgacgcatcatcccatatctattttacagaaatcgattttactggcgtagctatttttccaggaggcgaatcgcttcataagaaggaaatacagttccggttatctgcgccaaatggtgcgaatatatgggatgcctcaaatgattattcctttcaaggattaacatccaatatgcaaaaaacagcgagaattcctgtttttgatcaaggtgatttagtatttggtacgcttccgaataaataaatataaagggtgaggacatgacaaataaagaacggtttttaacactttatcatcaaatgaaaaacgatgcgaatggatatttttcaaaagaaggcattccgtatcattccgttgaaacactcatttgtgaggcacctgattacgggcatatgacaacttcagaagcttacagctattggttatggcttgaagcattgtatggtcactacacaggcgattggagcaaactagaagcggcttgggataatatggagaagtttatcattccagtaaacgaagatggacatgacgaacagccgcatatgagctcttacaatccatccagcccagccacatacgcttcagaaaaaccatatccagatcaatatccgagccagttgacgggtgctcgccctgctggtcaagatccaattgatcaagaactgaggtcaacttacggaacgaatgaaacgtatttaatgcactggcttcttgatgtagacaactggtatgaatatgggaatttgctcaacccatcacatatagccgcatatgtaaacacattccagcggggtccgcaagaatccgtatgggaggccatccctcatccatcacaagatgataaaacagccggaaagcccaatgaaggtttcatgagcttgttcacaaaagaaaatcaagcgccagccgcccagtggcgctacacaaatgcgacggacgctgatgcacgtgcgatacaggcaatgtattgggcaaaggaacttggctataatgggtcagcctatcttaataaagcgaaaaagatgggtgatttccttcgctacggaatgtatgataaatattttcaaacaattggaagcggcaagcaaggtaatccgtatcctggaaatggaaaaagtgcatgtcatcacttaatggcgtggtacacctcttggggcgggggacttggagaatatgcgaattggtcatggcgtatcggagcgagccattgtcatcaagggtatcaaaacccagtcgctgcctacgctttatcctcagataagggaggcttaaagccatcgtcaccaactgctgcaagtgattgggaaaagacgttaaagagacagcttgaattttacgtctggcttcaatcaaaagagggagcgattgcaggaggtgctaccaacagctggaatggagactatagcgcttatccagcaggaagaagcacattttatgatatggcttatgaagatgcgcctgtttaccatgatcctccgtccaataactggtttggaatgcaagcatggccgattgagcgtgtagcagagctttattatatctttgcaaaagatggcgacaaaacatctgaaaatttccaaatggccaaatctgtcatcacaaaatgggtcaactattcactagattatatttttattggcactcgtccagtgtcggatcaagatggatattttttagatggtcagggtcaaagaattctagggggggcaaatgttgctgttgctacgacgagtgcacctggagagttttggattcctgggaatatagaatggagcggtcaacctgacacttggagcggattccaatctgcaacaggtaatcccaatttaacggcagttacaaaagatcctactcaagatactggtgtactgggcagtctcatcaaagcgctcacattctttgctgctgcaacacagaaagagacaggaaactatacagcacttggcataagagcaaaagagacagcggcacagctccttgaggttgcttggaattacaatgatggtgtagggattgtgacagaggaagacagagaagactaccaccgtttctttaaaaaagaagtgtacttcccaaatggctggaacggaacatttggtcaaggaaatcagatccctggttccagcaccattccttctgacccgcagcgaggaggtaacggagtgtatacgagctttgcagatcttcgtccgaaaatcaagcaagacccagcttggtcagccctggagagtaaatatcaagcatcttttaatgaagcaacaggcaaatgggaaaacggagcgccaagttttacctatcaccgtttctggtcgcaagttgatatggctacggcttatgcagaataccatcgtctcataaacgaatagaacttagtgcagctgccggcttttttagtcggcggtcttctcatgagataaatgaagtgaaagcaaaggtgatgtcatcatggttaataagaaagaatttatgaatcattcatcgaatggcggatc

SEQ ID NO: 811 - protein, 659 aa, Bacillus pumilus
MHIFETRLILFNTVQNTNGMTRRWSFLVQCFTFKKKEGVRSRYMSDYNYVEVLQKSILFYEAQRSGKLPESNRLNWRGDSGLEDGKDVGHDLTGGWYDAGDHVKFGLPMAYSAAVLAWTVYEYREAYEEAELLDDMLDQIKWATDYFLKAHTGPNEFWAQVGDGNADHGWWGPAEVMPMNRPAFKIDEHCPGTEVAAQTAAALAAGSIIFKETDAPYAAKLLTHAKQLYAFADQYRGEYTDCVTNAQPFYNSWSGYIDELIWGGIWLYLATNDQTYLNKALKAVEEWPKDWDYTFTMSWDNTFFASQILLARITKEKRFIESTERNLDYWSTGFVQNGKVERITYTPGGLAWLDQWGSLRYTANAAFLAFVYADWVSDQEKKNRYQTFAIRQTHYMLGDNPQNRSYVVGFGKNPPMHPHHRTAHGSWSNQLTTPSSHRHTLYGALVGGPNAQDQYTDDISDYVSNEVATDYNAAFTGNVAKMVQLFGQGQSKLPNFPPKEKVEDEFFVEAAVMSNDTTSTQIKAILYNRSGWPARSSQSLSFRYYVNLSEIFAKGFTDKDIQVTAVYNEGASLSPLTVYDASSHIYFTEIDFTGVAIFPGGESLHKKEIQFRLSAPNGANIWDASNDYSFQGLTSNMQKTARIPVFDQGDLVFGTLPNK

SEQ ID NO: 812 - DNA, 3703 bp, Cellulomonas pachnodae
caatgccctggtcgccgaaccgcagctcgttgctctgaagctgggtcgcgtagttgcccacggagtcgatggtgaagccgcgcgccgcgagcacggtgcggttcgcggccgcgatccccacggtcccgtcacggccggtcgcgttgaggatgcggacgtgcacctcgctggtggcgagcggcagggcgccgtcgggctggtcctccaccttgggcaggcacggcggcgtcaccttctcctccggggacgacgacgtgaagccgcgcgcgaacggtgcgtcgatcgctccggtgaagatggcgagcgcgccgaggccgaccacgacgagcagggcgacgagcacaccgaagatgactgcctggcgttcgtgctcgcggcggcggcgcgcgatgcgggccgggtcctgggcggggttggtcacgcgacgaaactacctgagggtgagcacgcgggcgtggaggacggggcgttgctggagcgcagcacgtaccgcccggtgcagaccgtcctccagatacagcacgcctcggtactcgacgacgtgggcgaacaggtcgccgtagaacgtcgagtcctcggccaggagcttgtcgaggtccagtgcgctgtgtcgtgacgagctcgtcgaggcgcacctggcgcggcgggacgtcggcccagtccttcggactggtcagtccgtggtccgggtacgggcggccgtcacccacggacttgaagatcatgacgttcatcgtagaggggtccgcggggcgggctcccggactcccaggatggccatggtgtccttacggcgtcgtcacaagagttggcccgacgggcaccacttgacgcccaggcccgagcgggacacagtgacacacgtcacggtgggagcgctcctacgcggcgcttgctgccccgttgtcaggccgatcgaaggagatcgttgtgcatccacccacccgcatccgcgcccgtgccggcgtcgccgcggctgccgcgctcgcggcggccctcgtcgccacgcccgcctcggcccaccccgggaagtccgccgacggcggtgaggagctctgggtgaacccgaagagctcgatcaccgaacacctccgcacggagcatctcaagggtcaggatcgcgccgacgccgaggcgctcgcgggctacgcctcggcatcgtggttcaccgggggtacgccgagcgaggtgcgcaaggacgtgcgcgaccaggtgcgccgcgccgaccgcgccgatgccgtccccaccctggtcgcctacaacctgccgtaccgcgactgcgcccagtactcggcgggcggcgcggccagccaggcggactacgaggagtggatcgacgcgttcgcggccggcatcggcaacgagcgggcgatcgtcatcctggagccggacggcctcggggtcattccctggtacacgacgatcgacggggcccaggagtggtgtcagccggaggacgccgatccggcgaccgcggccgctgagcggttcgcgatgttcaaccacgccgtcgacgcattcggcgcgctgccgaacgcacaggtgtacctggacgccgggaactcggcgtggctgaacgtcggcgagaacaccgaccggctgatcaaggcgggggtgcagcgggccgacgggttcttcctcaacgcctcgaactaccagttcaccgagaactccacggcgtacgggcactggatctcgtcctgtatcgaggtgatcacgcgcggcctcggcgcggcggccgactgcggcaaccagtactggaacggcggcccggccaacgactggaccggcgtcgccatgaccaggtacgcgccgtggaccgccggcaacgcggaccccgccgccgacacgtcaggtgtcgactcgaagtatgcccagcagctcggcgacatcgtcccgacgacgcagttcgtcatcgacacctcgcgcaacggggtcgggccgtgggacccgacgacgtcggacgtggagtacacgggggacgccgaggactggtgcaacccgcccgatcgtgggctgggcgcgcgcccgacgctcgatgtcgacgacccgctcgtggccggctacctgtggatcaaggtgcccggcgagtcggacgggcagtgctaccgcagcctgggcgggcccctcgacccggagcgcggcatgcaggaccccgccgccgggcagtggttcgccgagcaggcccgtgagctcatcgagctcgcggtgccgcccctggagacgacgcgcgccgactgccgcggcaagggcaagggcaacggcagcgccgacgccaacgggaagggtcaggcgaacggcaaggggaacgccggtggcaacgggcatggccaaggccacggcggcgtgtaggccgtctgaccgaacgcagccgggagtcccgcgaaccgcgggggcccggctgcgtcgccgtcgggggtcacgagtgctcggtccgtgagggtgccgcgagaacttgacgcttgcgacagtggaaagtactagctatggtttcaggcatggaaagcactgacgctcgcgcggacgacgtcgaccccgccgcacggctgcgcgacctggagcgggtcgaggcgctgccctacgtcgtctacccgaagaccccgtggtggttcatgccggccatgggcgcgtacatgggcgggatcgtggcgtcgtacgagctcttcggcaggttccacaacctcctgcaactgggtgtgctcgtcgtgctcacggcgttcctcggcgccgtcgtcaccgcggtcaagtcccggtacggcgccttcccggcgctgagccggaacgcgccgcccgagatccgtggtgcgtaccggcgagccttcaccggactggccgtcgtcgccgtcgtcgtcgccgcggtgtggctctgggcgggtcccggcaccgccgggatcgtgatgttcgtcctgatcaccgggggcgacgtgctctacgaggcccactacgcgaccgccgcgtcccaggcccgggtgcgcctcgggatcgacgccgcatgagcctcgcggacctcgaccccgtcatccacgccccgaagcggctcgcggccatggcgatcctgtccggcgcggagtcggccacgttcgcctacctgcgcgagcacctgggcctcgcggactccgacctgtcgaagcagatggccgccctcgacgccgccggatacgtcaagaccaccaagcggggtcgcggcccgggctcgacgacgtcgttcgccatcacccgggcgggcgccaaggcgtaccgggtacaccgggctgcactcatggcgatgctggccgccgatacgtcccggtgacccgcggatgacggtcggtgatctctgcatgatctgatcgcgacccggaccggcccggctgccgcggtcagcgacaccctcagacggtgagccggtacaggcgttcgctgccgtaccgcgtgaacccgcagcgggagaggatcgggccggaggtctcgacgcgtcccttcacgagcgccagggtcgcgccccattcgcgagcgatccgcagtcgctcggccaggatcgcccggtatgcgcctctgccgcgatggtccggaacggtacaggcaccccacaggcgagcgacggggccgggtgcgccgtccgggccggcgctcagggtgcacccgccggtcgcgaccggggtgtgattgctctcgagccgaccgagaacgcggaacccggtcctcgcgcaatggtcgtgcgtga

SEQ ID NO: 813 - protein, 473 aa, Cellulomonas pachnodae
MHPPTRIRARAGVAAAAALAAALVATPASAHPGKSADGGEELWVNPKSSITEHLRTEHLKGQDRADAEALAGYASASWFTGGTPSEVRKDVRDQVRRADRADAVPTLVAYNLPYRDCAQYSAGGAASQADYEEWIDAFAAGIGNERAIVILEPDGLGVIPWYTTIDGAQEWCQPEDADPATAAAERFAMFNHAVDAFGALPNAQVYLDAGNSAWLNVGENTDRLIKAGVQRADGFFLNASNYQFTENSTAYGHWISSCIEVITRGLGAAADCGNQYWNGGPANDWTGVAMTRYAPWTAGNADPAADTSGVDSKYAQQLGDIVPTTQFVIDTSRNGVGPWDPTTSDVEYTGDAEDWCNPPDRGLGARPTLDVDDPLVAGYLWIKVPGESDGQCYRSLGGPLDPERGMQDPAAGQWFAEQARELIELAVPPLETTRADCRGKGKGNGSADANGKGQANGKGNAGGNGHGQGHGGV

SEQ ID NO: 814 - DNA, 2286 bp, Clostridium thermocellum
aaactaaaactcctatccaatactttagttcagttccagcatacgtctgtattcaaaatgcctgtatttataactgcatttataatacctgaagcaaataataattaaacttgtggaagaaaggaggttgcaacaggttttaaattatcttaattcaggtattttacaatttttaataaaaagggggataaaggtaaaaaatgagtagaatgaccttgaaaagcagcatgaaaaaacgtgtgttatctttgctcattgctgtagtgtttctaagcttgaccggagtatttccttcgggattgattgagaccaaagtgtcagctgcaaaaataacggagaattatcaatttgattcacgaatccgtttaaactcaataggttttataccgaaccacagcaaaaaggcgactatagctgcaaattgttcaaccttttatgttgttaaagaagacggaacaatagtgtataccggaacggcaacttcaatgtttgacaatgatacaaaagaaactgtttatattgctgatttttcatctgttaatgaagaaggaacgtactatcttgccgtgccgggagtaggaaaaagcgtaaactttaaaattgcaatgaatgtatatgaggatgcttttaaaacagcaatgctgggaatgtatttgctgcgctgcggcaccagtgtgtcggccacatacaacggaatacactattcccatggaccgtgccatactaatgatgcatatcttgattatataaacggacagcatactaaaaaagacagtacaaaaggctggcatgatgcgggcgactacaacaaatatgtggtaaacgccggcataaccgttggttcaatgttcctggcgtgggagcattttaaagaccagttggagcctgtggcattggagattcccgaaaagaacaattcaataccggattttcttgatgaattaaaatatgagatagactggattcttaccatgcaataccctgacgggagcggaagggtggctcataaagtttcgacaaggaactttggcggctttatcatgcctgagaacgaacacgacgaaagatttttcgtgccctggagcagtgccgcaacggcagactttgttgccatgacggccatggctgcaagaatattcaggccttatgatcctcaatatgctgaaaaatgtataaatgcggcaaaagtaagctatgagtttttgaagaacaatcctgcgaatgtttttgcaaaccagagtggattctcaacaggagaatatgccactgtcagtgatgcagatgacagattgtgggcggcggctgaaatgtgggagaccctgggagatgaagaataccttagagattttgaaaacagggcggcgcaattctcgaaaaaaatagaagccgattttgactgggataatgttgcaaacttaggtatgtttacatatcttttgtcagaaagaccgggcaagaatcctgctttggtgcagtcaataaaggatagtctcctttccactgcggattcaattgtgaggaccagccaaaaccatggctatggcagaacccttggtacaacatattactggggatgcaacggcacggttgtaagacagactatgatacttcaggttgcgaacaagatttcacccaacaatgattatgtaaatgctgctctcgatgcgatttcacatgtatttggaagaaactattacaacaggtcttatgtaacaggccttggtataaatcctcctatgaatcctcatgacagacgttcaggggctgacggaatatgggagccgtggcccggttaccttgtaggaggaggatggcccggaccgaaggattgggtggatattcaggacagttatcagaccaatgaaattgctataaactggaatgcggcattgatttatgcccttgccggatttgtcaactataattctcctcaaaatgaagtactgtacggagatgtgaatgatgacggaaaagtaaactccactgacttgactttgttaaaaagatatgttcttaaagccgtctcaactctcccttcttccaaagctgaaaagaacgcagatgtaaatcgtgacggaagagttaattccagtgatgtcacaatactttcaagatatttgataagggtaatcgagaaattaccaatataaattctgataaatattgataaacactaatatataagtgtttaatcggtaaaagagccctgtggcaaaaactgccgcaggctgtttttatcaattccggcgcagacgaaaatagcagacgtaaatattaattactgaa

SEQ ID NO: 815 - protein, 649 aa, Clostridium thermocellum
MSRMTLKSSMKKRVLSLLIAVVFLSLTGVFPSGLIETKVSAAKITENYQFDSRIRLNSIGFIPNHSKKATIAANCSTFYVVKEDGTIVYTGTATSMFDNDTKETVYIADFSSVNEEGTYYLAVPGVGKSVNFKIAMNVYEDAFKTAMLGMYLLRCGTSVSATYNGIHYSHGPCHTNDAYLDYINGQHTKKDSTKGWHDAGDYNKYVVNAGITVGSMFLAWEHFKDQLEPVALEIPEKNNSIPDFLDELKYEIDWILTMQYPDGSGRVAHKVSTRNFGGFIMPENEHDERFFVPWSSAATADFVAMTAMAARIFRPYDPQYAEKCINAAKVSYEFLKNNPANVFANQSGFSTGEYATVSDADDRLWAAAEMWETLGDEEYLRDFENRAAQFSKKIEADFDWDNVANLGMFTYLLSERPGKNPALVQSIKDSLLSTADSIVRTSQNHGYGRTLGTTYYWGCNGTVVRQTMILQVANKISPNNDYVNAALDAISHVFGRNYYNRSYVTGLGINPPMNPHDRRSGADGIWEPWPGYLVGGGWPGPKDWVDIQDSYQTNEIAINWNAALIYALAGFVNYNSPQNEVLYGDVNDDGKVNSTDLTLLKRYVLKAVSTLPSSKAEKNADVNRDGRVNSSDVTILSRYLIRVIEKLPI

SEQ ID NO: 816 - DNA, 3527 bp, Streptomyces halstedii
gcatgccatgccatcggtatgattcagacactgttacgcatacccaatgcttcggcacgtccctgcgggcagaaagcatggctgacggcggtcgcgtcgccttcgtcatcaactcatcaactgatgaccgtgcgcacgggggcagcaccgcaggtcgctcgcctgcaccttcgcgacaccccgaaccttttgagctccacgaatatggcggcagctcttaccaagctcgtatgcggacaccggtgaagtcgagcgctgcaccgttgatcgcggccgagtggcggggggctcgttgcatggtcgggccgttgtgtcatggccggcggcacaaggtcatgagggcagcccggctgcggcggcgtgcgatgggcgccggtgcgaagcgccggtggtcttcgccgaccggctcccctgtgcctgacctgcccctttgaaaaccctttgccgcattccaccccgatgggttgtcaggggcacgtctgcgctcctacagtccctacgaaccaagggtgggagcgctcccagattcgacacggctgggcgctgccgattccctgatcgccccatccggtcatccctcctggagaggcccccatgcgagcgttaccgcacggccccagaactccgcgcagcctgctcggtgcgctgctcctcgctctcgccaccgtggcggccgtcctggccgctgctccggcggcccacgcggacactctggtctgcgaacagtacggttcgacgacgatccagggccgctatgtggtccagaacaaccgctggggcgcgagtgccccccagtgcgtcaccgctaccgacagcggcttccgggtgacccaggccgacggcgccgtccccacgaacggtgccccgaagtcctatccctcggtcttcaacggctgtcactacaccaactgctcgcccgggacgaacctcccggcgcaggtgagcggtatcgccagcgcccccagcagcatctcctacggctttgtcggcagcgccgtgtacaacgcgtcgtacgacatctggctggaccccacacccaagaagaacggggtgaaccgtaccgagatcatgatctggctcaacaaggtcggcccgatccagcccatcggctcgcaggccggcaccgcctccgtcggcgggcgcacctggcaggtgtggaggggcagcaacggctccaacgacgtcatctccttcgtcgccccttcggccgtcgccagctggagcttcgacgtcatggacttcgtccggaacaccatcgcccgcggcatggcgcagaacaactggtatctcaccagtgtccaggcaggattcgagccgtggcagaacggtgccggactcgcggtgaactccttctcctcaaccgtgaacctcgggactccgggcaccggttccccgggggcgcccggggaaccggtgacagcctgcgaggtggcctacgcgacgaacgtctggagcgacggcttcaccgccgacgtcacggttgccaacaccggctcgacgcccgtcgactcctggagactgtccttcactctgccctccgggcaacgcgtcaccaacgcgtggaacgccaccgtcagcgggccgaccggagcggtgacggcgaccggcctcgcgcacagcgcccaagtagcagctggggccagccagacattcggtttccaggggacctacagcggcacgttctccaagccgtccggattcagtctcaacggcgcccgctgcgcatgagtacggcgcacgaccactgccctgtctccccgcacgcacaggccgcccaacctcaccgccgcgacccgacagcctccctggaacacgcctgactcccggatctctctcccctcagggcgggtgcctccaccgtaggacgaggcttccctcaccaaacagcaacagcagaaaacaggctcaatcggaagaaaactccacacaggaaaaggagacaccatggctcgaggcaaaagactacttgtatctctgacagcggtcttcgcgaccctgctcggcggaatcgccctgaccctgttcggacagggcaacgcgcaggctcacggcgtgacgatgaccccaggctcgcgtacctacctctgctggctggacgccaagaccagcaccggctccctggacccgaccaacccggcgtgcaaggctgcgctcagcgaaagcggctcgaatgcgctgtacaactggttcgccgtgctcgactccaacgcgggtggacgaggggccggttacgtcccggacggaaagctgtgcagtgccggcgaccggtcgccgtacaacttcaccggatacaacgccgcccgctccgactggccccggacgcacctgacggccggccggacgatccaggtcaagcacagcaactgggccgcgcatccgggctccttccgggtgtacctgtccaagcccggctactcgcccagcaccgaactgggctgggacgacctggagctgatcgagaccgtcaccaacccgccccagacgggttcgccgggcaccgacggcggccactactactggaatctggacctgcccagtggccgctcgggtgacgcggtgatgttcatccagtgggtgcgctccgacagccaggaaaacttcttctcctgctccgacgtcgttttcgacggcggtaacggcgaggtcaccggcatccggggttcgggcagcaccccggacccgacgcccacgccgaccccggacccgacccccacgccgaccgacccgcacagcgggtgcatggccgtctaccgcgtgaccaactactggagtggtggattccaggggtccgtcgaagtgatgaaccacagcacgacggcgcgtgacggctgggcggtgaagtggacacccggcgccggagccaaggtcagcagcgtctggaacggcgcgctgaccactggatccgacggcgcggtcacggtcaggagtctcgactacaaccggtccatcccaccggacggcagcgtcaccttcggattcacagcgacatcgaccggcaacaatctcccggtcggctcgatcggctgcgtcaacccgtagccgctgacagagacagcgccgctcccgcatcccggggagacggcgctgtcgcgcttccctgccggcacagccaccgcggcggggcgacaccgccggtccggcggtcgatgtgtacgaagctcctggcgggccccgtgcgtgcccctaaggtcggcggaagccaccaccgcacaccgcgacaccgtccaggcccgggaacaggccccaggggcgagccgcccgaatcgaggccgccgccgggaacaccgaggactgcgcatcaggatgtgggtctgtctgcgcgtgtccgctcgggcgggcgaggaagaagcagtggtgttcgtcgatgatcgaccgaggtgccggtgaccacgtcttgctcaaggggcggaacgccgcgctgtcgaccggggtagggccgatcacgtgcacggtgacggtcaagggccacccacagacgtgccggcgggcggtgatccagtcctgagcgtcgatgaaggcccgcatgc

SEQ ID NO: 817 - protein, 377 aa, Streptomyces halstedii
MRALPHGPRTPRSLLGALLLALATVAAVLAAAPAAHADTLVCEQYGSTTIQGRYVVQNNRWGASAPQCVTATDSGFRVTQADGAVPTNGAPKSYPSVFNGCHYTNCSPGTNLPAQVSGIASAPSSISYGFVGSAVYNASYDIWLDPTPKKNGVNRTEIMIWLNKVGPIQPIGSQAGTASVGGRTWQVWRGSNGSNDVISFVAPSAVASWSFDVMDFVRNTIARGMAQNNWYLTSVQAGFEPWQNGAGLAVNSFSSTVNLGTPGTGSPGAPGEPVTACEVAYATNVWSDGFTADVTVANTGSTPVDSWRLSFTLPSGQRVTNAWNATVSGPTGAVTATGLAHSAQVAAGASQTFGFQGTYSGTFSKPSGFSLNGARCA

SEQ ID NO: 818 - protein, 364 aa, Streptomyces halstedii
MARGKRLLVSLTAVFATLLGGIALTLFGQGNAQAHGVTMTPGSRTYLCWLDAKTSTGSLDPTNPACKAALSESGSNALYNWFAVLDSNAGGRGAGYVPDGKLCSAGDRSPYNFTGYNAARSDWPRTHLTAGRTIQVKHSNWAAHPGSFRVYLSKPGYSPSTELGWDDLELIETVTNPPQTGSPGTDGGHYYWNLDLPSGRSGDAVMFIQWVRSDSQENFFSCSDVVFDGGNGEVTGIRGSGSTPDPTPTPTPDPTPTPTDPHSGCMAVYRVTNYWSGGFQGSVEVMNHSTTARDGWAVKWTPGAGAKVSSVWNGALTTGSDGAVTVRSLDYNRSIPPDGSVTFGFTATSTGNNLPVGSIGCVNP

SEQ ID NO: 819 - DNA, 1553 bp, Bacillus sp
ttgatagacaatcgggagaaagatttttacaatgagttcgtgctcataagaagtgtagagccaaaatatgccaaggaggaagagatcagatatgaaacggtcaatctctatttttattacgtgtttattgattacgttattgacaatgggcggcatgatacgttcgccggcatcagcagcagggacaaaaacgccagtagccaagaatggccagcttagcataaaaggtacacagctcgttaaccgagacggtaaagcggtacagctgaaggggatcagttcacacggattgcaatggtatggagaatatgtcaataaagacagcttaaaatggctgagagatgattggggtatcaccgttttccgtgcagcgatgtatacggcagatggcggttatattgacaacccgtccgtgaaaaataaagtaaaagaagcggttgaagcggcaaaagagcttgggatatatgtcatcattgactggcatatcttaaatgacggtaatccaaaccaaaataaagagaaggcaaaagaattcttcaaggaaatgtcaagcctttacggaaacacgccaaacgtcatttatgaaattgcaaacgaaccaaacggtgatgtgaactggaagcgtgatattaaaccatatgcggaagaagtgatttcagttatccgcaaaaatgatccagacaacatcatcattgtcggaaccggtacatggagccaggatgtgaatgatgctgccgatgaccagctaaaagatgcaaacgttatgtacgcacttcatttttatgccggcacacacggccaatttttacgggataaagcaaactatgcactcagcaaaggagcacctatttttgtgacagagtggggaacaagcgacgcgtctggcaatggcggtgtattccttgatcaatcgagggaatggctgaaatatctcgacagcaagaccatcagctgggtgaactggaatctttctgataagcaggaatcatcctcagctttaaagccgggggcatctaaaacaggcggctggcggttgtcagatttatctgcttcaggaacattcgttagagaaaacattctcggcaccaaagattcgacgaaggacattcctgaaacgccatcaaaagataaacccacacaggaaaatggtatttctgtacagtacagagcaggggatgggagtatgaacagcaaccaaatccgtccgcagcttcaaataaaaaataacggcaataccacggttgatttaaaagatgtcactgcccgttactggtataacgcgaaaaacaaaggccaaaaccttgactgtgactacgagcagcttggatgcggcaatgtgtcacacacagttgtgacgttgcataaaccaaagcaaggtgcagatacctatctggaacttggatttaaaaacggaacgttggcaccgggagcaagcacagggaatattcagctccgtcttcacaatgatgactggagcaattatgcacaaagcggcgattattcctttttcaaatcaaatacgtttaaaacaatgaaaaaaatcactatatgat

SEQ ID NO: 820 - protein, 486 aa, Bacillus sp
MKRSISIFITCLLITLLTMGGMIRSPASAAGTKTPVAKNGQLSIKGTQLVNRDGKAVQLKGISSHGLQWYGEYVNKDSLKWLRDDWGITVFRAAMYTADGGYIDNPSVKNKVKEAVEAAKELGIYVIIDWHILNDGNPNQNKEKAKEFFKEMSSLYGNTPNVIYEIANEPNGDVNWKRDIKPYAEEVISVIRKNDPDNIIIVGTGTWSQDVNDAADDQLKDANVMYALHFYAGTHGQFLRDKANYALSKGAPIFVTEWGTSDASGNGGVFLDQSREWLKYLDSKTISWVNWNLSDKQESSSALKPGASKTGGWRLSDLSASGTFVRENILGTKDSTKDIPETPSKDKPTQENGISVQYRAGDGSMNSNQIRPQLQIKNNGNTTVDLKDVTARYWYNAKNKGQNLDCDYEQLGCGNVSHTVVTLHKPKQGADTYLELGFKNGTLAPGASTGNIQLRLHNDDWSNYAQSGDYSFFKSNTFKTMKKITI

SEQ ID NO: 821 - DNA, 3620 bp, Clostridium longisporum
tactaacacatatagaaagcatttcagaattcttcttaaaccacaatcttcaaatcttttcaaaaataccattatcatcagggtttaccatgtctacacttccagtaatgatttatatatgtataataaatactggtataggttatgcatgctattttaaggctctagaaaaaacttcagcaactaagacatctttagtatttttcttcaaaccaattttagctccaatactagctttaataatcttaaaagaatctttatcttttaatatgcttataggtatattattaatattgtgtggttcaatgacatcaatacttccatcacttaaaaataataaaaatattaagcttaaaaaggcagcaataaaataaaagggtatgtaattttgaacaaaatagactgttcaaaactacatgccctttaaaatatatagctttctagcttaagcacctttccaaaatctgatacaatatcaaagctcatcttttttccattaagcttttttattaactgtaaacttggtatatttaaaatatcagctgcaaaaataagtccttctatcttataattttcttttaaaaaatcttttataagaagtaaagcttcataagcatatcccttttttctttcatcttcacatatccaaattccaacttccggacattcatccttcaaattataaagctctatacttccaacaaacttatcttcttcattccacaagctaagcatagtattatcaccctttatacttaaatttataaattcctgcaaaaaactttcagcttcttttatagacttaaaagaatttgcaagctggtattttactacctcttcagtaaagttttcataatataaagctgcctcttcaatttttgtagaagttattctaagcctttttccttttatttcaattgtattattcataaaaaaccttcttaaatattcttaatgtattctttaactgatataaccttttaatctgaaattcttcatagcaatacaaatcaactatactgttcattatagaataaatataaaaattataaaagaaaaatttatgttattttacatgctggtaatgctaaaactggtagtattctaatttttattaataacaatgactaactttatgtattaatagcacactttcacgaattattattgaatttatttctttaagatattatattgaatttatgtaaataattacatcaaagaaataagggagatgattaaactatgaaaagatctttattaaaaacttgttctatcattgctggagcaacaattattttctcatcactttcaatttcaagaaatcctcttgaagtacaagctgcttctatgagatctgcaagtgaaattgtgcaggaaatgggagttgggtggaatcttggaaatactttagatgctaagattactaacctgtcttataatacttcaccaatatcctttgaaacaggctggggaaatcctgttactacaaaggctatgattgataaaatcaaaaatgctggatttaaaaccataagaataccaactacttggggagaacacttagatggtaataacaaacttaatgaagaatgggtaaagagagttaaagaagttgttgattattgtatagcagatgatctttatgttatcttaaatactcatcatgaaggaaactgggttattccaacttacgctaaagaatcttcagtaactccaaaactaaaaactctttggactcaaatatctgaagctttcaaagattatgatgatcatttaatatttgaaactcttaacgaaccaagacttgaaggaactccttatgaatggacaggtggtacaagtgaatctcgtgatgttgtaaataaatataacgcagctgctttagaatctataagaaaaactggtggtaataacttatctagagctgttatgatgccaacttatgcagcttctggttcatctactacaatgaatgattttaaagttccagatgataaaaatgtaattgcatctgttcatgcatattctccttacttctttgctatggacacaagcagcaattcagttaacacatggggaagttcttatgacaaatattctttagatgtagaattagattcttacttaaatacttttaaatctaaaggagttcctgttgttattggtgaatttggttctataaataaaaataatacttcttcaagagcagagcttgctgaatattatgttacagctgctcaaaagagaggtattccttgtgtatggtgggataacaactatgctgaaactaataagggtgaaacttttggattactaaatagaagtactttaaactggtactttagtgatattaaagatgctttaattagaggatataaaaatgtacatcctgaagctactgaagatgataaaccaagcacagatgtaaccaaccctgattcaggcaatactaaaccagacagtggtaatactaatcctggtacagaaactactactccaacagataatgaaaagatttcaataacttcaaaaattaatgattggggcggtgcttaccaagctgatttcactttaaaaaataacacttcaagtgacattaacaattggtcttttaagataaagaaaaatgatattgtgtttactaattactgggatgttaagataactgaagaaaatggatattatgttgttacacctcaagcttggaaaacaactatcctcgcaaattcttctatagttatttctattcaaggcactggaaaagtaattagtaattttgagtataaatttgactagataacctaaataaaatttaagcctaaacaatataacttctatcttgtttaggcttaaattatactactcgtccatcatattacggttattatatgagtacacattataatctctccaaataagttcaagatttgtaaatgtatctgaaatactttccttttctctcattcctactgctattataagtgcatttattactgataaaggtgctactaatgaatcaacaaatgaagccatattactttgagctattaacgtataatctgcatgtgaagcaagtggagataataaactatctgtaagtgctaaaaccttagctcctcttctcttagaaaaatctaaggcatctatagtttttgttgcatatcttgggaaaccaatccctataactaaatctccttctcccacattaatcatttgttcaaaaatgtctgaaattccgtagcttactattcttacattttgaagaattatattcaaataaaatcctaagaattcagcaagagctgtagaacttctaaggcctattatatatattttctttgcttcaaaaattgaatttaaaacttgttcaaaggtataagggtttatcttttcaagagttgctcttatattttccatatctgcctttaatactccctttaaagtatctccatcagaaataaggtcctttgaaagctctaatctttgaacagttgttagcttattttttattagctcttgaagagctttttgtaatttaggataacctaaaaatcctaattcatttgcaaatcttactactgtagattcagatacacctacagaatctccaagctttg

SEQ ID NO: 822 - protein, 517 aa, Clostridium longisporum
MKRSLLKTCSIIAGATIIFSSLSISRNPLEVQAASMRSASEIVQEMGVGWNLGNTLDAKITNLSYNTSPISFETGWGNPVTTKAMIDKIKNAGFKTIRIPTTWGEHLDGNNKLNEEWVKRVKEVVDYCIADDLYVILNTHHEGNWVIPTYAKESSVTPKLKTLWTQISEAFKDYDDHLIFETLNEPRLEGTPYEWTGGTSESRDVVNKYNAAALESIRKTGGNNLSRAVMMPTYAASGSSTTMNDFKVPDDKNVIASVHAYSPYFFAMDTSSNSVNTWGSSYDKYSLDVELDSYLNTFKSKGVPVVIGEFGSINKNNTSSRAELAEYYVTAAQKRGIPCVWWDNNYAETNKGETFGLLNRSTLNWYFSDIKDALIRGYKNVHPEATEDDKPSTDVTNPDSGNTKPDSGNTNPGTETTTPTDNEKISITSKINDWGGAYQADFTLKNNTSSDINNWSFKIKKNDIVFTNYWDVKITEENGYYVVTPQAWKTTILANSSIVISIQGTGKVISNFEYKFD

SEQ ID NO: 823 - DNA, 1203 bp, Bacillus agaradhaerens
atgaaaaagataactactatttttgtcgtattgcttatgacagtggcgttgttcagtataggaaacacgactgctgctgataatgattcagttgtagaagaacatgggcaattaagtattagtaacggtgaattagtcaatgaacgaggcgaacaagttcagttaaaagggatgagttcccatggtttgcaatggtacggtcaatttgtaaactatgaaagtatgaaatggctaagagatgattggggaataaatgtattccgagcagcaatgtatacctcttcaggaggatatattgatgatccatcagtaaaggaaaaagtaaaagaggctgttgaagctgcgatagaccttgatatatatgtgatcattgattggcatatcctttcagacaatgacccaaatatatataaagaagaagcgaaggatttctttgatgaaatgtcagagttgtatggagactatccgaatgtgatatacgaaattgcaaatgaaccgaatggtagtgatgttacgtggggcaatcaaataaaaccgtatgcagaggaagtcattccgattattcgtaacaatgaccctaataacattattattgtaggtacaggtacatggagtcaggatgtccatcatgcagctgataatcagcttgcagatcctaacgtcatgtatgcatttcatttttatgcagggacacatggtcaaaatttacgagaccaagtagattatgcattagatcaaggagcagcgatatttgttagtgaatggggaacaagtgcagctacaggtgatggtggcgtgtttttagatgaagcacaagtgtggattgactttatggatgaaagaaatttaagctgggccaactggtctctaacgcataaagatgagtcatctgcagcgttaatgccaggtgcaaatccaactggtggttggacagaggctgaactatctccatctggtacatttgtgagggaaaaaataagagaatcagcatctattccgccaagcgatccaacaccgccatctgatccaggagaaccggatccaacgcccccaagtgatccaggagagtatccagcatgggatccaaatcaaatttacacaaatgaaattgtgtaccataacggccagctatggcaagcaaaatggtggacacaaaatcaagagccaggtgacccgtacggtccgtgggaaccactcaattaa

SEQ ID NO: 824 - protein, 400 aa, Bacillus agaradhaerens
MKKITTIFVVLLMTVALFSIGNTTAADNDSVVEEHGQLSISNGELVNERGEQVQLKGMSSHGLQWYGQFVNYESMKWLRDDWGINVFRAAMYTSSGGYIDDPSVKEKVKEAVEAAIDLDIYVIIDWHILSDNDPNIYKEEAKDFFDEMSELYGDYPNVIYEIANEPNGSDVTWGNQIKPYAEEVIPIIRNNDPNNIIIVGTGTWSQDVHHAADNQLADPNVMYAFHFYAGTHGQNLRDQVDYALDQGAAIFVSEWGTSAATGDGGVFLDEAQVWIDFMDERNLSWANWSLTHKDESSAALMPGANPTGGWTEAELSPSGTFVREKIRESASIPPSDPTPPSDPGEPDPTPPSDPGEYPAWDPNQIYTNEIVYHNGQLWQAKWWTQNQEPGDPYGPWEPLN

SEQ ID NO: 825 - DNA, 2091 bp, Thermobifida fusca
  misc_feature (523)..(523): n is a, c, g, or t
gaattccaggatggtcgtgtggactgcggccaagcgggggtcggtcgacgtgctcgggggtgatcccgtggacgcgatcttctcctgctcgaactcctcgacgggggccgggggacggaccagggtggtgtagcggtcgacgatccgcccgtcggtgactcgcacgagtcccaccgcgcacacgctgccctggttgcggttggcggtctcgaagtcgatagcggtccaggtgtgctcgatcgccggtcgtcctcccttgggccgcactggccaggcgtcggggttcctcccatgctcccggaacttcacctcatccagcacccctccttctttgagtgacctagatcacttattgctcttgactttgtgctacggtctcactacataacgagaacggcgcattcctccttccccgattctgtcacggaatgcgcatccctatatgggagcgctcccatagccgtcttcctcccctctccccttggaggaaccatggcgaaatcccccgccgcccggaagggcngccctccggtcgctgtcgcggtgaccgcggccctcgccctgctgatcgcgctcctctcccccggagtcgcgcaggccgccggtctcaccgccacagtcaccaaagaatcctcgtgggacaacggctactccgcgtccgtcaccgtccgcaacgacacctcgagcaccgtctcccagtgggaggtcgtcctcaccctgcccggcggcactacagtggcccaggtgtggaacgcccagcacaccagcagcggcaactcccacaccttcaccggggtttcctggaacagcaccatcccgcccggaggcaccgcctcttccggcttcatcgcttccggcagcggcgaacccacccactgcaccatcaacggcgccccctgcgacgaaggctccgagccgggcggccccggcggtcccggaaccccctcccccgaccccggcacgcagcccggcaccggcaccccggtcgagcggtacggcaaagtccaggtctgcggcacccagctctgcgacgagcacggcaacccggtccaactgcgcggcatgagcacccacggcatccagtggttcgaccactgcctgaccgacagctcgctggacgccctggcctacgactggaaggccgacatcatccgcctgtccatgtacatccaggaagacggctacgagaccaacccgcgcggcttcaccgaccggatgcaccagctcatcgacatggccacggcgcgcggcctgtacgtgatcgtggactggcacatcctcaccccgggcgatccccactacaacctggaccgggccaagaccttcttcgcggaaatcgcccagcgccacgccagcaagaccaacgtgctctacgagatcgccaacgaacccaacggagtgagctgggcctccatcaagagctacgccgaagaggtcatcccggtgatccgccagcgcgaccccgactcggtgatcatcgtgggcacccgcggctggtcgtcgctcggcgtctccgaaggctccggccccgccgagatcgcggccaacccggtcaacgcctccaacatcatgtacgccttccacttctacgcggcctcgcaccgcgacaactacctcaacgcgctgcgtgaggcctccgagctgttcccggtcttcgtcaccgagttcggcaccgagacctacaccggtgacggcgccaacgacttccagatggccgaccgctacatcgacctgatggcggaacggaagatcgggtggaccaagtggaactactcggacgacttccgttccggcgcggtcttccagccgggcacctgcgcgtccggcggcccgtggagcggttcgtcgctgaaggcgtccggacagtgggtgcggagcaagctccagtcctgatgtgcagcgcggtggctgcgcgcccctgagcacagcaagcagcccgcgaggctcagccccgcgggccgcttctctgggtccttcctcccccgtggggatgagcggagaggatcagcgagcggtgcagctcagcgtcagcgagctagggacgtcgcccagccgatgaagccgaacgtggcggactgtcccgcacccagg

SEQ ID NO: 826 - protein, 466 aa, Thermobifida fusca
  misc_feature (11)..(11): Xaa can be any naturally occurring amino acid
MAKSPAARKGXPPVAVAVTAALALLIALLSPGVAQAAGLTATVTKESSWDNGYSASVTVRNDTSSTVSQWEVVLTLPGGTTVAQVWNAQHTSSGNSHTFTGVSWNSTIPPGGTASSGFIASGSGEPTHCTINGAPCDEGSEPGGPGGPGTPSPDPGTQPGTGTPVERYGKVQVCGTQLCDEHGNPVQLRGMSTHGIQWFDHCLTDSSLDALAYDWKADIIRLSMYIQEDGYETNPRGFTDRMHQLIDMATARGLYVIVDWHILTPGDPHYNLDRAKTFFAEIAQRHASKTNVLYEIANEPNGVSWASIKSYAEEVIPVIRQRDPDSVIIVGTRGWSSLGVSEGSGPAEIAANPVNASNIMYAFHFYAASHRDNYLNALREASELFPVFVTEFGTETYTGDGANDFQMADRYIDLMAERKIGWTKWNYSDDFRSGAVFQPGTCASGGPWSGSSLKASGQWVRSKLQS

SEQ ID NO: 827 - DNA, 1621 bp, Thermobifida fusca
cgatatggatgatctgacgtctgaatccccttgtcaccctagacattcacccattttgtcgcttttacggctttctttgggagttctccgtttcaccaaggaacaaaaccgcaacggagagtaggcgcggtctttacagctcccttgccaatggttatcgtccgaacggaaaacgatctgggagcgctcccagccatgcgctcctcttcgtgcccctcacttcttttgagccttgtgctcgttaggagccccgaatgtcccccagacctcttcgcgctcttctgggcgccgcggcggcggccttggtcagcgcggctgctctggccttcccgtcgcaagcggcggccaatgattctccgttctacgtcaaccccaacatgtcctccgccgaatgggtgcggaacaaccccaacgacccgcgtaccccggtaatccgcgaccggatcgccagcgtgccgcagggcacctggttcgcccaccacaaccccgggcagatcaccggccaggtcgacgcgctcatgagcgccgcccaggccgccggcaagatcccgatcctggtcgtgtacaacgccccgggccgcgactgcggcaaccacagcagcggcggcgcccccagtcacagcgcctaccggtcctggatcgacgaattcgctgccggactgaagaaccgtcccgcctacatcatcgtcgaaccggacctgatctcgctgatgtcgagctgcatgcagcacgtccagcaggaagtcctggagacgatggcgtacgcgggcaaggccctcaaggccgggtcctcgcaggcgcggatctacttcgacgccggccactccgcgtggcactcgcccgcacagatggcttcctggctccagcaggccgacatctccaacagcgcgcacggtatcgccaccaacacctccaactaccggtggaccgctgacgaggtcgcctacgccaaggcggtgctctcggccatcggcaacccgtccctgcgcgcggtcatcgacaccagccgcaacggcaacggccccgccggtaacgagtggtgcgaccccagcggacgcgccatcggcacgcccagcaccaccaacaccggcgacccgatgatcgacgccttcctgtggatcaagctgccgggtgaggccgacggctgcatcgccggcgccggccagttcgtcccgcaggcggcctacgagatggcgatcgccgcgggcggcaccaaccccaacccgaaccccaacccgacgcccacccccactccgacccccacgccgcctcccggctcctcgggggcgtgcacggcgacgtacacgatcgccaacgagtggaacgacggcttccaggcgaccgtgacggtcaccgcgaaccagaacatcaccggctggaccgtgacgtggaccttcaccgacggccagaccatcaccaacgcctggaacgccgacgtgtccaccagcggctcctcggtgaccgcgcggaacgtcggccacaacggaacgctctcccagggagcctccacagagttcggcttcgtcggctctaagggcaactccaactctgttccgacccttacctgcgccgccagctgacccctcctggcagtgcactgggtggcttaggcgtgctgggg

SEQ ID NO: 828 - protein, 441 aa, Thermobifida fusca
MSPRPLRALLGAAAAALVSAAALAFPSQAAANDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMSSCMQHVQQEVLETMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNAWNADVSTSGSSVTARNVGHNGTLSQGASTEFGFVGSKGNSNSVPTLTCAAS

SEQ ID NO: 829 - DNA, 3289 bp, Thermobifida fusca
ttttgttgttacagggaggaaagagcagccggaaagttctattccgagcgtaactattgacaccgctgagtgatcctgtttttatgtcataggtcacatgaaatgggagcgctcccatggtgggcctccgctgtgaggtcatcctcccagttcgaatccccctacggaaggacttccgtgcttaggagacccagatctcgatccccccttgtcgccctcaccgcggcgacttgccgagtcgcgctcgggggtacggcggttcccgcccaggcagacgaagtcaaccagattcgcaacggcgacttcagctccggcaccgcaccctggtggggaaccgagaacatccaactcaacgtcaccgacgggatgctgtgcgtcgacgtccccggcggcaccgtcaacccgtgggacgtgatcatcggccaggacgacatccccctcatcgaaggtgagtcctacgccttctccttcactgcctccagcaccgtccccgtctccatccgcgccctggtgcaagagcccgtggagccgtggaccacccagatggacgagcgtgccctgctcggccccgaggcagaaacctacgaattcgtcttcacctccaacgtcgactgggacgacgcccaagtcgccttccagatcggcggctccgacgaaccgtggaccttctgcctcgacgacgtcgccctgctcggccgcgccgaacccccggtctacgaacccgacaccggaccgcgggtccgcgtcaaccaggtcggctacctcccgcacggtcccaagaaggcgaccgtggtcaccgacgccaccagcgcgctcacctgggagcttgccgacgccgacggtaacgtggtcgccagcggccagaccaagccgcacggcgcggactccagctccgggctcaacgtccacaccgtcgacttcagctcctacaccacgaagggaagcgactacacgctcaccgtcgacggtgaaaccagctaccccttcgacatcgacgaaagcgtctacgaggaactgcgcgtcgacgcgctgtcgttctactacccgcagcgcagcggcatcgagatcctcgactccatcgcccccggctacggacgcccggccggccacatcggcgtgccccccaaccagggcgataccgacgtgccgtgcgcgcccggcacctgcgactactccctggacgtctccggcggctggtacgacgcgggcgaccacggcaaatacgtggtcaacggcggtatctcggtgcaccagatcatgagcatctacgagcgctcccagctcgccgacaccgcccagcccgacaagctggccgactccaccctgcgcctgcccgaaaccggcaacggcgtgcccgacgtgctcgacgaagcacgctgggagatggagttcctcctcaagatgcaggtgcccgaaggcgaaccgctcgccggcatggcgcaccacaagatccacgacgaacagtggaccgggctgccgctgctgccctccgctgacccgcagccgcgctacctgcagccgccgtccaccgcggccacgctgaacctggccgccaccgccgcccagtgcgctcgcgtgttcgaacccttcgacgaggatttcgccgccgagtgcctggctgccgcggaaaccgcgtgggacgccgccaaggccaacccgaacatctacgcgcctgccttcggtgaaggcggcggcccgtacaacgacaacaacgtcaccgacgagttctactgggccgcggccgaactgttcctcaccaccggcaaggaggagtaccgcgacgcggtgacctcgtcgccgctgcacaccgacgacgaagaggtcttccgcgacggcgccttcgactggggatggactgctgcgctggcccgcctccagctggccacgatccccaacgacctcgccgaccgcgaccgggtgcgccagtccgtggtcgatgccgccgacatgtacctcgccaacgtcgagaccagcccgtggggcctggcctacaagccgaacaacggcgtgttcgtctggggctccaacagcgctgtcctcaacaacatggtgatcctggcggtcgccttcgacctcaccggtgacaccaaataccgcgacggcgtgctggaaggcatggactacatcttcggccgcaacgcgctgaaccagtcctacgtcaccggctacggcgacaaggactcccgcaaccagcacagccgctggtacgcccaccagctcgacccccggttgcccaacccgcccaagggcacgctggccggtggacccaactccgactccaccacctgggacccggtggcccagtccaagctgaccgggtgcgccccccagatgtgctacatcgaccacatcgagtcgtggtccaccaacgagctgaccatcaactggaacgcccccctgtcgtggatcgcgtccttcatcgccgaccaggacgacgccggcgagcccggcggagaagagcccggaccgggcgacgacgagaccccgccgagcaagcctgggaacctgaaggccagcgacatcaccgcgaccagcgccaccctgacctgggacgcctccaccgacaacgtcggagtggtcggctacaaggtctccctggtccgcgacggtgacgctgaagaggtgggcaccaccgcgcagaccagctacacgctcaccgggctgagcgcggaccaggagtacaccgtccaggtggtcgcctacgacgcggcaggcaacctctccacgccagccaccgtcaccttcaccaccgagaaggaggacgagactcccacgcccagcgcctcctgcgcggtgacgtaccagaccaacgactggccgggcggcttcaccgcctcggtgacgctgaccaacaccggcagcaccccgtgggactcctgggaactgcgcttcaccttcccgtcgggacagactgtcagccacggctggagcgccaactggcagcagagcggcagtgacgtgaccgccacctccttgccgtggaacggatcagttccgccgggcggcggctcagtcaacatcggcttcaacggaacctggggcggttcgaacaccaaacctgagaagttcaccgtcaacggcgcggtctgctccatcggctgaacctcgccctggattcggatgtaagccgccgtggcccctgtcatcggcgggggccacacccggcaccatccccgcacaccccctgtgcggggatggtgctcccctcattggtctggtaagacgaggaaggcgccaacgtgacctccgagagccccgtgcgcgcggccccccgtgccggacggatgac

SEQ ID NO: 830 - protein, 974 aa, Thermobifida fusca
MLRRPRSRSPLVALTAATCRVALGGTAVPAQADEVNQIRNGDFSSGTAPWWGTENIQLNVTDGMLCVDVPGGTVNPWDVIIGQDDIPLIEGESYAFSFTASSTVPVSIRALVQEPVEPWTTQMDERALLGPEAETYEFVFTSNVDWDDAQVAFQIGGSDEPWTFCLDDVALLGRAEPPVYEPDTGPRVRVNQVGYLPHGPKKATVVTDATSALTWELADADGNVVASGQTKPHGADSSSGLNVHTVDFSSYTTKGSDYTLTVDGETSYPFDIDESVYEELRVDALSFYYPQRSGIEILDSIAPGYGRPAGHIGVPPNQGDTDVPCAPGTCDYSLDVSGGWYDAGDHGKYVVNGGISVHQIMSIYERSQLADTAQPDKLADSTLRLPETGNGVPDVLDEARWEMEFLLKMQVPEGEPLAGMAHHKIHDEQWTGLPLLPSADPQPRYLQPPSTAATLNLAATAAQCARVFEPFDEDFAAECLAAAETAWDAAKANPNIYAPAFGEGGGPYNDNNVTDEFYWAAAELFLTTGKEEYRDAVTSSPLHTDDEEVFRDGAFDWGWTAALARLQLATIPNDLADRDRVRQSVVDAADMYLANVETSPWGLAYKPNNGVFVWGSNSAVLNNMVILAVAFDLTGDTKYRDGVLEGMDYIFGRNALNQSYVTGYGDKDSRNQHSRWYAHQLDPRLPNPPKGTLAGGPNSDSTTWDPVAQSKLTGCAPQMCYIDHIESWSTNELTINWNAPLSWIASFIADQDDAGEPGGEEPGPGDDETPPSKPGNLKASDITATSATLTWDASTDNVGVVGYKVSLVRDGDAEEVGTTAQTSYTLTGLSADQEYTVQVVAYDAAGNLSTPATVTFTTEKEDETPTPSASCAVTYQTNDWPGGFTASVTLTNTGSTPWDSWELRFTFPSGQTVSHGWSANWQQSGSDVTATSLPWNGSVPPGGGSVNIGFNGTWGGSNTKPEKFTVNGAVCSIG

SEQ ID NO: 831 - DNA, 2641 bp, Actinomyces sp. 40
tgcacccaaccggtctggttgcccggccggttgggtgcctgaatggctagtcactcggccgcttaaccacttccctgcttgactactttgctgcctggctgcccggcggctgttatcgtcacgcatcccaccaccaccgacagggcagcagcatcgagcatcccctcaccgacgaaggagccaccatggacgcagacgataccgaacaacagacagcgcaacatgacacttccggggattcggcaagcgacgcccgcgacatcgcgcccgtcccgcggaccgctgacaaccacgatgatgcgccgaccgtcgacttcacggtgagccagacgcggcaacttccgccagccgacgggtctgcggcgcaggtcggcgggcaatcggtcagtggacagtcaaatagcacttcgccaagcagcagcacgtcaaccggcaaccagcttgatcgttccgacgcggtccgtgacccatcggcggcaaacggcgatgccgggcgtccggaacacacggcagacacagccacgacagacgacacaaccacgcaggacacgtcgcacagggcacgcggttccaaacaccgagggacgcctggcaagcccagcaacggcaagctcgcacgacgactgattgcggttgtggcggccatcgtcatcttcctcgccggagcgggaacggcaatcgccatcaccacctaccggcaacggcaggataccgctcggcaaacagcccacacctcgaacggcacaaccgcgggggcaccggcgaaatcctccggaacggcaagcgcggcagagtacatcaaggcgatgcaatccttcacagcagatgccggcgcggacaaacttgcctaccaagtcaccgggaaaaccaccaatctggcagcaagcgacaccccatatggcaagcatggcaagctctcggtaggcacaacagacgggttgagcgcgcccacaatcctcgatgagcacggcatgcccttccaactgcgaggcgccagcacccacggcctgcaatggttcggacagtacgtgaacaaagcagcgttccagtcgttgcgcgacgaatggggtctgaatatggtccgtctggccgtgtatccgcgggaaggcgggtatctgcaaggctcgcaggcccagatggacaaaacaatcgagcagggcgtccaggcagcgaccgatctgggcatgtacgtcatcatcgactggcatgtactgaactacaaccccaacggcgacgcgacccaagccgaatcgttcttcaagagctacgcggcgaaatacaagtcttatggcaacgtaatcttcgaagtatgcaacgagcccaccggcacgccgtggtacgacggctcaggcaatgacatctacagctactgcacgcgcatggccaaagccatccgggacgccggcagcgatgcgatcatcctgtgcgggaccaatacgtggtcgcaggatatcgacgcggtcgcaggcaagccgctctccgcggacgggttcgacaacatcatgtatgtgctgcatttctatgccgccacgcacaaagacgatctgcgggcgaagcttcaaaccgcgctcaatgcgggcacgccggtcttcgtcagcgaattcgggctctgcgacgcttcaggcaacggcggaatcgaccaggacagcgccaacgcatggatgaccctgctcgcccacaacaacatcagctatgcggcatgggcgctgtcaaacaaggcggagaccgccgcattcttcaagccatccgtcaccgcgacttccaagtggaccggtgacgacctgacgccgagcgcaatctggctggtcaacaccagccgcaaactcgccgattttgccgaccatgcggcatcgggaacatcctccggctcgtcgaaagcctcctcgggtaccggggcgggcaacgggaaaaagtcatccgcttccgcttcatcatccccgtccgcggcgtcagggggtctcacagccacagcggcgatacgcaaccaatggaattccggggcaacgtacgccatcaccgtgagcaatgcgtccggcagcaagcatgagggcgcttggcaggtcaccttcgacctcgacgccgaaatcgccgacatctggggcggcaccatcgtcagtcatgaaggcacacactatgtggtcgcgcccatggattggaatacggcgatcgaagcgggcgccagcgcggaaatcgggttcaacgcctccagcaccgggcaagcctcgcaaccgcagcatctcagcgtgcagtgacggccatcgagccgctgcacgctgagatgctgggacgggtacgggacatacggtgcacgcatcggcgaggctgtcgcaaggagatgactcgtctgcggcttgccgcgatgtccttggattccgactgagcaatcttcaatacgcacatccactcgacggcacctcgcaatagtatggaaacgatattcgtggaaatcgaacccacagaatgggtcgtggctcagcgcaaggacaaggtgcaggggtggaccacatccgtgtcccgatcacggccgcaacagaaaagtcaaggagtactcatgaccgattaccagccgcaaccgacccagccgacgcaaccggcgcaaccggcgcaacctcaagcaccgcaataccccaatgcccagcag

SEQ ID NO: 832 - protein, 481 aa, Actinomyces sp. 40
MQSFTADAGADKLAYQVTGKTTNLAASDTPYGKHGKLSVGTTDGLSAPTILDEHGMPFQLRGASTHGLQWFGQYVNKAAFQSLRDEWGLNMVRLAVYPREGGYLQGSQAQMDKTIEQGVQAATDLGMYVIIDWHVLNYNPNGDATQAESFFKSYAAKYKSYGNVIFEVCNEPTGTPWYDGSGNDIYSYCTRMAKAIRDAGSDAIILCGTNTWSQDIDAVAGKPLSADGFDNIMYVLHFYAATHKDDLRAKLQTALNAGTPVFVSEFGLCDASGNGGIDQDSANAWMTLLAHNNISYAAWALSNKAETAAFFKPSVTATSKWTGDDLTPSAIWLVNTSRKLADFADHAASGTSSGSSKASSGTGAGNGKKSSASASSSPSAASGGLTATAAIRNQWNSGATYAITVSNASGSKHEGAWQVTFDLDAEIADIWGGTIVSHEGTHYVVAPMDWNTAIEAGASAEIGFNASSTGQASQPQHLSVQ

SEQ ID NO: 833 - DNA, 1890 bp, Clostridium cellulovorans
ttatcctaacttaattagaaaaccactatataccaacatactatattactattttaaaatttaaattacacaagatttaaggaggacattatgtttaataatgtaaaaaagaagatactttctattgttgcagccggtgctatgttgatggcattagtcccaaatataaatgttgcagcagaaacaacttattctaatttaactggaaatgctaatgttaaaaaaccttctgttggaggtaaattacaactactaaacaaaaatggtataaaaactctatgtgataaagatggaaatccaattcaattgagaggtatgagtacccatggtctacaatggtttcctggggtagttaataataatgcttttgcagccctttctaatgattggaattctaatgtaattcgtcttgctatgtatgttgctgaagggggatatgcaacaaacccatcagttaaacaaactgtcatcaacggaataaactatgcaattgcaaatgatatgtacgttattgtagattggcatatgatgaatccgggagatccaaatgctagcgtatattcaggcgcgcaaagcttctttaatgatatttctacactatatccaaataataaaaatataatttatgagttgtgtaatgaacctaatggtgaaaatggtggagtaacgaatgatgcaactggttgggctcaggtaaaatcatatgcaactcctatagtacaattacttagaaacaagggaaatgagaatcttatcatcgtaggaaatccattctggagtcaaagacctgatttagctgcagataatcctattaatgactcaaatacaatgtattctgtacatttttatagtggtactaatccaatatcaactgtagacactaatagagataatgctatgagcaatgtaagatatgctcttaaccatggagctgctgtttttgcaacagaatggggaactagtttagctactggtactactggaccttacctagctaaagcagatgcgtggctagatttcttaaatggaaacaacataagctggtgtaacttttcaataagtaacaaggatgaaaaagcagctgcacttaatagtttaacaagtcttgatccaggttctgataagttatgggcagataatgaattaaccacttcaggtcaatatgtacgtgctcgtattaagggagcttattatgctacaccagttgatcctgtaacaaaccaaccaacagcaccgaaagacttttcttcaggcttttgggactttaatgacggtactacacaaggttttggtgtaaatccagatagtccaataactgctattaatgttgaaaatgctaacaatgctttaaaaatcagcaatcttaatagtaagggtagtaatgatttatctgaaggaaacttttgggccaatgtccgcatttcagctgatatctggggacaaagtataaatatatatggagacacaaaactaacaatggatgttatagctccaacacctgtaaatgtatcaatcgcagctatcccacaaagtagtactcacggttggggaaatcctacaagagctatacgtgtttggacaaacaactttgtagcacaaactgatggaacctataaagcaactttgaccatttctacaaacgatagtccaaatttcaatactatagctacagatgctgctgatagtgtagtaacaaatatgattctatttgttggttcaaattcagataatatttctttagacaatataaagtttactaaataaaataataaaataatcttgcaactggcggaaatggaattaaccatagggagcaggattttagaaaagtatcgaccgtctgggtaaattaatatttatccagactttttattgttttacgaataccac

SEQ ID NO: 834 - protein, 557 aa, Clostridium cellulovorans
MFNNVKKKILSIVAAGAMLMALVPNINVAAETTYSNLTGNANVKKPSVGGKLQLLNKNGIKTLCDKDGNPIQLRGMSTHGLQWFPGVVNNNAFAALSNDWNSNVIRLAMYVAEGGYATNPSVKQTVINGINYAIANDMYVIVDWHMMNPGDPNASVYSGAQSFFNDISTLYPNNKNIIYELCNEPNGENGGVTNDATGWAQVKSYATPIVQLLRNKGNENLIIVGNPFWSQRPDLAADNPINDSNTMYSVHFYSGTNPISTVDTNRDNAMSNVRYALNHGAAVFATEWGTSLATGTTGPYLAKADAWLDFLNGNNISWCNFSISNKDEKAAALNSLTSLDPGSDKLWADNELTTSGQYVRARIKGAYYATPVDPVTNQPTAPKDFSSGFWDFNDGTTQGFGVNPDSPITAINVENANNALKISNLNSKGSNDLSEGNFWANVRISADIWGQSINIYGDTKLTMDVIAPTPVNVSIAAIPQSSTHGWGNPTRAIRVWTNNFVAQTDGTYKATLTISTNDSPNFNTIATDAADSVVTNMILFVGSNSDNISLDNIKFTK

SEQ ID NO: 835 - DNA, 1740 bp, Fibrobacter succinogenes
aaaaagaggatggcttcggccatccttttttgctttcgttcctttttgtcaattcttccttttttgtgacatcgcctttttgcgaatcttttgattatattcatagtgggggtatttaaggagatgttatggttcaatcaaaattttttggaattgcctgtggcgtagcatttttcgcaggctctgtttctgcagccactcttccaacggcgaaagaagttcaagccaagatgggcatgggcttcaacatcggtaactccatggaagtgccgaacagcccgaccttgtggggtaacccttacccgactcagcctttgctcgattccgtgaaggcggcgggattcaatacggtgcgtattccttgcgcttgggatagccacacgagtggtggcaaggtcactgaaacttggctcgattccgtgaagacggttgttgattacgcgatgcgcgcaggcctctacacgattttgaacatccaccacgaaggtgaaggtggttggttccagagcaacatcggcacgagtgtcgataataccatcgataacaagatgaaaacttactggacgcaaattgcgaacaagtttaaggattacaacgaacgcttgctctttgcgggcgcaaacgaacccggtccgaatgtgaacacgtggacatcgcagcatgtgcagacgctcatgcactactaccagacgtttattgatgctgtccgcgctacgggcggcaacaacgccacgcgtaccttgattatccagggtctcaataccgacattgacaagtcggtcaaaagcgctccggtaagcaccttcccgaaggacaaggtcgaaggccgcttgatgttcgaagtgcattactacgacccgtaccagtacacgctcatgacgagtcctcaggattggggtgctccaggtggtgaaatgattcagccacagtattactatggcgactacaccaaggctagcgaacccaagcgcaatgcgggttacaacgcctgggcgggttccgtcgattccaagctcgggagcatcgtgcatccgcaggaacagtttgccaagatgaagacgaattacgtggacaagggctatccggtcattgtcggtgaatttggtgcaaatgtccgctctccggaattgagcggttccgatctgaatctccataagcaaggccgcgtgcagtggcacaaggatgtcgtttcggctgctaagcagtacggcctcaccccgattctctgggacatgggcaatgaaagcagcactggctatgacaacatggcttatatccgccgtcaatcttctccggtgggcaaggtccttgaaacagacgttatcaacgccatgcgtagcgtttacagcctcggcaattacgtgaacaacggcgtcacgcacgttgaagactttatcaatggcggtaacgacgcgcccgcctccagttctagcgaaattgcgcagtccagcagctcggcaacgattgctttgccgaccattctcgcaactaaccaggtaaatctccgtcgtgctggcaacacgctttatgcatccggcgatattactctatttgacatgaacggaaacctcgtccgttccacgaataatgtgcctgctggacaggcccaaatgcagctggatggtctccgccaaggcaactacatcgccaagtgcaagaatagcgtcttgcaagtcaagattcgctaacaaaaccaccccgcgggcatttcaaacaatgtcttttgcgggcttttcctag

SEQ ID NO: 836 - protein, 519 aa, Fibrobacter succinogenes
MVQSKFFGIACGVAFFAGSVSAATLPTAKEVQAKMGMGFNIGNSMEVPNSPTLWGNPYPTQPLLDSVKAAGFNTVRIPCAWDSHTSGGKVTETWLDSVKTVVDYAMRAGLYTILNIHHEGEGGWFQSNIGTSVDNTIDNKMKTYWTQIANKFKDYNERLLFAGANEPGPNVNTWTSQHVQTLMHYYQTFIDAVRATGGNNATRTLIIQGLNTDIDKSVKSAPVSTFPKDKVEGRLMFEVHYYDPYQYTLMTSPQDWGAPGGEMIQPQYYYGDYTKASEPKRNAGYNAWAGSVDSKLGSIVHPQEQFAKMKTNYVDKGYPVIVGEFGANVRSPELSGSDLNLHKQGRVQWHKDVVSAAKQYGLTPILWDMGNESSTGYDNMAYIRRQSSPVGKVLETDVINAMRSVYSLGNYVNNGVTHVEDFINGGNDAPASSSSEIAQSSSSATIALPTILATNQVNLRRAGNTLYASGDITLFDMNGNLVRSTNNVPAGQAQMQLDGLRQGNYIAKCKNSVLQVKIR

SEQ ID NO: 837 - DNA, 2492 bp, Ruminococcus flavefaciens
atcgatagcacgcctcaacaaggacctgagatacttctttttccttgaggtgccggaaaacggtctgaatcactatttcggagacatcaccaatatggcaaggcttttcaacactcttgcggatgtggatgccctgaacatcatcatgtacctcggtgcaagcgcaaggaacaagatgttttcggctgaaaatatctccgagaaactgaatattccgctggataaggtgcagtacatcatcgacaggctggacagattcggacttgtctggcgagtaggtgctgttctcagcgatgagtcggtgatactctacggttactctcaccaccacatgataacattcatgctggttctggcaagagcgatcacaaattatctgaaatatatcgagccgaataccgatatctggcgtcagggagctttccgttacagtgacggaagcgatgataccaaagtcccgtcagtaagatggtgggaaaaggacgagaaatgatccggtaatcgatcggtgaaaataaaagggatactaattacaaggaggaatttcttatgagaaaatcaacagcatttctgacagcacttgctatggcaggttgtacactgtctgcaccattaggcgtgttgcccgaaacaaaggtgaatgcagcaggaggttttgatatgaatatcaaggtagacctcaagggcgagcgcaaggagataagccctcttatctacggcgttaaccagtataccacagacctcaagagcgtcaagactactgctgtacgtcagggcggtaaccgtatgactgcttacaactgggagaacaatgcttcaaacgcaggttcggactggaaacacagttccgataacaacctctcggattcaaatcctcctgctgaggtagttcagagactttccaaggaagctgcaaagtacggcgttgattacaaaatgacaactctccagatggcaggctacgtttcagctgataaggacggcactgtcaaggaagatgaagtcgctccttcaaagcgctggaacgaggtaaagttcacaaagggcgcaccttttgctgatgagcctgatctgacagacggcgttgtttatatggatgagtacgtaaactacatcatcaataagctgggcgattcacagtcacctacaggtatccagggctacagccttgataacgagcctgttctctggaacgatactcacccgagagttcatcccgagcctgtaactatcgaagagcttggaaacaagtccatcgaacttgctaaggctgtcaagaagcttgatcctaaggctgagatcttcggacctgcactctatggctacactgctttcgatcacctcgacgatgacgagcagcatacagaatcgggagacgtaaagtccaagaacaactatcactggtatctggactgctatctcgaccagatgaagaaggcttctgaagaagaaggcacccgtctcctcgatgtacttgacatccactactactcggaatctgcaagaacaggcgctgaggacagagttcagtcagttcgtactctctatgaggaaggcttctccgagaacagctggatcggtcagtggtgtatgcagaatgtgcctatccttccgactataaagaagtccatagatacatactatcccggcacaaagctggctatctcagagtataacttcaagggcggcgaggatacttccggtactatcgctcaggcagaggcactgggatgcttcgctgatcagggcgtatatctcgcaactctctggggcggtgagccattcatcatctcaggtatcaacctctacactaactacgacggcaagggcggatgcttcggtgatactctcatccctgcttctactgaagatgtatcaaagtccagcacatacgctgctgttaacgacggcgatgagtcaaaggtaactgtcatgatcaccaacaagaatatgacagaagctgagaacgctgttatcgaccttgagaatgcttcaaaggactacaagtcagctgctgtttacgctgtatacggcgacaacgatcaggtaagacttctcgacatcgtaaaggatgtcaaggataacaaggtaaatgttgagcttcctgctttctcagctgcaatggtagttgtatccgatgacgccgctgctttcgacggtgagaagatatacgaggaaaagaaggtaaccgagaagactgaggaattcaaggatccttcttcaatgataaataagaacggctatgttgaaattccgataacagatcctgagcaggtctcaaagatcgttatcaacggcgatgttacatcaagtgcaggttcaggctgggcaacagccaggctgtgcagtatgcatcaacgcaaaggacaaggccggcaaggatttctggacatacaagagctacagtctcccgctgggcaagggtcagtccgctatcgtaaagtttgacggcacactcacaaagaccacaggtgaaggtgaggacaaggtat

SEQ ID NO: 838 - protein, 632 aa, Ruminococcus flavefaciens
MRKSTAFLTALAMAGCTLSAPLGVLPETKVNAAGGFDMNIKVDLKGERKEISPLIYGVNQYTTDLKSVKTTAVRQGGNRMTAYNWENNASNAGSDWKHSSDNNLSDSNPPAEVVQRLSKEAAKYGVDYKMTTLQMAGYVSADKDGTVKEDEVAPSKRWNEVKFTKGAPFADEPDLTDGVVYMDEYVNYIINKLGDSQSPTGIQGYSLDNEPVLWNDTHPRVHPEPVTIEELGNKSIELAKAVKKLDPKAEIFGPALYGYTAFDHLDDDEQHTESGDVKSKNNYHWYLDCYLDQMKKASEEEGTRLLDVLDIHYYSESARTGAEDRVQSVRTLYEEGFSENSWIGQWCMQNVPILPTIKKSIDTYYPGTKLAISEYNFKGGEDTSGTIAQAEALGCFADQGVYLATLWGGEPFIISGINLYTNYDGKGGCFGDTLIPASTEDVSKSSTYAAVNDGDESKVTVMITNKNMTEAENAVIDLENASKDYKSAAVYAVYGDNDQVRLLDIVKDVKDNKVNVELPAFSAAMVVVSDDAAAFDGEKIYEEKKVTEKTEEFKDPSSMINKNGYVEIPITDPEQVSKIVINGDVTSSAGSGWATARLCSMHQRKGQGRQGFLDIQELQSPAGQGSVRYRKV

SEQ ID NO: 839 - DNA, 1708 bp, Erwinia chrysanthemi
gatctactgtagaaaatccactataacctagggagcctcatcatgtgcaagtattgcaatattgatgaacacaccgactgaatagaataaaaccaatcgcctattctatttacagttaacactaacacatcgccatatgaaatggagattcatgtatgccgctctcttatttggataagaatccagtcatcgatagcaaaaaacacgccctacgtaaaaaattgtttttatcttgtgcctattttggattaagccttgcctgtctttccagtaatgcctgggcgagcgttgaaccgttatccgttaacggtaataaaatctacgcaggtgaaaaagccaaaagttttgccggcaacagcctattctggagtaataatggctggggcggagaaaaattctatacagccgataccgttgcatcgctgaaaaaagactggaaatccagcattgttcgcgccgctatgggcgttcaggaaagcggtggttatctgcaggacccggctggcaacaaggccaaagttgaaagagtggtggatgccgcaatcgccaacgatatgtatgcgattattggctggcactcgcattctgcagaaaacaatcgcagtgaagccattcgtttctttcaggaaatggcgcgcaaatatggcaacaagccgaatgtcatttatgaaatctacaacgaaccgcttcaggtttcatggagcaataccattaaaccttatgccgaagccgtaatttccgccattcgcgccattgacccggataacctgattattgtcggtacgcccagttggtcgcaaaacgttgatgaagcgtcgcgcgatccaatcaacgccaagaatatcgcctatacgctgcatttctacgcgggaacccatggtgagtcattacgcaataaagcccgccaggcgttaaataacggtattgctcttttcgtcaccgagtggggcaccgttaacgcggacggcaatggcggagtgaaccagacagaaaccgacgcctgggtaacgttcatgcgtgacaacaacattcagctaacgcaaaactgggcgttgaatgataaaaacgaaggggcatcaacctattatccggactctaaaaacctgaccgagtcgggtaaaaaagtaaaatcgatcattcaaagctggccatataaagcgggcagcgccgccagtgcaacaaccgatccgtcaaccgataccaccatgacaccaccgttgacgaaccgaccacaaccgacacaccggcaaaccgctgattgcgccaatgccaacgtttaccccaactgggttagcaaagactgggcgggcgggcagcctctcataacgaagcaggccaatcgatcgtctacaaaggcaacctgtataccgcaaactggtacaccgcatccgttccgggcagcgattcctcctggacgcaggttggtagctgtaactaattgattaatcttttcacaccccaaaaaacaggctgcgattgcagccctgatatgcaacattccatcacttaattgcgttcaaaagcgcccaaatccggtgcgctgcctgaataactgatattgctctctttcgtacccgcgttaatcagctttgagttagccgacagacggaacacggaggtttccggcaacgagccgtcattatcacgagatacggtcgccacgaggtatcctgcctgacgaaatcggaccggaagccgccggtcccgt

SEQ ID NO: 840 - protein, 428 aa, Erwinia chrysanthemi
MPLSYLDKNPVIDSKKHALRKKLFLSCAYFGLSLACLSSNAWASVEPLSVNGNKIYAGEKAKSFAGNSLFWSNNGWGGEKFYTADTVASLKKDWKSSIVRAAMGVQESGGYLQDPAGNKAKVERVVDAAIANDMYAIIGWHSHSAENNRSEAIRFFQEMARKYGNKPNVIYEIYNEPLQVSWSNTIKPYAEAVISAIRAIDPDNLIIVGTPSWSQNVDEASRDPINAKNIAYTLHFYAGTHGESLRNKARQALNNGIALFVTEWGTVNADGNGGVNQTETDAWVTFMRDNNIQLTQNWALNDKNEGASTYYPDSKNLTESGKKVKSIIQSWPYKAGSAASATTDPSTDTTMTPPLTNRPQPTHRQTADCANANVYPNWVSKDWAGGQPLITKQANRSSTKATCIPQTGTPHPFRAAIPPGRRLVAVTN

SEQ ID NO: 841 - DNA, 5284 bp, Caldocellum saccharolyticum
taatgagcctgagccagttccagcttcaaaatgataaaatacattaaataggaatttatggatatatgagaaaaatttaaggtcagtaggggaatgtatagttaaagtcattaagcaagcgaattaaaggaaaaaggggggcgataaaaaacggctaaaaacataagtaattattaaacatttattgtaggaactaagtataagtttcaaaatcataccgtccaatacgattaattgaagttaactatcaaatcaaaaagagggggttagggttaaaaatgcttaaactaaaaaaagcaataaaaaggataacactgtgtgttgctgtggtatttctattgcagattttatttctattttcaggatacaataacagtgatgtgaaagcagcaacaacctttaactatggtgaagctcttcaaaaagcaattatgttttatgaattccagatgtcaggtaaactgccatcatggatccgcaacaactggcgaggagattctggtctaaatgatggtaaagatgtaggcttggatctaacaggtggctggcatgatgcaggcgatcatgtaaagtttaatctaccaatgtcatacagtgcttcaatgctttcgtgggcagtttatgagtataaagcagcatttgagaaaagtggccagcttgaacatatacttaaccagatagaatgggtaaacgactactttgtaaaatgccatccatcaaagtatgtatactactatcaagttggtgatccaattgaagatcataacttctggggaccagcagaagttatgcaaatgaaacggccagcatacaagtgtgatttaaataatccagcaagttcagttgttgcagaaacagctgcatccttggctgcagcttcaatcgttatacgtgaaagaaacagtcaaaaggcagacacatatttgcagcatgcgatagaactctttgattttgctgatagaactcgtagcgatgcagggtatactgcagcaaccggcttttacacatcaggtggctttattgatgatcttggctgggcggcagtgtggttatatcttgcgacaaatgacaaatcatatttggataaagctgagacgcttatggcagaatatgccggtggcacaaatacatggacacagtgctgggatgatgtaagatacggagcaatcttacttttagcaaagattactaataaagacatatataaaggtgctgttgaaagaaatcttgatcattggacatataacataacatatacacctaagggtcttgcatggctaacagggtggggctcacttaggtatgctacaactgcagctttcttagcgtttgtttatgcagattggtcgggatgtccagaaaataagcgaacagcttatctaaaatttggtgagagtcagattaactatgcattaggttcaacaggaagaagctttttggtaggatttggacaaaattatccacaacatccacatcatagaaatgcacatagttcatgggcgaacagtatgcgaatacccgaatatcatcgacacatactttatggtgcattagtaggtggaccaggctctgatgatagttacaatgatgatattactgactatgtacaaaacgaggtggcttgtgactacaatgctggtattgttggtgctctagcaaaaatgtaccttatgtatggaggagacccaatacctaatttcaaagctatcgaaaagccaactaatgatgaaatttttgttgaatccaagtttggtaattcacagggtgcaaactatactgaaataatttcatacatttataacagaacgggatggccaccacgggtcacagataatttaaactttaagtattttattgacctaagtgagttaatcaaggctgggtatggtcctgatattgttaaagtagagacatattattcggaaggtggaaaaatatctggaccatacgtatggaatgcgtcaaagaacatttactatatattggttgattttacagggacaaaaatatacccaggtggggaagtagaacacaaaaaacaagctcaatttaagatctctgtaccacaaggcgttccatgggatccaactaatgacccatcttatgcaggattaacaaaagaacttagtaagaataaattcatagcagcttatgaaggtaatgtgctggtatggggacaagaaccagagggatcctcaagttcaacgccaacaccaacacctgtgccgacggtgacagtaacaccgacgccgacaccgacagtaacagtaacgccaaccccgacgccgacagtaacagcgactccaacacctacacctacacctgttagcacacctgcgacaggtgggcagataaaggtactgtatgctaacaaggagacaaacagcactacaaacacgataaggccatggttgaaggtagtgaatagtggcagcagtagtatagatttgagcagggtaacgataaggtactggtacacggtagatggtgagagggcacagagtgcggtatcagactgggcacagataggagcaagcaatgtaacattcaagtttgtaaagctgagcagtagtgtaagtggagcggattattacttggagataggatttaagagtggagcagggcagttacagcctgggaaggacacaggagagatacagataagatttaacaaggatgactggagcaattacaatcaggggaatgactggtcatggttacagagcatgacgagttatggagagaatgagaaggtaacggcgtatatagatggtgtgctggtatggggacaggagccgagtggagcgacacctgcgccagccccgacagcgacgtcgacacctacaccaacagtaacaccgacgccgacaccgacagtaacagtaacgccaaccccgacgccgacagtaacagcgactccaacacctacacctacacctgttagcacacctgcgacaggtgggcagataaaggtactgtatgctaacaaggagacaaacagcactacaaacacgataaggccatggttgaaggtggtgaatagtggcagcagtagtatagatttgagcagggtaacgataaggtactggtacacggtagatggtgagagggcacagagtgcgatatcagactgggcacagataggagcaagcaatgtaacattcaagtttgtgaagctgagtagtagtgtaagtggagcggactattacttggagataggatttaagagtggagcagggcagttgcagcctgggaaggacacaggagagatacagataagatttaacaaggatgactggagcaattacaatcaggggaatgactggtcatggttacagagcatgacgagttatggagagaatgagaaggtaacggcgtatatagatggtgtgctggtatggggacaggagccgagtggaacaacacctgcgccgacgtcaacaccgacagtaacggtaacaccaacaccgacacccacaccaacacctacaccaacagtaacaccgacaccaacaccaacaccgggtaatggattagcaagaattgatacaagcacattggtagggactaatcagcacactgttggtatagagatagacttgatacggcattgcgtggaatcaggcatggggtatgaactctgtgagggtagtgctgagtaatggttaccgatggacgaagataccagcaagtgaagtggcaaatattatatcattgtcaagaagtcttggtttcaaagctattatattagaagtacacgacacaacaggatatggagaagatggggcagcgtgttcattggtacaagcagtggaatattggaaggagataaagagcgtattagacggtaacgaagattttgtaattataaacattggcaatgagccgtatgggaacaataactatcaaaactgggttaatgacacgaagaacgctataaaagcacttagagatgcaggattcaagcacacgataatggtggatgcgccgaactggggtcaggattggtctaatactatgagagataatgcccagagcataatggaagcagatcccctgcgcaatttggtattttcgattcatatgtatggtgtatacaatacagcaagcaaggtcgaagagtacatcaaatcatttgttgataaggggttaccattggttattggggaatttggacatcagcacacagatggtgaccctgatgaagaagctattgtcaggtatgcaaaacagtacaagataggattatttagttggtcgtggtgtggaaattcgagctatgttgggtatttggacatggtaaacaactgggaccccaataatccaactccatgggggcaatggtataaaactaatgcaattggtacaaagtagaagcataaataattcaaagtgttaattgcaaaattagttacttttgacctcacagggtggggtttcctgtacgcccgccctgttaattttatgaataaccttgttgtaagaccagtaatattaaattatttgggacaattggctggaaaattaacccatttaataccattaaatgggtattcaattaataacatacattttagaaaatgtcatcataaaattaaaatattctatgctaaaaattaaaggagtgaaaagttaatgcaaaataaaaatagtttaataatttttgcgataccaattgcaacaatatactttacgttacaagtcattacgattggttcaagagatatcccagtaacatattgggctcctaaggaagaaggatgcatcattgaaatttctattgcaaaagaatttataaaagatttctttgcatattttggttatggcgatggaaaaattgatgtacaatttttaaaagataactctataatattacagcaatctgttcaagctgctttttaccaagggaaaattgtaccagtaaacaatattgttgacaaaatcatcattgtaacacacggaaataatattgagatcaaagaagttgcagcacggaaggattacaaaaatttcttaaacttatcgaaagcagtaattaacattttaaaaggttcaaaatatatagggaatcctaacaatatagttgaagaacagtcaaaaatgagaacaattttaaattaccgttacagttcatattttgatgaaatatatcacgcgaggacagcttatgaacttttaaagggattgcctccatatgatttagtccatccgccattgggtaagtggttaatatcaatcggaatggcaatatggggagtaaatccatttgggtggagatttgtta

SEQ ID NO: 842 - protein, 1934 aa, Clostridium thermocellum
ATATTACCCTATCAAATAACCCATTCAATTCGCATTTATTTTAAGGGAGAAAATTAACTGTTTGAAGATTATATATATTTTGAAGATTATATATATATTCTTTTATTTCTGATTTTTAATTCTAATTTGTATAAACATGACAAAATAAATATGATATAATGATTGTAAAGGATTGGTTGGCATAACGGAGACTTTAAGGATGTTATTGGTTTGGTAAATGTTTTTGGGTAACGATATTTATTTTTATTTATAATTTTTATTTATAAATTTTATATTAAATTTAAAAAGGAGGAAAAAAAAGTGAAGAACGTAAAAAAAAGAGTAGGTGTGGTTTTGCTGATTCTTGCAGTGTTGGGGGTTTATATGTTGGCAATGCCGGCAAACACTGTGTCAGCGGCAGGTGTGCCTTTTAACACAAAATACCCCTATGGTCCTACTTCTATTGCCGATAATCAGTCGGAAGTAACTGCAATGCTCAAAGCAGAATGGGAAGACTGGAAGAGCAAGAGAATTACCTCGAACGGTGCAGGAGGATACAAGAGAGTACAGCGTGATGCTTCCACCAATTATGATACGGTATCCGAAGGTATGGGATACGGACTTCTTTTGGCGGTTTGCTTTAACGAACAGGCTTTGTTTGACGATTTATACCGTTACGTAAAATCTCATTTCAATGGAAACGGACTTATGCACTGGCACATTGATGCCAACAACAATGTTACAAGTCATGACGGCGGCGACGGTGCGGCAACCGATGCTGATGAGGATATTGCACTTGCGCTCATATTTGCGGACAAGTTATGGGGTTCTTCCGGTGCAATAAACTACGGGCAGGAAGCAAGGACATTGATAAACAATCTTTACAACCATTGTGTAGAGCATGGATCCTATGTATTAAAGCCCGGTGACAGATGGGGAGGTTCATCAGTAACAAACCCGTCATATTTTGCGCCTGCATGGTACAAAGTGTATGCTCAATATACAGGAGACACAAGATGGAATCAAGTGGCGGACAAGTGTTACCAAATTGTTGAAGAAGTTAAGAAATACAACAACGGAACCGGCCTTGTTCCTGACTGGTGTACTGCAAGCGGAACTCCGGCAAGCGGTCAGAGTTACGACTACAAATATGATGCTACACGTTACGGCTGGAGAACTGCCGTGGACTATTCATGGTTTGGTGACCAGAGAGCAAAGGCAAACTGCGATATGCTGACCAAATTCTTTGCCAGAGACGGGGCAAAAGGAATCGTTGACGGATACACAATTCAAGGTTCAAAAATTAGCAACAATCACAACGCATCATTTATAGGACCTGTTGCGGCAGCAAGTATGACAGGTTACGATTTGAACTTTGCAAAGGAACTTTATAGGGAGACTGTTGCTGTAAAGGACAGTGAATATTACGGATATTACGGAAACAGCTTGAGACTGCTCACTTTGTTGTACATAACAGGAAACTTCCCGAATCCTTTGAGTGACCTTTCCGGCCAACCGACACCACCGTCGAATCCGACACCTTCATTGCCTCCTCAGGTTGTTTACGGTGATGTAAATGGCGACGGTAATGTTAACTCCACTGATTTGACTATGTTAAAAAGATATCTGCTGAAGAGTGTTACCAATATAAACAGAGAGGCTGCAGACGTTAATCGTGACGGTGCGATTAACTCCTCTGACATGACTATATTAAAGAGATATCTGATAAAGAGCATACCCCACCTACCTTATTAGTGTAATGGGTTTTTGACAGATTTACGGAAAGAGTTACTGCAAACTACCTGAATAGGTGGGCAGTAACTCTTTTTGTTTTCAAGCCTGTTAATAAGAAATTGTTTTGTAAAGGGTAGCTTGTAATATTTGTATTTTGGAGGTCTCTTATGAAAAAAATACCGTTACTTATGCTGCTGTCAGCAATAATATTTTTATCTTTA

SEQ ID NO: 843 - protein, 477 aa, Clostridium thermocellum
MKNVKKRVGVVLLILAVLGVYMLAMPANTVSAAGVPFNTKYPYGPTSIADNQSEVTAMLKAEWEDWKSKRITSNGAGGYKRVQRDASTNYDTVSEGMGYGLLLAVCFNEQALFDDLYRYVKSHFNGNGLMHWHIDANNNVTSHDGGDGAATDADEDIALALIFADKLWGSSGAINYGQEARTLINNLYNHCVEHGSYVLKPGDRWGGSSVTNPSYFAPAWYKVYAQYTGDTRWNQVADKCYQIVEEVKKYNNGTGLVPDWCTASGTPASGQSYDYKYDATRYGWRTAVDYSWFGDQRAKANCDMLTKFFARDGAKGIVDGYTIQGSKISNNHNASFIGPVAAASMTGYDLNFAKELYRETVAVKDSEYYGYYGNSLRLLTLLYITGNFPNPLSDLSGQPTPPSNPTPSLPPQVVYGDVNGDGNVNSTDLTMLKRYLLKSVTNINREAADVNRDGAINSSDMTILKRYLIKSIPHLPY

SEQ ID NO: 844 - DNA, 1428 bp, Clostridium cellulolyticum
atgaaaaaaacaacagcttttttattatgttttctaatgatttttacagcattattgccaatgcaaaatgctaatgcgtatgatgcttcacttattccgaatcttcagattccacaaaagaacattccgaataatgatggaatgaattttgtaaaaggtttaagactcggatggaatctgggtaatacatttgatgcttttaacggtacaaatattactaatgaattggattatgaaacatcatggagcggtatcaaaacaactaagcagatgatagatgcaataaagcaaaaaggattcaatactgttcgtattcctgtatcctggcatccacacgtaagtggttcagattacaaaatcagtgatgtatggatgaatcgtgttcaagaagtagtaaattattgtatagataataaaatgtatgtcattttaaacacacatcatgacgttgacaaagtaaaaggttatttcccaagcagtcaatatatggcaagctccaagaaatatataactagtgtctgggcacagattgctgctaggtttgcaaactatgatgagcatcttatttttgaaggaatgaacgagcctcgtcttgtaggacatgcaaatgagtggtggcctgagctgacaaattcagatgtagttgattctattaattgtattaatcaacttaatcaggattttgttaatacagtacgtgcaacaggtggaaaaaatgcaagcagatatcttatgtgtccaggatatgttgcatctcctgacggagcaacaaacgattacttcagaatgccaaatgatatttctggtaataacaacaaaataattgtatctgtacatgcatattgtccatggaattttgcagggttggcaatggctgatggaggtacaaatgcttggaatataaatgattcaaaagatcaaagtgaagttacttggtttatggataatatttataataagtatacaagcaggggtattcctgtaataatcggtgaatgtggagcagtagataagaacaatctgaagacaagagtagaatatatgtcctattatgttgcacaagctaaagcacgtggtatattatgcatattgtgggataacaataatttctcaggtactggtgaattatttggtttcttcgatagaagaagctgtcagttcaagttccctgaaattatagatggaatggtgaaatatgctttcgaagccaagacagatcctgacccagtaattgtatatggagattataacaatgatggaaatgttgatgcacttgattttgcaggcttaaagaaatatattatggctgctgaccatgcttatgtaaagaatttggatgttaatctcgacaatgaagtgaatgcatttgaccttgctattttgaaaaaatatctgcttggtatggtaagtaagcttccaagcaactaa

SEQ ID NO: 845 - protein, 475 aa, Clostridium cellulolyticum
MKKTTAFLLCFLMIFTALLPMQNANAYDASLIPNLQIPQKNIPNNDGMNFVKGLRLGWNLGNTFDAFNGTNITNELDYETSWSGIKTTKQMIDAIKQKGFNTVRIPVSWHPHVSGSDYKISDVWMNRVQEVVNYCIDNKMYVILNTHHDVDKVKGYFPSSQYMASSKKYITSVWAQIAARFANYDEHLIFEGMNEPRLVGHANEWWPELTNSDVVDSINCINQLNQDFVNTVRATGGKNASRYLMCPGYVASPDGATNDYFRMPNDISGNNNKIIVSVHAYCPWNFAGLAMADGGTNAWNINDSKDQSEVTWFMDNIYNKYTSRGIPVIIGECGAVDKNNLKTRVEYMSYYVAQAKARGILCILWDNNNFSGTGELFGFFDRRSCQFKFPEIIDGMVKYAFEAKTDPDPVIVYGDYNNDGNVDALDFAGLKKYIMAADHAYVKNLDVNLDNEVNAFDLAILKKYLLGMVSKLPSN

SEQ ID NO: 846 - DNA, 1330 bp, Ruminococcus flavefaciens
agatccagagcctttttacaagtgcttgtcttatttggatggaaagccatatatgacagaggtcattgcgtgtgctgcagaaaaagtacgtttggaattaaagtaagtatgcttaatataaagaaccgataattcatactcataaaacgccaagagcgttcaattcatagtcagaggtgatactaatgtggattttaaataatgatgtatagaaaaacaattttgattggagggctattatgcgaaaaagaataacttcaatgataacagtaatttcattgaccttatgcggaactataggtacttatccacacaatgctaatgcatcagcgaaagaagcgttcgaggatatatctaaaagatcagagtgtactaaagtatttgataacgataacggaacatacaccgcttattcaaatactgcgccaattcactatcttaataatgatgagtggaaagaaattgacaatacattaattgaggacagcgatgattattacagaaacaaagataactctttcaatatttatattccaaaggaatattcgcttggtaagaatataaaaaatcctgttataatgaattatgacacatttagtctgtcaacgtcaataacagacattaagatgcctgatagacctgaagaagaaacgttttctgagggagtatatgccgatatcaataatgaggtttatactacaattgataattcagcaatagccgaaggaatgaaagcggctttaaagaagtcagcatcaatggcgacctatcattcgatcgttgaagatattgatcttgatatagctgtgcataacgcttctgtcagcgagtcgataatcatcaataagttagaatctttaccggaaacgatcacatattctatttcggttgaagacgcaattattaagaaaactgaagacaacagattgcagcttatcaaagataatgaagcagtgctcatactatccccgtttacgatcagcgattcatctgaaaacgtcaatgtcatgcaggtagaatatgatcttactgaatctgaagaaggatatgaagttactctctatccggcagaaacagttaatcgcatgagcagccctgttatgccattatctttaggctcggagtattcatacgacagaccattttcaacagtttacaatagccaggcttcgcttcatccgtctataataataattacataaaagtaggaaatgaagctaataatagttatcatactataggatcgtttctcgaagatttttctttttatggtccatacgttagaatagtagattcgacattttattattatgtaacttccttaagtaca

SEQ ID NO: 847 - protein, 320 aa, Ruminococcus flavefaciens
MRKRITSMITVISLTLCGTIGTYPHNANASAKEAFEDISKRSECTKVFDNDNGTYTAYSNTAPIHYLNNDEWKEIDNTLIEDSDDYYRNKDNSFNIYIPKEYSLGKNIKNPVIMNYDTFSLSTSITDIKMPDRPEEETFSEGVYADINNEVYTTIDNSAIAEGMKAALKKSASMATYHSIVEDIDLDIAVHNASVSESIIINKLESLPETITYSISVEDAIIKKTEDNRLQLIKDNEAVLILSPFTISDSSENVNVMQVEYDLTESEEGYEVTLYPAETVNRMSSPVMPLSLGSEYSYDRPFSTVYNSQASLHPSIIIIT

SEQ ID NO: 848 - DNA, 1299 bp, Clostridium thermocellum
ggtatctgttccctgcaggtatatacattcccctgtgtcggtaattgaccgaagagactatgaaagttgcttgaatctcgtaaaagctgtgctggaggagtttgacaacaatgagagcttaattgaaagttttaaattgcacaatgtgaagtaaaatgaactaaaattacgtaaatcacagaaaaatggaggaagaggatatgtttgacttgctcaaaaagtttacaggaatcgttggagtatccggaaacgaagaagaaataagggaagctataattgaggaaattaaagaatgtgttgacgaaataaaagttgatactttgggaaaccttattgccgtcaaaaaaggcaagggcaaaaaaatcatggtggcggctcatatggatgagattggcgtaatggttacatatatagacgacaagggctttttaaggttttctgccgtcggaggggtcagccgctatgactgtataggccagagggtgaagtttaaaaacggagttgtcggagctgtttattacgaggaaaaacttgaggatatgaagaatctccagctttccaaaatgtatatagatattggagcaagaagcagagaggaagccctgaagatggtaaatatcggagatgtcgcctgctttgtcggagatgcggtgcttcagggggataccgtgatatcgaaggcattggacaacagaagcggctgtgcggtggttgtaaaggcgataaaagagttgaaaaagacggataatgaaatatattttgtgtttacggttcaggaagaggtcggtttgagaggagcaaaaaccgcggctttcagtataaagcctgatatagccatagctgtggatgttacaatgacgggagacacaccggaatcgcatcctatggaggttaagtgcggcggcgggcctgcaattaaagtaaaggatcgttccgtcatttgtcatccggaggtaagaaaacttttggaagagtcagcaaaaaggaataatattccttatcagttggaaatacttgaagcaggagggagcgacccgggctcaatacatttgacggcgggaggaataccttcgggtgcgatatccataccggtgaggtatgttcacagtccggtagagaccgccagcatgtcggatattaataatgccgtaaaattgttggttgaagccatttgctgatatttatatgtatgagattaatagattaataaagagatttataaaaggcttcctgcctttatggcgggaggcttttttagtaaatcagattttttgattatgggatattaacctaattgga

SEQ ID NO: 849 - DNA, 1844 bp, Erwinia chrysanthemi
gcagcagcaattgccgtccggctgggcggatctgttcggcgtgatcgtcaacgggatgatggataacgccggtgagcgggaagggctggcgtttttgcgtcacataggcgggcaactggccgaacgctacccgctgccggcgcggtgacggtggtggatctggaacgggaaattaatcgggtgctgtcgctgttccattggggatgcgtggacctgcgcccgtatgaaaatcggctggagatttatcatctgcgttgcccgcctcggtgaactcgtcgggcagcgtcagatggcgcatggcgatggcggcggtgttgcaggggctctacagccgctggctgcgtgagcagggcggcgtcgaggtctgtaccgctgtcctgcgaagaaaccgacagcgaatcgaccctgctgttccgttaccaacactgagccggacagtaatgggaaagccaatgtggcgttgttgggcgttgatgctgatggtgtggttcagtgcgtcggctacggcggcgaacggctgggaaatctataaaagccgtttcatgaccacggacgggcgcattcaggataccggcaataagaatgtcagccacaccgaaggtcagggattcgccatgctgatggcggtgcattacgatgaccgcatcgcgttcgataacctgtggaactggacgcaaagccacctgcggaacacgaccagcggcttgttctactggcgttacgatccgtcggcggccaatccggtggtggataagaacaacgcctcggatggcgatgtgctgattgcctgggcgttgttaaaagcgggaaataagtggcaggacaaccgttacctgcaggcgtcggacagcatccagaaagcgatcatcgccagcaatatcattcagtttgcgggccgcaccgtgatgttgcccggcgcctatggtttcaacaagaacagctatgtgatccttaacccgtcgtatttcctgttcccggcctggcgcgactttgctaaccgcagccatcttcaggtgtggcggcaactgattgacgacagcctgtcattggtcggagaaatgcgtttcggtcaggtcgggctgccgacggactgggcggcgctgaacgcggatggctcgatggcgccggcgacggcctggccgtcgcgtttcagttacgacgccattcgtatcccgctgtatttgtactggtatgacgccaaaaccacggcgctggtgccgttccagctgtactggcgtaactatccccgcctgacgacgccggcctgggttgatgtgctgagcagtaacaccgcgacttacaatatgcagggcggtttgctggcggtgcgcgacctgacgatgggcaacctcgacgggctcagcgatctgccaggcgcatcggaagattactactcgtcgagcctgcgcctgctggtgatgttggcgcgcggtaaataaccttattcttgcggtacacatggcgaggacgatgtccttgccattttccccacttttatccctctgaatggcgtgtttttcacgctttgttaacctgcttgttactcgtgatcccattcacaaaaaattcttatgaatcagcgcagaatagcgtaatggcgcggtttgccgcgaggtttgcgccgcgttagtcatgcgtgatgttaccgataaattaatgcaatgtttttgggaataatctgttgaagcgattcagctcttgtttttaaccggatgttcacaaactaaagttataaaagtattcagcctgttatcagggtgttattttccggcgcacagaggcggcacttttctgtcttatcccgtgtgtgtgtggcggcaactgattgacgacagcctgtcatt

SEQ ID NO: 850 - protein, 332 aa, Erwinia chrysanthemi
MGKPMWRCWALMLMVWFSASATAANGWEIYKSRFMTTDGRIQDTGNKNVSHTEGQGFAMLMAVHYDDRIAFDNLWNWTQSHLRNTTSGLFYWRYDPSAANPVVDKNNASDGDVLIAWALLKAGNKWQDNRYLQASDSIQKAIIASNIIQFAGRTVMLPGAYGFNKNSYVILNPSYFLFPAWRDFANRSHLQVWRQLIDDSLSLVGEMRFGQVGLPTDWAALNADGSMAPATAWPSRFSYDAIRIPLYLYWYDAKTTALVPFQLYWRNYPRLTTPAWVDVLSSNTATYNMQGGLLAVRDLTMGNLDGLSDLPGASEDYYSSSLRLLVMLARGK

SEQ ID NO: 851 - DNA, 4241 bp, Caldocellum saccharolyticum
cggtgtatcacatagtattacgttagatttcaatgtaagcataaaaattatacaaaatgaggttataaaattcataaggaatttggtttttatgagggctctggtgtaatgccaaagtggcaattgataatgtaacttggacgtaagaattgtgtcaaatatgttgatagtatttttgcaacagaggttgaaatattttcaaaatgagcattgttaatttaaatagactgagagcacaaatgtgaagcttaaaatttggaaaaagagcgataattacaaaataaggtttttaaaattagatactgtcgaagaaaaaacagtaactgagtttttaatgatgttaaattctataaagtcaaatgtaccacatatggtatatatgaaattaacataagaaaaaatgcaaaaaagaataaattataatttaattataggtttaaaaaagccgaaaaaaatatttaagtttacgctgcacgatgtgctgggagcctttcggcaacaccagagcctttgtttaaagttttgctcatattaagaattttttaatcacaaataagctttcaaaaaatggtaacatatagcgtctaaattgaacaattatatagtgtcgccaatttgtttttcgacaaaatgtaaaataaaaaatttaaaaataagaagagggggttagtggataaaatgaagagaaatctatttaggattgtatctcgagttgtattaatagcgtttattgctagtatttctctggttggtgcaatgagttattttccagttgaaactcaagctgcgccagactggagtattccaagtttatgtgagagttataaagacgattttatgataggcgtggcaatacctgcaagatgtttgagcaatgatactgacaaacgaatggtattgaaacattttaacagtataacagcagagaatgaaatgaagccggaaagcttattagctggtcagaccagtactgggttaagttatagatttagtactgctgatgcttttgttgactttgcgagtacaaacaagataggtataagaggtcatacattagtttggcataatcagacacctgattggttctttaaagatagcaatggtcaaaggttatccaaagatgcattattagcaagactaaagcaatatatttatgatgttgttggaagatataaagggaaagtgtatgcatgggacgttgtcaatgaagctatcgatgagaatcagccagatagttatagacgttcgacatggtatgaaatttgtggtcctgagtacattgaaaaagcatttatatgggctcatgaagcagaccctaacgcaaagctattctacaatgactataataccgagatttctaagaaaagagattttatatacaacatggtaaaaaacctgaaatctaaaggtatacctattcatggtattggtatgcaatgtcatataaatgttaactggccatctgttagcgaaatagaaaacagtattaagttatttagttcgataccaggtattgagattcacattacagaacttgatatgagcctatacaactacggctccagcgaaaattattccacaccaccacaggatttgcttcaaaagcagtctcagaaatacaaagagatttttacaatgctgaaaaaatacaaaaatgtagtaaaaagtgttactttttggggattgaaagatgattattcatggttaagatcattctacggtaagaatgattggccgttgttgttttttgaagattacagtgcaaagccagcctattgggcagtaattgaagcttctggggtaacaacatcatctccgacacctacacctacgccgacagtaacagtaacaccaactccaacaccgacaccgacaccgacagtaacagcgactccaacacctacacctacacctgttagcacacctgcgacaggtgggcagataaaggtactgtatgctaacaaggagacaaacagcacgacaaacacgataaggccatggttgaaggtagtgaatagtggcagcagtagcatagatttgagcagggtaacgataaggtactggtacacggtagatggtgaaagggcacagagtgcggtatcagactgggcacagataggagcaagcaatgtaacattcaagtttgtgaagctgagcagtagtgtaagtggagcggattattacttggagataggatttaagagtggagcagggcagttacagcctgggaaggacacaggagagatacagataaggtttaacaagagtgactggagcaattacaatcaggggaatgactggtcatggttacagagcatgacgagttatggagagaatgagaaggtaacagcgtatatagatggagtgctggtatggggacaggagccgagtggagcgacgcctgcgccgacgatgacggttgcaccgacagcgaccccgacaccaactctgagtccgacggtaacgccgacgccggcaccgacgcagacagcaataccaacgccaacattaactccaaatccaacgccaacatcgagtattcctgatgatacaaatgatgattggctttatgtaagtggtaataaaatagttgataaagacggtagaccagtatggttaacaggtattaactggtttggatataatactggtacaaatgtatttgatggtgtatggagttgtaatctgaaagatactcttgctgaaatagctaatagaggctttaacttgctaagagttccaatatctgcagagcttatattgaactggtcgcaaggtatttatccaaaaccaaatataaactactacgtaaatccagagcttgaaggcaaaaacagcttggaagtatttgacatagtagtgcaaacatgtaaagaagttggtttgaaaattatgttggatattcacagtataaaaacagacgcgatgggacatatctatccggtatggtatgatgaaaaatttactccagaggatttttataaagcgtgcgaatggattacaaatagatataaaaatgatgacactattatagcttttgacctaaagaatgagccacatggaaaaccgtggcaagatacaacatttgcaaaatgggataattcaacagatattaataattggaaatatgcagctgaaacatgtgcaaaacgtatactgaatataaatccaaaccttctaattgtaattgaaggaattgaagcctatccaaaggacgacgtcacatggacatcaaaatcctccagcgactactattcaacatggtggggcggtaacttgcgaggtgttagaaagtatcctattaatctgggtaaatatcaaaataaagttgtatattcgccacatgattacgggccatctgtttaccagcagccgtggttttatccagggttcacaaaagagtctttactacaagattgttggcgtccgaattgggcgtacattatggaagaaaacattgcgccacttctgataggtgagtggggtggtcatctggatggagccgataacgaaaagtggatgaagtatttacgagattatatcatagaaaatcatattcatcacacattttggtgctttaatgctaactcgggtgacactggaggattggttggatatgattttacgacatgggatgagaaaaaatactcatttttgaaaccggctctatggcaagacagtcaaggtaggtttgttggattagatcacaaaagacccttaggtacaaatgggaaaaacattaatattacaacatattacaacaataatgagcctgagccagttccagcttcaaaatgataaaatacattaaataggaatttatggatatatgagaaaaatttaaggtcagtaggggaatgtatagttaaagtcattaagcaagcgaattaaaggaaaaaggggggtgataaaaaacggctaaaaacataagtaattattaaacatttattgtaggaactaagtataagtttcaaaatcataccgtccaatacgattaattgaagttaactatcaaatcaaaaagagggggttagggttaaaaatgcttaaactaaaaaaagcaataaaaaggataacactgtgtgttgctgtggtatttctattgcagattttatttctattttcaggatacaataacagtgatgtgaaagcagcaacaacctttaactatggtgaagctcttcaaaaagcaattatgttttatgaattccagatgtcaggtaaactgccatcatggatcc

SEQ ID NO: 852 - protein, 1039 aa, Caldocellum saccharolyticum
MKRNLFRIVSRVVLIAFIASISLVGAMSYFPVETQAAPDWSIPSLCESYKDDFMIGVAIPARCLSNDTDKRMVLKHFNSITAENEMKPESLLAGQTSTGLSYRFSTADAFVDFASTNKIGIRGHTLVWHNQTPDWFFKDSNGQRLSKDALLARLKQYIYDVVGRYKGKVYAWDVVNEAIDENQPDSYRRSTWYEICGPEYIEKAFIWAHEADPNAKLFYNDYNTEISKKRDFIYNMVKNLKSKGIPIHGIGMQCHINVNWPSVSEIENSIKLFSSIPGIEIHITELDMSLYNYGSSENYSTPPQDLLQKQSQKYKEIFTMLKKYKNVVKSVTFWGLKDDYSWLRSFYGKNDWPLLFFEDYSAKPAYWAVIEASGVTTSSPTPTPTPTVTVTPTPTPTPTPTVTATPTPTPTPVSTPATGGQIKVLYANKETNSTTNTIRPWLKVVNSGSSSIDLSRVTIRYWYTVDGERAQSAVSDWAQIGASNVTFKFVKLSSSVSGADYYLEIGFKSGAGQLQPGKDTGEIQIRFNKSDWSNYNQGNDWSWLQSMTSYGENEKVTAYIDGVLVWGQEPSGATPAPTMTVAPTATPTPTLSPTVTPTPAPTQTAIPTPTLTPNPTPTSSIPDDTNDDWLYVSGNKIVDKDGRPVWLTGINWFGYNTGTNVFDGVWSCNLKDTLAEIANRGFNLLRVPISAELILNWSQGIYPKPNINYYVNPELEGKNSLEVFDIVVQTCKEVGLKIMLDIHSIKTDAMGHIYPVWYDEKFTPEDFYKACEWITNRYKNDDTIIAFDLKNEPHGKPWQDTTFAKWDNSTDINNWKYAAETCAKRILNINPNLLIVIEGIEAYPKDDVTWTSKSSSDYYSTWWGGNLRGVRKYPINLGKYQNKVVYSPHDYGPSVYQQPWFYPGFTKESLLQDCWRPNWAYIMEENIAPLLIGEWGGHLDGADNEKWMKYLRDYIIENHIHHTFWCFNANSGDTGGLVGYDFTTWDEKKYSFLKPALWQDSQGRFVGLDHKRPLGTNGKNINITTYYNNNEPEPVPASK

SEQ ID NO: 853 - DNA, 2535 bp, Streptomyces sp. M23
gatcgccggccggcgcggcccgcccgcgcggccgacggctgtcacgcacggcccttcggcggcccggaaccgtcccgcccgagccgccccggagcacccgggaccgctccgccggccctgcgccggtcgtgcggccgtgccgttccacttcacacgtatgacgccggggtgccgagcgcctgcgcgccctcggccgcgtacgtgcccacccgaagtcacccatggaggtacaccccactcatgagccgcagcagaacagcgatgctcgccgccctgaccctggcggccggcagcatgaccctggcgctcgccgccgggcccgccagcgccggccccgccgctcccacggcccgggtcgacaacccctacgtcggcgccacgatgtacgtcaaccccgagtggtccgcgctggccgcgtccgaaccgggcggcgaccgcgtcgccgaccagcccaccgcggtctggctcgaccgcatcgccaccatcgagggcgtcgacggcaagatgggcctgcgcgagcacctcgacgaggccctgcagcagaagggctccggcgaactggtcgtccagctggtcatctacgacctgcccggccgcgactgcgccgccctggcctccaacggcgagctgggcccggacgagctcgaccggtacaagagcgagtacatcgaccccatcgcggacatcctgtccgactccaagtacgagggcctgcgcatcgtcacggtcatcgagcccgactcactgcccaacctggtcaccaacgcgggcggtaccgacaccaccaccgaggcctgcaccaccatgaaggccaacggcaactacgagaagggcgtcagctacgccctgagcaagctcggtgccatcccgaacgtctacaactacatcgacgccgcccaccacggctggctcggctgggacaccaacctcggcccctccgtgcaggagttctacaaggtcgccaccagcaacggcgccagcgtcgacgacgtggccggcttcgccgtcaacaccgccaactacagccccaccgtggagccgtacttcacggtctccgacacggtgaacggccagacggtgcgccagtcgaagtgggtcgactggaaccagtacgtggacgagcagtcctacgcccaggcgctgcgcaacgaggccgtcgcggccgggttcaactcggacatcggcgtcatcatcgacacctcccgcaacggctggggcggctccgaccggccgtccggtcccggcccgcagaccagcgtcgacgcctatgtcgacggcagccgcatcgaccggcgcgtccacgtcggcaactggtgcaaccagagcggcgccggcctcggcgaacggcccaccgccgcacccgcgtccgggatcgacgcctacacctggatcaagccgccgggggagtccgacggcaacagcgcccccgtcgacaacgacgagggcaagggcttcgaccagatgtgcgacccctcgtaccagggcaacgcccgcaacgggtacaacccctcgggtgcgctgcccgacgcaccgctgtccgggcaatggttctccgcccagttccgggagctgatgcagaacgcctacccgccgctgtcctgacccggtgaggcgtccttcgaggtgatccgccggggcgggcggcccggagcgtcctgcccccgtcactcaccgggccggccccggcggaccgcgtgccgcgccgggcacccgcccggccgccgcacgcacacccgccgccgggcacagccgtcgctgtgcccggcggcgccgtgccccaccgcgtcccccggcgggcacggccgacgtcgtcgaaggccgcgcacacgacgccgccctccggcttctcgccgtccccgcggcacgactggccacaccgcggtgcgccgtcgcatgctgaacgcaccgacaggaggtcgaaacaccatgacgccggaacacccagggcccatgacgccggatcacccagagcaccgcccgagcccgcacgaccacccttcccgtaccgccgccgcggcggaaggccacggcggtcacgcacaccacgacggaaccgacgtcgactgggccgtgatgggcccgctgctggagtccgaggccgaggtgttcacacctctgtatcggcaggtgacggcgtggctggcggaacaggcgggcaacccgggcctgatcgtcgacgccggcagcggtccgggtgtgatcacgtgcctgttcgccgagcgcttccccggagcccgcgtcgtggcggtggacggctcggccccgctgctggaacgcgcccgcgagcgcgccgcccggttcggccacgccgaccgcttgaccacggtgaccggtctgctcccggacgcgctgtccgcactggaccgcccggccggtctgctgtggtgcggcaacagcctgcaccacctgggcgaccagcgcgccgccctgaccgcgttcgcccggcacctggcaccgggcggcaccctggccctgctggagggcggcctgcccgctcgtttcctgccgcgggacatcggcatcggccgccccggt

SEQ ID NO: 854 - protein, 453 aa, Streptomyces sp. M23
MSRSRTAMLAALTLAAGSMTLALAAGPASAGPAAPTARVDNPYVGATMYVNPEWSALAASEPGGDRVADQPTAVWLDRIATIEGVDGKMGLREHLDEALQQKGSGELVVQLVIYDLPGRDCAALASNGELGPDELDRYKSEYIDPIADILSDSKYEGLRIVTVIEPDSLPNLVTNAGGTDTTTEACTTMKANGNYEKGVSYALSKLGAIPNVYNYIDAAHHGWLGWDTNLGPSVQEFYKVATSNGASVDDVAGFAVNTANYSPTVEPYFTVSDTVNGQTVRQSKWVDWNQYVDEQSYAQALRNEAVAAGFNSDIGVIIDTSRNGWGGSDRPSGPGPQTSVDAYVDGSRIDRRVHVGNWCNQSGAGLGERPTAAPASGIDAYTWIKPPGESDGNSAPVDNDEGKGFDQMCDPSYQGNARNGYNPSGALPDAPLSGQWFSAQFRELMQNAYPPLS

SEQ ID NO: 855 - DNA, 4183 bp, Clostridium thermocellum
ttgaaaaatacttgacattactggttgacattttatatatttaaagtataaggaacataatttgcaccgatcctgttctaaattctgaaattaacaagtatttggggttgtattatatatggggttgtatcattggggtattataatcaatgcaatctattagtaaaagtctatgctgtcatatccatcaaatctttaaagcaggtgtcttttgtaacaaattcaataaacacccattaactgtttgtgcgctatgggctatattagattgaagcttctcacatggcatatttcaaactaataatataaaaccctcaaggaggtgaactcataagaagggttgtaaaccttttttaattagtttttaattagtttgaaatgcaaagaaatgagaaagcttcaatcctgatttagcaattctttaacgggaggcaaagaatgaaatttagaaggtcaatttgtactgctgttttgttggcggttttattgacacttctggtaccgacatccgtgtttgccttagaagataattcttcgactttgccgccgtataaaaacgaccttttgtatgagaggacttttgatgagggactttgttatccatggcatacctgtgaagacagcggaggaaaatgctcctttgatgtggtcgatgttccggggcagcccggtaataaagcatttgccgttactgttcttgacaaagggcaaaacagatggagagttcagatgagacaccgtggtcttactcttgaacagggacatacatatagagtacggcttaagatttgggcagatgcgtcctgtaaagtttatataaaaataggacaaatggcggagccctatgctgaatattggaacaacaagtggagtccatacacactgacagcaggtaaggtattggaaattgacgagacgtttgttatggacaagccaactgacgacacatgcgaatttacattccatttaggtggcgaattggcagcaactcctccatatacagtttatcttgatgatgtatccctttatgacccagaatatacgaagcctgttgaatatatacttccgcagcctgatgtacgtgtgaaccaggttggctacctgccggagggcaagaaagttgccactgtggtatgcaattcaactcagccggtaaaatggcagcttaagaatgctgcaggcgttgtagttttggaaggttataccgaaccaaagggtcttgacaaagactcgcaggattatgtacattggcttgatttttccgattttgcaaccgaaggaattggttactattttgaacttccgactgtaaacagtcctacaaactacagtcatccatttgacattcgcaaagacatctatactcagatgaaatatgatgcattggcattcttctatcacaagagaagcggtattcctattgaaatgccgtatgcaggaggagaacagtggaccagacctgcaggacatatcggaattgagccgaacaagggagatacaaatgttcctacatggcctcaggatgatgagtatgcaggaatacctcagaagaattatacaaaggatgtaaccggtggatggtatgatgccggtgaccacggtaaatatgttgtaaacggcggtatagccgtctggacattaatgaacatgtatgagagggcaaaaattagaggtcttgacaactggggaccatacagggacggcggaatgaacataccggagcagaataacggttatccggacattcttgatgaagcaagatgggaaattgagttctttaagaaaatgcaggtaactgaaaaagaggatccttccatagccggaatggtacaccacaaaattcacgacttcagatggactgctttgggtatgttgcctcacgaagatccccagccacgttacttaaggccggtaagtacggctgcgactttgaactttgcggcaactttggcacaaagtgcacgtctttggaaagattatgatccgacttttgctgctgactgtttggaaaaggctgaaatagcatggcaggcggcattaaagcatcctgatatttatgctgagtatactcccggtagcggtggtcccggaggcggaccatacaatgacgactatgtcggagacgaattctactgggcagcctgcgaactttatgtaacaacaggaaaagacgaatataagaattacctgatgaattcacctcactatcttgaaatgcctgcaaagatgggtgaaaacggtggagcaaacggagaagacaacggattgtggggatgcttcacctggggaactactcaaggattgggaaccattactcttgctttggttgaaaacggattgcctgctacagacattcaaaaggcaagaaacaatatagctaaagctgctgacagatggcttgagaatattgaagagcaaggttacagactgccgatcaaacgggcggaggatgagagagccggttatccatggggttcaaactccttgcattttgaaccagatgacctagttatgggatatgcctatgactttacaggtgactcaaatatctcgatggaatgtttgaccggcataagctacctgttgggaagaaacgcaatggatcagtcctatgtaacagggtatggtgagcgtccgcttcagaatcctcatgacaggttctggacgccgcagacaagtaagagattccctgctccacctccgggtataatttccggccgtccgaactcccgtttcgaggacccgacaataaatgcggccgttaagaaggatacaccgccacagaaatgttttatcgaccatacagactcatggtcaaccaacgagataactgttaactggaatgctccgtttgcatgggttacagcttatcttgacgagcagtacacagacagtgaaaccgataaggtaactattgattcgcctgttgcaggagaaagatttgaagcgggtaaagacattaatataagaactgttaaatcaaaaactcctgtaagcaaagtagagttttacaatggagatacgcttatttccagtgacacaactgcaccttacacagcaaagataacaggagccgctgtcggagcatataaccttaaagcggttgcagtgctgtctgacggaagaagaattgagtcaccggtaactcctgtacttgttaaggtaattgtgaaacctactgtaaaacttactgcacccaagtcaaatgttgtggcttatggaaatgagttcctgaagattacagcaacagccagtgactctgacggcaaaatctccagggttgatttccttgttgacggtgaagtaatcggttcagacagggaagcaccttatgaatatgagtggaaagctgtggaaggcaatcacgaaataagtgtaattgcttatgatgatgacgatgcggcttcaacacctgattccgtaaaaatatttgtaaaacaggcacgggatgtaaaagtacagtatttgtgcgaaaatacgcaaacatccactcaggaaatcaagggtaaattcaatatagttaacacaggaaacagagattattcgctgaaagatatagtattaagatactactttaccaaggagcacaattcacagcttcagtttatctgctattatacacccataggctccggaaatctcattccgtcctttggcggctcgggtgacgagcattatctgcagctggaattcaaagatgtcaagctgcctgccggcggtcagactggggaaatacagtttgttataagatatgcagataactccttccatgatcagtcgaacgactattcgttcgatccaactataaaagcgttccaggattatggcaaggttaccctgtataagaatggagaacttgtttggggaacgccgccgggcggtacagaacctgaagaaccggaagagcctgaagaaccggaagagcctgcgatagtttacggcgactgtaatgatgacggcaaagtaaattcaacagacgtcgcagtaatgaagagatatttaaagaaagaaaatgttaatattaatcttgacaatgcagatgtgaatgcggacggcaaagttaactcaacagacttctcaatacttaagagatatgttatgaagaacatagaagaattgccatatcgataagataatctgaaattatttgtgtaaggaccggtttttgccggtcctttttaaa

SEQ ID NO: 856 - protein, 1230 aa, Clostridium thermocellum
MKFRRSICTAVLLAVLLTLLVPTSVFALEDNSSTLPPYKNDLLYERTFDEGLCYPWHTCEDSGGKCSFDVVDVPGQPGNKAFAVTVLDKGQNRWRVQMRHRGLTLEQGHTYRVRLKIWADASCKVYIKIGQMAEPYAEYWNNKWSPYTLTAGKVLEIDETFVMDKPTDDTCEFTFHLGGELAATPPYTVYLDDVSLYDPEYTKPVEYILPQPDVRVNQVGYLPEGKKVATVVCNSTQPVKWQLKNAAGVVVLEGYTEPKGLDKDSQDYVHWLDFSDFATEGIGYYFELPTVNSPTNYSHPFDIRKDIYTQMKYDALAFFYHKRSGIPIEMPYAGGEQWTRPAGHIGIEPNKGDTNVPTWPQDDEYAGIPQKNYTKDVTGGWYDAGDHGKYVVNGGIAVWTLMNMYERAKIRGLDNWGPYRDGGMNIPEQNNGYPDILDEARWEIEFFKKMQVTEKEDPSIAGMVHHKIHDFRWTALGMLPHEDPQPRYLRPVSTAATLNFAATLAQSARLWKDYDPTFAADCLEKAEIAWQAALKHPDIYAEYTPGSGGPGGGPYNDDYVGDEFYWAACELYVTTGKDEYKNYLMNSPHYLEMPAKMGENGGANGEDNGLWGCFTWGTTQGLGTITLALVENGLPATDIQKARNNIAKAADRWLENIEEQGYRLPIKRAEDERAGYPWGSNSLHFEPDDLVMGYAYDFTGDSNISMECLTGISYLLGRNAMDQSYVTGYGERPLQNPHDRFWTPQTSKRFPAPPPGIISGRPNSRFEDPTINAAVKKDTPPQKCFIDHTDSWSTNEITVNWNAPFAWVTAYLDEQYTDSETDKVTIDSPVAGERFEAGKDINIRTVKSKTPVSKVEFYNGDTLISSDTTAPYTAKITGAAVGAYNLKAVAVLSDGRRIESPVTPVLVKVIVKPTVKLTAPKSNVVAYGNEFLKITATASDSDGKISRVDFLVDGEVIGSDREAPYEYEWKAVEGNHEISVIAYDDDDAASTPDSVKIFVKQARDVKVQYLCENTQTSTQEIKGKFNIVNTGNRDYSLKDIVLRYYFTKEHNSQLQFICYYTPIGSGNLIPSFGGSGDEHYLQLEFKDVKLPAGGQTGEIQFVIRYADNSFHDQSNDYSFDPTIKAFQDYGKVTLYKNGELVWGTPPGGTEPEEPEEPEEPEEPAIVYGDCNDDGKVNSTDVAVMKRYLKKENVNINLDNADVNADGKVNSTDFSILKRYVMKNIEELPYR

SEQ ID NO: 857 - DNA, 3217 bp, Clostridium thermocellum
atgcattggcattcttctatcacaagagaagcggtattcctattgaaatgccgtatgcaggaggagaacagtggaccagacctgcaggacatattggaattgagccgaacaagggagatacaaatgttcctacatggcctcaggatgatgaatatgcaggaagacctcaaaaatattatacaaaagaagtaaccggtggatggtatgatgccggtgaccacggtaaatatgttgtaaacggcggtatagctgtttggacattgatgaacatgtatgaaagggcaaaaatcagaggcatagctaatcaaggtgcttataaagacggtggaatgaacataccggagagaaataacggttatccggacattcttgatgaagcaagatgggaaattgagttctttaagaaaatgcaggtaactgaaaaagaggatccttccatagccggaatggtacaccacaaaattcacgacttcagatggactgctttgggtatgttgcctcacgaagatccccagccacgttacttaaggccggtaagtacggctgcgactttgaactttgcggcaactttggcacaaagtgcacgtctttggaaagattatgatccgacttttgctgctgactgtttggaaaaggctgaaatagcatggcaggcggcattaaagcatcctgatatttatgctgagtatactcccggtagcggtggtcccggaggcggaccatacaatgacgactatgtcggagacgaattctactgggcagcctgcgaactttatgtaacaacaggaaaagacgaatataagaattacctgatgaattcacctcactatcttgaaatgcctgcaaagatgggtgaaaacggtggagcaaacggagaagacaacggattgtggggatgcttcacctggggaactactcaaggattgggaaccattactcttgcattggttgaaaacggattgcctgctacagacattcaaaaggcaagaaacaatatagctaaagctgctgacagatggcttgagaatattgaagagcaaggttacagactgccgatcaaacaggcggaggatgagagaggcggttatccatggggttcaaactccttcattttgaaccagatgatagttatgggatacgcatatgactttacaggcaacagcaagtatcttgacggaatgcaggatggtatgagctacctgttgggaagaaacggactggatcagtcctatgtaacagggtatggtgagcgtccacttcagaatcctcatgacagattctggacgccgcagacaagtaagaaattccctgctccacctccgggtataattgccggtggtccgaactcccgtttcgaagacccgacaataactgcagcagttaagaaggatacaccgccgcagaagtgctacattgaccatacagactcatggtcaaccaacgagataactgttaactggaatgctccgtttgcatgggttacagcttatctcgatgaaattgacttaataacaccgccaggaggagtagacccagaagaaccggaggttatttatggtgactgcaatggcgacggaaaagttaattcaactgacgctgtggcattgaagagatatatcttgagatcaggtataagcatcaacactgataatgctgatgtaaatgctgatggcagagttaactctacagacttggcaatattgaagagatatattcttaaagagatagatgtattgccacataaataaaaaactgccatataatgataatctgttataaaaaaagaaccggttttaccggttctttttttataacgaaaaaaggtcattccttttgaaaaatacttgacattactggttgacattttatatatttaaagtataaggaacataatttgcaccgatcctgttctaaattctgaaattaacaagtatttggggttgtattatatatggggttgtatcattggggtattataatcaatgcaatctattagtaaaagtctatgctgtcatatccatcaaatctttaaagcaggtgtcttttgtaacaaattcaataaacacccattaactgtttgtgcgctatgggctatattagattgaagcttctcacatggcatatttcaaactaataatataaaaccctcaaggaggtgaactcataagaagggttgtaaaccttttttaattagtttttaattagtttgaaatgcaaagaaatgagaaagcttcaatcctgatttagcaattctttaacgggaggcaaagaatgaaatttagaaggtcaatttgtactgctgttttgttggcggttttattgacacttctggtaccgacatccgtgtttgccttagaagataattcttcgactttgccgccgtataaaaacgaccttttgtatgagaggacttttgatgagggactttgttatccatggcatacctgtgaagacagcggaggaaaatgctcctttgatgtggtcgatgttccggggcagcccggtaataaagcatttgccgttactgttcttgacaaagggcaaaacagatggagagttcagatgagacaccgtggtcttactcttgaacagggacatacatatagagtacggcttaagatttgggcagatgcgtcctgtaaagtttatataaaaataggacaaatggcggagccctatgctgaatattggaacaacaagtggagtccatacacactgacagcaggtaaggtattggaaattgacgagacgtttgttatggacaagccaactgacgacacatgcgaatttacattccatttaggtggcgaattggcagcaactcctccatatacagtttatcttgatgatgtatccctttatgacccagaatatacgaagcctgttgaatatatacttccgcagcctgatgtacgtgtgaaccaggttggctacctgccggagggcaagaaagttgccactgtggtatgcaattcaactcagccggtaaaatggcagcttaagaatgctgcaggcgttgtagttttggaaggttataccgaaccaaagggtcttgacaaagactcgcaggattatgtacattggcttgatttttccgattttgcaaccgaaggaattggttactattttgaacttccgactgtaaacagtcctacaaactacagtcatccatttgacattcgcaaagacatctatactcagatgaaatatgatgcat

SEQ ID NO: 858 - protein, 581 aa, Clostridium thermocellum
ALAFFYHKRSGIPIEMPYAGGEQWTRPAGHIGIEPNKGDTNVPTWPQDDEYAGRPQKYYTKEVTGGWYDAGDHGKYVVNGGIAVWTLMNMYERAKIRGIANQGAYKDGGMNIPERNNGYPDILDEARWEIEFFKKMQVTEKEDPSIAGMVHHKIHDFRWTALGMLPHEDPQPRYLRPVSTAATLNFAATLAQSARLWKDYDPTFAADCLEKAEIAWQAALKHPDIYAEYTPGSGGPGGGPYNDDYVGDEFYWAACELYVTTGKDEYKNYLMNSPHYLEMPAKMGENGGANGEDNGLWGCFTWGTTQGLGTITLALVENGLPATDIQKARNNIAKAADRWLENIEEQGYRLPIKQAEDERGGYPWGSNSFILNQMIVMGYAYDFTGNSKYLDGMQDGMSYLLGRNGLDQSYVTGYGERPLQNPHDRFWTPQTSKKFPAPPPGIIAGGPNSRFEDPTITAAVKKDTPPQKCYIDHTDSWSTNEITVNWNAPFAWVTAYLDEIDLITPPGGVDPEEPEVIYGDCNGDGKVNSTDAVALKRYILRSGISINTDNADVNADGRVNSTDLAILKRYILKEIDVLPHK

SEQ ID NO: 859 - DNA, 1821 bp, Clostridium thermocellum
tatatacttccgcagcctgatgtacgtgtgaaccaggttggctacctgccggagggcaagaaagttgccactgtggtatgcaattcaactcagccggtaaaatggcagcttaagaatgctgcaggcgttgtagttttggaaggttataccgaaccaaagggtcttgacaaagactcgcaggattatgtacattggcttgatttttccgattttgcaaccgaaggaattggttactattttgaacttccgactgtaaacagtcctacaaactacagtcatccatttgacattcgcaaagacatctatactcagatgaaatatgatgcattggcattcttctatcacaagagaagcggtattcctattgaaatgccgtatgcaggaggagaacagtggaccagacctgcaggacatatcggaattgagccgaacaagggagatacaaatgttcctacatggcctcaggatgatgagtatgcaggaatacctcagaagaattatacaaaggatgtaaccggtggatggtatgatgccggtgaccacggtaaatatgttgtaaacggcggtatagccgtctggacattaatgaacatgtatgagagggcaaaaattagaggtcttgacaactggggaccatacagggacggcggaatgaacataccggagcagaataacggttatccggacattcttgatgaagcaagatgggaaattgagttctttaagaaaatgcaggtaactgaaaaagaggatccttccatagccggaatggtacaccacaaaattcacgacttcagatggactgctttgggtatgttgcctcacgaagatccccagccacgttacttaaggccggtaagtacggctgcgactttgaactttgcggcaactttggcacaaagtgcacgtctttggaaagattatgatccgacttttgctgctgactgtttggaaaaggctgaaatagcatggcaggcggcattaaagcatcctgatatttatgctgagtatactcccggtagcggtggtcccggaggcggaccatacaatgacgactatgtcggagacgaattctactgggcagcctgcgaactttatgtaacaacaggaaaagacgaatataagaattacctgatgaattcacctcactatcttgaaatgcctgcaaagatgggtgaaaacggtggagcaaacggagaagacaacggattgtggggatgcttcacctggggaactactcaaggattgggaaccattactcttgcattggttgaaaacggattgcctgctacagacattcaaaaggcaagaaacaatatagctaaagctgctgacagatggcttgagaatattgaagagcaaggttacagactgccgatcaaacaggcggaggatgagagaggcggttatccatggggttcaaactccttcattttgaaccagatgatagttatgggatatgcctatgactttacaggtgactccaaatatctcgatggaatgtttgacggcataagctacctgttgggaagaaacgcaatggatcagtcctatgtaacagggtatggtgagcgtccgcttcagaatcctcatgacaggttctggacgccgcagacaagtaagagattccctgctccacctccgggtataatttccggcggtccgaactcccgtttcgaggacccgacaataaatgcggccgttaagaaggatacaccgccacagaaatgttttatcgaccatacagactcatggggaaccaacgagataactgttaactggaatgctccgtttgcatgggttacagcttatcttgacgag

SEQ ID NO: 860 - protein, 607 aa, Clostridium thermocellum
YILPQPDVRVNQVGYLPEGKKVATVVCNSTQPVKWQLKNAAGVVVLEGYTEPKGLDKDSQDYVHWLDFSDFATEGIGYYFELPTVNSPTNYSHPFDIRKDIYTQMKYDALAFFYHKRSGIPIEMPYAGGEQWTRPAGHIGIEPNKGDTNVPTWPQDDEYAGIPQKNYTKDVTGGWYDAGDHGKYVVNGGIAVWTLMNMYERAKIRGLDNWGPYRDGGMNIPEQNNGYPDILDEARWEIEFFKKMQVTEKEDPSIAGMVHHKIHDFRWTALGMLPHEDPQPRYLRPVSTAATLNFAATLAQSARLWKDYDPTFAADCLEKAEIAWQAALKHPDIYAEYTPGSGGPGGGPYNDDYVGDEFYWAACELYVTTGKDEYKNYLMNSPHYLEMPAKMGENGGANGEDNGLWGCFTWGTTQGLGTITLALVENGLPATDIQKARNNIAKAADRWLENIEEQGYRLPIKQAEDERGGYPWGSNSFILNQMIVMGYAYDFTGDSKYLDGMFDGISYLLGRNAMDQSYVTGYGERPLQNPHDRFWTPQTSKRFPAPPPGIISGGPNSRFEDPTINAAVKKDTPPQKCFIDHTDSWGTNEITVNWNAPFAWVTAYLDE

SEQ ID NO: 861 - DNA, 4187 bp, Clostridium thermocellum
aattctgggatatactttcgctgatattatttttaaggctttttgtcgtattcgaattaaaacccttgactttttcattttgaagggaggaaacttttgaagatattatatccataagacctttaatactgtttccgacttctttgattccaccgtcgtctttgcgtttgtccgatgatggccttgatgatgcaaaacggtattcttccggtaataagttgatgtccttcttattacccatacaaatcactcctttaaaaagcattgggtttgtaacacagtgcccgtagataagatgataacatgaaaaacaaaaccaatatcaataatccgtgcaaatataaaactatatctctccaatacaaaaatgttgcagaatgcagcgttaaaattctctaacacatttttacttattgataattataccatatctttgctttatagtacattatttttaagttaattattatttaaaaaaaccgatattaaaaagaagtaatttgtgagtaatgataataatataatgtaaaatgccatacagaatgtaatgttgtaatgatgtaagtacaaattttgtttccaaaattctataaaattatgttatagtcaagccaaggttttgatttatatcttcctttgattttaaattaaaattgcaaaagagacttgacatttgacgtatatagaaatatatttaaaatatatgatactgttttttcaaatagtataatttggggtttaggggtatcttcttacgaattggcttgttcgtaccaatgtatctgtttatctttaaagtagttttcctattatttattcaatactcaatccatcaaaaatatcctcattcagtactacttattcggcataggttaattttgtaaataatttaaatattttaattgttttaagttgttaaagtgaagcttaaagcttttcaaactaataaataaaaacactgcaaaggaggtgtactcttatcagagggctgtaaaaccctgtatttattagtttgatggtaggtttaataatttgttgcattttttatgatattcgacagaaagaaaaaagagtattgtaaagaatgcaacggaaaagcttcattttctaatgctttaaattaattaacgggaggtagatttatgaatttcagaagaatgttgtgcgcagccatagtgttgacaattgtactgtccattatgctgccgtcaactgtttttgctttggaagacaagtcttcaaagttgccagattataaaaacgaccttttgtatgaaagaacattcgacgaaggtctttgctttccgtggcatacttgcgaagacagtggaggaaaatgtgatttcgctgttgttgatgttccaggagagcctgggaacaaagctttccgcttgacagtaattgacaaaggacaaaacaagtggagtgtccagatgagacacagaggtattaccctcgagcaaggacatacatacacggtaaggtttacgatttggtctgacaaatcctgtagggtttatgctaaaattggtcagatgggtgaaccctatactgaatattggaacaataactggaatccattcaaccttacaccaggacagaagcttacagttgaacagaattttacaatgaactatcctactgatgacacatgcgagttcacattccatttgggtggagaacttgctgcaggtacaccttactatgtttaccttgatgatgtatctctctacgatcctaggtttgtaaagcctgttgaatatgtacttccgcagccggatgtacgtgttaaccaggtaggatacttgccgtttgcaaagaagtatgctactgttgtatcttcttcaaccagcccgcttaagtggcagcttctcaattcggcaaatcaggttgttttggaaggtaatacaataccaaaaggacttgacaaagattcacaggattatgtacattggatagatttctccaactttaagactgaaggaaaaggttattacttcaagcttccgactgtaaacagcgatacaaattacagccatcctttcgatatcagtgctgatatttactccaagatgaaatttgatgcattggcattcttctatcacaagagaagcggtattcctattgaaatgccgtatgcaggaggagaacagtggaccagacctgcaggacatattggaattgagccgaacaagggagatacaaatgttcctacatggcctcaggatgatgaatatgcaggaagacctcaaaaatattatacaaaagatgtaaccggtggatggtatgatgccggtgaccacggtaaatatgttgtaaacggcggtatagctgtttggacattgatgaacatgtatgaaagggcaaaaatcagaggcatagctaatcaaggtgcttataaagacggtggaatgaacataccggagagaaataacggttatccggacattcttgatgaagcaagatgggaaattgagttctttaagaaaatgcaggtaactgaaaaagaggatccttccatagccggaatggtacaccacaaaattcacgacttcagatggactgctttgggtatgttgcctcacgaagatccccagccacgttacttaaggccggtaagtacggctgcgactttgaactttgcggcaactttggcacaaagtgcacgtctttggaaagattatgatccgacttttgctgctgactgtttggaaaaggctgaaatagcatggcaggcggcattaaagcatcctgatatttatgctgagtatactcccggtagcggtggtcccggaggcggaccatacaatgacgactatgtcggagacgaattctactgggcagcctgcgaactttatgtaacaacaggaaaagacgaatataagaattacctgatgaattcacctcactatcttgaaatgcctgcaaagatgggtgaaaacggtggagcaaacggagaagacaacggattgtggggatgcttcacctggggaactactcaaggattgggaaccattactcttgcattggttgaaaacggattgcctgctacagacattcaaaaggcaagaaacaatatagctaaagctgctgacagatggcttgagaatattgaagagcaaggttacagactgccgatcaaacaggcggaggatgagagaggcggttatccatggggttcaaactccttcattttgaaccagatgatagttatgggatacgcatatgactttacaggcaacagcaagtatcttgacggaatgcaggatggtatgagctacctgttgggaagaaacggactggatcagtcctatgtaacagggtatggtgagcgtccacttcagaatcctcatgacagattctggacgccgcagacaagtaagaaattccctgctccacctccgggtataattgccggtggtccgaactcccgtttcgaagacccgacaataactgcagcagttaagaaggatacaccgccgcagaagtgctacattgaccatacagactcatggtcaaccaacgagataactgttaactggaatgctccgtttgcatgggttacagcttatctcgatgaaattgacttaataacaccgccaggaggagtagacccagaagaaccggaggttatttatggtgactgcaatggcgacggaaaagttaattcaactgacgctgtggcattgaagagatatatcttgagatcaggtataagcatcaacactgataatgctgatgtaaatgctgatggcagagttaactctacagacttggcaatattgaagagatatattcttaaagagatagatgtattgccacataaataaaaaactgccatataatgataatctgttataaaaaaagaaccggttttaccggttctttttttataacgaaaaaaggtcattccttttgaaaaatacttgacattactggttgacattttatatatttaaagtataaggaacataatttgcaccgatcctgttctaaattctgaaattaacaagtatttggggttgtattatatatggggttgtatcattggggtattataatcaatgcaatctattagtaaaagtctatgctgtcatatccatcaaatctttaaagcaggtgtcttttgtaacaaattcaataaacacccattaactgtttgtgcgctatgggctataatagattga

SEQ ID NO: 862 - protein, 895 aa, Clostridium thermocellum
MNFRRMLCAAIVLTIVLSIMLPSTVFALEDKSSKLPDYKNDLLYERTFDEGLCFPWHTCEDSGGKCDFAVVDVPGEPGNKAFRLTVIDKGQNKWSVQMRHRGITLEQGHTYTVRFTIWSDKSCRVYAKIGQMGEPYTEYWNNNWNPFNLTPGQKLTVEQNFTMNYPTDDTCEFTFHLGGELAAGTPYYVYLDDVSLYDPRFVKPVEYVLPQPDVRVNQVGYLPFAKKYATVVSSSTSPLKWQLLNSANQVVLEGNTIPKGLDKDSQDYVHWIDFSNFKTEGKGYYFKLPTVNSDTNYSHPFDISADIYSKMKFDALAFFYHKRSGIPIEMPYAGGEQWTRPAGHIGIEPNKGDTNVPTWPQDDEYAGRPQKYYTKDVTGGWYDAGDHGKYVVNGGIAVWTLMNMYERAKIRGIANQGAYKDGGMNIPERNNGYPDILDEARWEIEFFKKMQVTEKEDPSIAGMVHHKIHDFRWTALGMLPHEDPQPRYLRPVSTAATLNFAATLAQSARLWKDYDPTFAADCLEKAEIAWQAALKHPDIYAEYTPGSGGPGGGPYNDDYVGDEFYWAACELYVTTGKDEYKNYLMNSPHYLEMPAKMGENGGANGEDNGLWGCFTWGTTQGLGTITLALVENGLPATDIQKARNNIAKAADRWLENIEEQGYRLPIKQAEDERGGYPWGSNSFILNQMIVMGYAYDFTGNSKYLDGMQDGMSYLLGRNGLDQSYVTGYGERPLQNPHDRFWTPQTSKKFPAPPPGIIAGGPNSRFEDPTITAAVKKDTPPQKCYIDHTDSWSTNEITVNWNAPFAWVTAYLDEIDLITPPGGVDPEEPEVIYGDCNGDGKVNSTDAVALKRYILRSGISINTDNADVNADGRVNSTDLAILKRYILKEIDVLPHK

SEQ ID NO: 863 - DNA, 3776 bp, Cellulomonas fimi
gcgcagtacaccccgctcggcgccgcgtcgcaggcgctggccgcggcgtggttcgggcagccgttccccgcgaccgagctgctcgtgctggccggctggggtctggtcggcatcccgctcgcggcccggctgttccgctggtcgtgagccccggcacgctccaggagggggagcgcgacggcccgtcgggaggtctcccggcgggccgtcgtcgtgggaggggcgtgggaacggaccagggtgtggtcacgctcccacccgaaaggtttaggagtctggacgcgacctgtgcgaactcggagggtgggcccgacctgcccgacgcccaccggcggacccgcaccgacgcgaggcccggcggacggcgacggacagggtctcgtgcacctccaccaccccgcccgcggggtccggtgggttcgcccccgcgacgacgcgagggcacgcccgcacaccagaaaggtacggacgatgtcgtcaacgacccgccggcgatccgcctgggtggcagcagccaccgtaggcgtctcgtcgttcttggcggtcgccgggatcacccccgcgatcgccgcggccggagcgggacaacccgccacggtcaccgtccccgcggcctccccggtccgcgccgccgtggacggcgagtacgcgcagcggttcctcgcgcagtacgacaagatcaaggaccccgccaacgggtacttcagcgcgcagggcatcccgtaccacgccgtcgagaccctcatggtggaggcgcccgactacggccacgagacgacgtccgaggcgtactcctactggctgtggctcgaggcgctctacggccaggtcacccaggactgggcaccgctcaaccacgcctgggacaccatggagaagtacatgatcccccagtcggtggatcagcccacgaactccttctacaaccccaactcgccggccacctacgcgcccgagttcaaccacccgagcagctacccgtcgcagctcaacagcggcatcagcggcggcaccgacccgatcggcgccgagctcaaggcgacgtacggcaacgcggacgtctaccagatgcactggctggccgacgtcgacaacatctacggcttcggcgcgacgccgggcgcgggctgcacgctcggcccgaccgcgaccggcacgtcgttcatcaacaccttccagcgcggcccgcaggagtcggtctgggagaccgtcccgcagccgtcctgcgaggagttcaagtacggcggcaagaacgggtacctcgacctcttcacgaaggacgcgtcgtacgcgaagcagtggaagtacacctcggcgtccgacgccgacgcccgcgctgtcgaggccgtgtactgggccaaccagtgggcgaccgagcagggcaaggccgccgacgtcgccgcgaccgtggccaaggccgccaagatgggcgactacctgcggtacacgctgttcgacaagtacttcaagaagatcggctgcacctcgcccacctgcgccgcaggccagggccgtgaggccgcgcactacctgctctcctggtacatggcgtggggcggcgcgaccgacaccagctccggctgggcgtggcgcatcggctcgtcgcacgcgcacttcggctaccagaacccgctcgccgcgtgggcgctgtcgacggacccgaagctgacgccgaagtcgccgaccgccaaggcggactgggcggcctcgatgcagcgccagctcgagttctacacgtggctgcaggcgtccaacggcggcatcgccggcggcgcgaccaacagctgggacggcgcctacgcgcagcccccggccggcacgcccacgttctacggcatgggctacaccgaggcgcccgtctacgtcgacccgccgtcgaaccgctggttcggcatgcaggcgtggggcgtgcagcgcgtcgccgagctctactacgcgtcgggcaacgcgcaggccaagaagatcctcgacaagtgggtcccgtgggtcgtcgcgaacatctcgaccgacggtgcgagctggaaggtcccgagcgagctcaagtggaccggcaagcccgacacgtggaacgccgccgcaccgaccggcaaccccggcctcacggtcgaggtgacgagctacggccaggacgtcggcgtcgccgccgacaccgcccgcgccctgctcttctacgccgccaagtccggcgacaccgcgtcccgcgacaaggcgaaggcgctgctcgacgccatctgggccaacaaccaggacccgctgggcgtgtccgcggtcgagacccgcggcgactacaagcggttcgacgacacctacgtcgccaacggtgacggcatctacatcccgtccggctggaccggcacgatgcccaacggcgacgtcatcaagccgggtgtctcgttcctcgacatccgcagcttctacaagaaggacccgaactggtccaaggtgcagacgttcctcgacggcggcgcggagccgcagttccggtaccaccggttctgggcccagacggccgtcgcgggtgcgctcgcggactacgcgcggctcttcgacgacggcaccacgacgcctgacacgacggcgccgacggtcccgacgggcctgcaggcgggcgtcgtcacctcgaccgaggcgacgatctcctggacggcctcgacggacgacacccgcgtcacgggctacgacgtgtaccgcggcgccacgaaggtcggcaccgccaccacgacgtcgttcaccgacacgggcctgaccgcctcgacggcgtacgcgtacaccgtccgggcgttcgacgcggccggcaacgtctcggcaccgtccgcggcgctcaccgtcacgaccaaggccacgccgtccgacacgaccgctccgagcgtcccggcgatcacgtcgagctcgagcacggcgaacagcgtgaccatcggctggtcggcctcgaccgacaacgccggcggctcgggcctcgccgggtacgacgtgtaccgcggtgcgacccgcgtggcgcagacgaccgcgctcacgttcaccgacacgggcctgaccgcctcgaccgcgtacgagtacacggtccgggcgcgggacgtcgccggcaacgtgtcggccccgtcgacggccgtctcggtcacgacgaagtccgacaccacgccggacacgacggcgccgagcgtgcccgcgggcctcgccgcgatgaccgtcacggagacgagcgtcgcgctcacctggaacgcgtcgaccgacacaggcggctcgggcctcaagggctacgacgtctaccgcggcgccaccagggtcggctcgacgaccaccgcgtcgtacaccgacaccggcctcacggcggcgacggcgtaccagtacacggtccgggccacggacaacgcgggcaacgtctccgccgcgtcggccgccctgtccgtcaccacgaagacgccgcagaccggcggctcgtgctcggtggcctacaacgccagcagctggaacagcggcttcacggcgtcggtccggatcaccaacaccggcacgacgacgatcaacggctggagcctcggcttcgacctgacggcgggccagaaggtgcagcagggctggagcgcgacctggacgcagtccgggtccaccgtgacggcgaccaacgcaccctggaacgggaccctggccccgggccagaccgtcgacgtcggcttcaacggctcccacacgggccagaacccgaacccggcgtcgttcacgctcaacggcgcgtcctgcacgtgacgcgctgagcgaggacgcaccacccgcaggag

SEQ ID NO: 864 - protein, 1090 aa, Cellulomonas fimi
MSSTTRRRSAWVAAATVGVSSFLAVAGITPAIAAAGAGQPATVTVPAASPVRAAVDGEYAQRFLAQYDKIKDPANGYFSAQGIPYHAVETLMVEAPDYGHETTSEAYSYWLWLEALYGQVTQDWAPLNHAWDTMEKYMIPQSVDQPTNSFYNPNSPATYAPEFNHPSSYPSQLNSGISGGTDPIGAELKATYGNADVYQMHWLADVDNIYGFGATPGAGCTLGPTATGTSFINTFQRGPQESVWETVPQPSCEEFKYGGKNGYLDLFTKDASYAKQWKYTSASDADARAVEAVYWANQWATEQGKAADVAATVAKAAKMGDYLRYTLFDKYFKKIGCTSPTCAAGQGREAAHYLLSWYMAWGGATDTSSGWAWRIGSSHAHFGYQNPLAAWALSTDPKLTPKSPTAKADWAASMQRQLEFYTWLQASNGGIAGGATNSWDGAYAQPPAGTPTFYGMGYTEAPVYVDPPSNRWFGMQAWGVQRVAELYYASGNAQAKKILDKWVPWVVANISTDGASWKVPSELKWTGKPDTWNAAAPTGNPGLTVEVTSYGQDVGVAADTARALLFYAAKSGDTASRDKAKALLDAIWANNQDPLGVSAVETRGDYKRFDDTYVANGDGIYIPSGWTGTMPNGDVIKPGVSFLDIRSFYKKDPNWSKVQTFLDGGAEPQFRYHRFWAQTAVAGALADYARLFDDGTTTPDTTAPTVPTGLQAGVVTSTEATISWTASTDDTRVTGYDVYRGATKVGTATTTSFTDTGLTASTAYAYTVRAFDAAGNVSAPSAALTVTTKATPSDTTAPSVPAITSSSSTANSVTIGWSASTDNAGGSGLAGYDVYRGATRVAQTTALTFTDTGLTASTAYEYTVRARDVAGNVSAPSTAVSVTTKSDTTPDTTAPSVPAGLAAMTVTETSVALTWNASTDTGGSGLKGYDVYRGATRVGSTTTASYTDTGLTAATAYQYTVRATDNAGNVSAASAALSVTTKTPQTGGSCSVAYNASSWNSGFTASVRITNTGTTTINGWSLGFDLTAGQKVQQGWSATWTQSGSTVTATNAPWNGTLAPGQTVDVGFNGSHTGQNPNPASFTLNGASCT

SEQ ID NO: 865 - DNA, 3240 bp, Cellulomonas fimi
gacgcacgggccggggtcggccgcaggggcgctcccggtgtcgcgggccgccgccgcccgccacgggttccacggatggtcacgaaaaggtaacgcgcagggcttaaacgatttgccccatgccccgccgaggtggccgcgtgctgaggtagccgccagtcgctgcggactccccccgggcgactcgcgcctggccgggacggtccgtacgggcgtgccgaccgacacccggaggaccacgtgtccacactcggcaagcgagcaggggtgaggcgtcgcgtacgcgccgtcgccaccgctgcgacggcgacggctctcgtcgccgtccccctcaccaccctggcgacgagcgcgagcgccgcgcccgtccacgtcgacaacccctacgccggcgcggtgcagtacgtgaaccccacgtgggccgcctcggtgaacgccgctgccggccggcagagcgcggacccggccctcgccgcgaagatgcggacggtcgcgggtcagcccaccgccgtgtggatggaccggatcagcgcgatcacgggcaacgccgacggcaacggcctgaagttccacctcgacaacgccgtcgcgcagcagaaggccgcgggcgtgccgctcgtgttcaacctcgtcatctacgacctgcccggccgcgactgcttcgcgctcgcgtccaacggcgagctgcccgcgaccgacgccggcctcgcgcggtacaagagcgagtacatcgacccgatcgcggacctgctcgacaacccggagtacgagagcatccggatcgccgcgacgatcgagcccgactcgctgccgaacctcacgacgaacatctcggagcccgcctgccagcaggcggcgccgtactaccggcagggcgtcaagtacgcgctcgacaagctgcacgcgatcccgaacgtctacaactacatcgacatcggccactccggctggctcggctgggacagcaacgcgggcccgtccgcgacgctgttcgccgaggtcgccaagtcgacgacggccgggttcgcgtcgatcgacgggttcgtgtccgacgtcgcgaacacgacgccgctcgaggagccgctgctctccgactcgtccctgacgatcaacaacaccccgatccggtcgtcgaagttctacgagtggaacttcgacttcgacgagatcgactacaccgcgcacatgcaccggctgctggtcgcggcgggcttcccgtcgtcgatcggcatgctcgtcgacacgtcgcgcaacggctggggcggccccaaccgtccgacgtcgatcaccgcgagcaccgacgtgaacgcctacgtcgacgcgaaccgcgtggaccgtcgcgtgcaccgcggcgcgtggtgcaacccgctgggtgcgggcatcggccggttcccggaggccacgccgtccggctacgccgcgtcgcacctcgacgcgttcgtctggatcaagcccccgggtgagtccgacggcgcctcgaccgacatcccgaacgaccagggcaagcggttcgaccgcatgtgcgacccgacgttcgtctcgcccaagctcaacaaccagctgacgggtgcgacgcccaacgcgccgctcgccggccagtggttcgaggagcagttcgtcaccctcgtgaagaacgcgtacccggtgatcggcggcacgacgcccgtcgaggacctggtggcgccgacggtgccgaccggcctgaccgccggcacgaccaccgcgacgtcggtcccgctgtcgtggacggcgtcgacggacaacgtcgccgtcaccggctacgacgtctaccgcggcacgaccctcgtgggcacgaccgccgcgacgagctacaccgtcacgggcctgaccccggccacggcgtactcgttcacggtccgggcgaaggacgccgcgggcaacgtctcggcggcctccgccgcggcggccgcgacgacgcagtccggcaccgtgacggacacgacggcgccgtccgtcccggccggtctgacggccggcacgacgacgaccacgacggtcccgctctcgtggaccgcctcgaccgacaacgccggagggtccggcgtcgcgggctacgaggtcctgcgcggcacgacggtcgtcggcaccacgacggcgacgagctacacggtcacgggcctgacggccggcaccacgtactcgttctccgtgcgggccaaggacgtcgcgggcaacacgtccgccgcctccgccgcggtctccgcgacgacgcagaccggcaccgtggtcgacaccacggccccgtccgtcccgaccggcctgaccgccggcacgacgacgacctcgtcggtcccgctgacgtggaccgcctcgacggacaacgcgggcggctcgggcgtcgccggctacgaggtcttcaacggcaccacgcgcgtggcgaccgtgacctcgacgagctacacggtcaccggcctcgcggcggacaccgcgtactcgttcacggtcaaggccaaggacgtcgcgggcaacgtgtcggcagcctcggcagccgtctccgcccggacgcaggcggccacgtccggcggctgcacggtgaagtactccgccagctcgtggaacaccggcttcaccggcacggtcgaggtgaagaacaacggcacggcggccctcaacggctggacgctcggcttctccttcgccgacggccagaaggtgtcgcagggctggagcgccgagtggtcgcagtccggcaccgcggtgacggccaagaacgcgccgtggaacggcacgctcgccgccggctccagcgtgtcgatcggcttcaacggcacgcacaacggcacgaacaccgcgccgacggcgttcacgctcaacggcgtcgcctgcacgctcggctgacctgacggtgcccacggcaccgaccgcatgaccggcgggggtcctccggatgtcccggagggcccccgcacggcgtgcaccgcccggccgcaccaccgggtccccaccaccacgaaccgaggagaacccgtgcactccgcatcgcgcacccgcgcacgcacccgcgtgcggacggcggtctcgggcctgctggccgcgaccgtcctcgccgcacccctcaccctcgtcgccgcgcccgcgcaggcggcgaccggcgacgactggctgcacgtcgagggcaacacgatcgtcgactcgaccgggaaggaggcgatcctctccggcgtcaactggttcggcttcaacgcgagcgagcgtgtgttccacgggctgtggtccggg

SEQ ID NO: 866 - protein, 872 aa, Cellulomonas fimi
MSTLGKRAGVRRRVRAVATAATATALVAVPLTTLATSASAAPVHVDNPYAGAVQYVNPTWAASVNAAAGRQSADPALAAKMRTVAGQPTAVWMDRISAITGNADGNGLKFHLDNAVAQQKAAGVPLVFNLVIYDLPGRDCFALASNGELPATDAGLARYKSEYIDPIADLLDNPEYESIRIAATIEPDSLPNLTTNISEPACQQAAPYYRQGVKYALDKLHAIPNVYNYIDIGHSGWLGWDSNAGPSATLFAEVAKSTTAGFASIDGFVSDVANTTPLEEPLLSDSSLTINNTPIRSSKFYEWNFDFDEIDYTAHMHRLLVAAGFPSSIGMLVDTSRNGWGGPNRPTSITASTDVNAYVDANRVDRRVHRGAWCNPLGAGIGRFPEATPSGYAASHLDAFVWIKPPGESDGASTDIPNDQGKRFDRMCDPTFVSPKLNNQLTGATPNAPLAGQWFEEQFVTLVKNAYPVIGGTTPVEDLVAPTVPTGLTAGTTTATSVPLSWTASTDNVAVTGYDVYRGTTLVGTTAATSYTVTGLTPATAYSFTVRAKDAAGNVSAASAAAAATTQSGTVTDTTAPSVPAGLTAGTTTTTTVPLSWTASTDNAGGSGVAGYEVLRGTTVVGTTTATSYTVTGLTAGTTYSFSVRAKDVAGNTSAASAAVSATTQTGTVVDTTAPSVPTGLTAGTTTTSSVPLTWTASTDNAGGSGVAGYEVFNGTTRVATVTSTSYTVTGLAADTAYSFTVKAKDVAGNVSAASAAVSARTQAATSGGCTVKYSASSWNTGFTGTVEVKNNGTAALNGWTLGFSFADGQKVSQGWSAEWSQSGTAVTAKNAPWNGTLAAGSSVSIGFNGTHNGTNTAPTAFTLNGVACTLG

SEQ ID NO: 867 - DNA, 1142 bp, Piromyces rhizinflatus
actgccgtttggttagcttgggatggtgctccaggagaagttgaaggtcatcttaagaatgctggtgataagactattgtattcattctttacatgattccaactcgtgattgtaacagtaaggcttctgctggtggtgcttctaaccttaagaaataccaaggttatgttgattctattgctaacactattagcaagcaccccgaatccaaggttgttatggttattgaaccagatactcttggtaatcttattactggtgaaactgaagaatgtaagactgttcatactttacacaaggatgctcttgcttacgctgttaacgttttcggtgatatgagtaatgttagtgcttatcttgatgctgctcatggtaaatggttaggttgggccgctggtaagactgctgctgttattaaggaaattttagacaatgctccaaatggaaacattcgtggtttcagtactaatgtttctaactaccaaccaattgaatctgaatacgaatatcacgaaaagcttaatgctgctcttgaagatcttggtattaccggtaagaagttcattgttgatactggtcgtagtggtgttgatgttactgaagaatttaaccttaatcaaacctggtgtaatttaatttacgctggtttaggtgaaccatctcgtggaagtccagatccagaaaaattcccattattagatgcttacttctggcttaagccaccaggtgaagctgatggttctgacactggtagtagagctgatccagtttgtggtcgtgaagattccttcccaggtgctccagacgctggttcatggttctctgaatattttgctagtatgttagaaaaatctccattttacggtgaaggtattgaagaagaaccagaagaaccagaagaaccattatgtagtcaaaagttcttagatcaaggttaccaatgctgctctcaatgtggtactatttactacgttgatgatgccggtaattggggtgttgaaaacaacgaatggtgtggattaccagaagattgttaaataatttaaacatttaaaatattgaatattttaaacgtttttatctctttatagtaaattatttttaaattatatagaaaaaaaaaaaaaaaaaaaaaaaaaaa

SEQ ID NO: 868 - protein, 345 aa, Piromyces rhizinflatus
TAVWLAWDGAPGEVEGHLKNAGDKTIVFILYMIPTRDCNSKASAGGASNLKKYQGYVDSIANTISKHPESKVVMVIEPDTLGNLITGETEECKTVHTLHKDALAYAVNVFGDMSNVSAYLDAAHGKWLGWAAGKTAAVIKEILDNAPNGNIRGFSTNVSNYQPIESEYEYHEKLNAALEDLGITGKKFIVDTGRSGVDVTEEFNLNQTWCNLIYAGLGEPSRGSPDPEKFPLLDAYFWLKPPGEADGSDTGSRADPVCGREDSFPGAPDAGSWFSEYFASMLEKSPFYGEGIEEEPEEPEEPLCSQKFLDQGYQCCSQCGTIYYVDDAGNWGVENNEWCGLPEDC

SEQ ID NO: 869 - DNA, 1571 bp, Neocallimastix patriciarum
gaaataaaaaataatcattttatttgatataaaataattatttaaaaataaaaaaataaaattaaattttatataatattttttatttgatataaaaaaatattgtatcattttcaaaaaaaattataaattaaaataaaaaaaaaaaaaaaaaaaaataacgaaaatgaaaaatttacttttagctagtgttcttagtttaggtcttgctggcttagctaatgctgcttgtggtggtgcctgggctcaatgtggaggtgaaaacttccatggtgataaatgttgtgtttccggtcacacttgtgttagtattaaccaatggtattcacaatgtcaaccaggaggtgctccaagcaataatgcttcaaacaataataataacaataacaataataacaacaacaataataacaacaacaataaccacaacaacaacaacaacaataacaacaataacaataacaataacaatggtggtagtggtagtactaaaaacttctttgataaccaaatttatgctaacccaaagtttattgaagaagtcaattcttctattccaagattaagttatgatttacaacaaagggctcaaaaggttaaggatgttccaactgccgtttggttagcttgggatggagccactggagaagttgctcaacatcttaaagctgctggttctaaaactgttgtcttcatcatgtacatgattccaactcgtgattgtaacgctaatgcctctgctggtggtgctggtaacctcaacacttataagggatacgttgataatattgctagaactattcgtagttatccaaattcaaaggttgttatgattcttgaaccagatactcttggtaaccttgttactgctaatagtgctaactgtcaaaacgttcgtaacttacataagaatgctttatcttatggtgttaatgttttcggtagcatgagtaatgttagtgtttaccttgatgctgctcatggtgcttggttaggtagctctactgataaggttgcttctgttgttaaggaaatcttaaataatgctccaaatggaaagattcgtggtttaagtactaacatttctaactaccaatcaatttcttctgaataccaataccaccaaaaacttgcctctgctcttgctgctgtcggtgttccaaacatgcacttcattgttgatactggtcgtaatggtgttactattaattctggaacatggtgtaacttagtcggtactggtcttggtgaacgtccaagaggtagtccaaatgctggtatgccattattagatgcttacatgtggcttaagactccaggagaatctgacggttcatcctctggttctagagctgatccaaattgttctagtaatgattctcttagaggtgctccagatgctggtcaatggttccatgattacttcgctcaattagtaagaaatgctagaccatcattttaagcaaatttttaaatgattgaatttaacaaaaattactaattaaatatataaattatttaattatgtaataagtaaaaaacaaaaaaaaaaaaaaaaaaaaaaaaaaaaa

SEQ ID NO: 870 - protein, 431 aa, Neocallimastix patriciarum
MKNLLLASVLSLGLAGLANAACGGAWAQCGGENFHGDKCCVSGHTCVSINQWYSQCQPGGAPSNNASNNNNNNNNNNNNNNNNNNNHNNNNNNNNNNNNNNNGGSGSTKNFFDNQIYANPKFIEEVNSSIPRLSYDLQQRAQKVKDVPTAVWLAWDGATGEVAQHLKAAGSKTVVFIMYMIPTRDCNANASAGGAGNLNTYKGYVDNIARTIRSYPNSKVVMILEPDTLGNLVTANSANCQNVRNLHKNALSYGVNVFGSMSNVSVYLDAAHGAWLGSSTDKVASVVKEILNNAPNGKIRGLSTNISNYQSISSEYQYHQKLASALAAVGVPNMHFIVDTGRNGVTINSGTWCNLVGTGLGERPRGSPNAGMPLLDAYMWLKTPGESDGSSSGSRADPNCSSNDSLRGAPDAGQWFHDYFAQLVRNARPSF

SEQ ID NO: 871 - DNA, 3604 bp, Penicillium decumbens
aatgccaaaggtctaacatgaggctggtgctcgcttatggattaaccggcacgggctgatgcccgtgccggccggatcttgcataatatgtcacgaaatgattgttggaataatgcctcggattcacgggcgtgcgactatgtacggtctcttggcaggcactcggccgttgagcagcttgctggccaagaccacaactgtcgtggtgatagagggaaatttgacccgcgacaggctttcatgatctgaaccaaggtcttggacattcacatcaaagaaaaggctactagatagtgcagcgattccacttggacttttccagaacagcgctgatcctttccaaattggccatggaggatgccgcggtgggagagtgcctgatcaccaggtggatacaacaaaagctcatcctgaggtggtgacagtaaagatgaagttgatcattaccgccttgtagtaattcttccttgtatatgcaagtgacagaaggcgttataatcacggggtgtctccccgcaattgcgatcgacagtcgccaagatgaagaggcctgtacgtcccctcttcgtcttccgaccccatcacttttgaccgtggccgattgagtttaacggcatcttgaagagcactcacctagtgataattgactaagatggtcttctgatctgtgtgatgaatctttctacaaaatttccgttgcgggaaaaggctcaccattagacagggcagtgtacaatgttcgtcctgctttgctttccccctcatcagaaactaggaggcaaatgaatccaggacatcgccgctcatgtaagataagcgatcgatgtaattgctccattaacttcttcatttcacccagcggctatagtccagtcggaacggtagggtgattcatgttgtttcagtgggatgtgtgaggaagggattcggtttcgagtagaaataatggagcagacaccatgacaagattcggccaagatcgccagggaaaatcacggggtatagtcagcgctaagctctcattgaaggatattttgcgctttcatcccgtcagacctggggaaatttccggatatgtgggatacagcgccgatctgaaacgctctatgcccaaaacagcatgcagaatgccccggacaattcgacgccgcggagcgcggtgtaggtccctgcagagtgggatgctgctcatgtattgatgcgggcgctttccagaagcaaaacgcccaacgctttaccgaccgtatgtggcacgatcatggcgccaggtggcggcgccagcggatttaacctatagctctaatgagctctgcagctgtcgtagggtctttcaccatctacatcgtactagatctcttgatatttgagtctccgcaagaagtctggcaagtgaaatagtatagatttgcattttcttttcagcgcagatctccgatggtgatgccatttcaagctcggagatgggcccgtctagcgaggaccaaaatcgctagtcactagacgatagctcatgactccagcaacgaatcttgcacgtcgttggtcgagatcaactttcttggacgatctttcctcgcttggcagtgaaactcgatccaccttcattttgatgcagaacgtgggccatgattctccttgcaatggccctggtcggagaccggtctcttgtcttggctgagttgaacactccatctagtttctgaacaatatggctcgcaggagccacgacagtctgtgtcaatcttggcaaaactcgatgagagatctatataaagacctcggtgctgctccctcatctcaagaatcatcaactgcaggccagtgagacaatcctactacgcttccctccctcatatacaaactttcatacgtcaggtccattcctttcattgatctccattatgtatcaacgcgcacttcttttctccgccttgatggcgggcgtgagtgctcagcaggttggaactcagaagcctgaaacccacccaccactcgcctggaaggagtgtacctcgtctggctgcaccagcaaagatggttccgtggtcattgatgccaactggcgctgggttcactcggtcgatggttacaagaactgctacactggtaacgaagtgagtatcgagaactcttatggcttagactggaaaccacatgctaatcaatgtcaatttctttttcgccaacagtgggacagcaccctgtgccctgacgatgctacctgcgcgaccaactgcgctgtggacggtgcggactatgccggcacctacggagctaccaccgagggagactccctgtccatcaacttcgttaccggatcaaacatcggctcgcgcttctacctcatggaggatgagaacaaataccagatgttcaagctcctgaacaaggaattcaccttcgacgttgatgtttccactcttccctgtggcctcaatggtgccttgtactttgtctccatggatgccgacggtggcatgtccaagtatgagaccaacaaggcgggtgccaagtatggtacaggttactgtgactctcagtgcccgcgtgacctgaagttcatcaacggaaaggttcgttactcttgattgactcgcggagcaaaaattcaggtgctaaggttcaaaactttttagggtaacgttgaaggctggaagccatctgcgaacgacaagaatgccggtgttggaccacacggttcttgctgtgctgaaatggatatctgggaggctaacagcatctccactgccttgactccccatccctgcgataccaacggccagaccatttgcgaaggtgacagctgcggtggaacctactctaccaccagatacgccggtacctgcgatcccgatggctgcgacttcaaccccttccgcatgggtaacgaatccttctacggccccggaaagatggtggacaccaagtcgaagatgactgtcgtgacccagttcatcaccagcgacggaaccgacactggcagcttgaaggagatcaagcgcgtctatgtccagaatggcaaggtcattgccaactcggcctcggacgtgagcggcattactggcaactcgatcacctcggacttttgcactgctcagaagaagacctttggcgacgaggatgtctttaacaagcatggtggtctgtctggcatgggtgatgctctgggagaaggcatggttctcgtgatgagcctgtgggatgaccacaactctaacatgctctggctcgacggcgagaagtacccaaccgatgctgctgcttccaaggctggcgtcagccgtggcacctgcagcactgactctggcaagccctctactgttgaatccgagtctggttctgccaaggtcgttttctccaacatcaaggttggctccattgggtcaaccttttccgcataagggtcaggagaacctcattgggcttgatagcctagtcttcaacatttgatatgttgagagtttgaaagagaaattggattgttagactcatctgaagagctgttgatcagtcttcatgtccttacgagtctcgcaaagcgtggactagggtcttggtggtcccgaccagtctcggaagcttctgattttacagaaagaaataa

SEQ ID NO: 872 - protein, 453 aa, Penicillium decumbens
MYQRALLFSALMAGVSAQQVGTQKPETHPPLAWKECTSSGCTSKDGSVVIDANWRWVHSVDGYKNCYTGNEWDSTLCPDDATCATNCAVDGADYAGTYGATTEGDSLSINFVTGSNIGSRFYLMEDENKYQMFKLLNKEFTFDVDVSTLPCGLNGALYFVSMDADGGMSKYETNKAGAKYGTGYCDSQCPRDLKFINGKGNVEGWKPSANDKNAGVGPHGSCCAEMDIWEANSISTALTPHPCDTNGQTICEGDSCGGTYSTTRYAGTCDPDGCDFNPFRMGNESFYGPGKMVDTKSKMTVVTQFITSDGTDTGSLKEIKRVYVQNGKVIANSASDVSGITGNSITSDFCTAQKKTFGDEDVFNKHGGLSGMGDALGEGMVLVMSLWDDHNSNMLWLDGEKYPTDAAASKAGVSRGTCSTDSGKPSTVESESGSAKVVFSNIKVGSIGSTFSA

SEQ ID NO: 873 - DNA, 2820 bp, Polyporus arcularius
tggtgaaggaagagccagcgttcaccattcaagagcaccgagagttccccatactcggagtggtcacgaacgggcgatcgttaagcaggttgatcactctgaggctcggatgcactactggtgccgagggttctgtgatggtggtctggaagacgtccgaagttccaagatcacaagggctcgtatgcacgggaccggacattagcggctttacttgctccgcatggactcgtgggtctttcagctgtcctccggggctcttgtgcgtgggtaggaccgatcatactgaccacagagctaatcgaacgccttcgtcagatatagaccagtaccacctgcacgctcagcggacatggcgcgcatgcgggctagggacgtctgacatgacgcggtgcttggtaggcttgagggccagccaaagggtacgagaacgttgcccccgtaaagctcgcgagctccttccgtcaagctctgccagctgccataaaggacgtttgctggcttgattactaccgcggagtgacgttcgagacggatgcttctcactcaggtggcggagaaacatggctcgtgcccaagtcggccaactccatccgaacttgtaccgacgccgagcttgagcaaagaagacggacccgtcgcgcatgcttcctccgccgcttaccgcctacgacgatggatcgtggtcgggtgaacatgcggtcccatgacttacgctcaaccgcgtccatgtcgacaactgacctgccccgacgtctttccgccacgtccgctcgggtcttcgccggatattctgggtgttcgacgtgatgctgggtgccaccgagagctcttcgtagctgtcgctgcagctatataacgaccacgtcagatggctgggacgccaggatccacagaccctctcaagcccggtaccgcaaaatgtccaagttcgcgtcgctcctcgctctgctcgccatcgtcccctccctggcttacgcccaggctcccgtgtacgggcagtgcggcggtatcggctggtgtgagtaccacaaacaaagttgcttatggaacttggaactgacagtctggcatgaactacagctggtgctaccacctgtgtatctggatccgtttgcactaagcaaaacgactactactcgcagtgcctgtaagttcataacacaatgatactcctgctagcacaatgctcatcgtgtatcgtgcagtcctggcgcagcgagctcggcaccgacttctcccccaactacctcagcaccctcgtccactccggtcagcaccccaccgaccggcaccaccaccggtggcagcgccccttcgtccaccccggccgctggcaaccccttcgttggcgtcacggtaagtaaaactatcctcttggacacatacgaaactgagggtgctgatttgtgttctcgacagcccttcctcagcccttactacgctgctgaggtcgccgcggctgcggatgccatcaccgactccaccctgaaggccaaggctgcgagcgtcgccaagatcccgacgttcacctggctcgactccgtcgcgaaggtgcccgacctcggcacgtacctcgcagacgcgtccgcgctccagaagagctccggccagccgcaggtcgtgcagatcgtcgtgtacgacctccccgaccgtgactgcgcggccaaggcgtcgaacggcgagttcagcatcgccgacggcggccaggcgaagtactatgactacatcgaccagatcgtcgcgcagatcaagaagttccccgacgtccgcgtcatcgccgtgatcgagcccgactcactcgccaacctcgtcacgaacctgaacgtccagaagtgcgcgaacgcacagaccacgtacaaggcctgcgtcacctacgccctcaaccaactcgcctccgtcggcgtgtaccagtacatggatgccggccacgctggctggctcggctggcccgccaacatccagcccgctgcgcagctcttcgccgacatgttcaagagcgcgaactcctccaagttcgtccgcggtctcgccaccagtaagcctctcttcccgtcctttcccatgaggatcgtgagactcacatatggcccacagacgtcgcgaactacaacgccctcagcgcggcctcgcccgaccccatcacccagggcgacccgaactacgacgagctgcactacatcaacgcgctcggccccatgctcgcacagcagggcttccccgcccagttcgtcgtcgaccagggccgctccggccagcagaacctccgccagcagtggggcgactggtgcaacatcaagggcgccggcttcggcacccgcccgacgaccaacaccggctcctcgctcatcgacgccatcgtctgggtcaagcccggaggagagtccgacggtacctcgaacagctcctcgccacgcttcgacagcacgtgctctctggtgcgttcctgtccctgttcctctgctagtgtgaatgctggtgctgacggggtcccatcgtgcagtctgatgccactcaacccgcgcccgaggctggtacctggttccagacatacttcgagaccctcgtctcgaaggcgaacccgccgctgtaaaagccttcctggtgtatcgatggtagcttgctgtatccatgtgtactgtatctcttctcaaaatctagggctttctctcgcttcccgtgctgctggctgttcgtctgctggacacccccggtgttccgacgatgaaatctcacacgagttcgctctgcgtgggcgtgggtgaccccatccccaagatacccgccaaccgcggaggccacgatactcatgcgtgtact

SEQ ID NO: 874 - protein, 454 aa, Polyporus arcularius
MSKFASLLALLAIVPSLAYAQAPVYGQCGGIGWSGATTCVSGSVCTKQNDYYSQCLPGAASSAPTSPPTTSAPSSTPVSTPPTGTTTGGSAPSSTPAAGNPFVGVTPFLSPYYAAEVAAAADAITDSTLKAKAASVAKIPTFTWLDSVAKVPDLGTYLADASALQKSSGQPQVVQIVVYDLPDRDCAAKASNGEFSIADGGQAKYYDYIDQIVAQIKKFPDVRVIAVIEPDSLANLVTNLNVQKCANAQTTYKACVTYALNQLASVGVYQYMDAGHAGWLGWPANIQPAAQLFADMFKSANSSKFVRGLATNVANYNALSAASPDPITQGDPNYDELHYINALGPMLAQQGFPAQFVVDQGRSGQQNLRQQWGDWCNIKGAGFGTRPTTNTGSSLIDAIVWVKPGGESDGTSNSSSPRFDSTCSLSDATQPAPEAGTWFQTYFETLVSKANPPL

SEQ ID NO: 875 - DNA, 2424 bp, Polyporus arcularius
catgccgtcgaacttcatggtaattggtccttccacaggcgaatcttgggcggacggtcatcggccacacccgaactatttctgctccactcccatcacttcttcgcccatcttgacctgcatgtctgtcttctgcaacggactacacctgactacgagactgccgctctcatgtgcgcagtcggctacggaatatctgcggttcaaataacatcaccggtgcaagaccactcggtctttagctgtcttcccccttcatgctttccctgtaccttcggattcacttcggtgcctgtgatgaaccgtcttcctcccctcaagctggtaccctctcctgcgccgttctgcgttcagcacggtggaatcgtgacctcgtctcatgctgggcaacaacatacactagcgagctaccgtggattatccgttcgcgactcgtataaaaggtaggccacaacgccgtcaaccccatcgactcgacagtcgtcctcccaacagcaacagccccacagctagctgaccgacatgttccccacccttgctctcgtatcgctctctttcctcgcgatcgcctacggtcagcaagtgggcacgctcaccgccgagacccaccccaagctcagcgtctcgcaatgcaccgcgggcggaagctgcacgactgtccagcgttccgtcgtcctcgactctaactggcgttggctccacgacgtcggtggtagcaccaattgctacaccggcaacacctgggacgactcgctttgccctgaccccacgacctgcgcggccaactgtgccctcgacggtgcagactactccggtcagtacaccccacttctgttgttgcctcttccgcatcctgacattcgactacaggtacctacggtatcacgacgagtggcaacgccctcagcctgaagttcgtgacccagggcccctactcgacgaacatcggttctcgtgtctacctcctctctgaggatgacagcacgtacgagatgttcaacctgaagaaccaggagttcacctttgacgtcgacatgtccgccctcccttgcggtctcaacggcgcactctacttcgtcgagatggacaaggatggtggctctggccgcttcccgacgaacaaggctggttccaagtacggaactggctactgcgatacccagtgcccccacgacatcaagttcatcaacggcgaggtaagcaatattcgccctcagtatataagcagaggctaatagaccttctacgcactcaggccaacgtcctcgactgggctgggtcttccaacgacccgaacgcgggcaccggacactacggaacgtgctgcaacgagatggatatctgggaggcgaactcgatgggtgccgccgttacgccccacgtctgcaccgtccagggccagacccgctgcgaaggcaccgactgcggtgacggtgacgagcgctacgacggtatctgcgacaaggacggctgcgacttcaactcgtggcgcatgggcgaccagaccttcctcggccctggcaagaccgtcgacacctcgtccaagttcaccgtcgtcacccagttcatcaccgccgacaacacgacctcgggcgacctctccgagatccgccgtctctacgtccagaacggcaaggtcatcgccaactcgaagacgcaaatcgcgggcatggacgcgtacgactccatcaccgacgacttctgcaacgcccagaagaccacgttcggcgacaccaacacgttcgagcagatgggtggtctcgccaccatgggcgacgccttcgaaactggcatggtcctcgtcatgtccatctgggacgaccacgaggcgaagatgctctggctcgacagtgactaccccaccgacgccgacgcgtctgccccgggtgtctctcgtggaccgtgcccgacgacctcgggtgatcccaccgacgtcgagtcccagagccccggtgcgaccgtcatcttctccaacatcaagaccggtcccatcggctccaccttcacctcctaaagtgtgagttacatattttcactcctggactgcacacaagactaacctgctactgtcaggttggcgagcgcattcagggacgaagccgtctcggaaaaagtttcgagttccaactaccagtgactgcatgtaccatcgagaacgacaacagagctatcttatctcccttcactgtctttctgtgctaatccgagcgagggacgtcgccgcgccgaacggcggtgaagctgtagccacatcacattgagagtctcctgggccaggacagcatcgccaaattggggacagtccgagagcatgctgtcgtggactggagaggatgagagccagtgacagcacgcccgtaggcgtcgacgaagtatggtcgccaatgatcgcactcggtcggtaagcgctgagtatgatcgtac

SEQ ID NO: 876 - protein, 458 aa, Polyporus arcularius
MFPTLALVSLSFLAIAYGQQVGTLTAETHPKLSVSQCTAGGSCTTVQRSVVLDSNWRWLHDVGGSTNCYTGNTWDDSLCPDPTTCAANCALDGADYSGTYGITTSGNALSLKFVTQGPYSTNIGSRVYLLSEDDSTYEMFNLKNQEFTFDVDMSALPCGLNGALYFVEMDKDGGSGRFPTNKAGSKYGTGYCDTQCPHDIKFINGEANVLDWAGSSNDPNAGTGHYGTCCNEMDIWEANSMGAAVTPHVCTVQGQTRCEGTDCGDGDERYDGICDKDGCDFNSWRMGDQTFLGPGKTVDTSSKFTVVTQFITADNTTSGDLSEIRRLYVQNGKVIANSKTQIAGMDAYDSITDDFCNAQKTTFGDTNTFEQMGGLATMGDAFETGMVLVMSIWDDHEAKMLWLDSDYPTDADASAPGVSRGPCPTTSGDPTDVESQSPGATVIFSNIKTGPIGSTFTS

SEQ ID NO: 877 - DNA, 1395 bp, Fusicoccum sp. BCC4124
atgtaccagacttcgcttcttgcttcgctctctttccttctcgccacctcgcaggctcagcaggtcggcacgcaaacggcggagacgcaccccaagctcacgacccagaagtgcaccacggccggcggatgcaccgaccagtcgacctcgatcgttcttgacgccaactggcgctggctgcacactgttgacggctacaccaactgctacaccggccaggagtgggacacgtccatctgcaccgacggcaagacctgcgccgagaagtgcgcgctcgatggcgccgactacgagagcacctacggtatctcgacgagcggcaacgccctcacgatgaacttcgtgaccaagagctcgcagaccaacatcggtggccgtgtctacctgctcgccgccgacagcgacgacacgtacgagctgttcaagctcaagaaccaggagttcaccttcgacgtcgacgtgtcgaacctgccctgcggcctgaacggcgccctgtacttctccgagatggactcggacggtggtctgtccaagtacacgaccaacaaggccggtgccaagtacggcacgggctactgcgacacccagtgcccgcacgacatcaagttcatcaacggcgaggccaacgtccagaactggaccgcgtcctcgaccgacaagaacgccggcactggccactacggctcgtgctgcaacgagatggacatctgggaagccaactcgcaggccaccgccttcaccccccacgtctgcgaggccaaggtcgagggccagtaccgctgcgagggcaccgagtgcggtgacggcgacaaccgctacggcggtgtgtgcgacaaggacggctgcgacttcaactcgtaccgcatgggcaacgagaccttctacggctccaacggctcgaccatcgacacgaccaagaagttcaccgtcgtcacccagttcatcacggccgacaacactgccaccggcgccctgaccgagatccgccgcaagtacgtgcagaacgacgtcgtcatcgagaactcgtacgccgactatgagacgctgtccaagttcaactccatcaccgacgacttctgcgccgcccagaagaccctctccggcgacaccaacgacttcaagaccaagggcggcatcgcgcgcatgggcgagtcgttcgagcgcggcatggtcctcgtcatgtccgtctgggacgaccacgcggccaacgccctgtggctcgactcctcgtaccccactgacgccgatgccagcaagcccggtgtcaagcgcggcccctgctccaccagctccggtgtcccctctgatgtcgaggccaacgacgccgactcctcggtcatctactccaacatccgctacggcgacatcggctccaccttcaacaagaccgcttag

SEQ ID NO: 878 - protein, 464 aa, Fusicoccum sp. BCC4124
MYQTSLLASLSFLLATSQAQQVGTQTAETHPKLTTQKCTTAGGCTDQSTSIVLDANWRWLHTVDGYTNCYTGQEWDTSICTDGKTCAEKCALDGADYESTYGISTSGNALTMNFVTKSSQTNIGGRVYLLAADSDDTYELFKLKNQEFTFDVDVSNLPCGLNGALYFSEMDSDGGLSKYTTNKAGAKYGTGYCDTQCPHDIKFINGEANVQNWTASSTDKNAGTGHYGSCCNEMDIWEANSQATAFTPHVCEAKVEGQYRCEGTECGDGDNRYGGVCDKDGCDFNSYRMGNETFYGSNGSTIDTTKKFTVVTQFITADNTATGALTEIRRKYVQNDVVIENSYADYETLSKFNSITDDFCAAQKTLSGDTNDFKTKGGIARMGESFERGMVLVMSVWDDHAANALWLDSSYPTDADASKPGVKRGPCSTSSGVPSDVEANDADSSVIYSNIRYGDIGSTFNKTA

SEQ ID NO: 879 - DNA, 399 bp, Thermomyces lanuginosus
ttcgatgtcgatgtctctaacctgggctgcggtctcaacggcgccctctacttcgtctccatggacgctgatggtggtatgagcaagtactctggcaacaaggctggcgccaagtacggtaccggctactgcgatgctcagtgcccgcgcgaccttaagttcatcaacggcgaggccaacattgagaactggaccccttcgaccaatgatgccaacgccggtttcggccgctatggcagctgctgctctgagatggatatctgggaggccaacaacatggctactgccttcactcctcacccttgcaccattatcggccagagccgctgcgagggcaacagctgcggtggcacctacagctctgagcgctatgctggtgttcgcgatcccgacggctgc

SEQ ID NO: 880 - protein, 133 aa, Thermomyces lanuginosus
FDVDVSNLGCGLNGALYFVSMDADGGMSKYSGNKAGAKYGTGYCDAQCPRDLKFINGEANIENWTPSTNDANAGFGRYGSCCSEMDIWEANNMATAFTPHPCTIIGQSRCEGNSCGGTYSSERYAGVRDPDGC

SEQ ID NO: 881 - DNA, 2096 bp, Pleurotus ostreatus
ggacgactatctaccatcagttctttcaccaagttcttctctagccttggttttcagatcctgaatatcctccgtcgacatgttccgcaccgctgctctcaccgctttcacctttgctgccgtcgttctcggccagcaggtcgggactttgaccacagagaaccacccagctttgtccatccagcagtgcactgctactggttgcaccacccagcaaaaatcagtcgtcctcgactccaactggcgctggactcactccactgccggagcgactgtaagtacaactctgctcccaagctcgagcctgtttctcacttcccatcacgactgcttttagaactgctacaccggcaacgcctgggaccctgctctctgccccgacccggccacttgtgctaccaactgtgccatcgacggtgctgactacagtggaacgtacggtatcaccacctccggcaatgcccttaccctccgcttcgtcaccaatggccagtactcccagaacatcggttcccgagtctaccttttggacgacgctgatcactacaagctgttcgacttgaagaaccaggaattcacattcgatgtcgatatgtctggtcttccttgtggcctcaatggtgccctctacttctccgagatggccgctgacggtggcaaggctgcccatgccggtaacaacgtgagcatccaaccccgtctctttaagtcacccagtagctgacagtagaatttttcaattaggctggcgccaaatacggaaccggttattgtgacgctcaatgcccgcacgatatcaagtggatcaatggcgaggtaagtttatatatctatgagcgcgctggcaattgaattgcatcttatttctaccaggccaacgttctcgactggtccgcttctgcgactgacgacaacgctggcaatggccgatacggagcgtgctgcgctgagatggacatctgggaggccaactcagaagccactgcctacactcctcacgtctgccgtgacgagggtctctaccgctgctcaggcaccgagtgtggtgatggcaacaaccgctatggaggcgtctgcgacaaggatggctgcgacttcaactcttaccgcatgggtgacaagaacttcctcggccgcggcaagacaatcgacaccacgaagaaggtgactgtcgtgactcagtaagttctacctcagcacatttgtcttcaccgactgacactatttttaggttcattactgacaacaacactcccaccggcaaccttgtcgagatccgccgtgtttacgtccagaatggcgttgtctaccagaactcattctccaccttcccttcgttatctcagtacaactccatctctgatgagttctgtgtcgcccagaagaccctgttcggcgataaccagtactacaacactcacggtggtacgacaaagatgggcgacgccttcgataatggcatggtcctcatcatgtccctctggagtgatcacgccgcccacatgctctggcttgactctgactacccactcgacaagagcccgtctgagcccggtgtgtctcgtggagcttgcccaactagctccggagaccccgacgatgttgttgccaaccaccccaacgcgtccgtcaccttctcgaacatcaagtacggcccgatcggctctaccttcggtggcagcactccccccgtctcatcaggcggcagctctgtcccccctgtcacctcgaccacttcgtctgggacgaccacccccacaggacccacaggcaccgttcccaagtggggacaatgtggcggtgaggagcataatcctggaatatttgatatatactgaccccctgcggctaggtatcggctacagcggacccaccgcttgcgttgccgggtctacctgcacatacagcaacgactgtaagtttcttcttgctctttcctgatcattgtgcttatgccatcgattcagggtactctcaatgcctttaaattatcccgctatgctagtcatagttcaaaagtccatagtatatatgcctcatggtgtatttatcgcgtactttcgcatcgctgaaatgttaatcatgcaacaccaatc

SEQ ID NO: 882 - protein, 523 aa, Pleurotus ostreatus
MFRTAALTAFTFAAVVLGQQVGTLTTENHPALSIQQCTATGCTTQQKSVVLDSNWRWTHSTAGATNCYTGNAWDPALCPDPATCATNCAIDGADYSGTYGITTSGNALTLRFVTNGQYSQNIGSRVYLLDDADHYKLFDLKNQEFTFDVDMSGLPCGLNGALYFSEMAADGGKAAHAGNNAGAKYGTGYCDAQCPHDIKWINGEANVLDWSASATDDNAGNGRYGACCAEMDIWEANSEATAYTPHVCRDEGLYRCSGTECGDGNNRYGGVCDKDGCDFNSYRMGDKNFLGRGKTIDTTKKVTVVTQFITDNNTPTGNLVEIRRVYVQNGVVYQNSFSTFPSLSQYNSISDEFCVAQKTLFGDNQYYNTHGGTTKMGDAFDNGMVLIMSLWSDHAAHMLWLDSDYPLDKSPSEPGVSRGACPTSSGDPDDVVANHPNASVTFSNIKYGPIGSTFGGSTPPVSSGGSSVPPVTSTTSSGTTTPTGPTGTVPKWGQCGGIGYSGPTACVAGSTCTYSNDWYSQCL

SEQ ID NO: 883 - DNA, 2190 bp, Pleurotus ostreatus
tgtcctgcagatccttgaaggggactagcgactacgtatttcctgcgtccctctatataatctggtagggtgaggagttgttctctcatcggttctactaccagaagcttctacggccttggtttccagactctgaatacctcttgtcaaaatgttccgcactgctgctctcaccgctttcacccttgccgccgttgttctcggtcagcaagtcggcacattggcagccgaaaaccatcctgcgctctccatccagcagtgcacagccagtggctgcaccacccaacaaaaatcggtcgtcctcgactctaactggcgctggactcactccactgccggtgcaaccgtaagagtactttccttctggcctagagcttcgtcctcatttttcggtcacctagaactgctataccggaaacgcctgggattcatctctgtgccccaacccgacgacctgcgccaccaactgcgccatcgacggtgctgactacagcggcacatacggtatcacgacgtccggcaattcgctcacccttcgcttcgtcaccaacggccaatactcagaaaacattggctcgcgcgtctacctcttggatgacgccgatcactacaaactgttcaacttgaagaaccaggagttcacgttcgatgtcgacatgtccggccttccttgcggtctgaatggcgctctatacttctccgagatggccgccgatggaggcaaggccgcgcacactggcaacaacgtaagaacacaccccaacattgctggatcaatgctaatgtatcacgttaaggctggtgcgaaatacggaactggctactgtgatgcccagtgcccgcacgacatcaagtggatcaacggagaggtaggatgtcatccatgacaacaacacgcaattgaatctgatcttgtatatctaggccaacattctcgactggtcaggctctgccactgatcccaacgcaggaaacggccgatacggagcgtgctgcgctgagatggatatctgggaggccaactccgaagccactgcctacactcctcacgtctgccgtgacgagggtctctaccgctgctctggcaccgagtgtggtgatggcgacaaccgctacggaggagtctgcgacaaggatggctgtgacttcaactcgtaccgcatgggcgacaagaacttcctcgggcgtggcaagacgatcgacaccaccaagaagatcaccgtcgtcactcagtaagtggcatatcaccacccgtatctgactcggcgactgatcatattgctataggttcatcacggacgacaacacccccactggtaaccttgttgagattcgccgtgtctacgttcaagacggcgtcacgtaccagaactcattctccaccttcccctcgttgtctcaatacaattccatctcggacgacttctgtgtcgcccagaagacattgttcggtgacaaccaatactacaacacacacggtggcacagagaagatgggcgattccttggccaacggcatggtgctcatcatgtctctctggagtgaccacgccgcgcacatgctctggctcgactccgactacccgctcgacaagagcccgtctgagcccggtgtgtctcgtggagcttgcgcgacgaccactggagaccctgatgatgttgtggcgaaccatcccaacgcgtctgtgacgttctcgaacatcaagtatggcccaatcggctctacgtacggtggcagcacgcctccggtctcttctggtaacacctctgtgcctcctgtcacttcgacgacctcctctgggccaactaccccaactggacccactggaaccgtccccaagtggggacaatgtggcggtgagtaacctcactcactctcaccccagcattacgacctagtataaataggcatcggctacagtggacccaccagctgcgtcgccggctcaacctgcacgtacagcaacgaatgtaagtcctctatctgtcgtctgtcatggattgcgatactcaatctgctctatccctagggtactcccagtgcttgtgaacgtagctggataatttattgtcgtgctagccacaacttcgtctctcccttgagtaaatgtatttatcacatgttgtactattttcgcttgtactgcgtgatcgtcatatatccaatgccagtcgtgtggtgttctattag

SEQ ID NO: 884 - protein, 523 aa, Pleurotus ostreatus
MFRTAALTAFTLAAVVLGQQVGTLAAENHPALSIQQCTASGCTTQQKSVVLDSNWRWTHSTAGATNCYTGNAWDSSLCPNPTTCATNCAIDGADYSGTYGITTSGNSLTLRFVTNGQYSENIGSRVYLLDDADHYKLFNLKNQEFTFDVDMSGLPCGLNGALYFSEMAADGGKAAHTGNNAGAKYGTGYCDAQCPHDIKWINGEANILDWSGSATDPNAGNGRYGACCAEMDIWEANSEATAYTPHVCRDEGLYRCSGTECGDGDNRYGGVCDKDGCDFNSYRMGDKNFLGRGKTIDTTKKITVVTQFITDDNTPTGNLVEIRRVYVQDGVTYQNSFSTFPSLSQYNSISDDFCVAQKTLFGDNQYYNTHGGTEKMGDSLANGMVLIMSLWSDHAAHMLWLDSDYPLDKSPSEPGVSRGACATTTGDPDDVVANHPNASVTFSNIKYGPIGSTYGGSTPPVSSGNTSVPPVTSTTSSGPTTPTGPTGTVPKWGQCGGIGYSGPTSCVAGSTCTYSNEWYSQCL

SEQ ID NO: 885 - DNA, 2675 bp, Pleurotus ostreatus
tctcttcggcatcgtgaacttgtcatgttgacactcaaagcagaccaacgacctcttgcgaacgtaccaaatatcttccgtgtacctctatataaactggtgcgatgtcgaggtgttctaccatcggtcctaccaccaaaaagcttctacagccttggtttcgagtctgaattcttctgctaaaatgttccgcactgctgctctcaccgctttcaccctcgctgccgttgttctcggtcagcaagtcggcactttgacagccgaaaaccaccccgcgctctccatccagcagtgcacagccagtggctgcaccacccaacaaaaatcggtcgtcctcgactctaactggcgctggactcactccctgccagtgcacaccgtaagagtactttccttctggcctagagcttcgtcctcattcttcggtcacctagaactgctataccggaaacgcctgggacgcatctctctgcccagacccgactacctgcgccaccaactgcgccatcgacggtgctgactacagcgggacgtacggtatcaccacctccggcaacgcactcaccctccgtttcgtcactaatggcccctactcgaagaacattggctcgcgtgtctacctcttggacgatgccgaccattacaagatgttcgacctcaagaaccaggagtttacattcgacgttgacatgtccggccttccttgtggtctcaatggtgctctgtacttctccgagatgcccgctgatggaggcaaggcggctcatactagcaacaaggtaaggacgcttttctgaaagtaagatgtatcctaatacgcgatctataggccggtgccaaatacggaactggctactgtgacgcccagtgcccccacgatatcaaatggatcaatggcgaggtcggtttctcatagaccatgccgaatcagctctgacgttgtgtattccaggccaacatcctcgactggtcggcctctgcgactgacgccaatgctggcaacggaagatacggagcgtgctgcgctgagatggatatctgggaggccaactccgaggccactgcctacactcctcacgtctgccgtgacgagggtctctaccgctgctctggcaccgagtgtggtgatggcgacaaccgctatggaggagtctgcgacaaggatggctgtgacttcaactcgtaccgcatgggcgacaagaacttcctcgggcgtggcaagacgatcgacaccaccaagaagatcaccgtcgtcactcagtaagtggcatatcaccacccgtatctgactcggcgactgatcatgttgctataggttcatcacggacgacaatacgtcctctggcaaccttgttgagatccgccgtgtctacgttcaagacggcgtcacgtaccagaactcattctccaccttcccctcgttgtctcaatacaattccatctcggacgacttctgtgtcgcccagaagaccttattcggtgacaaccagtactacaacacacacggtggcacagagaagatgggtgacgccatggccaacggcatggtgctcatcatgtctctctggagtgatcacgccgcgcacatgctctggctcgactccgactacccgctcgacaagagcccatctgagcctggtgtgtctcgtggagcttgcgcgacgaccactggagaccctgatgatgttgttgcgaaccaccccaacgcgtctgtgacgttctcgaacatcaagtatggcccgatcggctccacatacggtggtagcacacctccagtctcctctggcaacacctccgcacctcctgtcacttcgacgacctcctctgggccaactacaccgactggacccactggaaccgtccccaagtggggacaatgtggcggtgagtgacgctgccgggcatcttttgatattgcattctgacgctgcactgctaggtaacggctacagcggacctactacttgcgttgctggctcgacgtgcacatacagcaatgattgtaagtcctctcccggctatcctttgtggttctccatactcatcctcctcctccagggtactcccaatgcctgtaaacagtagctatattgtagtgctagccataaatacccctcttgtattcgttcaacccagtctccatattatcgaatatctattgtcaatctgcttcatgatcatattcgaatagcaaccgtgttttgtatgaacagaagagagtacataaatccgacctggagatatctgggtcgttgttgaccatcatggaggaccaagtatgccattgagctgaaatcgattgcgggccttggcgttgtaagcagtgcgaaggaatgcggattcgcaagcgctgtgacccactgcgtcattgtctacaagttcggcgtcgatttctctttgcccttccagaggggtaattcgaattcgaaaaggaactgtgtggctgtggtcaggggcttataaggggtcccacgatgcaacatatcttgaccttgattacttaggcttgacgatgatttccacccgtgagctttttctttgaaaatgtggctcgttacttacttgtcatactccctagtttcgtttcagtcttcggcggtactcaatgagacgtcggttgcttctggcatctgagtacaccggttctatggccgactttaataaatttctgggga

SEQ ID NO: 886 - protein, 523 aa, Pleurotus ostreatus
MFRTAALTAFTLAAVVLGQQVGTLTAENHPALSIQQCTASGCTTQQKSVVLDSNWRWTHSLPVHTNCYTGNAWDASLCPDPTTCATNCAIDGADYSGTYGITTSGNALTLRFVTNGPYSKNIGSRVYLLDDADHYKMFDLKNQEFTFDVDMSGLPCGLNGALYFSEMPADGGKAAHTSNKAGAKYGTGYCDAQCPHDIKWINGEANILDWSASATDANAGNGRYGACCAEMDIWEANSEATAYTPHVCRDEGLYRCSGTECGDGDNRYGGVCDKDGCDFNSYRMGDKNFLGRGKTIDTTKKITVVTQFITDDNTSSGNLVEIRRVYVQDGVTYQNSFSTFPSLSQYNSISDDFCVAQKTLFGDNQYYNTHGGTEKMGDAMANGMVLIMSLWSDHAAHMLWLDSDYPLDKSPSEPGVSRGACATTTGDPDDVVANHPNASVTFSNIKYGPIGSTYGGSTPPVSSGNTSAPPVTSTTSSGPTTPTGPTGTVPKWGQCGGNGYSGPTTCVAGSTCTYSNDWYSQCL

SEQ ID NO: 887 - DNA, 2489 bp, Pleurotus ostreatus
ctagactcgatcattggttgtgcttcggtttgaggtttctgcagggaagagctcagatgcaacccgtctaggacatcgaataatccatacttttccgtattctcggcatagtgggtgctgcagaaagatcctatgtctgagtgtggtcaaaacttatgggccgcctaaagagtcgatcaccttgccatatttcggccaatatgctaacgttgaactttgccccgccacatccgggccctaatccgccgtagtttcaacccttggttgatattgtcttcaatgcaaggtattcaatgtacctgtggggcccgctgggccgttaacacatatgtcgatcggtgtcttctcggtcctggccgcaaggctgaattaaccaagaatggttgaacatcaaattcgaagtcattacagtccttcctactggccttaaactgactttttcttctcattgattcagaacatctcgtgttcccatgaaatcggaaccatatgaccgctagcgcgtggatgtggtcttaccatggtaccgctctgtgaccgctgcggttatggtattcaaggtagtcactgtctatatcaggtgtctaattgaaaccttgaaattcttcctcatattttccacttgtccgtcccaatgaatggacgtatgacatccacggcccatctcggtagccggctcagactttctaggttggagaacaagcttggctacttgcaaacctccaagcatttcccgcctcacggtgtataaaataccgaatgaactttgaaatcaacatcgacactagcagcaatgttcccctacatcgcccttgtttcattcagttttctgtctgttgtgcttgcgcagcaagtgggcacgttgacggcggaaacccacccgcagctcactgtccagcaatgcacgcgcggcggcagctgtacgacgcagcagcggtctgttgtgctcgacggcaactggcgttggctgcactcgaccagcggcagcaacgtaggtcgtctgtttcaatgtacacaaccacatcgctcactctctgtcaattttgtagaattgctacactggaaacacttgggacacgtctttgtgcccggacgccgcgacctgctcaaggaactgcgcgctcgacggtgcagattactccgggacatacggtatcactagctcaggtaatgcgctgacgctcaagttcgtcacccacggaccgtactcgaccaatattggctcgcgcgtgtacctcctcgccgacgacagccattaccagatgttcaacttaaagaacaaggagttcaccttcgacgtcgatgtctcccaactgccttgtggcctcaatggtgcactctacttctcccagatggacgccgatggtggtacgggaagattccccaacaacaaggtttgaatatcgcgccagcttctgtatgtcactcttaatacaaccacctcaggctggcgcgaagtacggtaccggatactgcgactctcagtgccctcatgatatcaaattcattaacggcgaggtgggcttaggttgattgatgctactcactgtttgatactgatgcactctataggccaacgtacaagggtggcagccatcccccaacgattcgaacgcaggcaaggggcaatacggctcctgctgcgcagaaatggatatctgggaggcaaactctatggcaagcgcatacacgcctcacccgtgcaccgtcaccacgcccacgcgctgccagggcaatgactgcggcgacggcgacaaccgctacggcggcgtctgcgacaaggacggctgcgacttcaactctttccgcatgggcgacaagaacttcctcggcccgggcaagaccgtgaacaccaactccaagttcaccgtcgtcacgcagttcctcacgagcgacaacacgacctcggggacgctctccgagatccggcgactatacgtgcagaatgggcgggtgatccagaattcgaaggtgaacatcccaggcatggcgtcgacgctggactcgatcaccgagtcgttctgctcgacgcagaagactgtgtttggggatacgaactcgttcgcgagcaagggcgggctcagggcgatggggaatgcgtttgacaagggcatggtgttggttttgagtatctgggacgatcacgaggcgaagatgctgtggctcgacagtaactaccctctcgacaaatctgcgtccgctccaggtgtcgcccgcggaacgtgcgcgactacgtccggggagcccaaggatgtggagtcgcagagcccgaatgcgcaagtcatcttctctaacatcaagtacggtgacatcggttcgacatacagcaactaggtggtgaaacaacagcggctttaatcggcatctccaaagcctttgggttggttaaatggtttaatgtactactctagtccggtactagtagcctcgaataacggtatatgtgctatgtatttcatgcccaaccctcttcctgatcgaggaattcg

SEQ ID NO: 888 - protein, 458 aa, Pleurotus ostreatus
MFPYIALVSFSFLSVVLAQQVGTLTAETHPQLTVQQCTRGGSCTTQQRSVVLDGNWRWLHSTSGSNNCYTGNTWDTSLCPDAATCSRNCALDGADYSGTYGITSSGNALTLKFVTHGPYSTNIGSRVYLLADDSHYQMFNLKNKEFTFDVDVSQLPCGLNGALYFSQMDADGGTGRFPNNKAGAKYGTGYCDSQCPHDIKFINGEANVQGWQPSPNDSNAGKGQYGSCCAEMDIWEANSMASAYTPHPCTVTTPTRCQGNDCGDGDNRYGGVCDKDGCDFNSFRMGDKNFLGPGKTVNTNSKFTVVTQFLTSDNTTSGTLSEIRRLYVQNGRVIQNSKVNIPGMASTLDSITESFCSTQKTVFGDTNSFASKGGLRAMGNAFDKGMVLVLSIWDDHEAKMLWLDSNYPLDKSASAPGVARGTCATTSGEPKDVESQSPNAQVIFSNIKYGDIGSTYSN

SEQ ID NO: 889 - DNA, 1359 bp, Aspergillus fumigatus
atgcatcaacgcgcgctccttttttctgctcttgctgtagccgccaatgctcagcaggtcggcactcagacaccggaaacccaccctcctctgacctggcaaaagtgtactgctgctggcagctgcagtcagcagagcggctccgttgtaattgatgccaactggcgctggctgcattcgaccaaagataccaccaactgctatactggcaacacatggaacacggagctctgccctgacaacgaatcctgcgctcaaaactgtgctttagatggtgccgattacgcgggtacatacggtgtcactacttctggatccgagcttaagctcagcttcgtcaccggtgccaacgttggctcgcgtttgtaccttatgcaggatgacgagacgtatcagcatttcaacctgctgaaccacgagttcaccttcgatgtggatgtctcgaaccttccttgcggtctgaacggtgctctgtactttgtggctatggatgccgatggtggcatgtctaaataccctagcaacaaggccggtgccaagtacggaaccggatactgtgattcccagtgccctcgggatctcaagttcatcaatggcatggccaacgtggaaggctgggagccctccagcagcgacaagaacgcaggcgtcggtggccacggatcctgctgccctgagatggacatctgggaggctaacagcatttccactgccgtgactcctcatccctgtgacgatgtctcacagaccatgtgcagcggtgatgcctgcggtggcacttactcggaaagccgctatgcaggcacttgcgatcctgatggctgtgacttcaatcctttccgcatgggcaatgagtccttctatggccctggaaagatcgttgatacgaaatccaagatgaccgtagtgacccagttcattaccgctgacggcactgacagtggtgctctttccgaaatcaagcgtctctacgtccagaacggtaaggtgattgccaactctgtctccaacgttgccggcgtgtctggtaactcgatcacctcggacttctgcacggcccagaagaaggcctttggcgatgaggatattttcgcgaagcacggcggcctcagcggcatgggcaaagccctgtcggagatggttctcataatgagcatctgggacgaccaccattctagcatgatgtggctcgacagcacctaccccactgatgctgatccctcgaagcctggcgttgcccgtggcacctgcgagcacggcgccggcgacccggagaacgtcgagtcccagcaccctgatgcctctgtgactttctccaacatcaagtttggtcccattggttcgacctacgaaggttaa

SEQ ID NO: 890 - protein, 452 aa, Aspergillus fumigatus
MHQRALLFSALAVAANAQQVGTQTPETHPPLTWQKCTAAGSCSQQSGSVVIDANWRWLHSTKDTTNCYTGNTWNTELCPDNESCAQNCALDGADYAGTYGVTTSGSELKLSFVTGANVGSRLYLMQDDETYQHFNLLNHEFTFDVDVSNLPCGLNGALYFVAMDADGGMSKYPSNKAGAKYGTGYCDSQCPRDLKFINGMANVEGWEPSSSDKNAGVGGHGSCCPEMDIWEANSISTAVTPHPCDDVSQTMCSGDACGGTYSESRYAGTCDPDGCDFNPFRMGNESFYGPGKIVDTKSKMTVVTQFITADGTDSGALSEIKRLYVQNGKVIANSVSNVAGVSGNSITSDFCTAQKKAFGDEDIFAKHGGLSGMGKALSEMVLIMSIWDDHHSSMMWLDSTYPTDADPSKPGVARGTCEHGAGDPENVESQHPDASVTFSNIKFGPIGSTYEG

SEQ ID NO: 891 - DNA, 1590 bp, Penicillium chrysogenum
atggcttccactctctccttcaagatctacaaaaatgctttgcttttggccgcctttcttggggctgcgcaggcacagcaggttggcacaagcactgccgaagttcatccatccttgacttggcaaaagtgtaccgcgggaggcagctgcacttcccaaagcggcaaggttgtcatcgattccaactggcgctgggttcacaacactggcggctacaccaattgctatactggcaatgactgggatagaactctctgcccggacgatgtcacatgtgccaccaactgcgccctggatggtgccgactacaagggcacctatggtgttaccgccagcggcagctctttgcggctgaacttcgtcactcaagcatctcaaaagaacatcggctcacgtctctacctgatggcggacgatagcaagtacgaaatgttccagctgctcaaccaggagttcaccttcgatgtcgatgtctcgaacctaccctgtggcttgaacggtgcgctgtactttgtggctatggacgaagatggtggcatggcacggtatcctaccaacaaagctggtgcgaaatacggtaccggttactgcgacgcgcaatgcccgcgcgatctcaagttcatcaacggccaggccaacgtggaaggctgggagccgtcttccagcgatgttaacggtggtactggcaattatggttcttgctgtgctgagatggatatttgggaggccaactccatctccaccgcattcacaccccatccctgcgatgacccagcccagacccggtgcactggagattcctgtggcggcacatacagcagtgaccgctatggtggtacttgtgaccccgatggatgtgatttcaacccttatcgcatgggcaaccagtccttctatggcccgagcaagatcgttgataccgaatcccctttcactgtggtgactcagtttatcaccaacgatggcacgtccaccggcaccctctcggaaatcaagcgcttctacgtgcagaatggcaaggttatcccccagtctgtgtccaccatcagcgctgtgactggcaattccatcaccgactccttctgctccgctcagaagactgcatttaaggacacggacgtattcgccaaacacggcggtatggcgggcatgggggccggtcttgcagagggcatggttctggtcatgagtctctgggatgatcacgcggccaacatgctgtggctcgacagcacctacccaaccagcgcctcttcgactactcccggtgctgctcgtggtagctgcgacatttcctctggcgagccttcagatgttgaagctaaccattcgaacgcctacgttgtctattcgaacatcaaggtcggtcctctcggctcgactttcggctcgaccgactcaggctccggcaccaccaccaccaaggtgaccaccactactgcgaccaagaccaccaccacaactggaccaagcaccaccggcgctgctcactatgcgcagtgtggtggacagaactggaccggtccaaccacttgcgccagcccatacacctgccaaaggcagggtgattactactcgcagtgcctgtag

SEQ ID NO: 892 - protein, 529 aa, Penicillium chrysogenum
MASTLSFKIYKNALLLAAFLGAAQAQQVGTSTAEVHPSLTWQKCTAGGSCTSQSGKVVIDSNWRWVHNTGGYTNCYTGNDWDRTLCPDDVTCATNCALDGADYKGTYGVTASGSSLRLNFVTQASQKNIGSRLYLMADDSKYEMFQLLNQEFTFDVDVSNLPCGLNGALYFVAMDEDGGMARYPTNKAGAKYGTGYCDAQCPRDLKFINGQANVEGWEPSSSDVNGGTGNYGSCCAEMDIWEANSISTAFTPHPCDDPAQTRCTGDSCGGTYSSDRYGGTCDPDGCDFNPYRMGNQSFYGPSKIVDTESPFTVVTQFITNDGTSTGTLSEIKRFYVQNGKVIPQSVSTISAVTGNSITDSFCSAQKTAFKDTDVFAKHGGMAGMGAGLAEGMVLVMSLWDDHAANMLWLDSTYPTSASSTTPGAARGSCDISSGEPSDVEANHSNAYVVYSNIKVGPLGSTFGSTDSGSGTTTTKVTTTTATKTTTTTGPSTTGAAHYAQCGGQNWTGPTTCASPYTCQRQGDYYSQCL

SEQ ID NO: 893 - DNA, 1673 bp, Thermoascus aurantiacus
atcgcaatgtatcagcgcgctcttctcttctctttcttcctcgccgccgcccgcgcgcacgaggccggtaccgtaaccgcagagaatcacccttccctgacctggcagcaatgctccagcggcggtagttgtaccacgcagaatggaaaagtcgttatcgatgcgaactggcgttgggtccataccacctctggatacaccaactgctacacgggcaatacgtgggacaccagtatctgtcccgacgacgtgacctgcgctcagaattgtgccttggatggagcggattacagtggcacctatggtgttacgaccagtggcaacgccctgagactgaactttgtcacccaaagctcagggaagaacattggctcgcgcctgtacctgctgcaggacgacaccacttatcagatcttcaagctgctgggtcaggagtttaccttcgatgtcgacgtctccaatctcccttgcgggctgaacggcgccctctactttgtggccatggacgccgacggcaatttgtccaaataccctggcaacaaggcaggcgctaagtatggcactggttactgcgactctcagtgccctcgggatctcaagttcatcaacggtcaggccaacgttgaaggctggcagccgtctgccaacgacccaaatgccggcgttggtaaccacggttcctcgtgcgctgagatggatgtctgggaagccaacagcatctctactgcggtgacgcctcacccatgcgacacccccggccagaccatgtgccagggagacgactgtggtggaacctactcctccactcgatatgctggtacctgcgacactgatggctgcgacttcaatccttaccagccaggcaaccactcgttctacggccccgggaagatcgtcgacactagctccaaattcaccgtcgtcacccagttcatcaccgacgacgggacaccctccggcaccctgacggagatcaaacgcttctacgtccagaacggcaaggtgatcccccagtcggagtcgacgatcagcggcgtcaccggcaactcaatcaccaccgagtattgcacggcccagaaggcagccttcgacaacaccggcttcttcacgcacggcgggcttcagaagatcagtcaggctctggctcagggcatggtcctcgtcatgagcctgtgggacgatcacgccgccaacatgctctggctggacagcacctacccgactgatgcggacccggacacccctggcgtcgcgcgcggtacctgccccacgacctccggcgtcccggccgacgtggagtcgcagaaccccaattcatatgttatctactccaacatcaaggtcggacccatcaactcgaccttcaccgccaactaagtaagtaacgggcactctaccaccgagagcttcgtgaagatacaggggtagttgggagattgtcgtgtacaggggacatgcgatgctcaaaaatctacatcagtttgccaattgaaccatgaagaaaagggggagatcaaagaagtctgtcagaagagaggggctgtggcagcttaagccttgttgtagatcgttcagagaaaaaaaaaagtttgcgtacttattatattaggtcgatcattatccgattgactccgtgacaagaattaaaaagagtactgcttgcttgcctattt

SEQ ID NO: 894 - protein, 456 aa, Thermoascus aurantiacus
MYQRALLFSFFLAAARAHEAGTVTAENHPSLTWQQCSSGGSCTTQNGKVVIDANWRWVHTTSGYTNCYTGNTWDTSICPDDVTCAQNCALDGADYSGTYGVTTSGNALRLNFVTQSSGKNIGSRLYLLQDDTTYQIFKLLGQEFTFDVDVSNLPCGLNGALYFVAMDADGNLSKYPGNKAGAKYGTGYCDSQCPRDLKFINGQANVEGWQPSANDPNAGVGNHGSSCAEMDVWEANSISTAVTPHPCDTPGQTMCQGDDCGGTYSSTRYAGTCDTDGCDFNPYQPGNHSFYGPGKIVDTSSKFTVVTQFITDDGTPSGTLTEIKRFYVQNGKVIPQSESTISGVTGNSITTEYCTAQKAAFDNTGFFTHGGLQKISQALAQGMVLVMSLWDDHAANMLWLDSTYPTDADPDTPGVARGTCPTTSGVPADVESQNPNSYVIYSNIKVGPINSTFTAN

SEQ ID NO: 895 - DNA, 1611 bp, Aspergillus niger
atgtcttccttccaagtctaccgagcagctctgctgctctctatccttgccactgccaatgctcagcaggttggcacctacaccactgagacacatccgtctctgacctggcaaacctgcaccagcgatggcagctgcactaccaacgacggcgaggtggtcatcgacgccaattggcgttgggtgcactcaacctccagtgccaccaactgctatactggcaacgaatgggacacctcaatctgtaccgacgatgtgacctgcgccgcgaactgcgcgcttgacggtgccacttacgaggcgacctatggtgtgaccacgtccggcagcgagctgcgcctgaacttcgtcactcaaggctccagcaagaacatcgggtctcgtttgtacctcatgagcgacgacagcaactatgagctgttcaagctcctcggccaggagttcacctttgatgtcgacgtgtccaaccttccctgcggtctcaacggcgcgctctacttcgtcgccatggacgctgacggtggcacctcggagtattccggcaacaaggccggtgccaaatacggaaccggctactgcgactcgcagtgccctcgcgacctgaagttcatcaacggcgaagccaactgcgacggctgggagccgtccagcaacaacgtcaacaccggagttggcgaccacggctcctgctgcgccgagatggacgtctgggaagcgaacagcatctccaacgccttcaccgcgcacccctgcgactccgtcagccagacaatgtgcgacggtgactcctgtggtggaacttacagcgccagcggcgaccgctacagcggcacctgcgaccccgacggctgcgactacaacccctaccgtctaggcaacacggacttttacggccccggcctgaccgtcgacacgaacagccccttcaccgtcgtcacccagttcatcaccgatgacggcacctcctccggcaccttgaccgagatcaagcggttgtacgtgcagaacggcgaggtcatcgccaacggcgcctccacctactccagtgtcaacggcagctctatcacctccgctttctgtgaatcagagaagacgctgttcggcgacgagaatgtcttcgacaagcacggcggtctcgagggcatgggcgaggctatggccaagggcatggtcttggtcttgagtctttgggatgactatgccgctgacatgctctggctcgacagcgactaccccgttaactcgtcggcctcgaccccaggtgtggcccgcggtacttgtagcacggactcgggtgtcccggctacggtggaggcggagtcgcccaatgcctatgtcacctactcgaacatcaagttcgggcctattggctcgacttactccagtggatcttcttcggggtcggggtctagctccagctcgagttcgactaccactaaggccacttcgacgaccttgaagactacctcgaccaccagcagtggaagcagttcgacctcggcggcgcaggcgtatggacagtgtggtggacagggctggactggtccgaccacttgtgtgagtgggtacacttgcacgtatgagaatgcgtactactcgcagtgtttgtag

SEQ ID NO: 896 - protein, 536 aa, Aspergillus niger
MSSFQVYRAALLLSILATANAQQVGTYTTETHPSLTWQTCTSDGSCTTNDGEVVIDANWRWVHSTSSATNCYTGNEWDTSICTDDVTCAANCALDGATYEATYGVTTSGSELRLNFVTQGSSKNIGSRLYLMSDDSNYELFKLLGQEFTFDVDVSNLPCGLNGALYFVAMDADGGTSEYSGNKAGAKYGTGYCDSQCPRDLKFINGEANCDGWEPSSNNVNTGVGDHGSCCAEMDVWEANSISNAFTAHPCDSVSQTMCDGDSCGGTYSASGDRYSGTCDPDGCDYNPYRLGNTDFYGPGLTVDTNSPFTVVTQFITDDGTSSGTLTEIKRLYVQNGEVIANGASTYSSVNGSSITSAFCESEKTLFGDENVFDKHGGLEGMGEAMAKGMVLVLSLWDDYAADMLWLDSDYPVNSSASTPGVARGTCSTDSGVPATVEAESPNAYVTYSNIKFGPIGSTYSSGSSSGSGSSSSSSSTTTKATSTTLKTTSTTSSGSSSTSAAQAYGQCGGQGWTGPTTCVSGYTCTYENAYYSQCL

SEQ ID NO: 897 - DNA, 1359 bp, Aspergillus niger
atgcatcaacgtgcccttctcttctcagccctgctgacggctgttcgcgcccagcaagccggaacgctcacggaggaagtccatccttccttgacctggcagaaatgcacttctgaaggcagctgcacggaacagagtggctcagttgtcattgactcgaactggcgctggacccattctgtcaatgacagcaccaattgctacactggcaacacctgggatgcaactctctgccctgatgatgagacctgtgcgaccaactgcgccctggacggagcggactacgagtccacctacggtgtcaccactgacggtgattcattgacactgaaattcgtcactggctccaatgttggctcgcggttgtatctcatggacacgagtgacgagggataccagacgttcaacttgcttgacgcagagttcactttcgacgttgatgtgtctaacctcccatgtgggctaaacggcgcgttgtacttcactgcaatggacgccgatggtggagcctcgaaataccctgccaataaggctggagccaagtacggaacaggatactgtgactcccaatgcccccgggacctgaagttcatcgacggacaagccaacgtcgatggctgggaaccttctagcaacaatgacaacacaggtatcggcaatcacggttcttgctgccctgaaatggatatctgggaggcaaacaagatctcgaccgcattgacaccccatccctgtgacagcagcgaacagaccatgtgtgagggtaacgactgcggtggaacctactcggatgatcgctacggaggaacctgcgaccctgacggctgcgacttcaacccttatcgcatgggcaacgactctttctacggtcctggcaagaccatcgacaccggatccaagatgacggttgtgacccagttcatcactgatggctctggctccctcagcgagatcaagcgttactacgtgcagaacggaaatgtcatagcgaacgctgattccaacatctctggagtgactggaaactcgatcacaacggacttctgcactgcgcagaagaaggcctttggcgacgacgatatattcgctgagcacaatggacttgctggaatcagtgatgccatgtcttccatggttctcatcttgagcttgtgggatgattactatgccagcatggagtggctcgacagcgactatcccgagaacgctaccgctaccgacccaggtgttgcacgcggaacatgcgactcggaatcaggcgtccctgcgacagtcgagggggcgcatcccgattcttcggtgaccttctcaaacatcaagttcggacccatcaactcgaccttcagcgcttccgcataa

SEQ ID NO: 898 - protein, 452 aa, Aspergillus niger
MHQRALLFSALLTAVRAQQAGTLTEEVHPSLTWQKCTSEGSCTEQSGSVVIDSNWRWTHSVNDSTNCYTGNTWDATLCPDDETCATNCALDGADYESTYGVTTDGDSLTLKFVTGSNVGSRLYLMDTSDEGYQTFNLLDAEFTFDVDVSNLPCGLNGALYFTAMDADGGASKYPANKAGAKYGTGYCDSQCPRDLKFIDGQANVDGWEPSSNNDNTGIGNHGSCCPEMDIWEANKISTALTPHPCDSSEQTMCEGNDCGGTYSDDRYGGTCDPDGCDFNPYRMGNDSFYGPGKTIDTGSKMTVVTQFITDGSGSLSEIKRYYVQNGNVIANADSNISGVTGNSITTDFCTAQKKAFGDDDIFAEHNGLAGISDAMSSMVLILSLWDDYYASMEWLDSDYPENATATDPGVARGTCDSESGVPATVEGAHPDSSVTFSNIKFGPINSTFSASA

SEQ ID NO: 899 - DNA, 1416 bp, Trichoderma viride
atgattgtcggcattctcaccacgctggctacgctggccacactcgcagctagtgtgcctctagaggagcggcaagcttgctcaagcgtctggggccaatgtggtggccagaattggtcgggtccgacttgctgtgcttccggaagcacatgcgtctactccaacgactattactcccagtgtcttcccggcgctgcaagctcaagctcgtccacgcgcgccgcgtcgacgacttctcgagtatcccccacaacatcccggtcgagctccgcgacgcctccacctggttctactactaccagagtacctccagtcggatcgggaaccgctacgtattcaggcaacccttttgttggggtcactccttgggccaatgcatattacgcctctgaagttagcagcctcgctattcctagcttgactggagccatggccactgctgcagcagctgtcgcaaaggttccctcttttatgtggctagatactcttgacaagacccctctcatggagcaaaccttggccgacatccgcaccgccaacaagaatggcggtaactatgccggacagtttgtggtgtatgacttgccggatcgcgattgcgctgcccttgcctcgaatggcgaatactctattgccgatggtggcgtcgccaaatataagaactatatcgacaccattcgtcaaattgtcgtggaatattccgatatccggaccctcctggttattgagcctgactctcttgccaacctggtgaccaacctcggtactccaaagtgtgccaatgctcagtcagcctaccttgagtgcatcaactacgccgtcacacagctgaaccttccaaatgttgcgatgtatttggacgctggccatgcaggatggcttggctggccggcaaaccaagacccggccgctcagctatttgcaaatgtttacaagaatgcatcgtctccgagagctcttcgcggattggcaaccaatgtcgccaactacaacgggtggaacattaccagccccccatcgtacacgcaaggcaacgctgtctacaacgagaagctgtacatccacgctattggacctcttcttgccaatcacggctggtccaacgccttcttcatcactgatcaaggtcgatcgggaaagcagcctaccggacagcaacagtggggagactggtgcaatgtgatcggcaccggatttggtattcgcccatccgcaaacactggggactcgttgctggattcgtttgtctgggtcaagccaggcggcgagtgtgacggcaccagcgacagcagtgcgccacgatttgactcccactgtgcgctcccagatgccttgcaaccggcgcctcaagctggtgcttggttccaagcctactttgtgcagcttctcacaaacgcaaacccatcgttcctgtaa

SEQ ID NO: 900 - protein, 471 aa, Trichoderma viride
MIVGILTTLATLATLAASVPLEERQACSSVWGQCGGQNWSGPTCCASGSTCVYSNDYYSQCLPGAASSSSSTRAASTTSRVSPTTSRSSSATPPPGSTTTRVPPVGSGTATYSGNPFVGVTPWANAYYASEVSSLAIPSLTGAMATAAAAVAKVPSFMWLDTLDKTPLMEQTLADIRTANKNGGNYAGQFVVYDLPDRDCAALASNGEYSIADGGVAKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEKLYIHAIGPLLANHGWSNAFFITDQGRSGKQPTGQQQWGDWCNVIGTGFGIRPSANTGDSLLDSFVWVKPGGECDGTSDSSAPRFDSHCALPDALQPAPQAGAWFQAYFVQLLTNANPSFL

SEQ ID NO: 901 - DNA, 1758 bp, Chaetomium thermophilum
gcgagcacaccaggcacacacggtcggtttgtctagagtctcacggttcatcttctggtctcacatccctctcactcaaaatgcagatcaagcagtacctccagtacctggcggcggctctgccgctcgtcaacatggctgctgcccagcgggccggcactcagcagaccgagactcatccccgtttgagctggaagcgctgctcgtcaggcggcaactgccaaacagtcaacgccgagatcgtcatcgatgcaaattggcggtggctgcacgactccaactaccagaactgctatgacggcaaccgctggaccagcgcgtgcagctcggcgaccgactgcgcgcagaagtgctacctggagggcgccaactacggcagcacgtacggtgtctcgaccagcggcgatgccttgacgctcaagttcgtcaccaagcacgagtacggaaccaacatcggctcgcgtgtgtacctcatgaatggctcggacaagtatcagatgttcacgctgatgaacaacgagttcgccttcgacgtcgacctgagcaaggtcgagtgcggtctcaacagcgccctgtactttgtcgccatggaggaggacggcggcatgcgcagttactcgtccaacaaggccggcgccaagtacggcacaggcgtaagtgccccgaactttctttctttctttcaggatgctgacttgtccagtactgtgatgcccaatgcgctcgtgacctcaagttcgtgggcggcaaggccaacatcgagggctggcgcccgtcgaccaacgatgctaacgccggtgttggtccgtacggcgcctgctgcgctgagatcgacgtctggtgagtcagagaagacaaggggggaaaaatgtagctgaccaggcagggagtcaaacgcctatgccttcgccttcaccccccacggttgcctcaacaacaactaccacgtttgcgaaacctccaactgcggtggtacatattcggaggaccgcttcggcggcctctgcgacgcaaacggctgcgactacaacccgtaccgcatgggcaacaaggacttctacggcaagggcaagacggtcgacaccagccgcaagtttactgtcgtcacgcgcttcgaggagaacaagctcacgcagttcttcatccaagacggccgcaagatcgacatcccgccgccgacctggcccggcctgcccaacagcagcgccatcacccccgagctgtgcaccaacctctccaaggtcttcgacgaccgcgaccgctacgaggagacgggcggcttccgcaccatcaacgaggccctgcgcatccccatggtcctggttatgtccatctgggacggcgtaagcctgcttcgtcactcttctaggtaaagcagagtactgaccgactccccagcattacgccaacatgctctggctcgactcggtctacccacccgagaaggctggccagcccggcgccgagcgtggtccttgcgctcctacttctggcgtccctgccgaggtcgaagcccaattccctaatgcccaggtcatctggtccaacatccgcttcggccccatcggctcgacttaccaggtctaggcatccagttaatgacgcgtctcgcatggccaagagcaggaggttgggtgcattttcttatcggacatattcgcttcttttttttgttgtgtatagccagatccgtaccatagcaaagccgtagaaagtcaatcaagctttaagcattgatctagaaaaaaaaaaaaaaaa

SEQ ID NO: 902 - protein, 451 aa, Chaetomium thermophilum
MQIKQYLQYLAAALPLVNMAAAQRAGTQQTETHPRLSWKRCSSGGNCQTVNAEIVIDANWRWLHDSNYQNCYDGNRWTSACSSATDCAQKCYLEGANYGSTYGVSTSGDALTLKFVTKHEYGTNIGSRVYLMNGSDKYQMFTLMNNEFAFDVDLSKVECGLNSALYFVAMEEDGGMRSYSSNKAGAKYGTGYCDAQCARDLKFVGGKANIEGWRPSTNDANAGVGPYGACCAEIDVWESNAYAFAFTPHGCLNNNYHVCETSNCGGTYSEDRFGGLCDANGCDYNPYRMGNKDFYGKGKTVDTSRKFTVVTRFEENKLTQFFIQDGRKIDIPPPTWPGLPNSSAITPELCTNLSKVFDDRDRYEETGGFRTINEALRIPMVLVMSIWDGHYANMLWLDSVYPPEKAGQPGAERGPCAPTSGVPAEVEAQFPNAQVIWSNIRFGPIGSTYQV

SEQ ID NO: 903 - DNA, 3297 bp, Hypocrea koningii/Trichoderma konin
gacattcaaggagtatttagccagggatgcttgagtgtatcgtgtaaggaggtttgtctgccgatacgacgaatactgtatagtcacttctgatgaagtggtccatattgaaatgtaagtcggcactgaacaggcaaaagattgagttgaaactgcctaagatctcgggccctcgggccttcggcctttgggtgtacatgtttgtgctccgggcaaatgcaaagtgtggtaggatcgaacacactgctgcctttaccaagcagctgagggtatgtgataggcaaatgttcaggggccactgcatggtttcgaatagaaagagaagcttagccaagaacaatagccgataaagatagcctcattaaacggaatgagctagtaggcaaagtcagcgaatgtgtatatataaaggttcgaggtccgtgcctccctcatgctctccccatctactcatcaactcagatcctccaggagacttgtacaccatcttttgaggcacagaaacccaatagtcaaccgcggactggcatcatgtatcggaagttggccgtcatctcggccttcttggccacagctcgtgctcagtcggcctgcactctccaatcggagactcacccgcctctgacatggcagaaatgctcgtctggtggcacgtgcactcaacagacaggctccgtggtcatcgacgccaactggcgctggactcacgctacgaacagcagcacgaactgctacgatggcaacacttggagctcgaccctatgtcctgacaacgagacctgcgcgaagaactgctgtctggacggtgccgcctacgcgtccacgtacggagttaccacgagcggtaacagcctctccattggctttgtcacccagtctgcgcagaagaacgttggcgctcgcctttaccttatggcgagcgacacgacctaccaggaattcaccctgcttggcaacgagttctctttcgatgttgatgtttcgcagctgccgtaagtgacttaccatgaacccctgacgctatcttcttgttggctcccagctgactggccaattcaaggtgcggcttgaacggagctctctacttcgtgtccatggacgcggatggtggcgtgagcaagtatcccaccaacaccgctggcgccaagtacggcacggggtactgtgacagccagtgtccccgcgatctgaagttcatcaatggccaggccaacgttgagggctgggagccgtcatccaacaacgcgaacacgggcattggaggacacggaagctgctgctctgagatggatatctgggaggccaactccatctccgaggctcttaccccccacccttgcacgactgtcggccaggagatctgcgagggtgatgggtgcggcggaacttactccgataacagatatggcggcacttgcgatcccgatggctgcgactggaacccataccgcctgggcaacaccagcttctacggccctggctcaagctttaccctcgataccaccaagaaattgaccgttgtcacccagttcgagacgtcgggtgccatcaaccgatactatgtccagaatggcgtcactttccagcagcccaacgccgagcttggtagttactctggcaacgagctcaacgatgattactgcacagctgaggaggcagaattcggcggatcctctttctcagacaagggcggcctgactcagttcaagaaggctacctctggcggcatggttctggtcatgagtctgtgggatgatgtgagtttgatggacaaacatgcgcgttgacaaagagtcaagcagctgactgagatgttacagtactacgccaacatgctgtggctggactccacctacccgacaaacgagacctcctccacacccggtgccgtgcgcggaagctgctccaccagctccggtgtccctgctcaggtcgaatctcagtctcccaacgccaaggtcaccttctccaacatcaagttcggacccattggcagcaccggcaaccctagcggcggcaaccctcccggcggaaaccgtggcaccaccaccacccgccgcccagccactaccactggaagctctcccggacctacccagtctcactacggccagtgcggcggtattggctacagcggccccacggtctgcgccagcggcacaacttgccaggtcctgaacccttactactctcagtgcctgtaaagctccgtgcgaaagcctgacgcaccggtagattcttggtgagcccgtatcatgacggcggcgggagctacatggccccgggtgatttattttttttgtatctacttctgacccttttcaaatatacggtcaactcatctttcactggagatgcggcctgcttggtattgcgatgttgtcagcttggcaaattgtggctttcgaaaacacaaaacgattccttagtagccatgcattttaagataacggaatagaagaaagaggaaattaaaaaaaaaaaaaaaacaaacatcccgttcataacccgtagaatcgccgctcttcgtgtatcccagtaccacggcaaaggtatttcatgatcgttcaatgttgatattgttcccgccagtatggctccaccccccatctccgcgaatctcctcttctcgaacgcggtgtggcgcgccaattggtaatgaccccatagggagacaaacagcataatagcaacagtggaaattagtggcgcaataattgagaacacagtgagaccatagctggcggcctggaaagcactgttggagaccaacttgtccgttgcgaggccaacttgcattgctgtcaagacgatgacaacgtagccgaggaccgtcacaagggacgcaaagttgtcgcggatgaggtctccgtagatggcatagccggcaatccgagagtagcctctcaacaggtggccttttcgaaaccggtaaaccttgttcagacgtcctagccgcagctcaccgtaccagtatcgaggattgacggcagaatagcagtggctctccaggatttgactggacaaaatcttccagtattcccaggtcacagtgtctggcagaagtcccttctcgcgtgcgagtcgaaagtcgctatagtgcgcaatgagagcacagtaggagaataggaacccgcgagcacattgttcaatctccacatgaattggatgactgctgggcagaatgtgctgcctccaaaatcctgcgtccaacagatactctggcaggggcttcagatgaatgcctctgggcccccagataagatgcagctctggattctcggttacgatgatatc

SEQ ID NO: 904 - protein, 513 aa, Hypocrea koningii/Trichoderma konin
MYRKLAVISAFLATARAQSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNRGTTTTRRPATTTGSSPGPTQSHYGQCGGIGYSGPTVCASGTTCQVLNPYYSQCL

SEQ ID NO: 905 - DNA, 1762 bp, Phanerochaete chrysosporium
cttcacaaggttacccggtctactttgtccccatgttccgcgccgccgcactcctcgctttcacttgtctcgccatggtgtctggccaacaggctggcaccaacacggcggagaaccacccccagctccagtcgcagcagtgcacgacgagcggcggctgcaagccgctgagcacgaaggtcgtcctcgactcgaactggcgctgggtccacagcacctcgggctacaccaactgctacaccggcaacgagtgggacacctcgctctgccccgacggcaagacatgcgccgcgaactgcgcgctcgacggtgcggactactctggcacctacggtatcacctccaccggcaccgcgctcacgctcaagttcgtcacgggctccaatgtcggctcccgcgtctacctcatggcggatgatacgcactaccagctgctcaagctcctgaaccaggagttcacctttgacgtcgacatgtccaacctcccctgcggtctcaacggcgcgctctacctctccgcgatggacgccgacggtggcatgtcgaagtaccccggaaacaaggctggtgccaagtacggaactggttactgcgactcgcagtgcccgaaggacatcaagttcattaacggcgaggctaatgtcggcaactggaccgagaccggcagcaacaccggtacgggcagctacggtacctgctgcagcgagatggacatatgggaggccaacaacgatgccgctgctttcactccccacccttgcaccaccaccggtcagacccgttgctctggggatgactgcgcgcgtaacaccggtctttgcgacggtgacggctgcgatttcaactcgttccgcatgggtgacaagaccttcctcggcaaggggatgaccgtcgacacctccaagcccttcaccgtcgtcacccagttcctgaccaacgacaacacctccaccggcacgctctctgagatccgccgcatctacattcagaacggcaaggtcatccagaactcggtcgcgaacatccccggtgtcgaccccgtcaacagcatcaccgacaacttctgcgcgcagcagaagaccgcgttcggcgacaccaactggttcgcgcagaagggcggcctgaagcagatgggcgaggccctcggcaacggcatggtcctcgctctctcgatctgggacgaccacgccgcgaacatgctctggctcgactccgactacccgaccgacaaagacccgtccgcccccggtgtcgcgcgcggcacgtgcgcgaccacctcgggtgtcccctccgacgtcgagtcccaggtgcccaactcccaggtcgtcttctccaacatcaagttcggcgacatcggcagcaccttcagcggcacctcctcccccaacccgccaggcggctccaccacctcctcgcccgtcaccaccagccctacgcccccgcccacaggcccgaccgtccctcagtggggtcagtgcggtggtattggctactctggctctactacctgcgccagcccgtacacttgccacgtccttaacccttgtgagtcgattctttctcttcagagaagcagcaatgctgaccaatacttgcagactactcgcagtgctactaagaggcgcttggacactgcattgcagcctcgaaaatagcagactgtagtctgctcgcccggagtgtctttagctaacggtagatgtccggtctatgtaacattatctagcgatccgtgaaatgcacacatactcgaggagaaaaa

SEQ ID NO: 906 - protein, 540 aa, Phanerochaete chrysosporium
MFRAAALLAFTCLAMVSGQQAGTNTAENHPQLQSQQCTTSGGCKPLSTKVVLDSNWRWVHSTSGYTNCYTGNEWDTSLCPDGKTCAANCALDGADYSGTYGITSTGTALTLKFVTGSNVGSRVYLMADDTHYQLLKLLNQEFTFDVDMSNLPCGLNGALYLSAMDADGGMSKYPGNKAGAKYGTGYCDSQCPKDIKFINGEANVGNWTETGSNTGTGSYGTCCSEMDIWEANNDAAAFTPHPCTTTGQTRCSGDDCARNTGLCDGDGCDFNSFRMGDKTFLGKGMTVDTSKPFTVVTQFLTNDNTSTGTLSEIRRIYIQNGKVIQNSVANIPGVDPVNSITDNFCAQQKTAFGDTNWFAQKGGLKQMGEALGNGMVLALSIWDDHAANMLWLDSDYPTDKDPSAPGVARGTCATTSGVPSDVESQVPNSQVVFSNIKFGDIGSTFSGTSSPNPPGGSTTSSPVTTSPTPPPTGPTVPQWGQCGGIGYSGSTTCASPYTCHVLNPCESILSLQRSSNADQYLQTTRSATKRRLDTALQPRK

SEQ ID NO: 907 - protein, 510 aa, Phanerochaete chrysosporium
MFRAAALLAFTCLAMVSGQQAGTNTAENHPQLQSQQCTTSGGCKPLSTKVVLDSNWRWVHSTSGYTNCYTGNEWDTSLCPDGKTCAANCALDGADYSGTYGITSTGTALTLKFVTGSNVGSRVYLMADDTHYQLLKLLNQEFTFDVDMSNLPCGLNGALYLSAMDADGGMSKYPGNKAGAKYGTGYCDSQCPKDIKFINGEANVGNWTETGSNTGTGSYGTCCSEMDIWEANNDAAAFTPHPCTTTGQTRCSGDDCARNTGLCDGDGCDFNSFRMGDKTFLGKGMTVDTSKPFTVVTQFLTNDNTSTGTLSEIRRIYIQNGKVIQNSVANIPGVDPVNSITDNFCAQQKTAFGDTNWFAQKGGLKQMGEALGNGMVLALSIWDDHAANMLWLDSDYPTDKDPSAPGVARGTCATTSGVPSDVESQVPNSQVVFSNIKFGDIGSTFSGTSSPNPPGGSTTSSPVTTSPTPPPTGPTVPQWGQCGGIGYSGSTTCASPYTCHVLNPYYSQCY

SEQ ID NO: 908 - DNA, 2085 bp, Phanerochaete chrysosporium
cgaggcgagcacggtcatgagcaccatggataaacattccattaagtgcgaactgcgcccggccgcctcgaaattgtcggggcaagtactcggtgcagccgctgcaattgtccgtcttggctcatgggaccaccttcatcgcgacggcgagacacagagtaaagccgtgatggtcgaacagaccgcttgagggagtgagtataaaggctgcatccacagcgctgctaatgaccaggtcgctccaagcatccttcacaaggttacccggtctactgtacgcacttcgactcagagttggaatctagaactaacgacttgccttgcagttgtccccatgttccgcgccgccgcactcctcgcattcacttgtctcgccatggtgtctggccaacaggctggcaccaacacggcagagaaccatccccagctccagtcgcagcagtgcacgacaagcggcggctgcaagccgctgagcaccaaggtcgtcctcgactcgaactggcgctgggtccacagcacttccggctacaccaactgctacaccggcaacgagtggaacacctcgctctgccccgacggcaagacatgcgccgcgaactgcgcgctcgacggtgcggactactctggcacctacggtatcacctccactggcaccgcgctcacgctcaagttcgtcacgggctccaatgtcggctcccgcgtctacctcatggcggatgatacgcactaccagctgcttaagctcctgaaccaggagttcacctttgacgtcgacatgtccaacctcccctgcggtctcaacggcgcgctctacctctccgcgatggacgccgacggtggcatgtcgaagtaccccggaaacaaggctggtgccaagtacggaactggttactgcgactcgcagtgcccgaaggacatcaagttcattaacggcgaggtgagctctcactataccacgacgagaagtcaagagctgacaccgttctgctaggctaatgtcggcaactggaccgagaccggcagcaacaccggtacgggcagctacggtacctgctgcagcgagatggacatttgggaggccaacaacgatgccgctgctttcactccccacccttgcaccaccaccggtcagacccgttgctctggggatgactgcgcgcgtaacaccggtctttgcgaccatggtgacggctgcgatttcaactcgttccgcatgggtgacaagaccttcctcggcaaggggatgactgtcgacacctccaagcccttcaccgacgtcacccagttcctgaccaacgacaacacctccaccggcacgctctctgagatccgccgcatctacattcagaacggcaaggtcatccagaactcggtcgcgaacatccccggagtcgaccccgtcaacagcatcacggacaacttctgcgcacagcagaagaccgcgttcggcgacaccaactggttcgcgcagaagggcggcctgaagcagatgggcgaggccctcggcaacggcatggtcctcgctctctcgatctgggacgaccacgccgcgaacatgctctggctcgactccgactacccgaccgacaaggacccgtccgcccccggtgtcgcgcgcggcacgtgcgcgaccacctcgggtgtcccctccgacgtcgagtcccaggtgcccaactcccaggtcgtcttctccaacatcaagttcggcgacatcggcagcaccttcagcggcacctcctcccccaacccgccaggcggctccaccacctcctcgcccgtcaccaccagccctacgcccccgcccacaggcccgaccgtccctcagtggggtcagtgcggtggtattggctactctggctctactacctgcgccagcccgtacacttgccacgtccttaacccttgtgagtcgattctttctcttcagagaagcagcaatgctgaccaatacttgcagactactcgcagtgctactaagaggcgcttggacattgcagcctcgaaaatagcagactgtagtctgctcgcccggagtgtctttcactaacggtagatgtccggtctatgtaacattatctagcgatc

SEQ ID NO: 909 - protein, 511 aa, Phanerochaete chrysosporium
MFRAAALLAFTCLAMVSGQQAGTNTAENHPQLQSQQCTTSGGCKPLSTKVVLDSNWRWVHSTSGYTNCYTGNEWNTSLCPDGKTCAANCALDGADYSGTYGITSTGTALTLKFVTGSNVGSRVYLMADDTHYQLLKLLNQEFTFDVDMSNLPCGLNGALYLSAMDADGGMSKYPGNKAGAKYGTGYCDSQCPKDIKFINGEANVGNWTETGSNTGTGSYGTCCSEMDIWEANNDAAAFTPHPCTTTGQTRCSGDDCARNTGLCDHGDGCDFNSFRMGDKTFLGKGMTVDTSKPFTDVTQFLTNDNTSTGTLSEIRRIYIQNGKVIQNSVANIPGVDPVNSITDNFCAQQKTAFGDTNWFAQKGGLKQMGEALGNGMVLALSIWDDHAANMLWLDSDYPTDKDPSAPGVARGTCATTSGVPSDVESQVPNSQVVFSNIKFGDIGSTFSGTSSPNPPGGSTTSSPVTTSPTPPPTGPTVPQWGQCGGIGYSGSTTCASPYTCHVLNPYYSQCY

SEQ ID NO: 910 - DNA, 2330 bp, Trichoderma viride
ctaatctcggctcggccttaatctacaggtcgatttggttatatgggcatttttggtgtggtagcattgaggaaccactgcttttgccaggagctagcgtatgctgtaggcaaagctctaggtgccactgcatttgtgtcgaacataatgtgatgcttgggcaggcataatagccgccaaagatagcctcattgagcggaagtcggcgaacagtgaagagcagaatatcacatatatatatggcccaaacgccgtgtccccttctccctttccccatctactcatcaactcagatcctccagaagacttgtacatcatcttttggggcatagcattctagtcgactacggactgcgcatcatgtatcaaaagttggccctcatctcggccttcttggctactgctcgtgctcagtcggcctgcaccctccaggcggaaactcacccgcctctgacatggcagaaatgctcatctggtggcacttgcacccaacagacaggctccgtggtcatcgacgcgaactggcgctggactcacgccaccaacagcagcacgaactgctacgacggcaatacttggagctcaaccctgtgccctgacaatgagacttgcgcgaagaactgctgcttggacggtgctgcctacgcgtccacgtacggagtcaccacgagcgctgacagcctctccattggcttcgtcactcagtctgcgcaaaagaacgtcggcgctcgtctctacttgatggcgagtgacacgacctatcaagaattcaccctgcttggcaacgagttctctttcgatgttgatgtttcgcagctgccgtaagtgaccaactacactcttgatgccattctcgtattgattctcagctgactagcttatttaagatgtggcttgaacggagctctttacttcgtgtccatggacgcggatggtggcgtgacgaagtatcccaccaacactgccggtgccaagtacggcacgggctactgtgacagccagtgccctcgtgatctcaagttcatcaacggccaggccaatgttgagggctgggagccgtcctctaacaatgcaaacacgggcattggcggacatggaagctgctgctctgagatggatatctgggaggccaattccatctctgaggctcttactcctcatccttgcacgaccgtcgggcaggaaatttgcgagggtgactcttgcggtggaacctactcgggtgaccgatatggcggtacttgcgaccctgatggctgcgattggaacccatatcgcttgggcaacaccagcttctatggccccggctccagcttcacgcttgacaccaccaagaagttgaccgtcgtcactcagttcgagacttcgggtgccatcaaccgatactatgtccagaatggcgtcactttccagcagcccaacgccgagctcggtgattactctggcaactcgctcgacgatgactactgcgcggctgaagaggcggagtttggcggctcctctttctcggacaagggcggccttactcaattcaagaaggctacttccggtggcatggtcctggtcatgagcctgtgggatgacgtgagtttcaagaattaacattcacattgtcaacagaatgactagactgatggagagacgatagtactacgccaacatgctgtggctggactctacctacccgacggacgagacctcctccacccccggtgccgtgcgtggaagctcctccaccagctccggtgttcctgctcagctcgagtccaactctcccaacgccaaggtcgtatactccaacatcaagttcggccccatcggcagcaccggcaaccctagcggcggaaaccctcctggcggaaaccctcccggcaccacaacaccgcgcccggctacctccactggaagctctcccggccctactcagacgcactatggccagtgcggtggaattgggtacatcgggcccaccgtctgcgcgagtggcagcacttgccaggtcctgaacccctactactctcagtgcttgtaaggtactgtggcaactcgacatacgtaggtcgaaagcttgaggatctgctggcttatggatgagttcatctcattatggactagatggaggatttactttgctgtatctacttctgaggcttccaatatatacggttatttcacctttgctggaatgctcgctagcttggcaagcacggctttcgagagagacggactgattctctgctaactatgcattatataagactgaaatagaccaaaaaaggaaaaggttccccactcgaattatctgacggtgttgatttatatgtaggcca

SEQ ID NO: 911 - protein, 513 aa, Trichoderma viride
MYQKLALISAFLATARAQSACTLQAETHPPLTWQKCSSGGTCTQQTGSVVIDANWRWTHATNSSTNCYDGNTWSSTLCPDNETCAKNCCLDGAAYASTYGVTTSADSLSIGFVTQSAQKNVGARLYLMASDTTYQEFTLLGNEFSFDVDVSQLPCGLNGALYFVSMDADGGVTKYPTNTAGAKYGTGYCDSQCPRDLKFINGQANVEGWEPSSNNANTGIGGHGSCCSEMDIWEANSISEALTPHPCTTVGQEICEGDSCGGTYSGDRYGGTCDPDGCDWNPYRLGNTSFYGPGSSFTLDTTKKLTVVTQFETSGAINRYYVQNGVTFQQPNAELGDYSGNSLDDDYCAAEEAEFGGSSFSDKGGLTQFKKATSGGMVLVMSLWDDYYANMLWLDSTYPTDETSSTPGAVRGSSSTSSGVPAQLESNSPNAKVVYSNIKFGPIGSTGNPSGGNPPGGNPPGTTTPRPATSTGSSPGPTQTHYGQCGGIGYIGPTVCASGSTCQVLNPYYSQCL

SEQ ID NO: 912 - DNA, 4468 bp, Phanerochaete chrysosporium
gctcagtgtcgttgtgcaatcttcttccccacgtccaggatgtttccgataggcaagtgtacggtgagcactcgccgttgcgtgctgtcggcgatggtagtcacgccccccactctggacatctcagccgttttctgtgacatcgccagtcaagtgcatgacactgtcgatctgctccgagtctcatcgtcgagcggtctgacgttgcaaacagtcgcaatactcgaaactttcaggttggttggctatataagctgtaagaccggccaacatgggataccagtatcgttttgcgcaggtgagtggctcttgtggaatatcccgtattcgccggggctcatcttaacgcagttacggtgaggacctctgtgactgcgacagtgtgaaaccgctacacattttaaatgggtaagattgtgatttctactacagcgagtctaagctgaaggctttacagtcgatatacagattgcaactttccttttgttgggcgtcgtcggcgtggccgcccagcaggtcggaacctatattcctgagaaccatccgcttctggcgacgcagagctgtacagcaagcggcggctgcactacttcgagcagtaagatcgtactagacgctaaccggcgctggatccactcgacccttggcacgaccagttgtttgactgcaaacggctgggacccgacactctgtccggacggcatcacatgtgcgaactactgcgccctggacggggtcagctatagcagcacgtacggtatcacgaccagcggctcggcgctccgcctacaatttgtaacgggcacgaacattggttcgcgcgttttcctcatggcagacgacacacactaccgtacattccagctcctgaaccaggagctcgccttcgacgtcgatgtgtcgaaacttccctgtggtctcaacggcgccttgtactttgtggctatggacgctgatggcggcaagtctaagtacccaggaaatcgtgccggagccaagtacggcactggatactgcgactcacagtgtccaagggatgtccagttcatcaacggacaggtgagcacagtttgatgtctcaagcacccccagtcgctcatcagtttgtcaggccaatgttcaaggttggaatgccaccagtgctaccacgggtacgggatcctacggcagctgttgcaccgagttggatatttgggaggcaaacagcaatgctgccgcgctcactccgcatacctgcacgaacaacgcacagacgcgttgctctggtagcaattgcacctccaacacgggcttttgcgacgccgacggctgcgacttcaactccttccgcctaggaaacaccaccttcctcggcgcaggcatgtccgtcgacacgacgaagaccttcaccgttgtcacccagttcatcaccagcgacaatacctccacagggaacctcaccgagatccgccgcttctacgtccagaacggcaacgtcatcccgaactccgtcgtcaacgttacaggcatcggcgctgttaactccatcacagaccccttctgctcgcagcagaagaaggcgttcatcgagacgaactactttgcgcagcacggcggccttgcacagcttgggcaggcgctgcgcactggcatggtgctcgcgttctcgatctcggacgaccccgcgaaccacatgctgtggctcgactcgaacttcccgcccagcgcgaacccggcggtgcctggcgttgcgcgcgggatgtgttccatcacctcgggaaaccccgcggatgtggggattctcaatccgtccccgtatgtctcctttttgaacatcaagtttggctctattggaacgacgttcaggcctgcgtgaatattggtgtgtaacttagattcgtggtgtgggtggttgcgatgctcatatgctcttcaggagagaaacgaagccggcttcttatgcacaatttttacggtattaattctttgcatggcaagactgcgtcgtcagcccatggtatcgaaaatatatcagacatgcgtgtacacgtgtcccggttggaagtctggatttctttcccagtacgttccactcggtgcaacgcttgtgacaaccggaacgtttttcggcgaggatcatactaactcgatatacggcagcaaaatcccgaggtcaaagcgacgctgactcgtctcccaccaatacaggcttgcgaagttataccgcttccctctgcccattggtacgagccctgctgtcatatcacagaagaccctggccgtgatagttgatcagcgatgcggaataacgcccccagctagtgagcattatttccgctactgccctgctgccttgttattgtccagaatacctcttgcgactatgtcgatgcctcacagggagcgaaatgcgcagccaacgaacagagttagatataaacgttagtccagaggatcagggccatgcagctcctctcgcttgttcacggtacgacagcacatctgagcaaaatagtctctgcctttctgacctcacttttagtgccaacaactgcactcaaggcctgaggttgagacgcgatacctatgaggaccgcgtgtatgtaactctcttcctctacgatatgcgggctttgaccgtgcctctagtagcattgatccttgcgcttgctgcattctccgcggtatccgctcagcaggcggggaccatcacggccgagacccacccgacgctcaccatccagcagtgcacacagagcggcggctgtgcgcctctcactacgaaagtcgtcctcgacgtgaactggcggtggatacattcgaccaccggctacaccaactgctacagcggcaacacctgggacgctatcttgtgccctgatccggtgacctgcgcagccaactgtgcgctcgacggcgcggactacacggggacatttggcatcctgccctcagggacctccgtgacgctgcgcccggtggatgggctgggcctacgtctgtttctgctggcggatgattctcactaccagatgttccagcttctgaacaaggagtttacctttgatgttgagatgccgaacatgcgctgcgggtctagcggcgccatccaccttactgctatggacgccgatggtggacttgcaaagtatcctgggaaccaggctggtgcgaagtatggcacaggcttctgcagtgcgcagtgtccgaaaggcgtcaagtttatcaacggccaggtgagcctttccgtaccactccggacgtaccagtgcgctcatattgcctataccctctaggcaaacgtggaaggctggcttggtaccacggccaccacgggtacagggttcttcggcagctgctgcacggacattgccctctgggaggcgaacgataattctgcatcatttgcccctcatccctgtacaacaaactcccagactcgctgctctggcagcgattgcactgcggatagtgggctgtgcgacgccgacggctgcaacttcaactccttccgcatgggcaacacaaccttcttcggcgcaggaatgtccgtggacaccaccaaactcttcactgtcgtcacccagttcatcacgagcgacaatacctcgatgggtgccctcgtcgagattcatcgcctctacatccagaacggccaggtcatccagaactctgttgtcaacattcccggtataaaccctgccacctctatcacggatgacctgtgcgcgcaagagaatgcagcgtttggaggcaccagctcgtttgcacagcacggcggcctggcgcaggtcggagaggcgctgcgctcgggcatggtcctcgcactctcgatcgtgaactccgcggcggacacgctctggctcgactcaaactacccggcggacgcggacccgtctgcgcctggtgtagcccgcggtacctgtcctcaggactctgccagcatccccgaagccccgacgccgtctgtcgtgttctcgaacatcaagctcggggatatcggcactacgtttggtgccggctctgcgctgttctctggtcgctcaccgccagggccggtcccgggatccgcacctgcatcttcagccacggcgactgctcctccattcggcagccagtgtgggggtctcggatacgcaggccctacgggagtctgccctagcccgtacacgtgtcaggctctcaatatctgtgggttgcttatgctgagaatcagaaaataaaatactgaagtctctgcacgcagactattctcagtgtatctaatgctggggtcacaagggtctcaggaccgagtctcacagctcgtctataccaagaaatacatcccagtcggcttggagtgggcctccaataacgatttgcgccatgaaccatagctggctattgagagtattcagacacatctggcaaggcgaggcgagaggatctgtatcgttacacttacagggagtaagtattggactcggagctacgtccaaggctgcgt

SEQ ID NO: 913 - protein, 449 aa, Phanerochaete chrysosporium
MVDIQIATFLLLGVVGVAAQQVGTYIPENHPLLATQSCTASGGCTTSSSKIVLDANRRWIHSTLGTTSCLTANGWDPTLCPDGITCANYCALDGVSYSSTYGITTSGSALRLQFVTGTNIGSRVFLMADDTHYRTFQLLNQELAFDVDVSKLPCGLNGALYFVAMDADGGKSKYPGNRAGAKYGTGYCDSQCPRDVQFINGQANVQGWNATSATTGTGSYGSCCTELDIWEANSNAAALTPHTCTNNAQTRCSGSNCTSNTGFCDADGCDFNSFRLGNTTFLGAGMSVDTTKTFTVVTQFITSDNTSTGNLTEIRRFYVQNGNVIPNSVVNVTGIGAVNSITDPFCSQQKKAFIETNYFAQHGGLAQLGQALRTGMVLAFSISDDPANHMLWLDSNFPPSANPAVPGVARGMCSITSGNPADVGILNPSPYVSFLNIKFGSIGTTFRPA

SEQ ID NO: 914 - protein, 504 aa, Phanerochaete chrysosporium
MRTALALILALAAFSAVSAQQAGTITAETHPTLTIQQCTQSGGCAPLTTKVVLDVNWRWIHSTTGYTNCYSGNTWDAILCPDPVTCAANCALDGADYTGTFGILPSGTSVTLRPVDGLGLRLFLLADDSHYQMFQLLNKEFTFDVEMPNMRCGSSGAIHLTAMDADGGLAKYPGNQAGAKYGTGFCSAQCPKGVKFINGQANVEGWLGTTATTGTGFFGSCCTDIALWEANDNSASFAPHPCTTNSQTRCSGSDCTADSGLCDADGCNFNSFRMGNTTFFGAGMSVDTTKLFTVVTQFITSDNTSMGALVEIHRLYIQNGQVIQNSVVNIPGINPATSITDDLCAQENAAFGGTSSFAQHGGLAQVGEALRSGMVLALSIVNSAADTLWLDSNYPADADPSAPGVARGTCPQDSASIPEAPTPSVVFSNIKLGDIGTTFGAGSALFSGRSPPGPVPGSAPASSATATAPPFGSQCGGLGYAGPTGVCPSPYTCQALNIYYSQCI

SEQ ID NO: 915 - DNA, 1607 bp, Chaetomium thermophilum
gcgagcacaccaggcacacacggtcggtttgtctagagtctcacggttcatcttctggtctcacatccctctcactcaaaatgcagatcaagcagtacctccagtacctggcggcggctctgccgctcgtcaacatggctgctgcccagcgggccggcactcagcagaccgagactcatccccgtttgagctggaagcgctgctcgtcaggcggcaactgccaaacagtcaacgccgagatcgtcatcgacgctaactggcgctggctgcacgactccaactaccagaactgctatgacggcaaccgctggaccagcgcgtgcagctcggcgaccgactgcgcgcagaagtgctacctggagggcgccaactacggcagcacgtacggtgtctcgaccagcggcgatgccttgacgctcaagttcgtcaccaagcacgagtacggaaccaacatcggctcgcgtgtgtacctcatgaatggctcggacaagtatcagatgttcacgctgatgaacaacgagttcgccttcgacgtcgacctgagcaaggtcgagtgcggtctcaacagcgccctgtactttgtcgccatggaggaggacggcggcatgcgcagttactcgtccaacaaggccggcgccaagtacggcacaggctactgtgatgcccaatgcgctcgtgacctcaagttcgtgggcggcaaggccaacatcgagggctggcgcccgtcgaccaacgatgctaacgccggtgttggtccgtacggcgcctgctgcgctgagatcgacgtctgggagtcaaacgcctatgccttcgccttcaccccccacggttgcctcaacaacaactaccacgtttgcgaaacctccaactgcggtggtacatattcggaggaccgcttcggcggcctctgcgacgcaaacggctgcgactacaacccgtaccgcatgggcaacaaggacttctacggcaagggcaagacggtcgacaccagccgcaagtttactgtcgtcacgcgcttcgaggagaacaagctcacgcagttcttcatccaagacggccgcaagatcgacatcccgccgccgacctggcccggcctgcccaacagcagcgccatcacccccgagctgtgcaccaacctctccaaggtcttcgacgaccgcgaccgctacgaggagacgggcggcttccgcaccatcaacgaggccctgcgcatccccatggtcctggtcatgtccatctgggacggccattacgccagcatgctctggctcgactcggtctacccacccgagaaggctggccagcccggcgccgagcgtggtccttgcgctcctacttctggcgtccctgccgaggtcgaagcccaattccctaatgcccaggtcatctggtccaacatccgcttcggccccatcggctcgacttaccaggtctaggcatccagttaatgacgcgtctcgcatggccaagagcaggaggttgggtgcattttcttatcggacatattcgcttcttttttttgttgtgtatagccagatccgtaccatagcaaagccgtagaaagtcaatcaagctttaagcattgatctagaaaaaaaaaaaaaaaa

SEQ ID NO: 916 - protein, 451 aa, Chaetomium thermophilum
MQIKQYLQYLAAALPLVNMAAAQRAGTQQTETHPRLSWKRCSSGGNCQTVNAEIVIDANWRWLHDSNYQNCYDGNRWTSACSSATDCAQKCYLEGANYGSTYGVSTSGDALTLKFVTKHEYGTNIGSRVYLMNGSDKYQMFTLMNNEFAFDVDLSKVECGLNSALYFVAMEEDGGMRSYSSNKAGAKYGTGYCDAQCARDLKFVGGKANIEGWRPSTNDANAGVGPYGACCAEIDVWESNAYAFAFTPHGCLNNNYHVCETSNCGGTYSEDRFGGLCDANGCDYNPYRMGNKDFYGKGKTVDTSRKFTVVTRFEENKLTQFFIQDGRKIDIPPPTWPGLPNSSAITPELCTNLSKVFDDRDRYEETGGFRTINEALRIPMVLVMSIWDGHYASMLWLDSVYPPEKAGQPGAERGPCAPTSGVPAEVEAQFPNAQVIWSNIRFGPIGSTYQV

SEQ ID NO: 917 - DNA, 1453 bp, Volvariella volvacea
tgattgcaagccacatatcccagagatgtccaggttttctgctcttactgctctccttttatctttgccactactggctattgctcagtccccgttgtatgggcaatgtggtggcaacggctggactggcccaaagacctgtgtatcaggtgcaacttgtacagtgatcaatgactggtattggcaatgcctgccaggaaatggcccaacttcttcttcaccaacttccacacctaccaccaccacaactacagggggacctcaaccaaccgtaccagcagcagggaatccttatactggatacgagatttacttgagtccttattacgctgctgaggctcaagctgcggctgcccaaatttctgatgccacgcagaaggccaaagccctgaaggtcgcacaaatccccacattcacctggtttgatgttattgcaaagacctccacactcggtgattatttggccgaagcgagcgcacttgggaaatcctctggaaagaaatacctcgttcaaatcgttgtatatgacttgccagatcgggattgcgctgctctggcttcgaatggagagtttagcatcgcaaacaatgggctcaacaactacaagggctacatcgatcaattggttgctcagatcaagaaataccctgatgtccgagtcgtggctgttattgaacccgactccttggccaatctcgttaccaatctcaatgttagcaagtgtgccaatgcacaaacagcctacaaggctggtgtcacgtacgctctccagcagctcaactctgttggcgtctatatgtacctcgatgctggacatgcgggttggctcggatggcctgccaacttgaatcccgctgcgcaactgttctctcaattgtacagagatgctggaagtccccaatatgtccgtggcctagctaccaatgttgccaactacaacgcactctctgccagcagccccgacccagtcacacaaggcaatcccaactatgacgaacttcattacatcaacgcactcgcgccagctctccaatccggtggcttccctgcccacttcattgtcgaccaaggccgatcaggagttcagaacatcagacaacaatggggcgactggtgcaacgtcaagggtgcaggctttggccagcgtccaactcttagcacaggttcatcccttatcgacgccattgtctggattaaacccggaggcgaatgcgacggtacaaccaacacatcgtcacctcgctatgattctcactgtggtctttctgatgctacacccaatgccccagaagctggccaatggttccaggcttacttcgagaccttagtccgtaacgccagcccacctctttgagtgtgcagtgtagataccagatatacaaggccccgagtgtgatacaacagaataaataatccctttttgctcctctcaaaaaaaaaaaaaaaaaaaaaa

SEQ ID NO: 918 - protein, 442 aa, Volvariella volvacea
MSRFSALTALLLSLPLLAIAQSPLYGQCGGNGWTGPKTCVSGATCTVINDWYWQCLPGNGPTSSSPTSTPTTTTTTGGPQPTVPAAGNPYTGYEIYLSPYYAAEAQAAAAQISDATQKAKALKVAQIPTFTWFDVIAKTSTLGDYLAEASALGKSSGKKYLVQIVVYDLPDRDCAALASNGEFSIANNGLNNYKGYIDQLVAQIKKYPDVRVVAVIEPDSLANLVTNLNVSKCANAQTAYKAGVTYALQQLNSVGVYMYLDAGHAGWLGWPANLNPAAQLFSQLYRDAGSPQYVRGLATNVANYNALSASSPDPVTQGNPNYDELHYINALAPALQSGGFPAHFIVDQGRSGVQNIRQQWGDWCNVKGAGFGQRPTLSTGSSLIDAIVWIKPGGECDGTTNTSSPRYDSHCGLSDATPNAPEAGQWFQAYFETLVRNASPPL

SEQ ID NO: 919 - DNA, 1710 bp, Volvariella volvacea
tgttctactcgctctctaccactagaacagaacttccccagccatgttccccaagtcctctcttctagttctttccttcctcgccacggcttacgcccaacaagttggcactcaaacagcagaggtccacccgtcgctcaactgggccagatgtacttccagcgggtgcacaaacgtcgctggctccgtcaccctcgacgccaactggcgctggttgcacaccacctccggctacaccaactgctacaccggtaacagctggaacaccaccctgtgccccgacggtgccacttgcgctcagaactgcgctcttgatggtgccaactaccaatccacctgcggtatcaccaccagcggtaacgctctcacgctcaaattcgtcactcagggtgagcagaagaacatcggatctcgcgtgtacttgatggctagcgagtcgcgctacgagatgttcggtctccttaacaaggagttcacgtttgacgtcgatgtctccaatcttccttgcggattgaacggagcattgtacttctcctctatggatgctgatggtggtatggccaagaacccgggtaacaaggccggtgccaaatatggtactggttactgcgactcccaatgtccacgagacatcaagttcatcaacggagaggccaacgtcgcaggatggaatggctctcccaatgacacgaacgcaggtaccggaaactggggagcgtgctgcaatgagatggatatctgggaagccaactcaatctccgctgcctacacccctcatccttgcacagtccaaggtctatcccgctgctctggcaccgcttgcggtaccaacgaccgctacggcaccgtctgcgatcccgacggttgcgatttcaactcgtaccgcatgggcgacaagacttattacggccccggtggaacgggcgtcgacacccgctccaagttcaccgtcgtcacccaattcctgaccaacaacaacagcagctccggcacactctccgagatccgccgtctatacgtccagaacggccgtgtcgtgcagaactccaaggtcaacatcccaggaatgagcaacactctcgactccatcaccactggattctgcgactcccagaagaccgcctttggcgataccaggagcttccagaacaagggtggcatgtcagctatgggtcaggctttaggtgcaggaatggtcttggtcctctccgtctgggacgaccacgcagcgaacatgctctggctcgacagcaactaccccgtcgatgcggacccaagtaagcccggtatcgcgcgcggtacctgctcaactacatccggcaagccgactgatgtcgagcaatccgctgccaactcctcggtcacattctccaacatcaagttcggtgatatcggcactacctacactggcggttccgtcaccactaccccgggtaacccaggcaccacgacctcgactgctcccggagctgttcagaccaagtggggtcaatgcggtggacaaggctggactgggcctactcgatgcgagtctggctccacatgtaccgtcgtcaaccaatggtacagccagtgtatctagatttagatatctgtctcttcgtcatcaattggttagaaacttggaaacgaaatgtagaatctcttgggctttctgaaattcatttctttgtttgctccgcaaaaaaaaaaaaaaaaaaaaaaaaaaaa

SEQ ID NO: 920 - protein, 512 aa, Volvariella volvacea
MFPKSSLLVLSFLATAYAQQVGTQTAEVHPSLNWARCTSSGCTNVAGSVTLDANWRWLHTTSGYTNCYTGNSWNTTLCPDGATCAQNCALDGANYQSTCGITTSGNALTLKFVTQGEQKNIGSRVYLMASESRYEMFGLLNKEFTFDVDVSNLPCGLNGALYFSSMDADGGMAKNPGNKAGAKYGTGYCDSQCPRDIKFINGEANVAGWNGSPNDTNAGTGNWGACCNEMDIWEANSISAAYTPHPCTVQGLSRCSGTACGTNDRYGTVCDPDGCDFNSYRMGDKTYYGPGGTGVDTRSKFTVVTQFLTNNNSSSGTLSEIRRLYVQNGRVVQNSKVNIPGMSNTLDSITTGFCDSQKTAFGDTRSFQNKGGMSAMGQALGAGMVLVLSVWDDHAANMLWLDSNYPVDADPSKPGIARGTCSTTSGKPTDVEQSAANSSVTFSNIKFGDIGTTYTGGSVTTTPGNPGTTTSTAPGAVQTKWGQCGGQGWTGPTRCESGSTCTVVNQWYSQCI

SEQ ID NO: 921 - DNA, 1500 bp, Trichoderma reesei
tctagagttgtgaagtcggtaatcccgctgtatagtaatacgagtcgcatctaaatactccgaagctgctgcgaacccggagaatcgagatgtgctggaaagcttctagcgagcggctaaattagcatgaaaggctatgagaaattctggagacggcttgttgaatcatggcgttccattcttcgacaagcaaagcgttccgtcgcagtagcaggcactcattcccgaaaaaactcggagattcctaagtagcgatggaaccggaataatataataggcaatacattgagttgcctcgacggttgcaatgcaggggtactgagcttggacataactgttccgtaccccacctcttctcaacctttggcgtttccctgattcagcgtacccgtacaagtcgtaatcactattaacccagactgaccggacgtgttttgcccttcatttggagaaataatgtcattgcgatgtgtaatttgcctgcttgaccgactggggctgttcgaagcccgaatgtaggattgttatccgaactctgctcgtagaggcatgttgtgaatctgtgtcgggcaggacacgcctcgaaggttcacggcaagggaaaccaccgatagcagtgtctagtagcaacctgtaaagccgcaatgcagcatcactggaaaatacaaaccaatggctaaaagtacataagttaatgcctaaaggagtcatataccagcggctaataattgtacaatcaagtggctaaacgtaccgtaatttgccaacggcttgtggggttgcagaagcaacggcaaagccccacttccccacgtttgtttcttcactcagtccaatctcagctggtgatcccccaattgggtcgcttgtttgttccggtgaagtgaaagaagacagaggtaagaatgtctgactcggagcgttttgcatacaaccaagggcagtgatggaagacagtgaaatgttgacattcaaggagtatttagccagggatgcttgagtgtatcgtgtaaggaggtttgtctgccgatacgacgaatactgtatagtcacttctgatgaagtggtccatattgaaatgtaagtcggcactgaacaggcaaaagattgagttgaaactgcctaagatctcgggccctcgggccttcggcctttgggtgtacatgtttgtgctccgggcaaatgcaaagtgtggtaggatcgaacacactgctgcctttaccaagcagctgagggtatgtgataggcaaatgttcaggggccactgcatggtttcgaatagaaagagaagcttagccaagaacaatagccgataaagatagcctcattaaacggaatgagctagtaggcaaagtcagcgaatgtgtatatataaaggttcgaggtccgtgcctccctcatgctctccccatctactcatcaactcagatcctccaggagacttgtacaccatcttttgaggcacagaaacccaatagtcaaccgcggactggcatcatg

SEQ ID NO: 922 - DNA, 1583 bp, Hypocrea koningii strain 3.2774
atgattgtcggcattctcaccacgctggctacgctggccacactggcagctagtgtgcctctagaggagcggcaagcttgctcaagcgcctggtaagatgacgatgggattccccaaagaggcatatattgacatacaccaaggggccaatgtggaggccagaactggtccggtccaacctgctgtgcttccggaagtacatgcgtctattccaacgactattactcccaatgtcttcctggcgctgcaagctcaagctcttcgacacgcgcctcgtcgacgactgcccgagcatcgtccacaacatccaggtcttccgcgacccctccccctggttcttccaccacgagagtacctccagtgggatctggaaccgctacatactcgggcaacccttttgtcggggttactccttgggccaatgcatattacgcctccgaagttagcagccttgccattcctagcctcactggagccatggccactgctgcagcagctgtcgccaaggttccctcttttatgtggctgtaggttctccagagacaaaggcactttgtgatcaaaggctcaccatttactgcagggatacttttgacaagacccctctcatggagcaaaccttggccgacatccgcactgccaataagaacggcggtaactatgctggtcagtttgtggtgtacgacctgccggatcgcgactgtgccgcccttgcttccaatggcgagtactccattgccgatggtggtgtcgacaagtataagaactacatcgacaccatccgtcagatcgtcgttgaatattccgatatccggaccctcttggtgattggtacgagttctcagtgccccccctccatctcgtcgtcatgctaaccattgttccctcttctagagcctgactctcttgccaacttggtgacaaacctcggcactccaaagtgtgcgaatgcccagtccgcctacctcgagtgcatcaactacgctgtcacgcagctgaaccttccaaacgtggcaatgtatctggacgctggtcacgcaggatggcttggctggccggcaaaccaggatccggccgctcagctgtttgcaaacgtttacaagaatgcatcgtccccgagagctcttcgcggactggcaaccaatgtcgccaactacaacggatggaacattaccagccccccatcatacactcaaggcaacgccgtctacaacgagcagctgtacatccacgctattggacctcttcttgccaaccacggctggtccaacgccttcttcatcactgaccaaggccgatctggcaagcagccgactgggcaacaacagtggggagactggtgcaatgtcatcggtaccggattcggtattcgcccctccgcaaacactggagactcgctgctggattcttttgtctggatcaagccaggcggcgagtgtgacggcaccagtgacagcagtgcgccacgatttgactcccactgtgccctacctgatgccctgcaaccggcgccccaagcaggtgcttggttccaagcctactttgtgcagctcctcacgaacgcaaacccatcgttcctgtaa

SEQ ID NO: 923 - protein, 470 aa, Hypocrea koningii strain 3.2774
MIVGILTTLATLATLAASVPLEERQACSSAWGQCGGQNWSGPTCCASGSTCVYSNDYYSQCLPGAASSSSSTRASSTTARASSTTSRSSATPPPGSSTTRVPPVGSGTATYSGNPFVGVTPWANAYYASEVSSLAIPSLTGAMATAAAAVAKVPSFMWLDTFDKTPLMEQTLADIRTANKNGGNYAGQFVVYDLPDRDCAALASNGEYSIADGGVDKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEQLYIHAIGPLLANHGWSNAFFITDQGRSGKQPTGQQQWGDWCNVIGTGFGIRPSANTGDSLLDSFVWIKPGGECDGTSDSSAPRFDSHCALPDALQPAPQAGAWFQAYFVQLLTNANPSFL

SEQ ID NO: 924 - DNA, 2220 bp, Hypocrea jecorina/Trichoderma reesei
aaggttagccaagaacaatagccgataaagatagcctcattaaacggaatgagctagtaggcaaagtcagcgaatgtgtatatataaaggttcgaggtccgtgcctccctcatgctctccccatctactcatcaactcagatcctccaggagacttgtacaccatcttttgaggcacagaaacccaatagtcaaccgcggactggcatcatgtatcggaagttggccgtcatcacggccttcttggccacagctcgtgctcagtcggcctgcactctccaatcggagactcacccgcctctgacatggcagaaatgctcgtctggtggcacttgcactcaacagacaggctccgtggtcatcgacgccaactggcgctggactcacgctacgaacagcagcacgaactgctacgatggcaacacttggagctcgaccctatgtcctgacaacgagacctgcgcgaagaactgctgtctggacggtgccgcctacgcgtccacgtacggagttaccacgagcggtaacagcctctccattggctttgtcacccagtctgcgcagaagaacgttggcgctcgcctttaccttatggcgagcgacacgacctaccaggaattcaccctgcttggcaacgagttctctttcgatgttgatgtttcgcagctgccgtaagtgacttaccatgaacccctgacgtatcttcttgtgggctcccagctgactggccaatttaaggtgcggcttgaacggagctctctacttcgtgtccatggacgcggatggtggcgtgagcaagtatcccaccaacaacgctggcgccaagtacggcacggggtactgtgacagccagtgtccccgcgatctgaagttcatcaatggccaggccaacgttgagggctgggagccgtcatccaacaacgcaaacacgggcattggaggacacggaagctgctgctctgagatggatatctgggaggccaactccatctccgaggctcttaccccccacccttgcacgactgtcggccaggagatctgcgagggtgatgggtgcggcggaacttactccgataacagatatggcggcacttgcgatcccgatggctgcgactggaacccataccgcctgggcaacaccagcttctacggccctggctcaagctttaccctcgataccaccaagaaattgaccgttgtcacccagttcgagacgtcgggtgccatcaaccgatactatgtccagaatggcgtcactttccagcagcccaacgccgagcttggtagttactctggcaacgagctcaacgatgattactgcacagctgaggagacagaattcggcggatctctttctcagacaagggcggcctgactcagttcaagaaggctacctctggcggcatggttctggtcatgagtctgtgggatgatgtgagtttgatggacaaacatgcgcgttgacaaagagtcaagcagctgactgagatgttacagtactacgccaacatgctgtggctggactccacctacccgacaaacgagacctcctccacacccggtgccgtgcgcggaagctgctccaccagctccggtgtccctgctcaggtcgaatctcagtctcccaacgccaaggtcaccttctccaacatcaagttcggacccattggcagcaccggcaaccctagcggcggcaaccctcccggcggaaaccgtggcaccaccaccacccgccgcccagccactaccactggaagctctcccggacctacccagtctcactacggccagtgcggcggtattggctacagcggccccacggtctgcgccagcggcacaacttgccaggtcctgaacccttactactctcagtgcctgtaaagctccgtgcgaaagcctgacgcaccggtagattcttggtgagcccgtatcatgacggcggcgggagctacatggccccgggtgatttattttttttgtatctacttctgacccttttcaaatatacggtcaactcatctttcactggagatgcggcctgcttggtattgcgatgttgtcagcttggcaaattgtggctttcgaaaacacaaaacgattccttagtagccatgcattttaagataacggaatagaagaaagaggaaattaaaaaaaaaaaaaaaacaaacatcccgttcataacccgtagaatcgccgctcttcgtgtatcccagtacca

SEQ ID NO: 925 - protein, 1649 aa, Gibberella zeae
ATGTATCGCGCCATCGCCACCGCCTCGGCGCTCATCGCAGCCGTTCGGGCTCAGCAAGTTTGCTCTCTCACACAGGAGAGCAAGCCCTCCCTGAACTGGTCCAAGTGTACATCCAGCGGATGCAGCAACGTCAAGGGATCCGTCACCATCGATGCCAACTGGCGATGGACTCACCAAGTATCCGGATCTACCAACTGCTACACCGGCAACAAGTGGGACACTTCCGTCTGCACCAGCGGAAAGGTCTGTGCTGAGAAGTGCTGTCTCGACGGCGCCGACTACGCCAGCACCTACGGTATCACCTCCAGCGGCGACCAGCTCAGCCTCTCGTTCGTCACCAAGGGACCCTACAGCACCAACATCGGTAGCCGTACTTACCTCATGGAGGACGAGAACACCTACCAGATGTTCCAGCTCCTGGGTAACGAGTTCACCTTTGATGTCGATGTTTCAAACATTGGATGTGGTCTGAACGGTGCTCTTTACTTCGTCAGCATGGACGCCGATGGTGGCAAGGCCAAGTACCCCGGTAACAAGGCCGGAGCCAAGTACGGTACTGGTTACTGTGATGCCCAGTGCCCTCGTGACGTTAAGTTCATCAACGGCCAGGTAAGCTTCAAACACATTTTTAACTCAGGATGAACGCTAACATGCAGTGAAGGCCAACTCTGATGGCTGGCAGCCCTCCGACAGCGATGTCAACGGTGGTATTGGTAACTTGGGCACATGCTGCCCTGAGATGGACATCTGGGAGGCCAACTCCATCTCCACTGCCTACACTCCTCACCCTTGCACTAAGCTCACTCAGCACTCTTGCACTGGCGACTCTTGCGGTGGAACCTACTCCAACGACCGTTACGGCGGAACTTGCGATGCTGACGGTTGCGATTTCAACTCCTACCGCCAGGGCAACAAGACCTTCTACGGTCCTGGATCTGGCTTCAACGTTGATACCACTAAGAAGGTCACCGTCGTCACTCAGTTCCACAAGGGCAGCAACGGACGTCTCTCTGAGATCACCCGTCTCTATGTCCAGAATGGCAAGGTCATTGCCAACTCTGAGTCCAAGATTGCTGGAGTTCCCGGAAACTCTCTTACCGCTGACTTCTGCACCAAGCAGAAGAAGGTCTTTAACGACCCCGATGACTTCACGAAGAAGGGTGCTTGGAGCGGTATGAGCGATGCTCTTGAGGCTCCCATGGTTCTTGTTATGTCTCTCTGGCACGACGTGAGTATTACCGAATTCCAAATTCATTGCATAGTATGATATACTGACTAATACACAGCACCACTCCAACATGCTCTGGCTCGACTCTACCTACCCCACTGACTCTACCAAGCTCGGCTCTCAGCGCGGATCTTGCTCTACATCCTCTGGCGTGCCTGCCGACCTTGAGAAGAACGTCCCCAACTCCAAGGTTGCCTTCTCCAACATCAAGTTCGGTCCCATCGGCAGCACCTACAAGAGCGACGGCACCACTCCCACCAACCCCACCAACCCTTCTGAGCCCAGCAACACTGCCAACCCCAACCCCGGCACCGTTGACCAGTGGGGCCAGTGCGGTGGCAGCAACTACAGCGGTCCTACCGCCTGCAAGTCTGGCTTCACCTGCAAGAAGATCAACGACTTCTACTCCCAGTGCCAGTAA

SEQ ID NO: 926 - protein, 512 aa, Gibberella zeae
MYRAIATASALIAAVRAQQVCSLTQESKPSLNWSKCTSSGCSNVKGSVTIDANWRWTHQVSGSTNCYTGNKWDTSVCTSGKVCAEKCCLDGADYASTYGITSSGDQLSLSFVTKGPYSTNIGSRTYLMEDENTYQMFQLLGNEFTFDVDVSNIGCGLNGALYFVSMDADGGKAKYPGNKAGAKYGTGYCDAQCPRDVKFINGQANSDGWQPSDSDVNGGIGNLGTCCPEMDIWEANSISTAYTPHPCTKLTQHSCTGDSCGGTYSNDRYGGTCDADGCDFNSYRQGNKTFYGPGSGFNVDTTKKVTVVTQFHKGSNGRLSEITRLYVQNGKVIANSESKIAGVPGNSLTADFCTKQKKVFNDPDDFTKKGAWSGMSDALEAPMVLVMSLWHDHHSNMLWLDSTYPTDSTKLGSQRGSCSTSSGVPADLEKNVPNSKVAFSNIKFGPIGSTYKSDGTTPTNPTNPSEPSNTANPNPGTVDQWGQCGGSNYSGPTACKSGFTCKKINDFYSQCQ

SEQ ID NO: 927 - DNA, 1630 bp, Fusarium venenatum
atgtatcgcgccatcgccaccgcctcagcgctcattgcagccgttcgagctcagcaagtttgctctctcacccccgagaccaagcctgccttgtcctggtccaagtgtacatctagcggatgcagcaacgttcagggatctgtcaccatcgatgccaactggcgatggactcaccaattgtccggatctaccaactgctacaccggtaacaagtgggacacttccatctgcaccagtggaaaggtttgtgctgagaagtgctgtatcgacggcgccgaatacgccagcacctacggaattacctccagcggcaaccagctcagcctctcttttgtcaccaaggggacttatggtaccaacatcggtagccgtacttacctcatggaggacgagaacacctaccagatgttccagctcttgggtaacgagttcacctttgacgtcgatgtttcaaacatcggctgtggtctgaacggtgctctgtacttcgtcagcatggacgccgacggtggcaaggccaagtaccctggtaacaaggctggagctaagtatggtactggttactgtgacgcccagtgcccccgtgacgtgaagttcatcaacggccaggtaagctttaaattcattttgaactcagaatgagagctaacatgcaataaaggccaactccgatggctggcagccatccaagagcgatgtcaacggtggcattggtaacctgggcacatgctgccctgaaatggacatctgggaggccaactccatctccactgcccacactcctcacccttgcaccaagctcactcaacactcctgcactggtgactcttgtggtggaacttactccgaagaccgttacggcggaacttgcgatgctgacggttgtgatttcaacgcctaccgccagggcaacaagaccttctacggtcctggatccggcttcaacgttgacaccaccaagaaggttactgtcgtcacccagttccacaagggcagcaacggccgtctctctgagattactcgtctctacgtccagaacggcaaggtcattgccaactctgagtccaagatcgctggagttcctggaagctctctcacccctgaattctgcactgcccagaagaaggtctttggcgacatcgatgactttgagaagaagggtgcttggggcggtatgagcgatgctcttgaggctcccatggttcttgttatgtctctctggcacgatgtaagtgctaccaaattccaaattcaccatgtaacatgatactgacatacacagcaccactccaacatgctctggctcgactctacctaccccactgactctactaagctcggcgcccagcgaggatcttgctccacatcctctggtgtgcccgccgaccttgagaagaacgtccccaactccaaggttgccttctccaacatcaagttcggtcccatcggcagcacctacaaggagggccagcctgagcccaccaaccccaccaaccccaaccctaccactcccggcggtaccgttgaccagtggggccagtgcggtggtaccaactacagcggtcctactgcttgcaagtctcctttcacctgcaagaagatcaacgacttctactcccagtgccagtaa

SEQ ID NO: 928 - protein, 507 aa, Fusarium venenatum
MYRAIATASALIAAVRAQQVCSLTPETKPALSWSKCTSSGCSNVQGSVTIDANWRWTHQLSGSTNCYTGNKWDTSICTSGKVCAEKCCIDGAEYASTYGITSSGNQLSLSFVTKGTYGTNIGSRTYLMEDENTYQMFQLLGNEFTFDVDVSNIGCGLNGALYFVSMDADGGKAKYPGNKAGAKYGTGYCDAQCPRDVKFINGQANSDGWQPSKSDVNGGIGNLGTCCPEMDIWEANSISTAHTPHPCTKLTQHSCTGDSCGGTYSEDRYGGTCDADGCDFNAYRQGNKTFYGPGSGFNVDTTKKVTVVTQFHKGSNGRLSEITRLYVQNGKVIANSESKIAGVPGSSLTPEFCTAQKKVFGDIDDFEKKGAWGGMSDALEAPMVLVMSLWHDHHSNMLWLDSTYPTDSTKLGAQRGSCSTSSGVPADLEKNVPNSKVAFSNIKFGPIGSTYKEGQPEPTNPTNPNPTTPGGTVDQWGQCGGTNYSGPTACKSPFTCKKINDFYSQCQ

SEQ ID NO: 929 - DNA, 1639 bp, Gibberella zeae
atgtatcgcgccatcgccaccgcctcggcgctcattgcagccgttagagctcagcaagtttgctctctcacccccgagaccaagcctgccttgtcctggtccaagtgtacatccagcggatgcagcaacgtccagggatctgtcaccatcgatgccaactggcgatggactcaccaattgtccggatctaccaactgctacaccggtaacaagtgggacacttccatctgcaccagtggaaaggtctgtgctgagaagtgctgtatcgacggcgccgaatacgccagcacctacggaattacctccagcggcaaccagctcagcctctcttttgtcacaaagggggcttatggtaccaacatcggtagccgtacttacctcatggaggacgagaacacctaccagatgttccagctcttgggtaacgagttcacctttgacgtcgatgtttcaaacattggctgtggtctgaacggtgctctgtactttgtcagcatggacgccgacggtggcaaggccaagtaccctggtaacaaggccggagctaagtatggtactggttactgtgacgcccagtgtccccgtgacgtgaagttcatcaacggccaggtaagctttaaattcactttgaactcggaatgaaagctaacatgcaataaaggccaactctgatggctggcagccatccaagagcgatgtcaacgctggcattggtaacatgggcacatgctgccctgagatggacatctgggaggccaactccatttccactgcctacactcctcacccttgcaccaagctcactcaacactcctgcactggtgactcttgtggtggaacttactccaacgaccgttacggcggaacttgcgatgctgacggttgtgatttcaacgcctaccgccagggcaacaagaccttctacggtcctggatccggcttcaacgtcgacaccaccaagaaggttactgtcgtcacccagttccacaagggcagcaacggccgtctctctgagattactcgtctctacgtccagaacggcaaggtcatcgccaactctgagtccaagatcgctggagttcccggaagctctctcacccctgaattctgcactgcccagaagaaggtctttggcgacaccgatgactttgcgaagaagggtgcttggagcggtatgagcgatgctcttgaggctcccatggttcttgttatgtctctctggcacgatgtaagtgctaccaaactccaaattcaccatgtaacatgatactgacctatacagcaccactccaacatgctctggctcgactctacctaccccactgactctactaagctcggtgctcagcgaggatcttgctccacatcctctggtgtgcctgccgaccttgagaagaacgtccccaactccaaggttgccttctccaacatcaagttcggtcccatcggcagcacttacaaggagggcgtgcctgagcccaccaaccccaccaaccccaccaaccctaccaaccctaccaaccccggtaccgttgaccagtgggcccagtgcggtggtaccaactacagcggtcctactgcttgcaagtctcctttcacctgcaagaagatcaacgacttctactcccagtgccagtaa

SEQ ID NO: 930 - protein, 510 aa, Gibberella zeae
MYRAIATASALIAAVRAQQVCSLTPETKPALSWSKCTSSGCSNVQGSVTIDANWRWTHQLSGSTNCYTGNKWDTSICTSGKVCAEKCCIDGAEYASTYGITSSGNQLSLSFVTKGAYGTNIGSRTYLMEDENTYQMFQLLGNEFTFDVDVSNIGCGLNGALYFVSMDADGGKAKYPGNKAGAKYGTGYCDAQCPRDVKFINGQANSDGWQPSKSDVNAGIGNMGTCCPEMDIWEANSISTAYTPHPCTKLTQHSCTGDSCGGTYSNDRYGGTCDADGCDFNAYRQGNKTFYGPGSGFNVDTTKKVTVVTQFHKGSNGRLSEITRLYVQNGKVIANSESKIAGVPGSSLTPEFCTAQKKVFGDTDDFAKKGAWSGMSDALEAPMVLVMSLWHDHHSNMLWLDSTYPTDSTKLGAQRGSCSTSSGVPADLEKNVPNSKVAFSNIKFGPIGSTYKEGVPEPTNPTNPTNPTNPTNPGTVDQWAQCGGTNYSGPTACKSPFTCKKINDFYSQCQ

SEQ ID NO: 931 - DNA, 1979 bp, Chaetomium thermophilum
cagcacaacagagtcaagacaagcttggtcgtctttgtcagaagttcatcatggctaagcagctgctgctcactgccgctcttgcggccacttcgctggctgcccctctccttgaggagcgccagagctgctcctccgtctggtatgtctcaaccccgggtctgagtattcgggatctgctcgatcatggatgctgatgctgacatgtttgtgtctcaggggtcaatgcggtggcatcaattacaacggcccgacctgctgccagtccggcagtgtttgcacttacctgaatgactggtacagccagtgcattcccggtcaggctcagcccggcacgactagcaccacggctcggaccaccagcaccagcaccaccagcacttcgtcggtccgcccgaccacctcgaatacccctgtgacgactgctcccccgacgaccaccatcccgggcggcgcctcgagcacggccagctacaacggcaacccgttctcgggtgtccaactttgggccaacacctactactcgtccgaggtgcacactttggccatccccagcttgtctcctgagctggctgccaaggccgccaaggtcgctgaggttcccagcttccagtggctcgaccgcaatgtgactgttgacactctcttctccggcactcttgccgaaatccgcgccgccaaccagcgcggtgccaacccgccttatggtaagcacattcaaaaacccgagacccactatggtggaacccagattttgtggggttgcttgcaaccctaacccttatagcatatgaactcttctgtcacccctcactatctctgatctcatttttgaacattttgaattgttccgatgctaactaaaaaaagccggcattttcgtggtttatgacttaccagaccgtgattgcgcggctgctgcttcgaacggcgagtggtctatcgccaacaatggtgccaacaactacaagcgctacatcgaccggatccgtgagctccttatccagtactccgatatccgcactattctggtcattgaacctgattccctggccaacatggtcaccaacatgaacgtccagaagtgctcgaacgctgcctccacttacaaggagcttactgtctatgccctcaaacagctcaatcttcctcacgttgccatgtacatggatgctggccacgctggctggcttggctggcccgccaacatccagcctgctgctgagctctttgctcaaatctaccgcgacgctggcaggcccgctgctgtccgcggtcttgcggtaagacaactcttgagaccacgacccttagaactacagttgctaacataatcaagaccaacgttgccaactacaatgcttggtcgatcgccagccctccgtcctacacctctcctaacccgaactacgacgagaagcactatattgaggcctttgctcctcttctccgcaaccagggcttcgacgcaaagttcatcgtcgacaccggccgtaacggcaagcagcccactggccagcttgaatggggtcactggtgcaatgtcaagggaactggcttcggtgtgcgccctactgctaacactgggcatgaacttgttgatgctttcgtgtgggtcaagcccggtggcgagtccgacggcaccagcgacaccagcgctgctcgttatgactatcactgcggcctttccgacgcactgactccggcgcctgaggctggccaatggttccaggcttatttcgaacagctgctcatcaatgccaaccctccgttctgaacggaagcggagataccggaaggcggtgagaagagcggaattcaagtctctgcttatcaaaatccactcaccaagtggattaaagcggatttatacatctgagaaacaacctgctttaaactcttcttgtacatatttcacttcgagacgtgcctctttctcaggagcactgtagataacaatatatctgtcacatttctgc

SEQ ID NO: 932 - protein, 476 aa, Chaetomium thermophilum
MAKQLLLTAALAATSLAAPLLEERQSCSSVWGQCGGINYNGPTCCQSGSVCTYLNDWYSQCIPGQAQPGTTSTTARTTSTSTTSTSSVRPTTSNTPVTTAPPTTTIPGGASSTASYNGNPFSGVQLWANTYYSSEVHTLAIPSLSPELAAKAAKVAEVPSFQWLDRNVTVDTLFSGTLAEIRAANQRGANPPYAGIFVVYDLPDRDCAAAASNGEWSIANNGANNYKRYIDRIRELLIQYSDIRTILVIEPDSLANMVTNMNVQKCSNAASTYKELTVYALKQLNLPHVAMYMDAGHAGWLGWPANIQPAAELFAQIYRDAGRPAAVRGLATNVANYNAWSIASPPSYTSPNPNYDEKHYIEAFAPLLRNQGFDAKFIVDTGRNGKQPTGQLEWGHWCNVKGTGFGVRPTANTGHELVDAFVWVKPGGESDGTSDTSAARYDYHCGLSDALTPAPEAGQWFQAYFEQLLINANPPF

SEQ ID NO: 933 - DNA, 2894 bp, Schizophyllum commune
atagctgtgtgactctgtgacatacgtaacgcccagcgcggacacgtgcccaaaccctccttgcggagaaccaagtctcggccagatgcactctgaagaagttcacactcaattttcacggcattatatcggccagagacgtcctcccccagtatggatctctgctcgtggtccgaagtttgctcacggggcccggccgtgtccccatgacactcgagaattgactctgccaattagcagaacggttcgccgtctgtacagcgacgccttcactgtcaataggcaattaygggctgaataacgcgacctgatggccgcccaagaacgtgctgaacgacgacgaattggacctacaactcgcggcaagctcagaaaacatgctagaccaagttctgaccatgtcctaatctcgctatcgctttccagtaaccatcctcgtcgactcttcggaagcatccttttctccaggtgtttatccgccatcaacttcacgggaacatacgatcaagtgcacgacgtgtgatacactctgttctgggcaccgcactgctctgtttgcgccgcattctacctctactgcggacaaggcatctccagaacgtttctttccccgaggcagacccgtctgcaccgtcatatctgctcttctccagcccgaggccacaaattcccgccagacggacgctggctccgcaattgaattgttgaagctcttctctgcgagattgtctctcttgtcataccttccagggtctgcattgatttttgtccagctgactgccatggtggtcccggtacttccccggttgtgcccttgcaggaccctcgacaactcacggttctaagtccgatcgccctgcagccatgaccgtgctcctgcctcgactgcccccgccccaggtcgtgtctccctccaaggattatccgcacgctcacgtatataagcccgccgatccgtccctcagttctcatcctcccaacacactctctaccggaccaccaaccgacttcggcaatgttccccgcagcggctctcgtctccctcaccctcgccgcgatagcgcgtgcccagcaggtcggcaacctgaccgctgagacgcacccgtcgctctcctggcaggagtgcacgtccagcggctgcaccgaccactccgcggcgatcacgatcgacgcgaactggcgctggctgcacaccgttgagggctacgacaactgctacaccggcaacgagtgggacgagtctgtctgcaccgacggcgcgacctgcgcgtccagctgcgccctcgacggcgcggactactctggtgagcgcgaccgtcacatggcgcgaaggacgcgaagctgatcagtacacgcgttcacaggcacctacggcatcacgactagcggcgacgcgctcagcctcaagttcgtcacctcgggccagcagaagaacatcggctcgcgcacgtacctcatgaacggcgaggacaagtaccagatgttcaagctcaagaacaaggagttcaccttcaccgtcgacatgtcgacgcttccttgcggtcttaacggtacgcgggcccgcggcgcttctcctacttccgcgacgctaatcggcttctcttccgactgataggcgcgctctacttcgtcgagatggacgaggatggcggcgtgtccaagtacccgaccaacaaggcgggcgctaagtacggcacgggctactgcgactcgcagtgcccgcacgacatcaagttcatcaacggcgaggcgaactccgagggctgggctgggtcggacaacgaccccaacgccggcacaggcacgtacggctcctgctgctctgagatggatatctgggaggccaactcccaggctgcggcctacaccccgcacgtctgcaccgttgagggccaggtacgtctctccgatgatctacgccaaatgcttctcactcacacctcaccagacccgctgcgagggcaccgactgcggtgacgacgacgaccgctactcgggtgtctgcgacaaggacggctgcgacttcaacagctaccgcatgggcgacaccaccttcctcggcgagggcctcaccatcgacaccacccagccgatcaccgtcgtcacccagttcatcaccgcggacaacacgacgtcgggcgcgctctccgagatccgccgcctctacgtacagggcggcgaggtcgtcgcgaactcggcgaccaagatcgagggcctcgacgactacgactcgatcacggaccagttctgcgcggaccagaaggaggtgttcggcgaccagaactactttggcacgctcggtggccttgaggcgatgggcgagtcgctcgaccgcggccacgtcctcgtcatgtccatctgggacgaccacgccgtcaacatgctctggctcgactctgactacccgctcgacaaggacccgagcgagccgggtgtctcccgtggcccgtgcggcactgactccggtgtccccactgacgtgagtgacagcacagtctctcctccttctcctgactcacaaactccctttaggtcgaggctcagagccccgacgccaccgtcatctactccgccatcaagttcggcgacatcggcaccacctacagcgcctaaacgtcgcgcgagcttgactgaagtgggctctttattctgtaacaatataccatgtatcctccctctcctttggcttcttttcttggcttgtaaaagtggatcacatgtactggcaccaaaatactctccctcccttacctagaatcggcactataccattctcatgagtagagctcagagtagacagatcgcaataaatggcttcgaaagcaacttcatcgctcggttcgacactccattccttccaaggattcttgtacctttcgcaagataaaaaaaca

SEQ ID NO: 934 - protein, 455 aa, Schizophyllum commune
MFPAAALVSLTLAAIARAQQVGNLTAETHPSLSWQECTSSGCTDHSAAITIDANWRWLHTVEGYDNCYTGNEWDESVCTDGATCASSCALDGADYSGTYGITTSGDALSLKFVTSGQQKNIGSRTYLMNGEDKYQMFKLKNKEFTFTVDMSTLPCGLNGALYFVEMDEDGGVSKYPTNKAGAKYGTGYCDSQCPHDIKFINGEANSEGWAGSDNDPNAGTGTYGSCCSEMDIWEANSQAAAYTPHVCTVEGQTRCEGTDCGDDDDRYSGVCDKDGCDFNSYRMGDTTFLGEGLTIDTTQPITVVTQFITADNTTSGALSEIRRLYVQGGEVVANSATKIEGLDDYDSITDQFCADQKEVFGDQNYFGTLGGLEAMGESLDRGHVLVMSIWDDHAVNMLWLDSDYPLDKDPSEPGVSRGPCGTDSGVPTDVEAQSPDATVIYSAIKFGDIGTTYSA

SEQ ID NO: 935 - DNA, 2537 bp, Humicola grisea var. thermoidea
atcgttacactcggcggacgtcctccgtgacacaccccctgggcctttggtccgcacaccaccagccctccaatgacttgcgttcgcccctggcaagcctgggtcaacctaaatccacttccagacttcgggtccacgtcctccacgatgccttgcgatgctctctgtccgtgctcccaggactggcggccgttgtcgtcacatcgccagccggactcccggccgctatgcaccgttttggcacatcgccgtccccgcgcttccccactatcgaatcttctcagcaatgcgccccggagcctcacacccagcaagaccaccacagcgcgggcacgcctaccaagcgacgccacccatcggacctcgtcctgccctgttccgatcaaggtcagccgttggcccctggctccacctaccgctcgttccctggacgtgagggcgctattccagatcggccagcgtcgcgaagctcatggctgagcgtcaccgggccgtgagccgcctccatgacgccgtgaccttgcgcgctttgggtggcgagccgtggacggtgcttgctggcgccggccttcccggcgatccgcgtgatgacagggccaccaacggcgggatgatgctccatggggaacttccccatggagaagagagagaaacttgcggagccgtgatctggggaaagatgctccgtgtctcgtctatataactcgagtctccccgagccctcaacaccaccagctctgatctcaccatccccatcgacaatcacgcaaacacagcagttgtcgggccattccttcagacacatcagtcaccctccttcaaaatgcgtaccgccaagttcgccaccctcgccgcccttgtggcctcggccgccgcccagcaggcgtgcagcctcaccaccgagaggcacccttccctctcttggaagaagtgcaccgccggcggccagtgccagaccgtccaggcttccatcactctcgactccaactggcgctggactcaccaggtgtctggctccaccaactgctacacgggcaacaagtgggatactagcatctgcactgatgccaagtcgtgcgctcagaactgctgcgtcgatggtgccgactacaccagcacctatggcatcaccaccaacggtgattccctgagcctcaagttcgtcaccaagggccagtactcgaccaacgtcggctcgcgtacctacctgatggacggcgaggacaagtatcagagtacgttctatcttcagccttctcgcgccttgaatcctggctaacgtttacacttcacagccttcgagctcctcggcaacgagttcaccttcgatgtcgatgtctccaacatcggctgcggtctcaacggcgccctgtacttcgtctccatggacgccgatggtggtctcagccgctatcctggcaacaaggctggtgccaagtacggtaccggctactgcgatgctcagtgcccccgtgacatcaagttcatcaacggcgaggccaacattgagggctggaccggctccaccaacgaccccaacgccggcgcgggccgctatggtacctgctgctctgagatggatatctgggaagccaacaacatggctactgccttcactcctcacccttgcaccatcattggccagagccgctgcgagggcgactcgtgcggtggcacctacagcaacgagcgctacgccggcgtctgcgaccccgatggctgcgacttcaactcgtaccgccagggcaacaagaccttctacggcaagggcatgaccgtcgacaccaccaagaagatcactgtcgtcacccagttcctcaaggatgccaacggcgatctcggcgagatcaagcgcttctacgtccaggatggcaagatcatccccaactccgagtccaccatccccggcgtcgagggcaattccatcacccaggactggtgcgaccgccagaaggttgcctttggcgacattgacgacttcaaccgcaagggcggcatgaagcagatgggcaaggccctcgccggccccatggtcctggtcatgtccatctgggatgaccacgcctccaacatgctctggctcgactcgaccttccctgtcgatgccgctggcaagcccggcgccgagcgcggtgcctgcccgaccacctcgggtgtccctgctgaggttgaggccgaggcccccaacagcaacgtcgtcttctccaacatccgcttcggccccatcggctcgaccgttgctggtctccccggcgcgggcaacggcggcaacaacggcggcaaccccccgccccccaccaccaccacctcctcggctccggccaccaccaccaccgccagcgctggccccaaggctggccgctggcagcagtgcggcggcatcggcttcactggcccgacccagtgcgaggagccctacacttgcaccaagctcaacgactggtactctcagtgcctgtaaattctgagtcgctgactcgacgatcacggccggtttttgtatgaaatgaaacaaacgaccgcgataaaaatggagg

SEQ ID NO: 936 - protein, 525 aa, Humicola grisea var. thermoidea
MRTAKFATLAALVASAAAQQACSLTTERHPSLSWKKCTAGGQCQTVQASITLDSNWRWTHQVSGSTNCYTGNKWDTSICTDAKSCAQNCCVDGADYTSTYGITTNGDSLSLKFVTKGQYSTNVGSRTYLMDGEDKYQTFELLGNEFTFDVDVSNIGCGLNGALYFVSMDADGGLSRYPGNKAGAKYGTGYCDAQCPRDIKFINGEANIEGWTGSTNDPNAGAGRYGTCCSEMDIWEANNMATAFTPHPCTIIGQSRCEGDSCGGTYSNERYAGVCDPDGCDFNSYRQGNKTFYGKGMTVDTTKKITVVTQFLKDANGDLGEIKRFYVQDGKIIPNSESTIPGVEGNSITQDWCDRQKVAFGDIDDFNRKGGMKQMGKALAGPMVLVMSIWDDHASNMLWLDSTFPVDAAGKPGAERGACPTTSGVPAEVEAEAPNSNVVFSNIRFGPIGSTVAGLPGAGNGGNNGGNPPPPTTTTSSAPATTTTASAGPKAGRWQQCGGIGFTGPTQCEEPYTCTKLNDWYSQCL

SEQ ID NO: 937 - DNA, 1851 bp, Agaricus bisporus
ccagaactcaacatgttcccgagatccattctcctcgccctctccctcactgctgttgccttgggccagcaagtcggtaccaacatggccgaaaaccacccatcgctcacttggcaaaggtgcaccagtagtggttgccagaacgtgaacggcaaagtcaccctcgacgctaactggcgttggactcaccgcatcaacgacttcaccaactgctacactggtaacgaatgggatacttctatttgtcctgacggcgtaacttgtgccgagaactgtgcgctcgatggtgctgactacgcaggcacatacggtgtcacctcctccggtaccgctcttactctgaaattcgtcactgagagccagcagaagaacattggttctcgtctctacctcatggctgatgattccaactatgagatcttcaacctcttgaacaaagagttcactttcgacgtcgatgtctccaaacttccttgcggtcttaacggtgccctttacttttcggagatggctgcagatggtggcatgtcgtcgaccaatacggctggtgccaagtacggtactggttattgtgactcgcaatgccctcgtgacatcaagtttatcgacggagaggccaacagcgagggttgggaaggctccccgaacgacgtcaacgctggaaccggtaactttggtgcctgctgcggtgaaatggatatctgggaggccaactctatctcttccgcctacactccccatccttgtagggaacccggactccagcgttgcgagggtaacacttgctcagtcaacgatcgctatgcgactgagtgtgaccccgacggttgtgatttcaactccttccgtatgggagacaagtcgttctacggccccggcatgacagtcgacaccaaccagcccatcactgtcgtcactcagtttatcactgataatggctccgacaacggtaacctccaggagatccgccgcatctacgtccagaacggccaggtcatccagaactccaatgtcaacattcccggaatcgactccggcaactccatttccgcagaattctgtgatcaggctaaggaagccttcggtgatgagcgatcattccaagataggggtggattgtcgggtatgggttctgcgttggaccgcggaatggttctcgtcctttccatctgggatgaccatgccgttaacatgttgtggctcgactctgactacccccttgacgcctccccaagtcaaccaggtatctcccgtggtacctgctctagggactctggtaaacccgaggatgttgaggctaacgctggcggcgtccaagtcgtctactccaatatcaagttcggtgacatcaactccactttcaacaacaacggtggtggcggtggcaaccccagcccaactaccactcgccccaactcccccgctcaaaccatgtggggtcaatgtggtggtcaaggctggactggcccgactgcttgccaatctccatctacttgccacgtcatcaatgacttctatagccaatgtttctgagtagcttgagaatgtttatttagcaataccttggtagtacctcgacggtaaccgggcgtttttgtaaaaaaaaatgcgattatgtgtatatgtaaaatttcgatagaaataacttttgcatcgctttgctttagtgccttttttgttttgataagcttaagttctcttttttttgaggggagagaaagtgagatagtttttagtgaatcagtgaccgaatgagggataaaacggggagtactattcgatgattattagctacgacatggattgtatttatactcaagaaataatgtccaggcgtcgggtggcgaaagc

SEQ ID NO: 938 - protein, 506 aa, Agaricus bisporus
MFPRSILLALSLTAVALGQQVGTNMAENHPSLTWQRCTSSGCQNVNGKVTLDANWRWTHRINDFTNCYTGNEWDTSICPDGVTCAENCALDGADYAGTYGVTSSGTALTLKFVTESQQKNIGSRLYLMADDSNYEIFNLLNKEFTFDVDVSKLPCGLNGALYFSEMAADGGMSSTNTAGAKYGTGYCDSQCPRDIKFIDGEANSEGWEGSPNDVNAGTGNFGACCGEMDIWEANSISSAYTPHPCREPGLQRCEGNTCSVNDRYATECDPDGCDFNSFRMGDKSFYGPGMTVDTNQPITVVTQFITDNGSDNGNLQEIRRIYVQNGQVIQNSNVNIPGIDSGNSISAEFCDQAKEAFGDERSFQDRGGLSGMGSALDRGMVLVLSIWDDHAVNMLWLDSDYPLDASPSQPGISRGTCSRDSGKPEDVEANAGGVQVVYSNIKFGDINSTFNNNGGGGGNPSPTTTRPNSPAQTMWGQCGGQGWTGPTACQSPSTCHVINDFYSQCF

SEQ ID NO: 939 - DNA, 1851 bp, Agaricus bisporus; identical to SEQ ID NO: 937

SEQ ID NO: 940 - protein, 506 aa, Agaricus bisporus; identical to SEQ ID NO: 938

SEQ ID NO: 941 - DNA, 1712 bp, Phanerochaete chrysosporium
cttcttcgcatcggtttcgaactaggcctccgaaaagctcctcgtgcggaaataccgtctgctcacactctagtcacaatgttccgcactgctactttgctcgcattcacgatggccgcaatggtgttcggccagcaggtcggcaccaacacggccgagaaccaccgcacgctcacgtcgcagaagtgcacgaagagcggcggctgctcgaacctgaacaccaagatcgtgctcgacgcgaactggcgctggctccactccacctccggctacaccaattgctatactggcaaccagtgggacgcaacgctctgccccgacggcaagacgtgtgcggccaactgcgcgctcgacggcgccgactacaccggcacctacggcatcaccgcgagcggctcgtcgctcaagctgcagttcgtcactggctcgaacgtcggctcccgtgtctacctcatggcggacgacacgcactaccagatgttccagctcctgaaccaggagttcaccttcgacgtcgacatgtcgaacctcccctgcggtctcaacggcgccctctacctctctgcgatggacgctgatggcggcatggccaagtacccgaccaacaaggctggtgctaagtacggtaccggctactgcgactcgcagtgcccgcgcgacatcaagttcatcaatggcgaggctaacgttgagggctggaacgccaccagtgccaacgcgggtaccggtaactacggtacctgctgcactgagatggatatttgggaggcgaacaatgatgccgctgcatacactccccacccttgcaccaccaacgctcagacccgctgctccggaagcgactgcacccgcgacaccggtctctgcgacgccgacggctgcgacttcaactccttccgcatgggcgaccagaccttcctcgggaagggcctgaccgtagacacctcgaagcccttcaccgtggtcacccagttcatcaccaacgacggcacctccgcgggcaccctcactgagatccgccgtctctatgtccagaatgggaaggtcatccagaactcctccgtcaagatccccggcatcgacctggtcaactcgatcaccgacaacttctgctcgcagcagaagacggcgttcggcgacaccaactacttcgcgcagcacggtggtctcaagcaggtcggtgaggcgttgcgcacgggcatggtcctcgcgctctcgatctgggatgactacgccgcgaacatgctctggctcgactccaactacccgacgaacaaggacccgtcgactcctggtgttgcccgcggcacctgcgcgaccacttccggcgtccccgcgcagatcgaggcgcagagcccgaacgcctacgtcgtcttctcgaacatcaagttcggcgacctcaacaccacgtacaccggcaccgtctcctcgtcctctgtctcctcttcgcactcctccacatccacgagctcctcgcactcctcgagcagcaccccgccaacgcagcccaccggcgtcaccgtccctcagtggggccagtgcggcggcattggctacactggctcgactacctgcgcgagcccgtacacttgccacgtcctcaacccatactactcccagtgctactaagttacggaatggatgcgggggttggatttgttgcacaaaaaaagctgaggccctagcatttttgtcttttatcacctcaaatc

SEQ ID NO: 942 - protein, 516 aa, Phanerochaete chrysosporium
MFRTATLLAFTMAAMVFGQQVGTNTAENHRTLTSQKCTKSGGCSNLNTKIVLDANWRWLHSTSGYTNCYTGNQWDATLCPDGKTCAANCALDGADYTGTYGITASGSSLKLQFVTGSNVGSRVYLMADDTHYQMFQLLNQEFTFDVDMSNLPCGLNGALYLSAMDADGGMAKYPTNKAGAKYGTGYCDSQCPRDIKFINGEANVEGWNATSANAGTGNYGTCCTEMDIWEANNDAAAYTPHPCTTNAQTRCSGSDCTRDTGLCDADGCDFNSFRMGDQTFLGKGLTVDTSKPFTVVTQFITNDGTSAGTLTEIRRLYVQNGKVIQNSSVKIPGIDLVNSITDNFCSQQKTAFGDTNYFAQHGGLKQVGEALRTGMVLALSIWDDYAANMLWLDSNYPTNKDPSTPGVARGTCATTSGVPAQIEAQSPNAYVVFSNIKFGDLNTTYTGTVSSSSVSSSHSSTSTSSSHSSSSTPPTQPTGVTVPQWGQCGGIGYTGSTTCASPYTCHVLNPYYSQCY

SEQ ID NO: 943 - DNA, 1710 bp, Thermoascus aurantiacus var. levisport
attagacgactgtggtggaacctactcctccactcgatatgctggtacctgcgaccctgatggctgcgacttcagaccaccaaatcaagcaacgagcgacagcaataacaatatcaatcgaatcgcaatgtatcagcgcgctcttctcttctctttcttcctcgccgccgcccgcgcgcagcaggccggtaccgtaaccgcagagaatcacccttccctgacctggcagcaatgctccagcggcggtagttgtaccacgcagaatggaaaagtcgttatcgatgcgaactggcgttgggtccataccacctctggatacaccaactgctacacgggcaatacgtgggacaccagtatctgtcccgacgacgtgacctgcgctcagaattgtgccttggatggagcggattacagtggcacctatggtgttacgaccagtggcaacgccctgagactgaactttgtcacccaaagctcagggaagaacattggctcgcgcctgtacctgctgcaggacgacaccacttatcagatcttcaagctgctgggtcaggagtttaccttcgatgtcgacgtctccaatctcccttgcgggctgaacggcgccctctactttgtggccatggacgccgacggcggattgtccaaataccctggcaacaaggcaggcgctaagtatggcactggttactgcgactctcagtgccctcgggatctcaagttcatcaacggtcaggccaacgttgaaggctggcagccgtctgccaacgacccaaatgccggcgttggtaaccacggttcctgctgcgctgagatggatgtctgggaagccaacagcatctctactgcggtgacgcctcacccatgcgacacccccggccagaccatgtgccagggagacgactgtggtggaacctactcctccactcgatatgctggtacctgcgaccctgatggctgcgacttcaatccttaccgccagggcaaccactcgttctacggccccgggaagatcgtcgacactagctccaaattcaccgtcgtcacccagttcatcaccgacgacgggaccccctccggcaccctgacggagatcaaacgcttctacgtccagaacggcaaggtgatcccccagtcggagtcgacgatcagcggcgtcaccggcaactcaatcaccaccgagtattgcacggcccagaaggccgccttcggcgacaacaccggcttcttcacgcacggcgggcttcagaagatcagtcaggctctggctcagggcatggtcctcgtcatgagcctgtgggacgatcacgccgccaacatgctctggctggacagcacctacccgactgatgcggacccggacacccctggcgtcgcgcgcggtacctgccccacgacctccggcgtcccggccgacgttgagtcgcagaaccccaattcatatgttatctactccaacatcaaggtcggacccatcaactcgaccttcaccgccaactaagtaagtaacgggcactctaccaccgagagcttcgtgaagatacaggggtagttgggagattgtcgtgtacaggggacatgcgatgctcaaaaatctacatcagtttgccaattgaaccatgaagaaaagggggagatcaaagaagtctgtcagaagagaggggctgtggcagcttaagccttgttgtagatcgttcagagaaaaaaaaa

SEQ ID NO: 944 - protein, 457 aa, Thermoascus aurantiacus var. levisport
MYQRALLFSFFLAAARAQQAGTVTAENHPSLTWQQCSSGGSCTTQNGKVVIDANWRWVHTTSGYTNCYTGNTWDTSICPDDVTCAQNCALDGADYSGTYGVTTSGNALRLNFVTQSSGKNIGSRLYLLQDDTTYQIFKLLGQEFTFDVDVSNLPCGLNGALYFVAMDADGGLSKYPGNKAGAKYGTGYCDSQCPRDLKFINGQANVEGWQPSANDPNAGVGNHGSCCAEMDVWEANSISTAVTPHPCDTPGQTMCQGDDCGGTYSSTRYAGTCDPDGCDFNPYRQGNHSFYGPGKIVDTSSKFTVVTQFITDDGTPSGTLTEIKRFYVQNGKVIPQSESTISGVTGNSITTEYCTAQKAAFGDNTGFFTHGGLQKISQALAQGMVLVMSLWDDHAANMLWLDSTYPTDADPDTPGVARGTCPTTSGVPADVESQNPNSYVIYSNIKVGPINSTFTAN

SEQ ID NO: 945 - DNA, 1413 bp, Trichoderma parceramosum
atgattgtcggcattctcaccacgctggctacgctggccacactggcagctagtgtgcctctagaggagcggcaagcttgctcaagcgtctggggccaatgtggtggccagaactggtcgggtccgacttgctgtgctgcgggaagcacatgcgtctactcaaacgactattactcccaatgccctcccggcgctgcaagctcaagctcttcgacacgcgcctcgtcgacgactaaccgagtatcgtccacaacatccacgtcttccgcaacccctccccctggttctaccactacgagagtacctccagtaggatcgggaaccgctacatattcaggcaatccttttgttggggttaccccttgggccaatgcctactatgcgtctgaagtcagcagtctcgctattccgagcttgactggagccatggccactgctgcagcagctgtcgcaaaggttccttcgttcatgtggctggatactcttgacaagacccccctcatggagcaaacattggccgatattcgcaccgccaacaagaacggtggtaactacgccgggcagtttgtggtgtatgacttaccagatcgcgactgtgctgcccttgcttccaatggcgaatactccattgccgatggtggtgtggctaaatacaagaactatatcgataccattcgtcaaattgtcgttgagtattccgatattcgcaccatcttggtcattgaacctgattctcttgccaacttggtcacaaacctgggtactccaaagtgtgcgaatgctcagtctgcctaccttgaatgcatcaactacgccatcacgcagctaaaccttccaaacatcgcgatgtacttggatgctggccatgcaggatggcttggttggccggcaaatcaagacccggccgctcaactgtttgcaaacgtttacaagaatgcctcgtctccgagcgctcttcgcgggttggcaaccaatgtagccaattacaatggttggaacattaccagcccaccatcatacacgcaaggcaacgccgtctacaacgagaagctgtatatccacgctattggacctcttcttgccaatcacggctggtctaacgccttcttcatcaccgaccaaggccgatctggcaagcagccaaccgggcagcaacagtggggagattggtgcaatgtcatcggtaccggattcggtattcgtccatcttcaaacaccggagactcgctgctggactcttttgtgtgggtcaagccaggcggcgagtgtgacgggaccagcgatagcagtgcgccacgatttgactcccattgcgccctcccagatgccttgcaaccagcgccccaagctggtgcttggttccaagcctactttgtgcagcttcttacgaatgcaaacccatcgttcctgtaa

SEQ ID NO: 946 - protein, 470 aa, Trichoderma parceramosum
MIVGILTTLATLATLAASVPLEERQACSSVWGQCGGQNWSGPTCCAAGSTCVYSNDYYSQCPPGAASSSSSTRASSTTNRVSSTTSTSSATPPPGSTTTRVPPVGSGTATYSGNPFVGVTPWANAYYASEVSSLAIPSLTGAMATAAAAVAKVPSFMWLDTLDKTPLMEQTLADIRTANKNGGNYAGQFVVYDLPDRDCAALASNGEYSIADGGVAKYKNYIDTIRQIVVEYSDIRTILVIEPDSLANLVTNLGTPKCANAQSAYLECINYAITQLNLPNIAMYLDAGHAGWLGWPANQDPAAQLFANVYKNASSPSALRGLATNVANYNGWNITSPPSYTQGNAVYNEKLYIHAIGPLLANHGWSNAFFITDQGRSGKQPTGQQQWGDWCNVIGTGFGIRPSSNTGDSLLDSFVWVKPGGECDGTSDSSAPRFDSHCALPDALQPAPQAGAWFQAYFVQLLTNANPSFL

SEQ ID NO: 947 - DNA, 1582 bp, Trichoderma parceramosum
atgattgtcggcattctcaccacgctggctacgctggccacactggcagctagtgtgcctctagaggagcggcaagcttgctcaagcgtctggtaagatgaaaatggaatccttccaggagacaggaatactaacatacgtcaaggggccaatgtggtggccagaactggtcgggtccgacttgctgtgctgcgggaagcacatgcgtctactcaaacgactattactcccaatgccctcccggcgctgcaagctcaagctcttcgacacgcgcctcgtcgacgactaaccgagtatcgtccacaacatccacgtcttccgcaacccctccccctggttctaccactacgagagtacctccagtaggatcgggaaccgctacatattcaggcaatccttttgttggggttaccccttgggccaatgcctactatgcgtctgaagtcagcagtctcgctattccgagcttgactggagccatggccactgctgcagcagctgtcgcaaaggttccttcgttcatgtggctgtaggtcctcccgaaaggaatacactttgcaacgaaactcacagtttaccgcagggatactcttgacaagacccccctcatggagcaaacattggccgatattcgcaccgccaacaagaacggtggtaactacgccgggcagtttgtggtgtatgacttaccagatcgcgactgtgctgcccttgcttccaatggcgaatactccattgccgatggtggtgtggctaaatacaagaactatatcgataccattcgtcaaattgtcgttgagtattccgatattcgcaccatcttggtcattggtacgagacctctgtgacccctaccaccgtgtcgctatgctaatccttgttccatcttctagaacctgattctcttgccaacttggtcacaaacctgggtactccaaagtgtgcgaatgctcagtctgcctaccttgaatgcatcaactacgccatcacgcagctaaaccttccaaacatcgcgatgtacttggatgctggccatgcaggatggcttggttggccggcaaatcaagacccggccgctcaactgtttgcaaacgtttacaagaatgcctcgtctccgagcgctcttcgcgggttggcaaccaatgtagccaattacaatggttggaacattaccagcccaccatcatacacgcaaggcaacgccgtctacaacgagaagctgtatatccacgctattggacctcttcttgccaatcacggctggtctaacgccttcttcatcaccgaccaaggccgatctggcaagcagccaaccgggcagcaacagtggggagattggtgcaatgtcatcggtaccggattcggtattcgtccatcttcaaacaccggagactcgctgctggactcttttgtgtgggtcaagccaggcggcgagtgtgacgggaccagcgatagcagtgcgccacgatttgactcccattgcgccctcccagatgccttgcaaccagcgccccaagctggtgcttggttccaagcctactttgtgcagcttcttacgaatgcaaacccatcgttcctgtaa

SEQ ID NO: 948 - protein, 470 aa, Trichoderma parceramosum; identical to SEQ ID NO: 946

SEQ ID NO: 949 - DNA, 3033 bp, Penicillium occitanis
agggagatccccttaatggagctttttggtaatggtttttatgtgacgtctgtatcacgtgatttttatcccaacaggtcgatccccctcttatagttaatggacaacatataagtacgtagcatcttagatagaacgtcagcgtcaactgaccaaagtccccgtgtttcattttaatttgtcagacagcaagagtctcgaaacataaaaagagatcgaaagttttgccttattaggctatatgaatgtcggaacaatgccgttgaggctattcccaatttcggaaatatgtatcttcattgctgtcgacttgacgacagtcgataaaaggctcatccggatagataagccagatcactcattatgccaatttctccggtgtctgaaaacgtatactacatacgtaactgatcttcgtggttgaaagagtgtttcttctcattctcatctgccgatgccgagccaattggaacaaaccccgcatatggtcctgaatatcaatcgcggagatgcggagagtgagggagcaacacaattttaaattagtcagttttctcatgttctccgcaatctgcaggcttgggtctggtaggtttatctctctctttcacaacaaggttgggccattgtcagcttagcaagcgcgcagcaaagggtgtcggtcaatgttcatgtcctccgcggtcactacaaaacagcacgtggggaatgttgctttccctgttgatgttcatgtgttgtcattcccggcaaatcgactccaattaatatggtaggctcctgcataatgcaagtccttgagatgcagcttccggcagatggacgtatagatcagggactgtgaggggctaaaacacttacccgagctaaaacataccataatttcgtttaatgaatttcgtctggatggcagaggctgaaggtcgattatgagtgaaattggtatgaagccacatacgccgatactgtaacgctgtgccttcatccgccttctatcgcgccccgacattccgcggtaccgcgattatgaagaaaaacactcgtaatgatgaggagatagttcttagctcttattatttttgtctagctatggaatgcaagtttagcactatataatggtggtgtttcccttgaagaattaggcactatcaaccgcaacagtcagaagcaatcgacacaatgtctgccttgaactctttcaatatgtacaagagcgccctcatcttgggctccttgctggcaacagctggtgctcagcaaattggtacttatactgctgaaacccatccctctctgagctggtctacttgcaaatcgggtggtagctgcaccacaaactccggtgccattacgttagatgccaactggcgttgggtccatggtgtcaataccagcaccaactgctacactggcaacacttggaatagcgccatctgcgacactgatgcatcctgtgcccaggactgtgctctcgatggcgctgactactctggcacgtacggtatcactacctccggcaactcattgcgcctgaacttcgttaccggttccaacgtcggatctcgtacttacctgatggccgataacactcactaccaaatcttcgacttgttgaaccaggagttcaccttcaccgtcgatgtctcccacctcccttgcggtttgaacggtgccctctacttcgtgaccatggatgccgacggtggcgtctccaagtaccccaacaacaaggccggtgctcagtacggtgttggatactgtgactctcaatgccctcgtgacttgaagttcatcgctggtcaggccaacgttgagggctggacgccctccgccaacaacgccaacactggaattggcaatcacggagcttgctgcgcggagcttgatatctgggaggcaaacagcatctcagaggccttgactcctcacccttgcgatacacccggtctatctgtttgcactactgatgcctgcggtggtacctacagctctgatcgttacgccggtacctgcgaccctgatggatgtgacttcaacccttaccgtcttggtgtcactgacttctacggctccggcaagaccgttgacaccaccaagccctttaccgttgtgactcaattcgtcactaacgacggtacctccaccggttccctctccgagatcagacgttactacgttcagaacggcgttgtcatcccccagccttcctccaagatctccggaatcagcggaaatgtcatcaactccgactactgcgctgctgaaatctccacctttggcgggactgcctccttcaacaaacacggtggcttgacaaacatggccgctggtatggaagctggtatggtcttggtcatgagtttgtgggacgactacgccgtcaacatgctctggctcgacagcacctaccctacaaacgcgactggtacccccggtgccgctcgtggtacctgcgctaccacttctggggaccccaagaccgttgaatcacaatccggcagctcctatgtcaccttctctgacattcgggttggtcctttcaattctacgttcagcggtggttctagcaccggtggcagcactactactaccgccagccgcaccaccaccacctcggcctcttccacctctacttccagcacctctactggcactggagtcgctggtcactggggtcagtgtggtggccagggctggactggtcctaccacctgtgttagtggaaccacatgcaccgtcgtgaacccttactactctcaatgtttgtaaaatttcacttctttcttcgcctattgattgggctatgacaaaattaggagagataggttggacgttgtcaagtcaaaatgtaccgaacacgatgcgttgatatgctgcacatgtgcctagtatccattcgttcctatttatattaaattgaaacttttcttatccaattactgagctaaaacatacttcagcactgtaagchccagcctaagttatgctatgttagactgtccggattcggctggtactggcttttgtgatccc

SEQ ID NO: 950 - protein, 529 aa, Penicillium occitanis
MSALNSFNMYKSALILGSLLATAGAQQIGTYTAETHPSLSWSTCKSGGSCTTNSGAITLDANWRWVHGVNTSTNCYTGNTWNSAICDTDASCAQDCALDGADYSGTYGITTSGNSLRLNFVTGSNVGSRTYLMADNTHYQIFDLLNQEFTFTVDVSHLPCGLNGALYFVTMDADGGVSKYPNNKAGAQYGVGYCDSQCPRDLKFIAGQANVEGWTPSANNANTGIGNHGACCAELDIWEANSISEALTPHPCDTPGLSVCTTDACGGTYSSDRYAGTCDPDGCDFNPYRLGVTDFYGSGKTVDTTKPFTVVTQFVTNDGTSTGSLSEIRRYYVQNGVVIPQPSSKISGISGNVINSDYCAAEISTFGGTASFNKHGGLTNMAAGMEAGMVLVMSLWDDYAVNMLWLDSTYPTNATGTPGAARGTCATTSGDPKTVESQSGSSYVTFSDIRVGPFNSTFSGGSSTGGSTTTTASRTTTTSASSTSTSSTSTGTGVAGHWGQCGGQGWTGPTTCVSGTTCTVVNPYYSQCL

SEQ ID NO: 951 - DNA, 1559 bp, Malbranchea cinnamomea
cgaggcgtccatcccacgccgcacgcgtcagccagtcattatgagagactctttgttcactttgctatctcttgccttgggctcggcctctgccagccctttccttcttccaaggcaagcgaactcctccaacccgtttgctggacacacgatctatccaaacccgtactactccaacgagattgacgagtttgccattcccgcgctgcaagagaccgatcctgcacttgtggagaaggccgctttagtaaaagaagttggaactttcttctggattgatgtcgtcgccaaggtcccagatatcggcccttacctgcaggggatccaagaagcaaacgccgcaggccagaatccgccgtacatcggcgcgattgttgtctatgacctccccaaccgtgactgcgctgccgcagcttccaacggagagttcagcctcgaggatggcggcgaggagaagtaccgcggttatatcgacggtatccgggagcaaattgagaaatacccagacgtccgtgtcgcgctggttatcgagcccgattcgctcgcgaacatggtcaccaatctcaatgtccccaagtgcgctgagtcggagcaggcttatcgagatggcgtcgcgtatgcactgaaacagctagacctccccaacgtctggacatatatcgatgctggtcattcaggttggcttggctggcccgccaacatcgagcctgccgcagaaatttttgttgaggtctggaatgcagctggcaggccaaagtccactcgagggtttgctacgaacgtttccaactacaacggttattccctcagcaccgctcctccctacactgagcccaaccccaatttcgacgaagtgcgttatatcaatgcattccgcccactcctcgaggcacggggtttcccagcatacttcatcgtcgaccaaggccgcagcggtgtccagcccactgcgcagattgagcaaggacactggtgcaatgtgatcgacaccggttttggaactcgccccactactgacactggtaatgagtacgttgactcgatcgtgtgggtgaagcctggcggcgaatcggacggaaccagcgatacctctgctgagagatatgactaccactgcggacttgaggatgcattgaagccagctcctgaagcgggacagtggttccaggcctacttcgagcaactgctcagaaatgccaaccccccattctaaatcagatgaaggacggacccaattgatgacggcctgtcttcgtgatccgacgaaagcaatgtcagggtgaaaatgaccgagagattggagagtcatgaggataggtagtcaatgatttcacccgagtttccacgttttacccttcttgtacatagtttggagtcgcctgttggtttcagtagtacatcttatccgacagagtctatcgtttgattaccccagtcaaaagcgttattgcaatcttttcctagggatttattgtttgctgcggatgtcgtggctatgggcagctgactgaattaaactggaactcttggtatccaaaaaaaaaaaaaaaaaaaaaaaa

SEQ ID NO: 952 - protein, 390 aa, Malbranchea cinnamomea
MRDSLFTLLSLALGSASASPFLLPRQANSSNPFAGHTIYPNPYYSNEIDEFAIPALQETDPALVEKAALVKEVGTFFWIDVVAKVPDIGPYLQGIQEANAAGQNPPYIGAIVVYDLPNRDCAAAASNGEFSLEDGGEEKYRGYIDGIREQIEKYPDVRVALVIEPDSLANMVTNLNVPKCAESEQAYRDGVAYALKQLDLPNVWTYIDAGHSGWLGWPANIEPAAEIFVEVWNAAGRPKSTRGFATNVSNYNGYSLSTAPPYTEPNPNFDEVRYINAFRPLLEARGFPAYFIVDQGRSGVQPTAQIEQGHWCNVIDTGFGTRPTTDTGNEYVDSIVWVKPGGESDGTSDTSAERYDYHCGLEDALKPAPEAGQWFQAYFEQLLRNANPPF

SEQ ID NO: 953 - DNA, 1587 bp, Stillbella annulata
ggcacgaggcgcgcatcacaatggccggtcgattcttcctctctgctgccttcctggctagcgcggctttggccgtccctctcgaggagaggcagaactgctccccgcagtgggcccagtgcggtggaaatggatggagcggtccgacgtgctgcgcctccggcagcaactgccaggtcaccaacgagtggtactctcagtgtgttccgggcgcggcgcctccccctccccccgtcaccacgacgcggtcgaccaccacgcccccgacgacgacgaccaggaccaccgctgatgcccctcctcccaccggcggcgctacttacaccggcaaccccttcctcggtgtcaaccagtgggccaacaacttctaccggtctgagatcatgaacatcgccgtcccgtccctgtccggtgccatggctaccgccgccgccaaggtcgccgatgtgcccaccttccagtggattgacaagatggacaagctccccttgatcgatgaggctctcgccgacgtccgcgctgccaacgcccgtggcggcaactacgcttccatcctggtcgtctacaacctgcccgaccgtgactgcgccgccgccgcctcgaacggcgagttcgccatcgccgacggcggtgttgctaagtacaagaactacattgacgagattcgcaagctcgtcatcaagtacaacgacctccgtatcatcctggtcatcgagcccgactccctcgccaacatggtgaccaacatgaacgtcgccaagtgccagaacgccgcctcggcctaccgggagtgcaccaactatgccctgacgaacctcgacctgcccaacgtcgcccagtacatggatgccggacatgctggctggctcggctggcccgccaacatcacccccgccgcccagctcttcgccgaggtctacaagcaggccggcagccccaagtcggtccgtggtctggccatcaacgtctccaactacaacgcgtggagcgtttcgtcccctcctccctacacctctcccaaccccaactacgacgagcgccacttcgttgaggcctttgcgcccctcctgcgccagaacggctgggatgccaagttcatcgtcgaccagggccgctccggcaggcagcccaccggccagcaggagtggggacactggtgcaacgccatcggcactggcttcggccagcgcccgacgtccaacaccggccacgccgatgttgacgctttcgtctggatcaagccgggcggtgagtgcgacggcaccagcgacacctcggccgcccgctacgaccacttctgtggcaaccctgatgccctcaagccggcccccgaagccggagagtggttccaggcctacttcgagcagcttctgcgcaacgccaaccccgccttctaagtgctggatgagcttttctgagagggtacttccgcggtcttgggtttcactcttctcagcctttcagggcagcagttttggtttcttggggtaggacctccgggtttatgtagacggagttaggaagccaaacctactatgaatgtagtattcaagaagataatgacttgaaaaaaaaaaaaaaaaaaaa

SEQ ID NO: 954 - protein, 458 aa, Stillbella annulata
MAGRFFLSAAFLASAALAVPLEERQNCSPQWAQCGGNGWSGPTCCASGSNCQVTNEWYSQCVPGAAPPPPPVTTTRSTTTPPTTTTRTTADAPPPTGGATYTGNPFLGVNQWANNFYRSEIMNIAVPSLSGAMATAAAKVADVPTFQWIDKMDKLPLIDEALADVRAANARGGNYASILVVYNLPDRDCAAAASNGEFAIADGGVAKYKNYIDEIRKLVIKYNDLRIILVIEPDSLANMVTNMNVAKCQNAASAYRECTNYALTNLDLPNVAQYMDAGHAGWLGWPANITPAAQLFAEVYKQAGSPKSVRGLAINVSNYNAWSVSSPPPYTSPNPNYDERHFVEAFAPLLRQNGWDAKFIVDQGRSGRQPTGQQEWGHWCNAIGTGFGQRPTSNTGHADVDAFVWIKPGGECDGTSDTSAARYDHFCGNPDALKPAPEAGEWFQAYFEQLLRNANPAF

SEQ ID NO: 955 - DNA, 1731 bp, Chaetomium thermophilum
cgggggggggggacagcacaacagagtcaagacaagcttggtcgctttgtcagaagttcatcatggctaagcagctgctgctcactgccgctcttgcggccacttcgctggctgcccctctccttgaggagcgccagagctgctcctccgtctggggtcaatgcggtggcatcaattacaacggcccgacctgctgccagtccggcagtgtttgcacttacctgaatgactggtacagccagtgcattcccggtcaggctcagcccggcacgactagcaccacggctcggaccaccagcaccagcaccaccagcacttcgtcggtccgcccgaccacctcgaatacccctgtgacgactgctcccccgacgaccaccatcccgggcggcgcctcgagcacggccagctacaacggcaacccgttttcgggtgttcaactttgggccaacacctactactcgtccgaggtgcacactttggccatccccagcttgtctcctgagctggctgccaaggccgccaaggtcgctgaggttcccagcttccagtggctcgaccgcaatgtgactgttgacactctcttctccggcactcttgccgaaatccgcgccgccaaccagcgcggtgccaacccgccttatgccggcattttcgtggtttatgacttaccagaccgtgattgcgcggctgctgcttcgaacggcgagtggtctatcgccaacaatggtgccaacaactacaagcgctacatcgaccggatccgtgagctccttatccagtactccgatatccgcactattctggtcattgaacctgattccctggccaacatggtcaccaacatgaacgtccagaagtgctcgaacgctgcctccacttacaaggagcttactgtctatgccctcaaacagctcaatcttcctcacgttgccatgtacatggatgctggccacgctggctggcttggctggcccgccaacatccagcctgctgctgagctctttgctcaaatctaccgcgacgctggcaggcccgctgctgtccgcggtcttgcgaccaacgttgccaactacaatgcttggtcgatcgccagccctccgtcctacacctctcctaacccgaactacgacgagaagcactatattgaggcctttgctcctcttctccgcaaccagggcttcgacgcaaagttcatcgtcgacaccggccgtaacggcaagcagcccactggccagcttgaatggggtcactggtgcaatgtcaagggaactggcttcggtgtgcgccctactgctaacactgggcatgaacttgttgatgctttcgtgtgggtcaagcccggtggcgagtccgacggcaccagtgcggacaccagcgctgctcgttatgactatcactgcggcctttccgacgcactgactccggcgcctgaggctggccaatggttccaggcttatttcgaacagctgctcatcaatgccaaccctccgctctgaacggaagcggagataccggaaggcggtgagaagagcggaattcaagtctgcttatcaaaatccactcaccaagtggattaaagcggatttatacatctgagaaacaacctgctttaaactcttcttgtacatatttcacttcgagacgtgcctctttctcaggagcactgtagataccaatatatctgtcacatttcatataaaaaaaaaaaaaaagaaaaaaagtactagtcga

SEQ ID NO: 956 - protein, 1349 aa, Chaetomium thermophilum
AAAATGAAAAATTTACTTTTAGCTAGTGTTCTTAGTTTAGGTCTTGCTGGCTTAGCTAATGCTGCTTGTGGTGGTGCCTGGGCTCAATGTGGAGGTGAAAACTTCCATGGTGATAAATGTTGTGTTTCCGGTCACACTTGTGTTAGTATTAACCAATGGTATTCACAATGTCAACCAGGAGGTGCTCCAAGCAATAATGCTTCAAACAATAATAATAACAATAACAATAATAACAACAATAACAATAACAATGGTGGTAGTGGTAGTACTAAAAACTTCTTTGATAACCAAATTTATGCTAACCCAAAGTTTATTGAAAGAGTCAATTCTTCTAATCCAAGATTAAGTTATGATTTACAACAAAAGGCTCAAAAGGTTAAGGATGTTCCAACTGCCGTTTGGTTAGCTTGGGATGGAGCCACTGGAGAAGTTGCTCAACATCTTAAAGCTGCTGGTTCTAAAACTGTTGTCTTCATCATGTACATGATTCCAACTCGTGATTGTAACGCTAATGCCTCTGCTGGTGGTGCTGGTAACCTCAACACTTATAAGGGATACGTTGATAATATTGCTAGAACTATTCGTAGTTATCCAAATTCAAAGGTTGTTATGATTCTTGAACCAGATACTCTTGGTAACCTTGTTACTGCTAATAGTGCTAACTGTCAAAACGTTCGTAACTTACATAAGAATGCTTTATCTTATGGTGTTAATGTTTTCGGTAGCATGAGTAATGTTAGTGTTTACCTTGATGCTGCTCATGGTGCTTGGTTAGGTAGCTCTACTGATAAGGTTGCTTCTGTTGTTAAGGAAATCTTAAATAATGCTCCAAATGGAAAGATTCGTGGTTTAAGTACTAACATTTCTAACTACCAATCAATTTCTTCTGAATACCAATACCACCAAAAACTTGCCTCTGCTCTTGCTGCTGTCGGTGTTCCAAACATGCACTTCATTGTTGATACTGGTCGTAATGGTGTTACTATTAATTCTGGAACATGGTGTAACTTAGTCGGTACTGGTCTTGGTGAACGTCCAAGAGGTAGTCCAAATGCTGGTATGCCATTATTAGATGCTTACATGTGGCTTAAGACTCCAGGAGAATCTGACGGTTCATCCTCTGGTTCTAGAGCTGATCCAAATTGTTCTAGTAATGATTCTCTTAGAGGTGCTCCAGATGCTGGTCAATGGTTCCATGATTACTTCGCTCAATTAGTAAGAAATGCTAGACCATCATTTTAAGTAAATTTCTAAATGATTGAATTTAACAAAAATTACTAATTAAATATATAAATTATTTAATTATGTAATAAGTAAAAAGCAAAAAAAAAAAAAAAAAAAAAAAAAAA

SEQ ID NO: 957 - DNA, 1566 bp, Neocallimastix frontalis
atgttccgcaaagctgcactcctcgctttctccttccttgccatcgcacacggtcagcaggttggcaccaaccaggctgagaaccacccttcccttccttcccaacactgtaccgctagcggctgcaccacttcttcgacttccgtagtgctcgacgccaactggcgttgggtccacaccaccactggctacaccaactgctacaccggtcaaacctgggacgccagcatctgccctgacggtgttacctgcgccaaggcctgcgctctcgatggagctgactactctggtacctacggtatcaccaccagcggcaacgctcttacgctccagttcgtgaagggaaccaacgtcggttctcgtgtgtacttgctccaggacgcgagcaactaccagctgttcaagctcatcaaccaggagttcaccttcgacgttgacatgtcaaaccttccttgcggtctcaacggtgccgtctacctctctcagatggaccaggatggtggtgtttccagattccccaccaacaccgctggtgccaagtacggtactggttactgcgactctcaatgcccaagggatatcaagttcatcaacggcgaggccaacgtcgctggctggactggctcatccagcgatcccaactctggtactggtaactacggcacgtgctgctctgagatggatatctgggaagccaactctgttgccgccgcctacactcctcacccttgctcggtcaaccagcagacccgctgcactggtgctgactgtggtcaggatgccaaccgttacaagggtgtctgcgatcccgacggttgcgacttcaactccttccgtatgggtgaccagaccttcctcggcaagggcctcactgttgacaccagccgcaagttcaccatcgtcactcagttcatctccgacgacggtacctccagcggtaacctcgctgagatccgccgcttctacgtccaggacggcaaggtcatccccaacagcaaggtcaacatcgccggttgtgacgctgtcaactccatcaccgacaagttctgcacccagcagaagaccgcctttggtgacaccaaccgcttcgccgaccagggtggccttaagcagatgggtgccgctctcaagtctggcatggtcctcgctctctcgctctgggacgaccacgctgccaacatgctctggctcgactccgactaccccaccaccgctgatgccagcaagcccggtgttgctcgtggcacttgcccgaacacctccggtgttcccaaggacgtcgagtcccagagcggctctgccaccgtcacctactcgaacatcaagtggggtgacctcaactccaccttctctggcaccgcctccaaccctaccggccccagcagcagccccagcggaccttcatcgtcctcctcctccaccgctggctcgcagcccactcaacccagctctggctctgttgctcagtggggccagtgcggtggtattggctacagcggcgcgactggttgcgtctctccctacacttgccacgtcgttaacccttactactcccagtgctactaa

SEQ ID NO: 958 - protein, 521 aa, Neocallimastix frontalis
MFRKAALLAFSFLAIAHGQQVGTNQAENHPSLPSQHCTASGCTTSSTSVVLDANWRWVHTTTGYTNCYTGQTWDASICPDGVTCAKACALDGADYSGTYGITTSGNALTLQFVKGTNVGSRVYLLQDASNYQLFKLINQEFTFDVDMSNLPCGLNGAVYLSQMDQDGGVSRFPTNTAGAKYGTGYCDSQCPRDIKFINGEANVAGWTGSSSDPNSGTGNYGTCCSEMDIWEANSVAAAYTPHPCSVNQQTRCTGADCGQDANRYKGVCDPDGCDFNSFRMGDQTFLGKGLTVDTSRKFTIVTQFISDDGTSSGNLAEIRRFYVQDGKVIPNSKVNIAGCDAVNSITDKFCTQQKTAFGDTNRFADQGGLKQMGAALKSGMVLALSLWDDHAANMLWLDSDYPTTADASKPGVARGTCPNTSGVPKDVESQSGSATVTYSNIKWGDLNSTFSGTASNPTGPSSSPSGPSSSSSSTAGSQPTQPSSGSVAQWGQCGGIGYSGATGCVSPYTCHVVNPYYSQCY

SEQ ID NO: 959 - DNA, 675 bp, Irpex lacteus
acatggcagaaatgcacatctggcggaagctgtacaactcaatcgggcaaagtagtccttgatgcaaactggcgatggactcacgcttatcctagcggtaacaattgttataacggcaatacctgggatgctaccctatgtcctgatgacgagacctgtgcgaagaactgttgtttagagggagccgattactcgggaacctatggagtcaccaccagtggtaaccagcttaccattgacttcgttactcagtcgcaaaacaagaatgtcggtgctcgtctgtacttgatggcatccgacactgcctatgaagagtttactcttcagaataatgagttctctttcgatgttgatgtgtctcagctgccgtgagtatactttactaaaaaataagctggctggcagtttttaagctaacatggctatcattaggtgtggcttgaacggagctctatacttcgtgtctatggatgcagatggtggtgcatccaaatacccaacaaatcttgctggcgcgaaatacggcacaggatactgtgacagccagtgccctcgtgacctgaagtatatcaacggccaggccaacgttgaaggctggcagccatcttcaaacaacgccaacactggaattggggggcacggaagctgctgctccgagatggatatctgggaggc

SEQ ID NO: 960 - protein, 204 aa, Irpex lacteus
TWQKCTSGGSCTTQSGKVVLDANWRWTHAYPSGNNCYNGNTWDATLCPDDETCAKNCCLEGADYSGTYGVTTSGNQLTIDFVTQSQNKNVGARLYLMASDTAYEEFTLQNNEFSFDVDVSQLPCGLNGALYFVSMDADGGASKYPTNLAGAKYGTGYCDSQCPRDLKYINGQANVEGWQPSSNNANTGIGGHGSCCSEMDIWEA

SEQ ID NO: 961 - DNA, 1369 bp, Trichoderma asperellum
cttcttggttctcaaagatgctctccaacgtctttcttaccgctgccctcgcagccggcctggctcaggccctgccccaggccacgcctaccccaaccgctgcgccctctggcaaccccttcgcgggcaagaacttctacgccaacccatactactcgtctgaagtccacaccctggccatgccctcgcttccagcctcgctgaagcctgctgctaccgccgtggccaaggtcggatcattcgtgtggatggacaccatggccaaggttcctctcatggacacctacctcgcagacatcaaggccaagaacgctgctggcgcaaacctcatgggtacttttgtcgtctacgaccttcccgaccgtgactgcgccgctctggcctccaacggtgaactcaagattgacgagggtggtgtcgagaagtacaagacccagtacattgacaagattgccgccatcatcaagaagtaccccgacgtcaagatcaaccttgccattgagcccgattcccttgccaacatggtcaccaacatgggtgtgcagaagtgctcgcgcgccgccccatactacaaggagctcactgcctacgccctcaagacgctcaacttcaacaacgtcgacatgtacatggacggtggccacgccggttggctcggctgggacgccaacattggccctaccgcaaagcttttcgcagaggtctacaaggctgctggctctccccgtggcgtccgtggtatcgtcaccaacgtcagcaactacaacgctctccgcgtctcctcctgcccatccatcacccaaggaaacaagaactgcgacgaggagcgctacatcaacgccttggctcctcttctcaagaacgagggtttccctgctcacttcatcgtcgaccagggccgctccggaaaggtgcctactaaccagcaggagtggggtgactggtgcaacgtctcaggtgctggattcggtacccgtcccaccaccaacactggcaatgccctcattgatgccatcgtctgggtcaagcccggtggcgagtctgacggtacctctgacaccagcgctgcccgctacgatgcccactgcggcaggaacagcgctttcaagcccgctcctgaggctggaacctggttccaggcttacttcgagatgcttctcaagaacgctaaccctgctcttgcttaagtgtctggttcttttgaataagcttgggtagattgttagaagggaaaattagtctgcgagtggtctttcaccgcagattctggtggattgtaaatatggctttggaactagaataggcaacgtttgatgttgcagttcgtgtaaatattataccttttggagctaaaaaaaaaaaaaaaaaa

SEQ ID NO: 962 - protein, 389 aa, Trichoderma asperellum
MLSNVFLTAALAAGLAQALPQATPTPTAAPSGNPFAGKNFYANPYYSSEVHTLAMPSLPASLKPAATAVAKVGSFVWMDTMAKVPLMDTYLADIKAKNAAGANLMGTFVVYDLPDRDCAALASNGELKIDEGGVEKYKTQYIDKIAAIIKKYPDVKINLAIEPDSLANMVTNMGVQKCSRAAPYYKELTAYALKTLNFNNVDMYMDGGHAGWLGWDANIGPTAKLFAEVYKAAGSPRGVRGIVTNVSNYNALRVSSCPSITQGNKNCDEERYINALAPLLKNEGFPAHFIVDQGRSGKVPTNQQEWGDWCNVSGAGFGTRPTTNTGNALIDAIVWVKPGGESDGTSDTSAARYDAHCGRNSAFKPAPEAGTWFQAYFEMLLKNANPALA

SEQ ID NO: 963 - DNA, 1848 bp, Cochliobolus heterostrophus
aagcttcaatcgtccctcgatcagttggcaaccatggttgactctttctccatctacaaaacagctctcctgctgtccatgctggccaccagcaatgcgcagcaggtcggcacttacaccgctgaaacgcaccccagcttgacctggcaaacctgcagcggcagtggtagctgcactaccaccagcggcagcgtggtcattgacgccaattggcgctgggtgcacgaggttggtggctacaccaactgctatagcggcaacacttgggacagttcgatctgctccaccgataccacctgcgcgtccgaatgtgccctcgagggtgcaacttacgagagcacctatggtgtgaccaccagcggctcgtcgctccgtctcaacttcgttactaccgcgtcgcagaagaacattggctcgcgtctgtatcttctcgctgacgacagcacctacgagactttcaagcttttcaaccgcgagttcaccttcgatgtcgatgtctcgaaccttccctgtggattgaacggcgccctctacttcgtctctatggacgctgacggtggtgtttcccgcttccccacgaacaaagctggcgccaaatacggaaccggatattgcgactcccaatgtcctcgggatcttaagttcatcgatggtcaggccaacattgagggctgggagccatcctcgaccgatgtcaatgcgggtactggtaaccacggctcctgctgtcctgagatggatatctgggaggcgaacagcatctccagtgccttcacagcccacccttgcgactcggtccagcaaaccatgtgcacaggcgatacttgcggtggcacttacagcgacactaccgaccgttactctggtacttgcgatccagatggatgcgatttcaacccttaccggtttggcaacaccaacttctatggtcccggaaagaccgtcgacaacagcaagcccttcacggttgtgacgcagttcattacccatgatggcactgacacgggtaccctgactgagatccgtcgtctctacgtgcagaacggtgtcgtgattggcaacggcccctcgacctacactgccgcgagcggcaactcgatcaccgagagcttctgcaaggccgagaagaccttgttcggcgacaccaacgtcttcgaaacccacggtggactgtctgccatgggtgacgccctcggcgacggcatggtcctggtgctcagtctgtgggacgaccacgccgctgacatgctctggctcgacagcgactaccccaccaccagctgcgcttccagccctggtgtcgcccgcggtacctgccccaccactaccggaaatgccacctacgtcgaggccaactacccgaactcgtatgttacctactccaacatcaagttcggcaccctcaactcgacctactccggcacctcctctggcggctccagctccagcagcaccaccttgactaccaaggcctcgaccagcaccactagctccaagaccactaccaccacttccaagacgtccaccacctcgagctcgtccacgaatgttgcccagctctacggacaatgcggtggacagggatggactggtcccaccacctgcgccagcggcacttgcaccaagcagaatgactactactcgcagtgcttgtaggcggagaaatgactgttgaagcgatcttgatgagcaggcaggagagatcgacgaggaatgagtgagatgggagaaagtatgatggcaatttgttacttccggtaggatctccaagcttaggactagtctagcaaatgaaaggctgtttttttttttcttaaaaaaaaccatggtacccggatcctcgaattc

SEQ ID NO: 964 - protein, 540 aa, Cochliobolus heterostrophus
MVDSFSIYKTALLLSMLATSNAQQVGTYTAETHPSLTWQTCSGSGSCTTTSGSVVIDANWRWVHEVGGYTNCYSGNTWDSSICSTDTTCASECALEGATYESTYGVTTSGSSLRLNFVTTASQKNIGSRLYLLADDSTYETFKLFNREFTFDVDVSNLPCGLNGALYFVSMDADGGVSRFPTNKAGAKYGTGYCDSQCPRDLKFIDGQANIEGWEPSSTDVNAGTGNHGSCCPEMDIWEANSISSAFTAHPCDSVQQTMCTGDTCGGTYSDTTDRYSGTCDPDGCDFNPYRFGNTNFYGPGKTVDNSKPFTVVTQFITHDGTDTGTLTEIRRLYVQNGVVIGNGPSTYTAASGNSITESFCKAEKTLFGDTNVFETHGGLSAMGDALGDGMVLVLSLWDDHAADMLWLDSDYPTTSCASSPGVARGTCPTTTGNATYVEANYPNSYVTYSNIKFGTLNSTYSGTSSGGSSSSSTTLTTKASTSTTSSKTTTTTSKTSTTSSSSTNVAQLYGQCGGQGWTGPTTCASGTCTKQNDYYSQCL

SEQ ID NO: 965 - DNA, 3459 bp, Aspergillus aculeatus
gaattctagacctttatcctttcatccgaccagacttccctttttgaccttggcgccctgttgactacctacctacctaggtagtaacgtcgtcgaccctcttgaatgatccttgtcacactgcaaacatccgaaaacatacggcaaaagatgattgggcatggatgcaggagacatcgaatgagggcttagaaggaaatgaaaacctgggaccaggacgctaggtacgatgaaatccgccaatggtgaaactttaagtcgtgcctacagcacaggctctgtgaagattgcgctgttcagacttaatcttctcatcacagtccaagtctttatgaaaaggaaaaagagagggaagagcgctatttcgagctgttggcctcatagggagacagtcgagcataccagcggtatcgacgttagactcaaccaagaataatgacgagaataaacacagaagtcaaccttgaactggatagcagggttccagcagcagatagttacttgcataaagacaactccccgagggctctctgcatacaccaggatgttccggaattattcactgctcgtttccgacgtggcgtcagtgatccgtctccacagaactctacctgggaataacccaggggaggaatctgcaagtaagaacttaataccaatccccggggctgccgaggtgaatcgaatctcccgcgggaaattaaacccatacgatgtttttgcaccacatgcatgcttagcacgatttctccgcaagggagtcacagagaaagacatatttcgcatactactgtgactctgcagagttacatatcactcaggatacattgcagatcattgtccgggcatcaaaaatggacctgcaggatcaacggcccgacaaaacacaagtggctaaagctgggggatgcccgaaaccctctggtgcaatatcatttgatggatgttccccccgcatttctaagacatcgacggatcggcccgcatactaatccttttatcaaccaaaagttccactcgactagagaaaaaaaaggccaaggccactagttgcagtcggatactggtcttttcgccgtccaacaccttcatccatgatccccttagccaccaatgccccacataatacatgttgacataggtacgtagctctgttatccaatcggatccgaacctctttaacggacccctcctacacaccttatcctaacttcagaagactgttgcccattggggattgaggaggtccgggtcgcaggatgcgttctaggctaaattctcggccggtagccatctcgaatctctcgtgaagccttcatctgaacggttggcggcccgtcaagccgatgaccatgggttcctgatagagcttgtgcctgaccggccttggcggcatagacgagctgaacacatcaggtatgaacagatcagatataaagtcggattgagtcctagtacgaagcaatccgccaccaccaaatcaagcaacgagcgacacgaataacaatatcaatcgaatcgcaatgtatcagcgcgctcttctcttctctttcttcctcgccgccgcccgcgcgcacgaggccggtaccgtaaccgcagagaatcacccttccctgacctggcagcaatgctccagcggcggtagttgtaccacgcagaatggaaaagtcgttatcgatgcgaactggcgttgggtccataccacctctggatacaccaactgctacacgggcaatacgtgggacaccagtatctgtcccgacgacgtgacctgcgctcagaattgtgccttggatggagcggattacagtggcacctatggtgttacgaccagtggcaacgccctgagactgaactttgtcacccaaagctcagggaagaacattggctcgcgcctgtacctgctgcaggacgacaccacttatcagatcttcaagctgctgggtcaggagtttaccttcgatgtcgacgtctccaatctcccttgcgggctgaacggcgccctctactttgtggccatggacgccgacggcaatttgtccaaataccctggcaacaaggcaggcgctaagtatggcactggttactgcgactctcagtgccctcgggatctcaagttcatcaacggtcaggtacgtcagaagtgataactagccagcagagcccatgaatcattaactaacgctgtcaaatacaggccaacgttgaaggctggcagccgtctgccaacgacccaaatgccggcgttggtaaccacggttcctcgtgcgctgagatggatgtctgggaagccaacagcatctctactgcggtgacgcctcacccatgcgacacccccggccagaccatgtgccagggagacgactgtggtggaacctactcctccactcgatatgctggtacctgcgaccctgatggctgcgacttcaatccttaccagccaggcaaccactcgttctacggccccgggaagatcgtcgacactagctccaaattcaccgtcgtcacccagttcatcaccgacgacgggacaccctccggcaccctgacggagatcaaacgcttctacgtccagaacggcaaggtgatcccccagtcggagtcgacgatcagcggcgtcaccggcaactcaatcaccaccgagtattgcacggcccagaaggcagccttcggcgacaacaccggcttcttcacgcacggcgggcttcagaagatcagtcaggctctggctcagggcatggtcctcgtcatgagcctgtgggacgatcacgccgccaacatgctctggctggacagcacctacccgactgatgcggacccggacacccctggcgtcgcgcgcggtacctgccccacgacctccggcgtcccggccgacgttgagtcgcagaaccccaattcatatgttatctactccaacatcaaggtcggacccatcaactcgaccttcaccgccaactaagtaagtaacgggcactctaccaccgagagcttcgtgaagatacaggggtagttgggagattgtcgtgtacaggggacatgcgatgctcaaaaatctacatcagtttgccaattgaaccatgaagaaaagggggagatcaaagaagtctgtcagaagagaggggctgtggcagcttaagccttgttgtagatcgttcagagaaaaaaaaagtttgcgtacttattatattaggtcgatcattatccgattgactccgtgacaagaattaaaaagagtactgcttgcttgcctatttaaattgttatatacgccgtagcgcttgcggaccacccctcacagtatatcggttcgcctcttcttgtctcttcatctcacatcacaggtccaggtccagcccggcccggtccgggtgccatgcatgcacagggggactaatatattaatcgtgaccctgtvcctaagctagggtccctgcattttgaacctgtggacgtctg

SEQ ID NO: 966 - protein, 457 aa, Aspergillus aculeatus
MYQRALLFSFFLAAARAHEAGTVTAENHPSLTWQQCSSGGSCTTQNGKVVIDANWRWVHTTSGYTNCYTGNTWDTSICPDDVTCAQNCALDGADYSGTYGVTTSGNALRLNFVTQSSGKNIGSRLYLLQDDTTYQIFKLLGQEFTFDVDVSNLPCGLNGALYFVAMDADGNLSKYPGNKAGAKYGTGYCDSQCPRDLKFINGQANVEGWQPSANDPNAGVGNHGSSCAEMDVWEANSISTAVTPHPCDTPGQTMCQGDDCGGTYSSTRYAGTCDPDGCDFNPYQPGNHSFYGPGKIVDTSSKFTVVTQFITDDGTPSGTLTEIKRFYVQNGKVIPQSESTISGVTGNSITTEYCTAQKAAFGDNTGFFTHGGLQKISQALAQGMVLVMSLWDDHAANMLWLDSTYPTDADPDTPGVARGTCPTTSGVPADVESQNPNSYVIYSNIKVGPINSTFTAN

SEQ ID NO: 967 - DNA, 3459 bp, Thermoascus aurantiacus; identical to SEQ ID NO: 965

SEQ ID NO: 968 - protein, 457 aa, Thermoascus aurantiacus; identical to SEQ ID NO: 966

SEQ ID NO: 969 - DNA, 1697 bp, Trichoderma viride strain CICC 13038
gggctttatcctgtgctcccgaataccacatcgtgatgatgcttcagcgcacggaagtcacagacaccgcctgtataaaagggggactgtgaccctgtatgaggcgcaacatggtcacagcagctcacctgaagaggcttgtaaggccaccctctgtgtattgcaccatgattgtcggcattctcaccacgctggctacgctggccacactcgcagctagtgtgcctctagaggagcggcaagcttgctcaagcgtctggggccaatgtggtggccagaattggtcgggtccgacttgctgtgcttccggaagcacatgcgtctactccaacgactattactcccagtgtcttcccggcgctgcaagctcaagctcgtccacgcgcgccgcgtcgacgacttctcgagtatcccccacaacatcccggtcgagctccgcgacgcctccacctggttctactactaccagagtacctccagtcggatcgggaaccgctacgtattcaggcaacccttttgttggggtcactccttgggccaatgcatattacgcctctgaagttagcagcctcgctattcctagcttgactggagccatggccactgctgcagcagctgtcgcaaaggttccctcttttatgtggctagatactcttgacaagacccctctcatggagcaaaccttggccgacatccgcaccgccaacaagaatggcggtaactatgccggacagtttgtggtgtatgacttgccggatcgcgattgcgctgcccttgcctcgaatggcgaatactctattgccgatggtggcgtcgccaaatataagaactatatcgacaccattcgtcaaattgtcgtggaatattccgatatccggaccctcctggttattgagcctgactctcttgccaacctggtgaccaacctcggtactccaaagtgtgccaatgctccgtcagcctaccttgagtgcatcaactacgccgtcacacagctgaaccttccaaatgttgcgatgtatttggacgctggccatgcaggatggcttggctggccggcaaaccaagacccggccgctcagctatttgcaaatgtttacaagaatgcatcgtctccgagagctcttcgcggattggcaaccaatgtcgccaactacaacgggtggaacattaccagccccccatcgtacacgcaaggcaacgctgtctacaacgagaagctgtacatccacgctattggacctcttcttgccaatcacggctggtccaacgccttcttcatcactgatcaaggtcgatcgggaaagcagcctaccggacagcaacagtggggagactggtgcaatgtgatcggcaccggatttggtattcgcccatccgcaaacactggggactcgttgctggattcgtttgtctgggtcaagccaggcggcgagtgtgacggcaccagcgacagcagtgcgccacgatttgactcccactgtgcgctcccagatgccttgcaaccggcgcctcaagctggtgcttggttccaagcctactttgtgcagcttctcacaaacgcaaacccatcgttcctgtaaggctttcgtgaccgggcttcaaacaatgatgtgcgatggtgtggttcccggttggcggagtctttgtctactttggttgtctgtcgcaggtcggtagaccgcaaatgagcaact

SEQ ID NO: 970 - protein, 471 aa, Trichoderma viride strain CICC 13038
MIVGILTTLATLATLAASVPLEERQACSSVWGQCGGQNWSGPTCCASGSTCVYSNDYYSQCLPGAASSSSSTRAASTTSRVSPTTSRSSSATPPPGSTTTRVPPVGSGTATYSGNPFVGVTPWANAYYASEVSSLAIPSLTGAMATAAAAVAKVPSFMWLDTLDKTPLMEQTLADIRTANKNGGNYAGQFVVYDLPDRDCAALASNGEYSIADGGVAKYKNYIDTIRQIVVEYSDIRTLLVIEPDSLANLVTNLGTPKCANAPSAYLECINYAVTQLNLPNVAMYLDAGHAGWLGWPANQDPAAQLFANVYKNASSPRALRGLATNVANYNGWNITSPPSYTQGNAVYNEKLYIHAIGPLLANHGWSNAFFITDQGRSGKQPTGQQQWGDWCNVIGTGFGIRPSANTGDSLLDSFVWVKPGGECDGTSDSSAPRFDSHCALPDALQPAPQAGAWFQAYFVQLLTNANPSFL

SEQ ID NO: 971 - DNA, 1746 bp, Trichoderma viride
tttgaggcacagaaacccaatagtcaaccgcggactgcgcatcatgtatcggaagttggccgtcatctcggccttcttggccacagctcgtgctcagtcggcctgcactctccaatcggagactcacccgcctctgacatggcagaaatgctcgtctggtggcacgtgcactcaacagacaggctccgtggtcatcgacgccaactggcgctggactcacgctacgaacagcagcacgaactgctacgatggcaacacttggagctcgaccctatgtcctgacaacgagacctgcgcgaagaactgctgtctggacggtgccgcctacgcgtccacgtacggagttaccacgagcggtaacagcctctccattggctttgtcacccagtctgcgcagaagaacgttggcgctcgcctttaccttatggcgagcgacacgacctaccaggaattcaccctgcttggcaacgagttctctttcgatgttgatgtttcgcagctgccgtgcggcttgaacggagctctctacttcgtgtccatggacgcggatggtggcgtgagcaagtatcccaccaacaccgctggcgccaagtacggcacggggtactgtgacagccagtgtccccgcgatctgaagttcatcaatggccaggccaacgttgagggctgggagccgtcatccaacaacgcgaacacgggcattggaggacacggaagctgctgctctgagatggatatctgggaggccaactccatctccgaggctcttaccccccacccttgcacgactgtcggccaggagatctgcgagggtgatgggtgcggcggaacttactccgataacagatatggcggcacttgcgatcccgatggctgcgactgggacccataccgcctgggcaacaccagcttctacggccctggctcaagctttaccctcgataccaccaagaaattgaccgttgtcacccagttcgagacgtcgggtgccatcaaccgatactatgtccagaatggcgtcactttccagcagcccaacgccgagcttggtagttactctggcaacgggctcaacgatgattactgcacagctgaggaggcagaattcggcggatcctctttctcagacaagggcggcctgactcagttcaagaaggctacctctggcggcatggttctggtcatgagtctgtgggatgattactacgccaacatgctgtggctggactccacctacccgacaaacgagacctcctccacacccggtgccgtgcgcggaagctgctccaccagctccggtgtccctgctcaggtcgaatctcagtctcccaacgccaaggtcaccttctccaacatcaagttcggacccattggcagcaccggcgaccctagcggcggcaaccctcccggcggaaacccgcctggcaccaccaccacccgccgcccagccactaccactggaagctctcccggacctacccagtctcactacggccagtgcggcggtattggctacagcggccccacggtctgcgccagcggcacaacttgccaggtcctgaacccttactactctcagtgcctgtaaagctccgtggcgaaagcctgacgcaccggtagattcttggtgagcccgtatcatgacggcggcgggagctacatggccccgggtgatttattttttttgtatctacttctgacccttttcaaatatacggtcaactcatctttcactggagatgcggc

SEQ ID NO: 972 - protein, 514 aa, Trichoderma viride
MYRKLAVISAFLATARAQSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWDPYRLGNTSFYGPGSSFTLDTTKKLTVVTQFETSGAINRYYVQNGVTFQQPNAELGSYSGNGLNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGDPSGGNPPGGNPPGTTTTRRPATTTGSSPGPTQSHYGQCGGIGYSGPTVCASGTTCQVLNPYYSQCL

SEQ ID NO: 973 - DNA, 295 bp, Piromyces sp. E2
  misc_feature (33)..(33): n is a, c, g, or t
aaccgtcaatgctcttccggtctcaagctttangttacccatgttgtacttctacttccgatgttgcctacgttgatggtgatggtaattggggtgttgaaaatggtaactggtgtggtattattgctggtggtaattcaagcaacaacaacagtagtagtactattaatgttggtgatgttactattggtaatcaatacactcacactggtaatccattcgctggtcacaaattcttcattaatccatattacactgctgaattcgatggtgccatcgccccttggtcacccca

SEQ ID NO: 974 - protein, 97 aa, Piromyces sp. E2
  misc_feature (11)..(11): Xaa can be any naturally occurring amino acid
PSMLFRSQALXYPCCTSTSDVAYVDGDGNWGVENGNWCGIIAGGNSSNNNSSSTINVGDVTIGNQYTHTGNPFAGHKFFINPYYTAEFDGAIAPWSP

SEQ ID NO: 975 - DNA, 1383 bp, Phanerochaete chrysosporium
atgttcaagaaagtcgccctcaccgctctctgcttcctcgccgtcgcacaggcccaacaggtcggtcgcgaagtcgctgaaaaccacccccgtctcccgtggcagcgttgcactcgcaacggcggatgccagactgtctctaacggtcaggtcgtcctcgacgccaactggcgatggctccacgtcaccgatggctacaccaactgctacaccggtaactcctggaacagcaccgtctgctccgaccccaccacctgcgctcagcgatgcgctctcgagggtgccaactaccagcaaacctacggtatcaccaccaacggagacgccctcaccatcaagttcctcacccgatcccaacaaaccaacgtcggtgctcgtgtctacctcatggagaacgagaaccgataccagatgttcaacctcctcaacaaggagttcaccttcgacgttgacgtctccaaggttccttgcggtatcaacggtgccctctacttcatccagatggacgccgatggtggtatgagcaagcaacccaacaacagggctggtgctaagtacggtaccggctactgcgactctcagtgcccccgtgacatcaagttcattgacggcgtggccaacagcgccgactggactccatccgagaccgatcccaatgccggaaggggtcgctacggcatttgctgcgccgagatggatatctgggaggccaactccatctccaatgcctacaccccccacccttgccgaacccagaacgatggtggctaccagcgctgcgagggccgcgactgcaaccagcctcgctatgagggtctttgcgatcctgatggctgtgactacaaccccttccgcatgggtaacaaggacttctacggacccggaaagaccatcgacaccaacaggaagatgaccgtcgtcacccaattcatcacccacgacaacaccgacactggcaccctcgttgacatccgccgcctctacgttcaagacggccgtgtcattgccaaccctcccaccaacttccccggtctcatgcccgcccacgactccatcaccgagcagttctgcactgaccagaagaacctcttcggcgactacagcagcttcgctcgtgacggtggtctcgctcacatgggtcgctccctcgccaagggtcacgtcctcgctctctccatctggaacgaccacggtgcccacatgttgtggctcgactccaactaccccaccgacgctgaccccaacaagcccggtattgctcgtggtacctgcccgaccactggtggcaccccccgtgaaaccgaacaaaaccaccctgatgcccaggtcatcttctccaacattaaattcggtgacatcggctcgactttctctggttactaa

SEQ ID NO: 976 - protein, 460 aa, Phanerochaete chrysosporium
MFKKVALTALCFLAVAQAQQVGREVAENHPRLPWQRCTRNGGCQTVSNGQVVLDANWRWLHVTDGYTNCYTGNSWNSTVCSDPTTCAQRCALEGANYQQTYGITTNGDALTIKFLTRSQQTNVGARVYLMENENRYQMFNLLNKEFTFDVDVSKVPCGINGALYFIQMDADGGMSKQPNNRAGAKYGTGYCDSQCPRDIKFIDGVANSADWTPSETDPNAGRGRYGICCAEMDIWEANSISNAYTPHPCRTQNDGGYQRCEGRDCNQPRYEGLCDPDGCDYNPFRMGNKDFYGPGKTIDTNRKMTVVTQFITHDNTDTGTLVDIRRLYVQDGRVIANPPTNFPGLMPAHDSITEQFCTDQKNLFGDYSSFARDGGLAHMGRSLAKGHVLALSIWNDHGAHMLWLDSNYPTDADPNKPGIARGTCPTTGGTPRETEQNHPDAQVIFSNIKFGDIGSTFSGY

SEQ ID NO: 977 - DNA, 519 bp, Aspergillius sp.
gagatggacatatgggaggccaacagcatctccacggccttcacgccccacccctgcgatgtccccggccaggtgatgtgcgagggcgactcctgcggtggcacctacagcagcgaccgctatggcggcacctgcgatcccgatggatgtgacttcaactcctaccgccagggcaacaagtccttctacggccccggcatgaccgtcgacaccaacagcaaggtcaccgtcgtgactcagttcctcaccgacgacggcactgccaccggcaccctgtcggagatcaagcggttctacgtgcagaacggcaaggtcatccccaactccgagtcgacctggcccggcgtcggcggcaactccatcaccaccgactactgtctggcccagaagagcctcttcggcgataccgacgtcttcaccaagcacggcggtatggagggcatgggcgccgccctcgccgagggcatggtcctcgtcctgagtctctgggacgaccaccactccaacatgctctggctg

SEQ ID NO: 978 - DNA, 1371 bp, Pseudoplectania nigrella
atgctatccaatctccttctctcactctctttcctttccctagcctccgggcaaaacatcggtaccaacaccgccgaaagccacccccaacttcgttctcaaacctgcaccaaaggcaacggatgcagcacccaatccacctccgtagtcctggactccaactggcgctggctgcacaataatggaggttcaacgaactgctacaccggcaattcctgggactctacattatgtcccgacccagttacctgcgccaagaactgtgctctcgacggtgccgactattctgggacatacggaatcacctctacgggagatgctttgacgttgaagtttgttactcagggtccttattcgactaatattggatctcgggtatacctaatggcgagtgatactcagtataagatgttccagctcaagaacaaggagtttacgtttgatgttgatgtctctaatcttccttgtggattaaacggagcgttgtattttgtggagatggatgcggatggaggaatgtcgaaatacccgtctaataaagccggggcaaaatatggaaccgggtattgtgatgcgcagtgtccacatgatatcaaatttatcaacggggaggcaaatctcctagactggacgccttcaaccagcgacaaaaatgccggctccggacgttacgggacctgttgtcaagaaatggacatctgggaagccaacagcatggcaaccgcctatacaccgcatccctgtagtgtctcaggacctacccgatgctcaggaacccaatgtggggatggttctaaccgtcataacggaatttgcgataaagatggctgcgatttcaattcctaccgtatgggcaatacgacattcttcggcaagggagcaacggttaacaccaactccaaatttactgttgtaacgcaattcatcacctccgacaacacctcaactggagcgctaaaggagattcgtcgtctttatattcagaatggaaaagtcatccagaactcgaaaagtaatatctccggcatgtcagcttacgactctataaccgaggatttctgtgccgctcaaaaaaccgcatttggagacacaaatgactttaaggcaaagggcggatttacaaaccttgggaatgcgttgcaaaagggaatggttttggcgttgagtatttgggatgatcatgctgcgcagatgctttggttggatagttcttacccgctcgataaagacccttctcaaccaggtgttaagaggggcgcgtgtgctacctcttctggtaaaccgtcggatgtcgagaaccagtctccgaatgcgtcggtgactttttcgaacattaagtttggggatattggatcgacttattcctcttag

SEQ ID NO: 979 - protein, 456 aa, Pseudoplectania nigrella
MLSNLLLSLSFLSLASGQNIGTNTAESHPQLRSQTCTKGNGCSTQSTSVVLDSNWRWLHNNGGSTNCYTGNSWDSTLCPDPVTCAKNCALDGADYSGTYGITSTGDALTLKFVTQGPYSTNIGSRVYLMASDTQYKMFQLKNKEFTFDVDVSNLPCGLNGALYFVEMDADGGMSKYPSNKAGAKYGTGYCDAQCPHDIKFINGEANLLDWTPSTSDKNAGSGRYGTCCQEMDIWEANSMATAYTPHPCSVSGPTRCSGTQCGDGSNRHNGICDKDGCDFNSYRMGNTTFFGKGATVNTNSKFTVVTQFITSDNTSTGALKEIRRLYIQNGKVIQNSKSNISGMSAYDSITEDFCAAQKTAFGDTNDFKAKGGFTNLGNALQKGMVLALSIWDDHAAQMLWLDSSYPLDKDPSQPGVKRGACATSSGKPSDVENQSPNASVTFSNIKFGDIGSTYSS

SEQ ID NO: 980 - DNA, 1523 bp, Orpinomyces sp. PC-2
aaaaattaaattttgtaatatttttttatttgatataaaaaaaatattagtaaattttttataaacctttttctaattatttaaaaaaagcacaatgaaaattttactttttgccagtattcttagttttggtcttgtaaattttgctaacgctgcttgtggtggtgcttatgctcaatgtggaggtgaaaacttttacggtgaaaaatgttgtgtttctggttacaaatgtgtttatatgaatcaatggtattctcaatgtcaaccaggtgcttcatcatcaaatccaccttctaataatgcttctaacaataataacaatgataacaacaacaacaacaacaataataataataataataataataataataataataataataactctggtagtggaagtactcaaaacttcttcactaatcaaatttatgctaatccaaaattcattgaagaagtcaattcttctattccaaaattaagttgggacttacaacaaaaggctcaaaaggttaaggatgttccaactgctgtttggttagcttgggaaggtgctccaggtgaagttgaacaacatcttaaggctgctggttctaaaactgttgtatttattctttacatgattccaactcgtgattgtaatagtaatgcttctgctggtggtgccggtagtcttaacacttacaagggttatgttgacaacatttctagaactattcgtagttatccaaactctaaggttgttatggttcttgaaccagatactcttggtaatcttgttactggtaacagtgctaactgtcaaaacgtccgtcaattacacaagaacgctttatcctatgctgttaatgtttacggtgctatgaataatgttagtgtttaccttgatgctgcccatggtaaatggttaggtggtgttactgataaggttgctgctgttgttaaggaaatcttaaacaatgctccaaatggtaaaattcgtggtttaagtactaacgtttctaactaccaaccaattgcttctgaatactcctaccaccaaaagcttgcttcctctctttctgctgttggtattccaaacatgcactttattgttgatactggccgtaatggtgttgatgttagtgctgctttcaatacatctgaaacttggtgtaactttgtaggtactggttttggtgaacgtccaagaggtaatccaaactcaggtatgccattattagatgcttacatgtggcttaagactccacgagaatctgatggttcttcctctggtagtagagctgatccagtttgttctcgttctgattctcttagaggtgcaccagacgcaggtcaatggttccacgattatttcgttcaattattaagaaatgctagaccaggattctaagttaattaagaagaaaaaaaaagatgataaaaaaatttcagtattaattattctttttactattactaattaaatgaataatagataaaatatatactatatatcatttattgatgatataaagtttggc

SEQ ID NO: 981 - protein, 432 aa, Orpinomyces sp. PC-2
MKILLFASILSFGLVNFANAACGGAYAQCGGENFYGEKCCVSGYKCVYMNQWYSQCQPGASSSNPPSNNASNNNNNDNNNNNNNNNNNNNNNNNNNNNSGSGSTQNFFTNQIYANPKFIEEVNSSIPKLSWDLQQKAQKVKDVPTAVWLAWEGAPGEVEQHLKAAGSKTVVFILYMIPTRDCNSNASAGGAGSLNTYKGYVDNISRTIRSYPNSKVVMVLEPDTLGNLVTGNSANCQNVRQLHKNALSYAVNVYGAMNNVSVYLDAAHGKWLGGVTDKVAAVVKEILNNAPNGKIRGLSTNVSNYQPIASEYSYHQKLASSLSAVGIPNMHFIVDTGRNGVDVSAAFNTSETWCNFVGTGFGERPRGNPNSGMPLLDAYMWLKTPRESDGSSSGSRADPVCSRSDSLRGAPDAGQWFHDYFVQLLRNARPGF

SEQ ID NO: 982 - DNA, 1585 bp, Orpinomyces sp. PC-2
tttttttatattaattaaaataaaattcactggatgaatattttattttaaattatattaaaaaataactttgtctaaaaaaaaaaaaaaaaaagaatatataaaaaaaaaattatatattaattataataaattgcaaataaaaaaaaaagtcaataattataatatttatatatatacaaaagagattaaaaaaaaaaaaaaaatgaaattcttaacaatcgcttcattatttattgctggtactttagcttctcaatgccatccaaactatccttgctgtcaaaattgtggtgaagtattttatacagatagtgatggccaatggggaattgaaaataatgactggtgcttaattcaaccatctaaatgtaattcaaatcaatcctgtaaattcaatgctcttggttactcatgctgttctcactgtaactccgtttactctgacaatgatggtcaatggggtattgaaaatggtaattggtgtggtcttaaggattctggcttcggtaatgttactccaaccaccacaagaaattctaacccaaccacttctgtcaataccaatgatccagataacttcttcaacaacagaatctattgtaatgatgatcgtaagaaacgtgtccaaagctctattaaccaattaagtggtgaattaagagctaaggctgaaaagataaaggatgttccaactgccctttggttatcttgggatagagctccagaatctgtttcaggtcatcttagccaagctggtgatcaaactgcagttttcatcttatattggattccaactcgtgattgtaacagttatgcttctcaaggaggagctcaagacatgaatcgatatcaacaatatgttcaaagaatttacaatgccttcagaagttatccaaatagtaaaattgttgttgtcattgaaccagatactcttggtaacatggtcacttctcaaagtaaccaacattgtagagacgttcatgaccttcataagcaagccattgcctatgccctcaacactttaggttctctcaacaatgttagagcctacatagatgctgcccatggtcgttggttaggtcctcataccgatgaagttgccaaaatcattaaggatattgttagtatggctccacaaggtaagcttcgtggtttatccactaatgtctccaactatcaatccaccagggatgaatatgcctatcatcaaaagcttaattctgcacttgaaaatgttggtattcgtaatatgaagtttattgtagatactgctcgtaatggtgttgatgttgctgaatccttagttcgtactggtacctggtgtaatgtcattggcactggttttggtgaacgtccaaagggtactccagatccagtcaacatgccattattagatgcctacatgtggttaaagccaggaggtgattctgatggttcttccagtggtccatatgctgatccaaattgtgctcattcagattccttaccaggagctggtaatgctggagattggttccatgaatactttgttcaattaattaagaatgccaatccaccaattcaagcttaaaaataattaaaa

SEQ ID NO: 983 - protein, 455 aa, Orpinomyces sp. PC-2
MKFLTIASLFIAGTLASQCHPNYPCCQNCGEVFYTDSDGQWGIENNDWCLIQPSKCNSNQSCKFNALGYSCCSHCNSVYSDNDGQWGIENGNWCGLKDSGFGNVTPTTTRNSNPTTSVNTNDPDNFFNNRIYCNDDRKKRVQSSINQLSGELRAKAEKIKDVPTALWLSWDRAPESVSGHLSQAGDQTAVFILYWIPTRDCNSYASQGGAQDMNRYQQYVQRIYNAFRSYPNSKIVVVIEPDTLGNMVTSQSNQHCRDVHDLHKQAIAYALNTLGSLNNVRAYIDAAHGRWLGPHTDEVAKIIKDIVSMAPQGKLRGLSTNVSNYQSTRDEYAYHQKLNSALENVGIRNMKFIVDTARNGVDVAESLVRTGTWCNVIGTGFGERPKGTPDPVNMPLLDAYMWLKPGGDSDGSSSGPYADPNCAHSDSLPGAGNAGDWFHEYFVQLIKNANPPIQA

SEQ ID NO: 984 - DNA, 4023 bp, Talaromyces emersonii
  misc_feature (3947)..(3947): n is a, c, g, or t
  misc_feature (3978)..(3978): n is a, c, g, or t
cttagcaaaggatttaactattatgctgcgtaatgtgaagcggtctgtagtacagaatagaagatgatggatgatcctcacagaacaccgccgatcccgttccgggtcgctattttaataccgtaccgatttccgagtgaagccggtgtgggactcgggagtgagacatgccgcccaatagtctggaactctacgatcctgctggaacagcgccgccaccaccatcaaagaccttggaacagttgagattttttctatcgctgtagactatctgacagcagattgtagagattgtttcaagatctgttgagagggacagctattgataatctcccggcaacgggccccggagtgtatatggtatcggaccctacccaaggtgtctggaatcattggcctagttgatacggattacgttgacacttagcagaacagcttacagcttacggagtacagagtacagctggagggtttgctgggccttaaatgcggcactttgtgtagacaatgccgtcatcaattggccgtgttacgcagcttacgccagcagatggcttggacgctgctaattttagatctaaagcccgaatcggattagcgcctgacgtgttaaccttaagtgccgccaatcctattctggttgcagatatagggtttagggtttagggttgaggattgcagacaagggctagggctaagggctagggttgagttggtcactgggcatcgccattagctcgtcatggtgagtttgaataggttagcaacctctttgccctggaaaaccagcctgccgagatgcgcacatgctccgaagaccactggtgattgggaacatgacctccaactgtcagtaatcgggtatgaacatcgtcaggacatggcagagactggaggaagatgaaatctgaagagctcctcgggcacgcgtttgacatcgcaaatccgctagcgccgttgagaacgacacgcatcggaatgtcgggaacagctgtcttcacaggccagaatgatgcctgcctatgcctttccgtttaaaaatttcttcctcgtcaccgtctttgaaaggggctcgaagagggtctggcaaccttattaggtgtctcgattcctagctacgggattaacgtttgactggattgttctcgcatgctgagctatgtaaccgtgcgctgctggaaaggtatacgacgacttcgccgtttatccggaccacgggtctggtcaattgctctgcgcgtggcgctcgctctgcaaccttatgatggtctgcattcaggttatgcaacagcatattctctcagatgaggcaacactaagaagcgacacgaatagccaagcatctccgtgcccgagttggcaagggggccaggctcccctcgttgccattgatggaatttagtcgcaccccgcattgcgggatcgaccgtggcgtgagattttcatccccccgacgcctcgcgtttattaaggcggtccctgagactaatcctgccaaactcccccttctccagcttaaacagtcgtccaatcgtcgcgagcagcatccccgcatcggcagttgaccttaatttcccgaggtcccttatctgggccagacatgcggagtgtcgggagacgagtagtatctccagactgaccgaccagcaaccaaaaacgatcactctggtgatctgtcgacacggggagtctcgcacttcagcaaacaatggcatctcttcccatgaatcgatgcccaattcgggatggagatgtcgatcagatggagtataaaagggcagggtgaatccagggtccaggccatctgccatcactcagactcaaacactccatcagcagcttcgaaagcggtctttttgctatcatcatgcttcgacgggctcttcttctatcctcttccgccatccttgctgtcaaggcacagcaggccggcacggcgacggcagagaaccacccgcccctgacatggcaggaatgcaccgcccctgggagctgcaccacccagaacggggcggtcgttcttgatgcgaactggcgttgggtgcacgatgtgaacggatacaccaactgctacacgggcaatacctgggaccccacgtactgccctgacgacgaaacctgcgcccagaactgtgcgctggacggcgcggattacgagggcacctacggcgtgacttcgtcgggcagctccttgaaactcaatttcgtcaccgggtcgaacgtcggatcccgtctctacctgctgcaggacgactcgacctatcagatcttcaagcttctgaaccgcgagttcagctttgacgtcgatgtctccaatcttccgtgcggattgaacggcgctctgtactttgtcgccatggacgccgacggcggcgtgtccaagtacccgaacaacaaggctggtgccaagtacggaaccgggtattgcgactcccaatgcccacgggacctcaagttcatcgacggcgaggtatgtacagtggtaaaatcagatcgtctcgtgaacttctgctgacaggttcgatctacaggccaacgtcgagggctggcagccgtcttcgaacaacgccaacaccggaattggcgaccacggctcctgctgtgcggagatggatgtctgggaagcaaacagcatctccaatgcggtcactccgcacccgtgcgacacgccaggccagacgatgtgctctggagatgactgcggtggcacatactctaacgatcgctacgcgggaacctgcgatcctgacggctgtgacttcaacccttaccgcatgggcaacacttctttctacgggcctggcaagatcatcgataccaccaagcccttcactgtcgtgacgcagttcctcactgatgatggtacggatactggaactctcagcgagatcaagcgcttctacatccagaacagcaacgtcattccgcagcccaactcggacatcagtggcgtgaccggcaactcgatcacgacggagttctgcactgctcagaagcaggcctttggcgacacggacgacttctctcagcacggtggcctggccaagatgggagcggccatgcagcagggtatggtcctggtgatgagtttgtggggtacgtatacccatttctccccccagtaatacagaaactaatttcaactcagacgactacgccgcgcagatgctgtggttggattccgactacccgacggatgcggaccccacgacccctggtattgcccgtggaacgtgtccgacggactcgggcgtcccatcggatgtcgagtcgcagagccccaactcctacgtgacctactcgaacattaagtttggtccgatcaactcgaccttcaccgcttcgtgagtcttggttacatttgaagtagacggaagttgctctgcgatggaactggcatatggagaagaccacacaaaactgcatcgaagaaaagaggggggaaaagagaaaagcaaagttatctagtttgaaaatgaaactacgctcgtttttattcttgaaaatcgccactcttgccttttttttcttttttctttttattttttttccttttgaaatcttcaatttaaatgtacatattgttaaatcaaatcaagtaaatatacttgacatgtgacattcttaccaactttgagaaaccctcatattattggattattttactactactcaacacttatgcaaaaagctgactcgaagaaagacgaggaaaagaaaacctaaaatcaataagactgataataataatatgaaaatatgattcgacctaagaatatcctctctggtgctgtggtctattctgcatgaactggaactgaccgtgtaaataaccaactaatcaacctccctttccaattcattcatatacataaatgattaattaggtgcccactgtaataaaccaaacacaccaacagtcattcatggatcaattaggggtttanagaaaatgggaaaaaagaagggaaattggcngaatggccagccgatcaagtcatggtgattctcgatcccacccca

SEQ ID NO: 985 - protein, 455 aa, Talaromyces emersonii
MLRRALLLSSSAILAVKAQQAGTATAENHPPLTWQECTAPGSCTTQNGAVVLDANWRWVHDVNGYTNCYTGNTWDPTYCPDDETCAQNCALDGADYEGTYGVTSSGSSLKLNFVTGSNVGSRLYLLQDDSTYQIFKLLNREFSFDVDVSNLPCGLNGALYFVAMDADGGVSKYPNNKAGAKYGTGYCDSQCPRDLKFIDGEANVEGWQPSSNNANTGIGDHGSCCAEMDVWEANSISNAVTPHPCDTPGQTMCSGDDCGGTYSNDRYAGTCDPDGCDFNPYRMGNTSFYGPGKIIDTTKPFTVVTQFLTDDGTDTGTLSEIKRFYIQNSNVIPQPNSDISGVTGNSITTEFCTAQKQAFGDTDDFSQHGGLAKMGAAMQQGMVLVMSLWDDYAAQMLWLDSDYPTDADPTTPGIARGTCPTDSGVPSDVESQSPNSYVTYSNIKFGPINSTFTAS

SEQ ID NO: 986 - DNA, 4176 bp, Trichoderma viride
aagcttccatttggcggctgaataccctgagaatgaaaacacatcaggctgggtgatatccatgaagacaggtggtgaatatgtaatcacgtccgttctcctgaagggaaaccccttgtcgtggtcacatgcggctctttccatgtaagtcggatattcctaagtagcgatggagcggcagaatcaaataggcaatacagcgagtggctcgaactttttaaatgtcgggcgggttgctgcgcttcggcactagtagacattgtattccataccccgcccctgtttccgcgacctctgggattcccttgaatgatcaaattctcgcctctactacctaactcccactgagcctttacgtcttttgccattcatcctggtggaagttatcgcggtgtgtagggctacatgctaggtcaactggacgtgttggggcccggacccgaacctaattttatacaacgactttgattcagtctacagtaatgggacgtccccatatacagttgcacgtagggcacaacggtagagtacgttgggtgaattcgatatgatacgaggataaccccctgaatgtagagtctcacggcaaactctgaccgcgcggtgcgacctcacaaaacaatacaaacggatggctaaaagtacatgagttaatgcctaaagatgtcatataccagcggctaataattgtacaattaagtggctaaacgtaccgtaatttgccaatgacttgtagggttgcagaagcaacagtacagccccacttccccacgtttgccctcttacacgcaggtctaacctcaactgatgatctcccatctaagttctcttgttgttgtttagtctaagaggcaagtgtttacttcaggattttgtaaggcgtagcatgtaagaaataaacagaaagcagacgccaagaagcgagtttctggatgaaggcgtttgagagaaccttgcagggagttgtctgacaatagaaaaacaatggattgtcgcttctactcaggtgtctgtaattaaatgttactccgtcctgtacaggcaaaaaatatagtcgaatctgcctaagatctcgggccttcgggcctttaagtctacaggtcagtttggttatatgggcatttttgggtgtggtagcattgagggaaccactgcttttgccaaggagctgaacgtatgctgtaggcaaagctctaggtgccactgcatttgtgtcgaacataatgtgatgcttgggcaggcataatagccgccaaagatagcctcattgagcggaagtcggcgaacaggtgaagagcagaatatcacatatatatatggcccaaacgccgtgtccccttctccctttccccatctactcatcaactcagatcctccagaagacttgtacatcatcttttggggcatagcattctagtcgactacggactgcgcatcatgtatcaaaagttggccctcatctcggccttcttggctactgctcgtgctcagtcggcctgcaccctccaggcggaaactcacccgcctctgacatggcagaaatgctcatctggtggcacttgcacccaacagacaggctccgtggtcatcgacgcgaactggcgctggactcacgccaccaacagcagcacgaactgctacgacggcaatacttggagctcaaccctgtgccctgacaatgagacttgcgcgaagaactgctgcttggacggtgctgcctacgcgtccacgtacggagtcaccacgagcgctgacagcctctccattggcttcgtcactcagtctgcgcaaaagaacgtcggcgctcgtctctacttgatggcgagtgacacgacctatcaagaattcaccctgcttggcaacgagttctctttcgatgttgatgtttcgcagctgccgtaagtgaccaactacacctcttgatgccattctcgtattagttctcagctgactagcttatttaagatgtggcttgaacggagctctttacttcgtgtccatggacgcggatggtggcgtgagcaagtatcccaccaacactgccggtgccaagtacggcacgggctactgtgacagccagtgccctcgtgatctcaagttcatcaacggccaggccaatgttgagggctgggagccgtcctctaacaatgccaacacgggcattggcggacatggaagctgctgctctgagatggatatctgggaggccaattccatctctgaggctcttactcctcatccttgcacgaccgtcgggcaggaaatttgcgacggtgactcctgcggtggaacctactcgggtgaccgatatggcggtacttgcgaccctgatggctgcgattggaacccatatcgcttgggcaacaccagcttctatggccccggctccagcttcacgcttgacaccaccaagaagttgaccgtcgtcactcagttcgagacttcgggtgccatcaaccgatactatgtccagaatggcgtcactttccagcagcccaacgccgagctcggtgattactctggcaactcgctcgacgatgactactgcgcggctgaagaggcggagtttggcggctcctctttctcggacaagggcggccttactcaattcaagaaggctacttccggtggcatggtcctggtcatgagcctgtgggatgacgtgagttcaagaataacattcacattgtcaacagaatgacagaactgactgagagacgatagtactacgccaacatgctgtggctggactctacctacccgacgaacgagacctcctccacccccggtgccgtgcgtggaagctgctccaccagctccggtgttcctgctcagctcgagtccaactctcccaacgccaaggtcgtatactccaacatcaagttcggccccatcggcagcaccggcaactctagcggcggaaaccctcctggcggaaaccctcccggcaccacaaccacccgccgcccggctacctccactggaagctctcccggccctactcagacgcactatggccagtgcggtggaattggatactcgggccccaccgtctgcgcgagtggcagcacttgccaggtcctgaacccctactactctcagtgcttgtaaggtactgtggcaaaagcttgaggtactgctggcttatggatgagttcatctcattatggactagatggaggatttactttgctgtatctacttctgaggcttccaatatatacggttatttcacctttgctggaatgctcgctagcttggcaagcacggctttcgagagacggactgattctctgctaactatgcattatataagactgaaatagacaaaaaaggaaaaaagttgccactcgaattatcttgacggtgttgattatatgtatggcattgtaagggtttttcattgatatttctcccgccaatatggttctactcccatctccgcgaatctccttttctcgaaggccgtagtggcacgccaattggcaacaacccacagggagacgaaaaacatgatggcggcagccgaaatcagtggcgcaatgattgaaaacacggtgagaccgtagcttgcagcctggaaagcactgttggagaccagcttgtccgttgcgaggccgacttgcattgctgtcaagacgatggcaatgtagccgagcactgtcaccagggacgcaaagttgtcgcggataaggtctccgtagatggcgtagccagagattcgagaatagcctctcaaaaggtggccctttcgaaaccggtaaatcttgttcaagcgtcctaggcgcagctcgccgtaccagtagcggggattgacagcagaatagcagtgattctccaggacttgactggacaatatcttccagtactcccaagatacaatatccggcaagagtcccttctcacgtgcgaggcgaaagtcgctgtagtgcgcaatgagagcgcagtaggagaatagaaaccccctggcacattgttctacctcggcgtgtagtggatgactgtcgggcagaatgtgctgtctccagaatccgatgtctagtagatactctggcagaggcttcaggtgaatgcccttgggaccccagatgagatgcagctccggattctcagtaacgacgatctcgcgggagagcacgagttggtgatgaagagggcgaggaggcatgggtcgac

SEQ ID NO: 987 - protein, 514 aa, Trichoderma viride
MYQKLALISAFLATARAQSACTLQAETHPPLTWQKCSSGGTCTQQTGSVVIDANWRWTHATNSSTNCYDGNTWSSTLCPDNETCAKNCCLDGAAYASTYGVTTSADSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICDGDSCGGTYSGDRYGGTCDPDGCDWNPYRLGNTSFYGPGSSFTLDTTKKLTVVTQFETSGAINRYYVQNGVTFQQPNAELGDYSGNSLDDDYCAAEEAEFGGSSFSDKGGLTQFKKATSGGMVLVMSLWDDYYANMLWLDSTYPTNETSSTPGAVRGSCSTSSGVPAQLESNSPNAKVVYSNIKFGPIGSTGNSSGGNPPGGNPPGTTTTRRPATSTGSSPGPTQTHYGQCGGIGYSGPTVCASGSTCQVLNPYYSQCL

SEQ ID NO: 988 - DNA, 2716 bp, Geotrichum sp. M128
agcgcgcctcgtgcctcccccgatcaccaatggggccatgacgtgaatggaagaactgggtatgctccgtaatcgccccggtgttggctcatcgggccgcggtgtcggtgttgatacgagtacataattgggactgtcggtgcgattggcccccaacttcaccacacaacacctacacactctttagatatggtggcagtcacctccctcgggaaggcgcttactgccctttcgattctggcgtcgctcgcggtcgccaaggagcactacgagttcaagaatgtcgcgatcggcggcggcgggtacattaccgggattgtcgcgcacccaaagaccaaggacctgctgtacgcgcgcacggacattggcggcgcgtaccgctgggacgcaggcacgtccaagtggatcccgctcaacgactttatcgaggcgcaggacatgaacattatgggcaccgagtcgatcgcgctggaccccaacaaccccgacaggctgtacctcgcgcaggggcgctatgtcggcgacgagtgggcggcgttctatgtgtccgaagaccgcggccagtcgtttacaatctacgagtcgccgttcccgatgggcgccaacgacatgggacgcaacaatggcgagcgcctcgctgtcaacccgttcaactcgaacgaggtctggatgggtacgcgtacagagggtatctggaagagttcggaccgcgccaagacctggacaaacgtcacgtccatcccggacgcgttcaccaacggtatcggatacacgtcggtcattttcgaccccgaacgtaatggcaccatctacgcgagcgcgactgccccgcagggcatgtacgtcacgcacgacggcggtgtctcgtgggagccagtggcgggccagccgtccagctggctcaacaggaccacgggcgcgttcccggacaagaagcccgcgtcgatcgcgccgcagcccatgaaagtcgctctcacccccaacttcctctacgtgacttacgccgactaccctggtccatggggcgtcacgttcggcgaagtctggcgccagaaccgcacctcgggcgcctgggacgacattactccccgcgtcggcaactcgtcgcctgccccgtacaacaaccagacgttccctgcgggcggattttgcggtctcagcgtcgacgcgaccaaccccaaccgtctcgtcgtcatcaccctcgaccgcgaccccggacccgccctcgacagcatctacctctcaaccgatgccggcgcgacctggaaggacgtcacccagctctcgtccccgtccaacctcgaaggtaactggggccacccgactaacgcggcgcggtacaaggacggcacgcctgttccgtggctcgacttcaacaacggtccccagtgggggggatacggtgcgccgcacggtacgcccggcctcaccaagtttggctggtggatgagcgctgtgcttatcgatccgttcaaccccgagcacctgatgtacggcacgggggcgaccatctgggcgaccgacacgctctcccgtgtcgagaaggactgggcgccgagctggtacctccagatcgacggtatcgaggagaatgcgatcctgtcgctccgctcgcccaagagcggcgcggcgctcctgtcgggcatcggtgacattagcggcatgaagcacgacgacctcaccaagccccagaagatgtttggtgcgccccagttctccaacctcgacagcatcgacgctgcgggcaacttccccaacgttgtcgtccgcgccggatcctcgggacacgagtacgacagcgcgtgcgcgcgcggtgcgtacgcgactgacggcggagacgcgtggaccatcttccctacctgccctcctggcatgaacgcgagccactaccagggcagcacgattgcagtcgacgcgagcggcagccagatcgtgtggtcgaccaagcttgacgagcaggcctcgggaccgtggtactcgcacgactatggcaagacgtggtctgttcccgctggcgacctgaaggcccagactgccaatgtgctctcggacaaggtccaggatggcacgttctacgctaccgatggcggcaagttcttcgtctcgaccgacggcgggaagtcgtatgccgccaagggcgccggacttgtcactggcacatcgctcatgcctgccgtgaacccctgggtggccggcgacgtctgggtgcctgttcccgagggcggtctcttccactcgaccgactttggcgcctcgttcacgagggtaggtaccgccaacgcgaccctcgtgagcgtcggcgcccccaagtccaagtcggacggcaagaaggctagcgcgccctccgcggtcttcatctggggcaccgacaagcctggaagcgacatcggcctgtaccgctccgacgacaacggcagcacctggacgcgcgtcaatgaccaggagcacaactactcgggccccaccatgatcgaggccgaccccaaggtctacgggcgcgtgtatctaggcacgaacggccgcggtatcgtgtacgccgaccttaccaacaagaagagcaacgaggagaagtcgaccgcaaagtgcgccaacggccagaagggcacgcactgctatgtgaaaaagtaaatgggaaggaaagggcgaaagggacataccgcctggttatttaaatgcatctacatgttacttaaaaaaaaaaaaaaaaaaaaaaaaa

SEQ ID NO: 989 - protein, 812 aa, Geotrichum sp. M128 [sequence omitted]

SEQ ID NO: 990 - DNA, 3141 bp, Aspergillus oryzae
gatatcagtttaaccgggtaaaaatgtggagattaaattgcgaggttgcagtccccggtggctatactagcacgtggtctcctgcatgtcagactggagaccatcacacttggatatggcacctcaactcatttccccagttttcctcttagattaattgaggggtcatgaacagccacccagcagaactgtgtggcggaagcatagctacagcttagatgatgatatccgattcagtatggaggagatgccatgggtggaaataccaacctgtggccttgctctctggcttgaatctcgatggttatgaaacagggccgctgtttcttgacgatttcctctaccgcacgacggatcatctgatcgatcatctaatagacgcctggcccagaagtgcgagaagtccgtatgactagtccatcccaagattccgcagcctttcctattacgatgaggagcaagagactacggggcaaagtgtccagattctgcacaacgtgaagctcgccgctaggtcttagccactggaaatacgaacctgtttaggctcagtgcgaactgatttccgctcttttctttgcttcaatagaggttattctgttttcatcacggagaatgagctgcttgtgtctccaaatattgttcctccaacggaccggcggtccttcgatccggcggaaaaatcctcaagtttgcacgatacgatgatgtctgagccgggcagggcatctatataaggatgacttctttctcgagttcttcgatatctctcatgaaatccaagcaccggcaaagctttgtggagtcaagatggcttccctttccctctccaagatctgccgcaatgccctcatcttgtcctcagttctgtcaactgcccagggtcagcaggttgggacttaccagaccgaaacccatccctcgatgacctggcagacatgcggtaacggcggtagttgcagcaccaaccaaggctccgttgtcctcgatgccaactggcgttgggtccaccaaactggaagctctagcaattgttacaccggcaacaagtgggatacttcctactgcagtaccaatgacgcatgtgcccagaaatgtgccctggatggtgccgactactcaaacacttacggcatcaccaccagcggcagtgaggtccgtctcaactttgtcaccagcaactccaacggaaagaacgtcggttcccgtgtctacatgatggccgacgatacccattacgaggtttacaagctgctgaaccaagagtttacctttgatgtggacgtctccaagctcccatgtggtcttaatggcgctttgtacttcgtcgtaatggatgccgatggaggtgtttccaaatatccaaacaacaaagcgggtgctaagtacggtactggttactgtgactctcaatgcccacgggatctcaaatttatccagggacaggccaatgtcgaaggctgggtatcgtcaaccaacaatgccaatacaggcactggaaaccatggctcctgctgcgcggagctggacatatgggagtccaacagcatttcgcaggctctcactcctcacccatgcgatacgccgaccaacactctatgcactggggatgcctgcggtggcacatatagttccgatcgctacagtggcacgtgtgatcctgacggttgcgacttcaacccatatcgtgtgggcaacaccaccttctacggccctggcaagacaattgataccaacaaaccgatcacagttgtgacccagttcatcaccgacgacggcacttccagcggcaccctatccgagattaaacggttctacgtgcaagatggcgtcacgtacccccagcccagcgcagacgttagcggtctcagcggcaacaccatcaactctgagtattgcaccgcggagaataccctgttcgaaggctcgggcagcttcgcgaaacatggtgggctcgccggtatgggtgaagccatgtcgactggcatggtgctggttatgagcttgtgggatgattactatgccaacatgctctggcttgacagcaactaccccaccaacgagtccacgagcaagcccggcgtggcccgtggaacttgttccacgtcgtctggcgttcctagcgaggtcgaagcctccaaccctagcgcctatgtggcctattccaacattaaagttggccctatcggctccaccttcaagagctgatctccggggcggatctccataccttgcaggtgatgaactttatctactttgagtgcttctcgctcactgtgggtggtcgctatgatcaaatgtgtttcgccatcgctatgttaggaggaatatcaagtgtattgagaagcaagagaaatgtacggtgacgctgttgtagccaggagaatatgcaatgaatatgacgtcgttgagatctaaagtccttaccgcccagaaccctgtggagaatcccgcatagagcttccttttcggatcatgccgagcggatgctttctcagctgctgtcattcaaaatgatccagtgaccaccggccaatttacctcaattctcgtagatttctttcctttgccgtcgccacattttcctgccgggaatagatcatactgtacctcagaacaaccatatctatcctcacccggtaagtctattcgcccataggaagttcccgacgctcatctgtatttaaggttggcacccacacgagtacaattcaataaactcaaatccatactccctgtcactatgaccgtggaagttgttcccctcacagaagccgacatacccgaggcgatcgaagttatccaacaagcgttcgcagaggacccatatttccaatgggttttcgatccctccaaggtgagttctgatcaacggacaaaaccaccatttccagagtcccaaaactcaagcccggctatcacaacacaaggcaagcaatcccaccacagaaacaatagctaacgaacagcggcccatcaacgcggtcgaggtcaaccaccgaccgacgtgatggacaagctatgcctggaacacagttcaacaagcaaagaaactatgattctctcgcagcacggtgcctctgggggatcaacaacgccctgttccacgtcgccaaggaaaccggggagaatggcgtcgac

SEQ ID NO: 991 - protein, 465 aa, Aspergillus oryzae
MASLSLSKICRNALILSSVLSTAQGQQVGTYQTETHPSMTWQTCGNGGSCSTNQGSVVLDANWRWVHQTGSSSNCYTGNKWDTSYCSTNDACAQKCALDGADYSNTYGITTSGSEVRLNFVTSNSNGKNVGSRVYMMADDTHYEVYKLLNQEFTFDVDVSKLPCGLNGALYFVVMDADGGVSKYPNNKAGAKYGTGYCDSQCPRDLKFIQGQANVEGWVSSTNNANTGTGNHGSCCAELDIWESNSISQALTPHPCDTPTNTLCTGDACGGTYSSDRYSGTCDPDGCDFNPYRVGNTTFYGPGKTIDTNKPITVVTQFITDDGTSSGTLSEIKRFYVQDGVTYPQPSADVSGLSGNTINSEYCTAENTLFEGSGSFAKHGGLAGMGEAMSTGMVLVMSLWDDYYANMLWLDSNYPTNESTSKPGVARGTCSTSSGVPSEVEASNPSAYVAYSNIKVGPIGSTFKS

SEQ ID NO: 992 - DNA, 1680 bp, Fusarium oxysporum
agaccggaattcgcggccgccatctatccaacggtctagcttcacttcacaatgtatcgcatcgtcgcaaccgcctcggctcttattgccgctgctcgggctcaacaggtctgctctttgaacaccgagaccaagcctgccttgacctggtccaagtgtacatccagcggctgcagcgatgtcaagggctccgttgttattgatgccaactggcgatggactcaccagacttctgggtctaccaactgttacaccggaaacaagtgggacacctccatctgcactgatggcaagacctgcgccgaaaagtgctgtcttgatggcgccgactattctggtacctacggaatcacctccagcggcaaccagctcagtcttggattcgtcaccaacggtccctacagcaagaacatcggcagccgaacctacctcatggagaacgagaacaccatccagatgttccagcttctgggcaacgagttcacctttgatgtcgatgtctctggtatcggctgcggtctgaacggtgcccctcacttcgtcagcatggacgaggatggtggcaaggccaagtactccggaaacaaggccggagccaagtacggaactggctactgtgatgcccagtgccctcgtgatgtcaagttcatcaacggagttgccaactctgagggctggaagccctctgacagtgatgtcaacgctggtgttggtaatctgggcacctgctgccccgagatggatatctgggaggccaactccatctccaccgccttcactcctcatccttgcaccaagctcacacagcactcttgcactggcgactcttgtggtggaacctactctagtgaccgatatggcggtacttgcgatgccgacggttgtgatttcaatgcctaccgtcagggcaacaagaccttctacggtcctggatccaacttcaacatcgacaccaccaagaagatgactgttgtcactcagttccacaagggcagcaacggacgtctttctgagatcacccgtctgtacgtccagaacggcaaggtcattgccaactcagagtccaagattgcaggcaaccccggtagctctctcacctctgacttctgctccaagcagaagagcgtctttggcgatatcgatgacttctctaagaagggtggctggaacggcatgagcgatgctctctctgcccctatggttcttgttatgtctctctggcacgaccaccactccaacatgctctggctggactctacctacccaaccgactctaccaaggttggatctcaacgaggttcttgcgctaccacctctggcaagccctccgaccttgagcgagatgttcccaactccaaggtttccttctccaacatcaagttcggtcccatcggaagcacctacaagagcgacggcaccacccccaacccccctgccagcagcagcaccactggttcttccactcccaccaacccccctgccggtagcgtcgaccaatggggacagtgcggtggccagaactacagcggccccacgacctgcaagtctcctttcacctgcaagaagatcaacgacttctactcccagtgtcagtaaaggggctgccgagctatctagcatgagattgagaaacgatgtgatgagtggacgatcaaggagaagtgtgtggatgatatgaac

SEQ ID NO: 993 - DNA, 2369 bp, Talaromyces emersonii
  misc_feature (298)..(298): n is a, c, g, or t
gacggacctgcacttagtcggtaggttatgtatgtagctggagattgggatagggaagttagctaatagtctacttcgtgtgagggttgattttgatggtcgacagtattcgtttcttatacgcagcgtcatggatctgtgtttctgtcacatgtcgggtggatggttcctggacagcagcacacaaatggtgttctgtagataggcgatactcggcaggggattgtgcaggggattgtatcgtagatggttctagtaaaatagatcccgagtatggttagctctcatacctcgagtngatgaagcacaatatgctacgatatgccaagtaaaactctattgtattctgcagctagcaattgaagaatccgacattcccattgtcatctaatcgggcagacatgtgcaaagagggacgattcgtgatcgaagtgctccaatccatggcgtaggaccagacagctccatccgatctagagctatatggagctcctcgcaactccgacactccgcgagacagctctcacaagcactataaatatggccaagaaccctgcagaacagcttcactctacagcccgttgagcagaacaaacaaaatatcactccagagagaaagcaacatgcggaatcttcttgctcttgcaccggccgcgctgcttgtcggcgcagcggaagcgcaacaatccctctggggacaatgtgagcagctcctaaacgtctgtctgagggattatgtctgactgctcaggcggcgggagttcgtggactggcgcgacgagctgtgctgctggagcgacgtgcagcacaatcaatccttgtacgtctgctgaacgataatcctacattgttgacgtgctaactgcgtagactacgcacaatgcgttcctgcaacggccactccgaccacgctgacgacaacgacaaaaccaacgtccaccggcggcgctgctccaacgactcctcctccgacaacgactggaacaacgacatcgcccgtcgtcaccaggcccgcgtctgcctccggcaacccgttcgaaggctaccagctctacgccaatccgtactatgcgtcggaggtgattagtttggcaattccctcgctgagcagcgagctggttcccaaggcgagcgaggtggccaaggtgccgtctttcgtctggctgtaagtaaattcccccaggctgtcatttccccttactgatcttgtccagcgaccaagccgccaaggtgcccagcatgggcgactatctgaaagacatccagtcgcagaacgcagccggcgcagaccccccgattgcaggcatctttgtcgtctacgacctgcctgaccgcgactgcgcggctgcagccagcaatggcgagttctccatcgccaacaacggcgtcgccctgtacaagcagtacatcgactcgatccgcgagcagctgacgacctattcagatgtgcacaccatcctggtcatcggtagttccagtcctcttctgtgatgttgatgaaaaaaatactgactgactcctgcagaacccgacagccttgcgaacgtggtcaccaacctgaacgtgccgaaatgcgcaaatgcccaggacgcctatctcgaatgcatcaactacgccatcacccagctcgatctgccaaacgtggccatgtatcttgatgctggtgagtcctcacatacaagtgaataaaaataaaactgatgcagtgcaggacacgccggatggctaggctggcaagccaacctcgcccccgccgcccagctgtttgcctcggtgtacaaaaacgcctcctctccggcatccgtccgcggtctcgccaccaacgtcgccaactacaacgcctggtcgatcagccggtgcccgtcgtacacgcagggcgacgccaattgcgacgaggaggattacgtgaatgccttggggccgttgttccaggaacagggattcccggcatattttatcattgatacatgtaagctttaccccagaacccctccatagaaggtcaatctaacggtaatgtacagcccgcaatggcgtccgacccaccaagcaaagccaatggggcgactggtgcaacgtcatcggcacgggcttcggcgtccggcccacgaccgacaccggcaatcctctcgaggacgctttcgtctgggtcaagcccggtggcgagagcgatggcacgtccaacacgacctctccgcggtacgactaccactgcgggctgagcgatgcgctgcagccggcgccggaggcggggacttggttccaggtatgacgcgccttcgtattagcaattacgatacatgtgcatgctgaccatgcgacaggcgtactttgagcagttgctcacgaatgctaacccgctgttctga

SEQ ID NO: 994 - protein, 459 aa, Talaromyces emersonii
MRNLLALAPAALLVGAAEAQQSLWGQCGGSSWTGATSCAAGATCSTINPYYAQCVPATATPTTLTTTTKPTSTGGAAPTTPPPTTTGTTTSPVVTRPASASGNPFEGYQLYANPYYASEVISLAIPSLSSELVPKASEVAKVPSFVWLDQAAKVPSMGDYLKDIQSQNAAGADPPIAGIFVVYDLPDRDCAAAASNGEFSIANNGVALYKQYIDSIREQLTTYSDVHTILVIEPDSLANVVTNLNVPKCANAQDAYLECINYAITQLDLPNVAMYLDAGHAGWLGWQANLAPAAQLFASVYKNASSPASVRGLATNVANYNAWSISRCPSYTQGDANCDEEDYVNALGPLFQEQGFPAYFIIDTSRNGVRPTKQSQWGDWCNVIGTGFGVRPTTDTGNPLEDAFVWVKPGGESDGTSNTTSPRYDYHCGLSDALQPAPEAGTWFQAYFEQLLTNANPLF

SEQ ID NO: 995 - DNA, 1703 bp, Talaromyces emersonii
ctctacagcccgttgagcagaacaaacaaaatatcactccagagagaaagcaacatgcggaatcttcttgctcttgcaccggccgcgctgcttgtcggcgcagcggaagcgcaacaatccctctggggacaatgcggcgggagttcgtggactggcgcgacgagctgtgctgctggagcgacgtgcagcacaatcaatccttactacgcacaatgcgttcctgcaacggccactccgaccacgctgacgacaacgacaaaaccaacgtccaccggcggcgctgctccaacgactcctcctccgacaacgactggaacaacgacatcgcccgtcgtcaccaggcccgcgtctgcctccggcaacccgttcgaaggctaccagctctacgccaatccgtactatgcgtcggaggtgattagtttggcaattccctcgctgagcagcgagctggttcccaaggcgagcgaggtggccaaggtgccgtctttcgtctggctcgaccaagccgccaaggtgcccagcatgggcgactatctgaaagacatccagtcgcagaacgcagccggcgcagaccccccgattgcaggcatctttgtcgtctacgacctgcctgaccgcgactgcgcggctgcagccagcaatggcgagttctccatcgccaacaacggcgtcgccctgtacaagcagtacatcgactcgatccgcgagcagctgacgacctattcagatgtgcacaccatcctggtcatcgaacccgacagccttgcgaacgtggtcaccaacctgaacgtgccgaaatgcgcaaatgcccaggacgcctatctcgaatgcatcaactacgccatcacccagctcgatctgccaaacgtggccatgtatcttgatgctggacacgccggatggctaggctggcaagccaacctcgcccccgccgcccagctgtttgcctcggtgtacaaaaacgcctcctctccggcatccgtccgcggtctcgccaccaacgtcgccaactacaacgcctggtcgatcagccggtgcccgtcgtacacgcagggcgacgccaattgcgacgaggaggattacgtgaatgccttggggccgttgttccaggaacagggattcccggcatattttatcattgatacatcccgcaatggcgtccgacccaccaagcaaagccaatggggcgactggtgcaacgtcatcggcacgggcttcggcgtccggcccacgaccgacaccggcaatcctctcgaggacgctttcgtctgggtcaagcccggtggcgagagcgatggcacgtccaacacgacctctccgcggtacgactaccactgcgggctgagcgatgcgctgcagccggcgccggaggcggggacttggttccaggcgtactttgagcagttgctcacgaatgctaacccgctgttctgagtgaaataagaaagagttgacctcaatggggatggagaatggagacagacaagacaagacaaatttgacgcagagaaacagtaacaaaagtgagaggaaacaaaagtcaactttcctatgctatgctatgctatgctattctatgcttgccaaacactccctcgcatatttcttctgtgtatatgcttgcttgctttattttgtgtgtatatacgcaaaattaaatctggttttgtttaaaaaaaaaaaaaaaaaaaaaaaaaaaaaaa

SEQ ID NO: 996 - protein, 459 aa, Talaromyces emersonii; identical to SEQ ID NO: 994

SEQ ID NO: 997 - DNA, 1704 bp, Talaromyces emersonii
ctcagactcaaacactccatcagcagcttcgaaagcggtctttttgctatcatcatgcttcgacgggctcttcttctatcctcttccgccatccttgctgtcaaggcacagcaggccggcacggcgacggcagagaaccacccgcccctgacatggcaggaatgcaccgcccctgggagctgcaccacccagaacggggcggtcgttcttgatgcgaactggcgttgggtgcacgatgtgaacggatacaccaactgctacacgggcaatacctgggaccccacgtactgccctgacgacgaaacctgcgcccagaactgtgcgctggacggcgcggattacgagggcacctacggcgtgacttcgtcgggcagctccttgaaactcaatttcgtcaccgggtcgaacgtcggatcccgtctctacctgctgcaggacgactcgacctatcagatcttcaagcttctgaaccgcgagttcagctttgacgtcgatgtctccaatcttccgtgcggattgaacggcgctctgtactttgtcgccatggacgccgacggcggcgtgtccaagtacccgaacaacaaggctggtgccaagtacggaaccgggtattgcgactcccaatgcccacgggacctcaagttcatcgacggcgaggccaacgtcgagggctggcagccgtcttcgaacaacgccaacaccggaattggcgaccacggctcctgctgtgcggagatggatgtctgggaagcaaacagcatctccaatgcggtcactccgcacccgtgcgacacgccaggccagacgatgtgctctggagatgactgcggtggcacatactctaacgatcgctacgcgggaacctgcgatcctgacggctgtgacttcaacccttaccgcatgggcaacacttctttctacgggcctggcaagatcatcgataccaccaagcccttcactgtcgtgacgcagttcctcactgatgatggtacggatactggaactctcagcgagatcaagcgcttctacatccagaacagcaacgtcattccgcagcccaactcggacatcagtggcgtgaccggcaactcgatcacgacggagttctgcactgctcagaagcaggcctttggcgacacggacgacttctctcagcacggtggcctggccaagatgggagcggccatgcagcagggtatggtcctggtgatgagtttgtgggacgactacgccgcgcagatgctgtggttggattccgactacccgacggatgcggaccccacgacccctggtattgcccgtggaacgtgtccgacggactcgggcgtcccatcggatgtcgagtcgcagagccccaactcctacgtgacctactcgaacattaagtttggtccgatcaactcgaccttcaccgcttcgtgagtcttggttacatttgaagtagacggaagtagctctgcgatggaactggcatatggagaagaccacacaaaactgcatcgaagaaaagaggggggaaaagagaaaagcaaagttatttagtttgaaaatgaaactacgctcgtttttattcttgaaaatcgccactcttgccttttttttcttttttctttttattttttttccttttgaaatcttcaatttaaatgtacatattgttaaatcaaatcaagtaaatatacttgaaaaaaaaaaaaaaaaaaa

SEQ ID NO: 998 - protein, 455 aa, Talaromyces emersonii; identical to SEQ ID NO: 985

SEQ ID NO: 999 - DNA, 516 bp, Trichoderma koningii
ttagccagggatgcttgagtgtatcgtgtaaggaggtttgtctgccgatacgacgaatactgtatagtcacttctgatgaagtggtccatattgaaatgtaagtcggcactgaacaggcaaaagattgagttgaaactgcctaagatctcgggccctcgggccttcggcctttgggtgtacatgtttgtgctccgggcaaatgcaaagtgtggtaggatcgaacacactgctgcctttaccaagcagctgagggtatgtgataggcaaatgttcaggggccactgcatggtttcgaatagaaagagaagcttagccaagaacaatagccgataaagatagcctcattaaacggaatgagctagtaggcaaagtcagcgaatgtgtatatataaaggttcgaggtccgtgcctccctcatgctctccccatctactcatcaactcagatcctccaggagacttgtacaccatcttttgaggcacagaaacccaatagtcaaccgcggactgcgcatc

SEQ ID NO: 1000 - DNA, 558 bp, Trichoderma koningii
taaggctttcgtgaccgggcttcaaacaattaaagtgcgatggtgtggttcccggttggcggagtctttgtctactttggttgtctgtcgcaggtcggtagaccgcaaatgagcaactgatggattgttgccagcgatactataattcacatggatggtctttgtcgatcagtagctagtgagagagagagaacatctatccacaatgtcgagtgtctattagacatactccgagaataaagtcaactgtgtctgtgatctaaagatcgattcggcagtcgagtagcgtataacaactccgagtaccagcaaaagcacgtcgtgacaggagcagggctttgccaactgcgcaaccttgcttgaatgaggatacacggggtgcaacatggctgtactgatccatcgcaaccaaaatttctgtttatagatcaagctggtagattccaattactccacctcttgcgcttctccatgacatgtaagtgcacgtggaaaccatacccaaattgcctacagctgcggagcatgagcctatggcgatcagtctggtcatgttaa

SEQ ID NO: 1001 - DNA, 621 bp, Trichoderma koningii
gctctagaatcctaggctaggtatgcgaggcacgcggatctagggcagactgggcattgcatagctatggtgtagtagaactcccgtcaacggctattctcacctagactttccccttcgaactgacaagttgttatattgcctgtgtaccaagcgctaatgtggacaggattaatgccagagttcattagcctcaagtagagcctatttcctcgccggaaagtcatctctcttattgcatttctgcccttcccactaactcagggtgcagcgcaacactacacgcaacatatacactttattagccgtgcaacaaggctattctacgaaaaatgctacactccacatgttaaaggcgcattcaaccagcttctttattgggtaatatacagccaggcggggatgaagctcattagccgccactcaaggctatacaatgttgccaactctccgggctttatcctgtgctcccgaataccacatcgtgatgatgcttcagcgcacggaagtcacagacaccgcctgtataaaagggggactgtgaccctgtatgaggcgcaacatggtctcacagcagctcacctgaagaggcttgtaagatcaccctctgtgtattgcacc

SEQ ID NO: 1002 - DNA, 1332 bp, Lentinula edodes
atgaagattacttccactggcttacttgctctctcatctttactgccgtttgcgctcggtcagtctcagttatatgcccaatgcggcggtataggttggagtggcgcgactacctgtgtttccggcgcaacctgcacggtcgtaaacgcttactactcacagtgccttcctggttcggcctcggcacctccaacttcgacaagtagcatcggaacaggaactactacttcatccgcgcccggaagcactggaaccacgacacctgctgccggcaaccccttcactgaacagatctatctcagtccttactacgccaacgaaatagctgctgcagtcacgcagatcagtgatcctaccaccgccgctgccgcagctaaagtcgcaaacatccccacgttcatttggctggatcaagttgccaaagtaccagatttaggaacgtacctggcggatgctagtgccaagcaaaagtccgaaggaaagaattacctcgtacagattgtagtatacgacctcccagaccgcgactgtgctgctttggcgtccaacggagaattcaccattgctgataatggcgaagcaaactaccacgactatattgatcaaatcgtggcacaaatcaaacaataccccgatgtccacgttgttgctgttattgaacctgactctttggccaaccttgtcacaaacctcagcgtcgccaagtgcgcgaacgcccagaccacttacttggaatgtgtcacatatgccatgcaacaactctctgccgtcggcgttaccatgtatctcgatgctggtcatgccggctggttgggctggccggcgaatttgtcaccggctgctcagctcttcacatccttatactccaatgctgggtcaccctctggcgttcgaggacttgctaccaacgttgccaactataatgccctcgttgctactacaccagatcctattacccaaggtgatcccaactacgacgagatgctttacatcgaggctctggctcctttgcttggctccttccctgctcatttcatcgttgaccaaggtcgttcaggtgtccaggacatcagacagcaatggggtgactggtgtaacgttcttggtgctggattcggaacgcagcctacgactaacaccggatcatccttgattgattctatcgtttgggtaaaaccgggaggtgaatgtgatggaacatcgaacacatcgtcaccgcgttacgatgcccactgtggtcttcccgatgccactccaaacgctccggaggctggtacatggttccaggcatacttcgaaaccttggtggaaaaggccaaccctcctctatag

SEQ ID NO: 1003 - protein, 443 aa, Lentinula edodes
MKITSTGLLALSSLLPFALGQSQLYAQCGGIGWSGATTCVSGATCTVVNAYYSQCLPGSASAPPTSTSSIGTGTTTSSAPGSTGTTTPAAGNPFTEQIYLSPYYANEIAAAVTQISDPTTAAAAAKVANIPTFIWLDQVAKVPDLGTYLADASAKQKSEGKNYLVQIVVYDLPDRDCAALASNGEFTIADNGEANYHDYIDQIVAQIKQYPDVHVVAVIEPDSLANLVTNLSVAKCANAQTTYLECVTYAMQQLSAVGVTMYLDAGHAGWLGWPANLSPAAQLFTSLYSNAGSPSGVRGLATNVANYNALVATTPDPITQGDPNYDEMLYIEALAPLLGSFPAHFIVDQGRSGVQDIRQQWGDWCNVLGAGFGTQPTTNTGSSLIDSIVWVKPGGECDGTSNTSSPRYDAHCGLPDATPNAPEAGTWFQAYFETLVEKANPPL

SEQ ID NO: 1004 - DNA, 1772 bp, Phanerochaete chrysosporium
ccttcacaaggttacccggtctactgtacgtacttctactcagagttggaatctagaactgacgacttgccttgcagttgtccccatgttccgcgccgccgcactcctcgctttcacttgtctcgccatggtgtctggccaacaggctggcaccaacacggcggagaaccacccccagctccagtcgcagcagtgcacgacgagcggcggctgcaagccgttgagcacgaaggtcgtcctcgactcgaactggcgctgggtccacagcacctcgggctacaccaactgctacaccggcaacgagtgggacacctcgctctgccccgacggcaagacatgcgccgcgaactgcgcgctcgacggtgcggactactctggcacctacggtatcacctccaccggcaccgcgctcacgctcaagtttgtcacgggctccaatgtcggctcccgcgtctacctcatggcggatgatacgcactaccagctgctcaagctcctgaaccaggagttcacctttgacgtcgacatgtccaacctcccctgcggtctcaacggcgcgctctacctctccgcgatggacgccgacggtggcatgtcgaagtaccccggaaacaaggctggtgccaagtacggaactggttactgcgactcgcagtgcccgaaggacatcaagttcattaacggcgaggtgagctctcactataccacgacgagaagtcacgagctgacaccgttctgctaggctaatgtcggcaactggaccgagaccggcagcaacaccggtacgggcagctacggtacctgctgcagcgagatggacatatgggaggccaacaacgatgccgctgctttcactccccacccttgcaccaccaccggtcagacccgttgctctggggatgactgcgcgcgtaacaccggtctttgcgacggtgacggctgcgatttcaactcgttccgcatgggtgacaagaccttcctcggcaaggggatgaccgtcgacacctccaagcccttcaccgtcgtcacccagttcctgaccaacgacaacacctccaccggcacgctctctgagatccgccgcatctacattcagaacggcaaggtcatccagaactcggtcgcgaacatccccggtgtcgaccccgtcaacagcatcaccgacaacttctgcgcgcagcagaagaccgcgttcggcgacaccaactggttcgcgcagaagggcggcctgaagcagatgggcgaggccctcggcaacggcatggtcctcgctctctcgatctgggacgaccacgccgcgaacatgctctggctcgactccgactacccgaccgacaaggacccgtccgcccccggtgtcgcgcgcggcacgtgcgcgaccacctcgggtgtcccctccgacgtcgagtcccaggtgcccaactcccaggtcgtcttctccaacatcaagttcggcgacatcggcagcaccttcagcggcacctcctcccccaacccgccaggcggctccaccacctcctcgcccgtcaccaccagccctacgcccccgcccacaggcccgaccgtccctcagtggggtcagtgcggtggtattggctactctggctcgactacctgcgccagcccgtacacttgccacgtcctcaacccttgtgagtcgattctttctcttcagagaagcagcaatgctaaccaatacttgcagactactcgcagtgctactaagaggcgcttggacattgcagcctcgaaaatagcagactgtagtctcg

SEQ ID NO: 1005 - protein, 510 aa, Phanerochaete chrysosporium; identical to SEQ ID NO: 907

SEQ ID NO: 1006 - DNA, 1389 bp, Agaricus bisporus
cttgaaccaatgttcaaattcgctgctctactagctttggcttcgctcgtcccaggctttgtccaggctcagtcacctgtatggggtcaatgcggtggtaatggctggactggcccgacaacctgcgcttcgggctcaacctgcgtgaagcagaatgatttctattctcagtgccttcccaacaatcaagctcctccttccacaactacacagcctggcaccacaccccccgccaccaccacttccggcggcacaggacctacttcaggtgctggaaacccttataccggtaaaacggtctggctgtcacccttctatgctgacgaggtcgcgcaagcggccgctgatatatccaatcctagtttggcaaccaaggctgcttcggttgctaaaatccctaccttcacttggtttgatacggttgccaaggttcccgaccttggtggctaccttgccgatgcccagtccaagaaccagctcgttcaaattgttgtctacgatctgcccgaccgtgactgcgccgccctcgcctctaacggagagttctctctcgccaatgatggcctcaacaagtataagaactatgttgaccagattgcggcccagattaagcagttccctgacgtatccgtcgtggctgtcattgagcctgactcgctcgctaatttggtcacaaatttgaatgtccaaaaatgtgctaacgcccaaagcgcttacaaggagggtgtcatttacgctatccaaaaacttgacgcagttggtgttaccatgtacatcgatgctggtcatgctggatggttgggctggcctgctaatctgtcccctgccgcccaactcttcgcccaaatctacagagacgctggctcgcccagaaacctccgtggtatcgccacgaacgttgccaacttcaacgcccttagagcttcctctcccgatcctatcactcagggcaacagtaattatgacgaaatacactacattgaagctcttgctcccatgctcagtaatgctggtttccctgctcacttcatcgtcgaccaaggtcgctcgggtgttcagaatatcagagaccagtggggcgactggtgcaacgtcaagggtgctggcttcggtcaacgaccgacaacaaacactggctcctcgctcatcgatgctattgtctgggtcaagccaggtggcgaatgcgacggtacctcagacagttcatcccctcggttcgactcgcattgctctcttagcgacgctcatcaacccgctcctgaggctggtacctggttccaagcttactttgagaccttggttgcgaatgccaaccctgccctttaaaagctgattaactgcctagcatgtagttgtatttattattttggaatacactttttgtgtctc

SEQ ID NO: 1007 - protein, 438 aa, Agaricus bisporus
MFKFAALLALASLVPGFVQAQSPVWGQCGGNGWTGPTTCASGSTCVKQNDFYSQCLPNNQAPPSTTTQPGTTPPATTTSGGTGPTSGAGNPYTGKTVWLSPFYADEVAQAAADISNPSLATKAASVAKIPTFTWFDTVAKVPDLGGYLADAQSKNQLVQIVVYDLPDRDCAALASNGEFSLANDGLNKYKNYVDQIAAQIKQFPDVSVVAVIEPDSLANLVTNLNVQKCANAQSAYKEGVIYAIQKLDAVGVTMYIDAGHAGWLGWPANLSPAAQLFAQIYRDAGSPRNLRGIATNVANFNALRASSPDPITQGNSNYDEIHYIEALAPMLSNAGFPAHFIVDQGRSGVQNIRDQWGDWCNVKGAGFGQRPTTNTGSSLIDAIVWVKPGGECDGTSDSSSPRFDSHCSLSDAHQPAPEAGTWFQAYFETLVANANPAL

SEQ ID NO: 1008 - DNA, 2068 bp, Phanerochaete chrysosporium
ggatccaagggcgtcgtctccactgctgcatgcccctcggatgtgcttgtcgtatttacctggaaattctcggcccaaggtcgctacagggcgcaccaatttgtccggggcctccatgcaccgacgaggacgagctcacgagaccacgactttgccaagtgtcgacgcgcgcaggaggtataaaagctgttggaggtggcgacgaggagaaccagagccctcttcgccttcttcgcattcgtaagccttcatctgcactccaactgcgctctgagtcttacttttctccagggtttcgaactaggcctccgaaaagctcctcgtgcggaaataccgtctgctcacactctaggtagggagattcgtgtgctacggcttggtatcagggctgacttcccccgcagtcacaatgttccgcactgctactttgctcgcattcacgatggccgcaatggtgttcggccagcaggtcggcaccaacacggccgagaaccaccgcacgctcacgtcgcagaagtgcacgaagagcggcggctgctcgaacctgaacaccaagatcgtgctcgacgcgaactggcgctggctccactccacctccggctacaccaattgctacactggcaaccagtgggacgcaacgctctgccccgatggcaagacgtgtgcggccaactgcgcgctcgacggcgccgactacaccggcacctacggcatcaccgcgagcggctcgtcgctcaagctgcagttcgtcactggctcgaacgtcggctcccgtgtctacctcatggcggacgacacgcactaccagatgttccagctcctgaaccaggagttcactttcgacgtcgacatgtcgaacctcccctgcggtctcaacggcgccctctacctctctgcgatggacgctgatggcggcatggccaagtacccgaccaacaaggctggtgctaagtacggtaccggctactgcgactcgcagtgcccgcgcgacatcaagttcatcaatggcgaggtaagcttctttcgaatagtgtgatcgcaatatcatactcactgtttattttccaggctaacgttgagggctggaacgccaccagtgccaacgcgggtaccggtaactacggtacctgctgcactgagatggatatctgggaggcgaacaatgatgccgctgcatacactccccacccttgcaccaccaacgctcagacccgctgctccggaagcgactgcacccgcgacaccggtctctgcgacgccgacggctgcgacttcaactccttccgcatgggcgaccagaccttcctcgggaagggcctgaccgtcgacacctcgaagcccttcaccgttgtcacccagttcatcaccaacgacggcacctccgcgggcaccctcaccgagatccgccgtctctatgtccagaatgggaaggtcatccagaactcctccgtcaagatccccggcatcgacccggtcaactcgatcaccgacaacttctgctcgcagcagaagacggcgttcggcgacaccaactacttcgcgcagcacggtggtctcaagcaggtcggtgaggcgttgcgcacgggcatggtcctcgcgctctcgatctgggatgactacgccgcgaacatgctctggctcgactccaactacccgacgaacaaggacccgtcgactcctggtgttgcccggggcacctgcgcgaccacttccggcgtccccgcgcagatcgaggcgcagagtccgaacgcctacgtcgtcttctcgaacatcaagttcggcgacctcaacaccacctacaccggcaccgtctcctcgtcctctgtctcctcttcgcactcctccacgtccacgagctcctcgcactcctcgagcagcaccccgccaacgcagcccaccggcgtcaccgtccctcagtggggccagtgcggcggcattggctacactggctcgactacctgcgcgagcccgtacacttgccacgtcctcaacccatgtgagtacctcctcatttttgtccgcggctctttttctcattccatggcagactactcccagtgctactaag

SEQ ID NO: 1009 - protein, 516 aa, Phanerochaete chrysosporium
MFRTATLLAFTMAAMVFGQQVGTNTAENHRTLTSQKCTKSGGCSNLNTKIVLDANWRWLHSTSGYTNCYTGNQWDATLCPDGKTCAANCALDGADYTGTYGITASGSSLKLQFVTGSNVGSRVYLMADDTHYQMFQLLNQEFTFDVDMSNLPCGLNGALYLSAMDADGGMAKYPTNKAGAKYGTGYCDSQCPRDIKFINGEANVEGWNATSANAGTGNYGTCCTEMDIWEANNDAAAYTPHPCTTNAQTRCSGSDCTRDTGLCDADGCDFNSFRMGDQTFLGKGLTVDTSKPFTVVTQFITNDGTSAGTLTEIRRLYVQNGKVIQNSSVKIPGIDPVNSITDNFCSQQKTAFGDTNYFAQHGGLKQVGEALRTGMVLALSIWDDYAANMLWLDSNYPTNKDPSTPGVARGTCATTSGVPAQIEAQSPNAYVVFSNIKFGDLNTTYTGTVSSSSVSSSHSSTSTSSSHSSSSTPPTQPTGVTVPQWGQCGGIGYTGSTTCASPYTCHVLNPYYSQCY

SEQ ID NO: 1010 - DNA, 4614 bp, Pleurotus sajor-caju
aattccgcgtggaagtaatccctaagggcaaacctgcggcgatgaagttgaaggtcagagggaagcggttagaacccggtcaggatgatagcctaaaggtcacgccctggcctttggaccagggcgttgtcgaggtcaaggcgttcgtacgatagataccttacatgcacacgtatccgcaacaagtaaacaaagtctcaattctgcaaacagacgtgatctgcagcgcttcttgcttctcagtgatcgtgccaaagtcaagttcgttccttcccttccttggttctttacttcctgataccccaccgactttcaaccgaacgcgtaatgacttcattcgcctaatttgacgcgcctagtcgccccttgttgcgggttgtaccagatgaccacgcacataccgacgtctttccgttaggtgactcgggtgaaagccggcttttctacgaacgccttctcgacataaccaaaatgcaagggaaatcgtataaaaggcccatggaatttagcacaagtcctcaccaggccatctctactcctccagatttaggatgttcaagttctccacccttctcgggctcgtcgctctcgtaccggctttcactctcgctgttggagagtggggacaatgcggtggcattaactacagtaagtttttatttggtgtactggtcgtggtgaatcgcgttctgatttcctcttacagctggttctaccacttgtgatgctggattggtctgcaatgtgatcaacgattattatcaccagtgcctgtgagtattcaagaaactttaagccactgctgccaactcaaagaaatacagccgcggtggaactgtcgcacctccaacgtcctcgtcatcctcatctggaccctcagtacccccgacctcaaccagcacttcctccggtcctcagcccaccccagacgcaggcaacccctacattggctacgacgtaagtcacgtcctctggtgtcagtgacttcactgaatgttgttccaatagatctatctcagcccttactacgctgatgaagttgccgctgccgtctccgccattagcaaccctgccctagctgctaaggctgcctcagtcgccaacatccccaccttcatttggttcgacgtcgtcgccaaggtccctactttgggcacgtacttggctgatgccctctccattcaacaaagcactggccgcaaccaattggtccaaattgtcgtttacgacctgcccgaccgtgactgcgccgctttggcttccaatggtgaattttccattgccaacaacggtctcgccaactacaagaactacgtcgaccagattgttgcccagatcgcccgtacgtgttgcccccttgttacttctgctattactgacctagcttgcctctcagagtaccctcaaatccgcgttgttgctgttgtcgaacccgattcattggccaacatggtcaccaacttgaacgttcctaagtgtgccggtgcacaggccgcttataccgagggtgtcacctatgctctccagaaactcaacactgtcggtgtctactcctacgtcgacgctggccacgctggatggctcggatggcccgccaacttgggccccgctgctcaattgttcgctaacctctacactaacgccggatccccctccttcttccgtggtctcgctaccaacgttgccaactacaacctcttgaacgctccttccccggacccagttaccagtcccaatgccaactacgatgagatccactacatcaacgtcagtgattgtttcgtgttaatttggacgtctctaacgatttgtatcatagccctcgctcctgaactctcttcccgtggcttcccggctcacttcatcgtcgaccaaggtcgttctgctgtccaaggcatccgcggagcttggggtgactggtaagttgcgatcccactctatcaccacctcgtattgattccgtctcaggtgcaacgtcgacaacgccggcttcggtactcgccccaccaccagcactggctcctcgctcatcgatgccatcgtctgggtcaagcctggaggagaatccgatggaacctctgacacttccgccgttcgctacgacggtcactgtggtcttgcctctgccaagaagcctgctcccgaagctggtacctggttccaggtaagagcctcccataccatcagatggcttccgtgtattcacattcttctttccaggcttacttcgaaatgctggttgccaacgccgtccctgctttgtaaatacctaaaacttttgtatacctctgtaaaaaggtctttgaaagaccgtgactctatgtttattaccactaatgtatcgttgaatatacgcacacagtcgttcattccgtactgaataaagccgcgctttccacatacattccagtccgcataaactccccatgcgaatgctccgttaattatgcacgtataggtgccgaggtcatacccaccaactaggaagaagtctaaaacttacggattcagtatggatcatcctatgacaatcggtaccgagaaaaggacacgactaccgctcaccgcaattgactactatcgaacgtcggggaaatagactcgataccggtatccaaataatcgacgttcactacgtctgactgccagcgaaaggtctaaaaaggtcatgtgtggtagagttcggtactgcgaggtacgggtcagcctacaatactcccgatgagtgcttgtattgcgaggttgctttgagactcgggggctgttgtgagaagttgaggaagtactagggataacctatagcatccaccgacgtgtcgccacaagacattcgatttcgcggctgactacaagacaagccccgcaagtcggtgttaagcatgcccagatcagttggggtgggagccataaccaagtcacggaacgtttaaacaagtgccaagatcggcggcacgtgtatatagaagtcgatgaagggggggatgcttgaaatccggttaaaactggcggttgtgatgtatttgtggtaatagatgcattatcctggtaaatggacggatacataggctcaaaagcttgcgagctactagttcagcgtccgaggtgaatatactgcgacatatgaaccgttgaaggagccctcctttacagacagccacctcccaagtcggtgctcctgccccacgccaacgatgagtagtattgactcgggtacaccaattttattttttgacagacgggtagccgttacctgctcgtccggttgcgatgatgattgcgatgctagccatgaagtactcgataggaaccctttgggcggtgagagaagttgaagagagttgatgacgcctgggagagacagtttgccagcaagctcgaaggattttagtttcgggtcgagcttccatatgcgtatgtcgccatcccaggatcctggcgtgcagtcagcctaaggtaagcaagttgatggtacggcatggtggaagttacctgacgcaaatatatctgaatatcgcagacttgccaaagcggtcacccaacgaggtgtttgtatgactccttcagtttccgattgcgcctcgttgagtccgtgggcgagaggttgagtgaatatcggcttctttttcgtagtactccacagacttatcgagctgcaaaccaattgaaacatggatgcaaacgatggtggttttggtacgtacccgctgtcaccgccactaacgaaagtcgactcgtcaatcatggctatgcattctaagctggcctcgatgaacttctgggcttcgtttccttttcgtttcgtagaacgtccgtcaacgtccatcgtgttgtcctccccatcatcatcaccccgtaacccgccctctagcatctctctgaccttactccttccgccacctctaaacactagctgcgtctcgtcgacaatcttccagaacctcgccgtcttatccctagcacccacactaacacaagtctccaagcgaagagcgtcgacggaaagaacgtggtcttgatggccatacaaggtctcgacatacccccattacagatggtgtgagatcgaagacttttaacgtgcgatcaaaagagcctgaataaagttgatgtgtcgctttgcgaaaagataatgactacagaggtgttaacgatagttctcattcgtactgaacgaaaagagctcacggatacagcatctctgtggcacattgggccagtaaaacattttatccactcggccttctcagcgtcccagacgacgaccctcctatcccttcctccactcactaggtattttccgtcagaactgagggccagggcaagcacctcatccgtgtgccctttaacgtcgcccgctggcggagccttaccctttcccttcccattagagcgcaccttaaacagagtagctagcttcttccctgtcgtcatgtcccacttaattatgtgaccctcttttccggacgtgaataggtacctcgcagattcggcagcgacggcggatgttacagacaaacgatggcctctcgttttcatggatgactgtggagggtcttcgaagttgaactgagaggtttagtataaccattgatggatatgccggtacactcacag

SEQ ID NO: 1011 - protein, 465 aa, Pleurotus sajor-caju
MFKFSTLLGLVALVPAFTLAVGEWGQCGGINYTGSTTCDAGLVCNVINDYYHQCLPTPDAGNPYIGYDVSHVLWCQIYLSPYYADEVAAAVSAISNPALAAKAASVANIPTFIWFDVVAKVPTLGTYLADALSIQQSTGRNQLVQIVVYDLPDRDCAALASNGEFSIANNGLANYKNYVDQIVAQIARTCCPLVTSAITDLACLSEYPQIRVVAVVEPDSLANMVTNLNVPKCAGAQAAYTEGVTYALQKLNTVGVYSYVDAGHAGWLGWPANLGPAAQLFANLYTNAGSPSFFRGLATNVANYNLLNAPSPDPVTSPNANYDEIHYINVSDCFVLIWTSLTICIIALAPELSSRGFPAHFIVDQGRSAVQGIRGAWGDWCNVDNAGFGTRPTTSTGSSLIDAIVWVKPGGESDGTSDTSAVRYDGHCGLASAKKPAPEAMASVYSHSSFQAYFEMLVANAVPAL

SEQ ID NO: 1012 - DNA, 1698 bp, Trichoderma harzianum
atgtatcggaagttggccgtcatctcggccttcctggctgctgctcgtgctcagcaggtctgcacccaacaagcagagactcacccacctctgacatggcagaaatgcacagcttccggttgcacacctcaacaaggttctgtggttcttgatgcaaactggcgttggactcacgataccaagagcaccaccaactgctacgatggcaacacctggagctcaaccttgtgccccgacgatgcgacttgtgccaagaactgttgtttggatggagccaactactcgggcacttacggagtcaccaccagcggcgacgctctcacccttcaatttgttactgcgtcgaatgtcggctcccgtctttacttgatggcaaatgattctacctaccaggagttcacgctctctggcaatgagttctcctttgacgttgatgtttcccaactgccgtaagtaatcacaatctaacatcacagttggtttcacagttcgcggactaaataattgctagttgtggcttgaacggagcgctgtacttcgtttccatggacgccgatggtggccagagcaagtaccccggcaatgctgccggtgccaaatacggcacaggttactgtgacagccagtgccctcgtgacctgaagttcatcaacggtcaggccaacgttgagggttgggagccatcttccaacaacgccaacactggtgttggtggccacggaagctgctgctccgagatggatatctgggaggcaaactccatttctgaggctcttactcctcacccttgcgagactgtcggccagacgatgtgcagtggcgattcttgcggtggaacttactccaatgaccgatatggtggcacctgcgaccctgatggctgcgactggaacccataccgtctgggcaacacctccttctacggacccggttcatcattcgctcttgacaccaccaagaaattgaccgttgtgacccagttcgccaccgacggttcaattagccgatactatgtccagaatggagtcaagttccagcagcccaacgctcaagtcggcagctactctggcaacacgatcaacaccgactactgtgcagctgagcagacagccttcggcggaacctcattcacagacaagggcggccttgcccagatcaacaaggcattccagggcggaatggtcttggtcatgagcttgtgggatgatgtgagtttacaacatatagttgatatgatttctattacattactgactggttcacgcagtacgcggtcaacatgctttggttggattccacctacccaacaaacgccactgcttccacccctggcgccaagcgaggaagctgctctaccagctctggtgttcccgcccaagtcgaagctcagtcacccaactccaaggttatctactccaacatccgcttcggacccattggcagcactggtggcaacactggcagcaaccctcccggcacttcaaccactcgggctcctccgtccagcactggaagctcccccaccgccacccagacacactacggccagtgtggtggaactggctggaccggacctaccagatgcgctagcggctacacttgccaggttctgaacccattctactctcagtgcctgtaaggtgctttggcggcggcttgagatgttaggttgtagatggattgtctcatcttcaacta

SEQ ID NO: 1013 - protein, 505 aa, Trichoderma harzianum
MYRKLAVISAFLAAARAQQVCTQQAETHPPLTWQKCTASGCTPQQGSVVLDANWRWTHDTKSTTNCYDGNTWSSTLCPDDATCAKNCCLDGANYSGTYGVTTSGDALTLQFVTASNVGSRLYLMANDSTYQEFTLSGNEFSFDVDVSQLPCGLNGALYFVSMDADGGQSKYPGNAAGAKYGTGYCDSQCPRDLKFINGQANVEGWEPSSNNANTGVGGHGSCCSEMDIWEANSISEALTPHPCETVGQTMCSGDSCGGTYSNDRYGGTCDPDGCDWNPYRLGNTSFYGPGSSFALDTTKKLTVVTQFATDGSISRYYVQNGVKFQQPNAQVGSYSGNTINTDYCAAEQTAFGGTSFTDKGGLAQINKAFQGGMVLVMSLWDDYAVNMLWLDSTYPTNATASTPGAKRGSCSTSSGVPAQVEAQSPNSKVIYSNIRFGPIGSTGGNTGSNPPGTSTTRAPPSSTGSSPTATQTHYGQCGGTGWTGPTRCASGYTCQVLNPFYSQCL

SEQ ID NO: 1014 - DNA, 1785 bp, Orpinomyces sp. PC-2
  misc_feature (41)..(43): n is a, c, g, or t
caacaatagtgttaataatataaaaaattttattaaataannnataatttagtgctagaatcactataatacttttttttttattacaaaaataacaaattaaatttaattataatttaagaaaaaaaaaatgaagtctactattgctttaactgctgttgctgctcttgctgctaaggcctctgctgcttgctggtctgaaagtttaggttacccatgctgttcctctccaaatgctaatgttgaatacactgatgctgatggtaagtggggtgttgaaaacggtaactggtgtggtattccagttccagaagcttgctggtccgaaaaattaggttacccatgctgttcctcttcaagtgctaaagttgaatacactgatgctgatggtaagtggggtgttgaaaacggtaactggtgtggtatccaaactactccaggtactccaagtccagtcccaaccccagatattgaagttaagccaggagaacaatacactcacagtggtaacccattctctggtgttgaattcttccttaacccatactacgttgctgaagttgatgctgccatcgaacaaatgactaactcttctcttaaggctaaggctgaaaagatgaagacttactctaacgctatttggttagataccatcaagaacatgcaccaatggttagaaactaacttaaagggtgctctccaacaacaagaattcactggtagcaaggttttaactgttttcgtcgtttacgatttaccaggtcgtgattgtcacgctcttgcttccaatggtgaacttctcgctaacgacagtgatgctcaacgttacaagactgaatacattgacgtcatcgaagaaaaattaaagtactacaagtctcaaccagttgttcttattgttgaaccagattcccttgctaacttagtcactaaccttgattccactccagcttgtcgtgactctgaaaagtactaccttgacggtcacgcttacttaattcaaaagctcggtgttctcccacacgttgctatgtaccttgatattggtcacgccttctggttaggttgggatgataaccgtgaaaaggccggtaaggtttactccaaggttatcagctctggtaagccaggtaaggttcgtggtttcactgataatgttgctaactacactccatgggaagacccaactctttctcgtggtccagaaactgaatggaacccatgtccagatgaaaagagatacttacaagagctaatgcacaaggacttcaaggctgccggtattgaatccgtttacttcgtttgtgatacctctcgtaacggtcacaaggtcgaccgtaagcacccaggtgaatggtgtaaccaaactggtgttggtgttggtgccagaccacaagctagcccagtctctggtatggactaccttgatgccttctactggattaagccactcggtgaatctgatggtacttccgatacttctgctgctcgttacgatggttactgtggtcacgataccgctatgaaaccagctccagaagccggtcaatggttccaaaagcacttcgaacaaggtcttgaaaacgctaacccaccactctaaattcattgaattttttttggaaaatagttaaaaaaaattttataataatataataataataatagtactaacttcattcattaataaaaaggaaataattaataattcaattaattaattcttttttatagtaataaaaaaaaagaaatgaaaaaaaaaacaactttttattttttatttaa

SEQ ID NO: 1015 - protein, 490 aa, Orpinomyces sp. PC-2
MKSTIALTAVAALAAKASAACWSESLGYPCCSSPNANVEYTDADGKWGVENGNWCGIPVPEACWSEKLGYPCCSSSSAKVEYTDADGKWGVENGNWCGIQTTPGTPSPVPTPDIEVKPGEQYTHSGNPFSGVEFFLNPYYVAEVDAAIEQMTNSSLKAKAEKMKTYSNAIWLDTIKNMHQWLETNLKGALQQQEFTGSKVLTVFVVYDLPGRDCHALASNGELLANDSDAQRYKTEYIDVIEEKLKYYKSQPVVLIVEPDSLANLVTNLDSTPACRDSEKYYLDGHAYLIQKLGVLPHVAMYLDIGHAFWLGWDDNREKAGKVYSKVISSGKPGKVRGFTDNVANYTPWEDPTLSRGPETEWNPCPDEKRYLQELMHKDFKAAGIESVYFVCDTSRNGHKVDRKHPGEWCNQTGVGVGARPQASPVSGMDYLDAFYWIKPLGESDGTSDTSAARYDGYCGHDTAMKPAPEAGQWFQKHFEQGLENANPPL

SEQ ID NO: 1016 - DNA, 1712 bp, Orpinomyces sp. PC-2
  misc_feature (16)..(16): n is a, c, g, or t
tttttattttttaaanttaataataattttctctggaaggaaatatttataaataaaaaaaaacaaaaaaaaaaaaaaaaataaaataaaaacattttaattatttgataactgtgcaagacacaaatactttttttattttaaaataatttaaattaaaaaatctattaaaatgaaaacctcttttgttttagctgctgttgctgctcttgccgctaaggcttctgctgcttgtttctctgaaagattaggttacccatgctgttcttcttcagatgctaaggttgaatacgttgattctgatggtaattggggtgttgaaaacggtaactggtgtggtattccagatccagaaccaacttgttgggctgaaagattaggttacccatgctgtaccactactactacagttgaatacactgattctgatggtaagtggggtgttgaaaacggtaactggtgtggtattactggtaaaccagtaccaactaaaactcaaggtccaactccaacttcaggttcagacccaactccaggatctcaactcactctttctggtaatccattctctggtgttgaattcttccttaacccatactacgttgctgaagttgatgctgccattgctcaaatgtctaactcttctcttaaggctaaggctgaaaagatgaagacttactctaacgctatttggttagatactattaagaacatgcaacaatggttagaaactaacttaaagggagctcttgctcaacaaactggtagcaagaaggtcttaactgtcttcgtcgtttacgatttaccaggtcgtgattgtcacgctcttgcctctaacggtgaacttcttgctaatgacagtgatgctcaacgttacaagactgaatacattgatgtcattgaagaaaaattaaagtactacaaatctcaaccagttgttcttattattgaaccagattcccttgctaacttagttactaaccttgaaaacactccagcttgtcgtgactctgaacaatactatcttgatggtcatgcttacttaattaagaagttcggtgttctcccacacgttgctatgtaccttgatattggtcacgccttctggttaggttgggatgataaccgtgaaaaggccgctaaggtttactctaaggttatcagctctggttctccaggtaaggttcgtggtttcactgataacgttgctaactacactccatgggaagacccaactctttctcgtggaccagacactgaatggaacccatgtccagatgaaaagagatacttagaagccatgcacaaggacttcaaggctgctggtattagctctgtttacttcgtctctgatacttctcgtaacggtcacaagaccgaccgtaagcacccaggagaatggtgtaaccaaactggtgttggtattggtgccagaccacaagccaacccaatctccagtatggattaccttgatgccttctattggattaagccacttggtgaatctgatggtacttccgatacttcagctgctcgttacgatggttactgtggtcacgaaactgccatgaaaccagctccagaagccggtcaatggttccaaaagcacttcgaacaaggtcttgaaaacgctaacccaccactctaagcagtttagttttcattatcaaataaagtgtttaattttttatttttttttaataaaaaataaa

SEQ ID NO: 1017 - protein, 491 aa, Orpinomyces sp. PC-2
MKTSFVLAAVAALAAKASAACFSERLGYPCCSSSDAKVEYVDSDGNWGVENGNWCGIPDPEPTCWAERLGYPCCTTTTTVEYTDSDGKWGVENGNWCGITGKPVPTKTQGPTPTSGSDPTPGSQLTLSGNPFSGVEFFLNPYYVAEVDAAIAQMSNSSLKAKAEKMKTYSNAIWLDTIKNMQQWLETNLKGALAQQTGSKKVLTVFVVYDLPGRDCHALASNGELLANDSDAQRYKTEYIDVIEEKLKYYKSQPVVLIIEPDSLANLVTNLENTPACRDSEQYYLDGHAYLIKKFGVLPHVAMYLDIGHAFWLGWDDNREKAAKVYSKVISSGSPGKVRGFTDNVANYTPWEDPTLSRGPDTEWNPCPDEKRYLEAMHKDFKAAGISSVYFVSDTSRNGHKTDRKHPGEWCNQTGVGIGARPQANPISSMDYLDAFYWIKPLGESDGTSDTSAARYDGYCGHETAMKPAPEAGQWFQKHFEQGLENANPPL

SEQ ID NO: 1018 - DNA, 1611 bp, Hypocrea jecorina
atgattgtcggcattctcaccacgctggctacgctggccacactcgcagctagtgtgcctctagaggagcggcaagcttgctcaagcgtctggtaattatgtgaaccctctcaagagacccaaatactgagatatgtcaaggggccaatgtggtggccagaattggtcgggtccgacttgctgtgcttccggaagcacatgcgtctactccaacgactattactcccagtgtcttcccggcgctgcaagctcaagctcgtccacgcgcgccgcgtcgacgacttctcgagtatcccccacaacatcccggtcgagctccgcgacgcctccacctggttctactactaccagagtacctccagtcggatcgggaaccgctacgtattcaggcaacccttttgttggggtcactccttgggccaatgcatattacgcctctgaagttagcagcctcgctattcctagcttgactggagccatggccactgctgcagcagctgtcgcaaaggttccctcttttatgtggctgtaggtcctcccggaaccaaggcaatctgttactgaaggctcatcattcactgcagagatactcttgacaagacccctctcatggagcaaaccttggccgacatccgcaccgccaacaagaatggcggtaactatgccggacagtttgtggtgtatgacttgccggatcgcgattgcgctgcccttgcctcgaatggcgaatactctattgccgatggtggcgtcgccaaatataagaactatatcgacaccattcgtcaaattgtcgtggaatattccgatatccggaccctcctggttattggtatgagtttaaacacctgcctccccccccccttcccttcctttcccgccggcatcttgtcgttgtgctaactattgttccctcttccagagcctgactctcttgccaacctggtgaccaacctcggtactccaaagtgtgccaatgctcagtcagcctaccttgagtgcatcaactacgccgtcacacagctgaaccttccaaatgttgcgatgtatttggacgctggccatgcaggatggcttggctggccggcaaaccaagacccggccgctcagctatttgcaaatgtttacaagaatgcatcgtctccgagagctcttcgcggattggcaaccaatgtcgccaactacaacgggtggaacattaccagccccccatcgtacacgcaaggcaacgctgtctacaacgagaagctgtacatccacgctattggacgtcttcttgccaatcacggctggtccaacgccttcttcatcactgatcaaggtcgatcgggaaagcagcctaccggacagcaacagtggggagactggtgcaatgtgatcggcaccggatttggtattcgcccatccgcaaacactggggactcgttgctggattcgtttgtctgggtcaagccaggcggcgagtgtgacggcaccagcgacagcagtgcgccacgatttgactcccactgtgcgctcccagatgccttgcaaccggcgcctcaagctggtgcttggttccaagcctactttgtgcagcttctcacaaacgcaaacccatcgttcctgtaa

SEQ ID NO: 1019 - protein, 471 aa, Hypocrea jecorina
MIVGILTTLATLATLAASVPLEERQACSSVWGQCGGQNWSGPTCCASGSTCVYSNDYYSQCLPGAASSSSSTRAASTTSRVSPTTSRSSSATPPPGSTTTRVPPVGSGTATYSGNPFVGVTPWANAYYASEVSSLAIPSLTGAMATAAAAVAKVPSFMWLDTLDKTPLMEQTLADIRTANKNGGNYAGQFVVYDLPDRDCAALASNGEYSIADGGVAKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEKLYIHAIGRLLANHGWSNAFFITDQGRSGKQPTGQQQWGDWCNVIGTGFGIRPSANTGDSLLDSFVWVKPGGECDGTSDSSAPRFDSHCALPDALQPAPQAGAWFQAYFVQLLTNANPSFL

SEQ ID NO: 1020 - DNA, 2603 bp, Aspergillus niger
ggtaccgtaatgggtagtaggtgatgttgaatcaagcagtggttgctctttgggaatgacttcagttcctgacaactagcagaattgaatttcggccgttgggcgccccgccgcgtagcaacgaggatctttacccggtttcggccatgatttgatgactcaggcggggtgcggtgattgataagattagggctagcaggtagggctacgctgcgagtcacatggtctgcactggatttcctctttgggctcgtgagatggctgtcccgcgcggattgccggatgcacaacggcattgtctcctgcttattgtggcggcgccaccaggctgccggattacctctttggtaaagggaatggtcttccttgagttcgcttgtcacgatgacttcaagattggacgccgacgagctcagtctactatacgtgccatgtcgggatgcggtccgtttagccgtaacatatccgggatcatgaagttgagagataggcagcatacaactgcaaaaggtataaagagctcgttcttctcctctgtccattatcacagcattcacattcttcacagcagaactcagaggctcaagagctcaagcagtgaatcacaatgtcttccttccaaatctaccgagcagctctgctgctctctatccttgccactgccaatgctcagcaggttggcacctacaccactgagacacatccgtctctgacctggcaaacctgcaccagcgatggcagctgcactaccaacgacggcgaggtggtcatcgacgccaattggcgttgggtgcactcaacctccagtgccaccaactgctatactggcaacgaatgggacacctcaatttgtaccgacgatgtgacctgcgccgcgaactgcgcgcttgacggtgccacttacgaggcgacctatggtgtgaccacgtccggcagcgagctgcgcctgaacttcgtcactcaaggctccagcaagaacatcgggtctcgtttgtacctcatgagcgacgacagcaactatgagctgttcaagctcctcggccaggagttcacctttgatgtcgacgtgtccaaccttccctgcggtctcaacggcgcgctctacttcgtcgccatggacgctgacggtggcacctcggagtattccggcaacaaggccggtgccaaatacggaaccggctactgcgactcgcagtgccctcgcgacctgaagttcatcaacggcgaagccaactgcgacggctgggagccgtccagcaacaacgtcaacaccggagttggcgaccacggctcctgctgcgccgagatggacgtctgggaagcgaacagcatctccaacgccttcaccgcgcacccctgcgactccgtcagccagacaatgtgcgacggtgactcctgtggtggaacttacagcgccagcggcgaccgctacagcggcacctgcgaccccgacggctgcgactacaacccctaccgtctaggcaacacggacttttacggccccggcctgaccgtcgacacgaacagccccttcaccgtcgtcacccagttcatcaccgatgacggcacctcctccggcaccttgaccgagatcaagcggttgtacgtgcagaacggcgaggtcatcgccaacggcgcctccacctactccagtgtcaacggcagctctatcacctccgctttctgtgaatcagagaagacgctgttcggcgacgagaacgtcttcgacaagcacggcggtctcgagggcatgggcgaggctatggccaagggcatggtcttggtcttgagtctttgggatgactatgccgctgacatgctctggctcgacagcgactaccccgttaactcgtcggcctcgacccctggtgtggcccgcggtacttgtagcacggactcgggtgtcccggctaccgtggaggcggagtcacccaatgcctatgtcacgtactcgaacatcaagttcgggcctattggctcgacttactccagtggatcttcttcggggtcggggtctagctccagctcgagttcgactaccactaaggccacttcgacgaccttgaagactacctcgaccaccagcagtggaagcagttcgacatcggcggcgcaggcgtatggacagtgtggtggacagggctggactggtccgaccacttgtgtgagtgggtacacttgcacgtatgagaatgcgtactactcgcagtgtttgtagacactactcgaagggggatgaagatggcagtgtgggggggggaatagttagtgattagtagttagcacacgtactacagtttagtcaaatttaggaagcaatatgacatgatcacttgatgcagaatctaccaaccaccactctacctcaaattacactccactataatcctactataaattaacttcccgtacccgaccaacctaggcacaaaccgaacccaatcaaccatcacccaataatcctccccctctccttacttatctgcagaacatccgtgcggaaagcctaaagtagcgcttacatgaccagacagtgtcaccccagacacaccacatggctggacgggatattctccgcacccaatgcatgcatcctctgcagg

SEQ ID NO: 1021 - protein, 536 aa, Aspergillus niger
MSSFQIYRAALLLSILATANAQQVGTYTTETHPSLTWQTCTSDGSCTTNDGEVVIDANWRWVHSTSSATNCYTGNEWDTSICTDDVTCAANCALDGATYEATYGVTTSGSELRLNFVTQGSSKNIGSRLYLMSDDSNYELFKLLGQEFTFDVDVSNLPCGLNGALYFVAMDADGGTSEYSGNKAGAKYGTGYCDSQCPRDLKFINGEANCDGWEPSSNNVNTGVGDHGSCCAEMDVWEANSISNAFTAHPCDSVSQTMCDGDSCGGTYSASGDRYSGTCDPDGCDYNPYRLGNTDFYGPGLTVDTNSPFTVVTQFITDDGTSSGTLTEIKRLYVQNGEVIANGASTYSSVNGSSITSAFCESEKTLFGDENVFDKHGGLEGMGEAMAKGMVLVLSLWDDYAADMLWLDSDYPVNSSASTPGVARGTCSTDSGVPATVEAESPNAYVTYSNIKFGPIGSTYSSGSSSGSGSSSSSSSTTTKATSTTLKTTSTTSSGSSSTSAAQAYGQCGGQGWTGPTTCVSGYTCTYENAYYSQCL

SEQ ID NO: 1022 - DNA, 3498 bp, Aspergillus niger
gatgctaaccgcctggttcaagccggaaaggcgggctctaacggaagcaaagactataatgtttcttggtttgacgttgacaagcccatctaggccgcctagttccggcttggatgaatcaaatttcagcctagccatctgcttaaatccgaataattttggcacgtactcgagctgtcattgatgggatgtagcaccccgcattccgagatcgacaaggctagcagaggaccctggaaattaatcaatccttcatcaggatttgagatgaatcgggggatggctgataccaaacaacgccacatgctgccacatcttcattaagtcagcgttaacatgggacgtcgttgctctcgtttttcctaaaagggactgcgaatgattcttcttagacaacgcggctaactgaatacagggatcacgattcgaagatattctaagtatcggaaatgagaaatagcattagagcggactgcacgattgcagtcacttgcttctattcttcattagaatttgccgggtacaatacagatacctactcgagctaggattctagaaccgaagacaagggctccaaaaacctgtctattgcaaaacttcatcaagttagcaagtaaggcaaaatttctctgcatgcacggccttggaaaggctacacatgactcaaacagtcttcattggaaggctccaaggcttattacatgcagggaacagaaacaattcggagggccctccgtgaatccttgagctcgatgaaccaataatacacagcggaagccaagcagcctgatatactccatcctagtgatagaacctgggcccactttcggacatatctcaacacgcagaaccctctttctgcaacatgacactctattattgtgcgttcttcatttcacggcacagaagagcttgcctaatttgaaacatcggcggactggcggtccgttataccggcaaaagtgggtgaccctattcttccggattgcaagatgatatggaattgaatgctgggtggaaatgttataaatagggaggttatgccgctgtacagcttggaaattcatctgccggacagacaacgaaatcactaaaaggagacgactagagtcttatacaatctcattacaatgcatcaacgtgcccttctcttctcagccctgctgacggctgttcgcgcccagcaagccggaacgctcacggaggaagtccatccttccttgacctggcagaaatgcacttctgaaggcagctgcactgaacagagtggctcagttgtcattgactcgaactggcgctggacccattccgtcaatgacagcaccaattgctacactggcaacaccgtgagttcgattgacccctatgtgctgaactggctaacgcacctaacagtgggatgcaactctctgccctgatgatgagacctgtgcggccaactgcgccctggacggagcagactacgagtccacctacggtgtcaccactgacggtgattcattgacactgaaattcgtcactggctccaatgttggctcgcggttgtatctaatggacacgagcgacgagggataccagacgttcaacttgcttgacgcagagttcactttcgacgttgatgtgtctaacctcccatgtgggctaaacggcgcgttgtacttcactgcaatggacgccgatggtggagtctcaaaataccctgccaataaggctggagccaagtacggaacaggatactgtgactcccaatgcccccgggacctgaaattcatcgacggacaagtatgtagtcctccgagattccctcatcgctagcatgctgacctgaatcaggccaacgtcgatggctgggaaccttctagcaacaatgacaacacaggtatcggcaatcacggttcttgctgccctgaaatggatatctgggaggcaaacaagatctcgaccgcattgacaccccatccttgtgacagcagcgaacagaccatgtgtgagggtaacgactgcggtggaacctactcggatgatcgctacggaggtacggatacccaaataggcgatctaggttgatgtttcggctaattccatttacaggaacctgcgaccctgacggctgcgacttcaacccttatcgcatgggcaacgactctttctacggtcctggcaagaccatcgacaccggatccaagatgacggttgtgacccagttcatcactgatggctctggctccctcagcgagatcaagcgttactacgtgcagaacggaaatgttatagcgaacgctgattccaacatctctggagtgactggaaactcgatcacaacggacttctgcactgcgcagaagaaggcctttggcgacgaggatatattcgctgagcacaatggacttgctggaatcagtgatgccatgtcttccatggttctcatcttgagcttgtgggatgattactatgccagcatggagtggctcgacagcgactatcccgagaacgctaccgctaccgacccaggtgttgcacgcggaacatgcgactcggaatcaggcgtccctgcgacagtcgagggggcgcatcccgattcttcggtgaccttctcaaacatcaagttcggtcccatcaactcgaccttcagcgcttccgcataaggggaagtgcagggttcagagcctcaattacatcccacaagccgaacacaacaggacaggttcctggaacggaatatgggagagttgcgggcttgtaaatagtccgaaaagtggtcactgcttttgtgtatcgggctgtcttcccattttattttcattcactccagattgattgatgcagatcttgtttgttgattctttcacttcgtgctgtgactttttgtacctaacttcacattcgtttcttttctgtttttgagtccactcaatccaagagacagttgttcctttgctactcctgacctagtcagccctgcgtagacagcaagctcttagtagccttaagcctaaactttatagccaaccaaccccggaagatccgtcggcccgccctctccgagactgatcggctccgccagcctgcagctgcagctccgcaagtcaaaaaactgcggcatagattcgccctcgtgcaattgctcattcttcgcaatgttcgacaccgtttgcacccttccgctatcagcggacctgttctcccaggccctgcatcccaaggagcccgtcgtgtccgttggtctctcctccgggcatgtccagacgttccgactccccaccgacgaagcggccagcgacgacgacgagacatcaaatgcctcgtcacgcaatggcagaggacacattgatacgatgtggcggacgagacgccataagggtagctgccggtgcttgacgtttggaattgatggcgagacgctctattcgggccggcacggacgggctgatcaaagccgcaaaggcggagacgggagtcgtggaaaacaagatcgctattcctacagaaaagaatggg

SEQ ID NO: 1023 - protein, 452 aa, Aspergillus niger
MHQRALLFSALLTAVRAQQAGTLTEEVHPSLTWQKCTSEGSCTEQSGSVVIDSNWRWTHSVNDSTNCYTGNTWDATLCPDDETCAANCALDGADYESTYGVTTDGDSLTLKFVTGSNVGSRLYLMDTSDEGYQTFNLLDAEFTFDVDVSNLPCGLNGALYFTAMDADGGVSKYPANKAGAKYGTGYCDSQCPRDLKFIDGQANVDGWEPSSNNDNTGIGNHGSCCPEMDIWEANKISTALTPHPCDSSEQTMCEGNDCGGTYSDDRYGGTCDPDGCDFNPYRMGNDSFYGPGKTIDTGSKMTVVTQFITDGSGSLSEIKRYYVQNGNVIANADSNISGVTGNSITTDFCTAQKKAFGDEDIFAEHNGLAGISDAMSSMVLILSLWDDYYASMEWLDSDYPENATATDPGVARGTCDSESGVPATVEGAHPDSSVTFSNIKFGPINSTFSASA

SEQ ID NO: 1024 - DNA, 1353 bp, Humicola grisea var. thermoidea
atgcagatcaagagctacatccagtacctggccgcggctctgccgctcctgagcagcgtcgctgcccagcaggccggcaccatcaccgccgagaaccaccccaggatgacctggaagaggtgctcgggccccggcaactgccagaccgtgcagggcgaggtcgtcatcgacgccaactggcgctggctgcacaacaacggccagaactgctatgagggcaacaagtggaccagccagtgcagctcggccaccgactgcgcgcagaggtgcgccctcgacggtgccaactaccagtcgacctacggcgcctcgaccagcggcgactccctgacgctcaagttcgtcaccaagcacgagtacggcaccaacatcggctcgcgcttctacctcatggccaaccagaacaagtaccagatgttcaccctgatgaacaacgagttcgccttcgatgtcgacctctccaaggttgagtgcggtatcaacagcgctctgtacttcgtcgccatggaggaggatggtggcatggccagctacccgagcaaccgtgctggtgccaagtacggcacgggctactgcgatgcccaatgcgcccgtgacctcaagttcattggcggcaaggccaacattgagggctggcgcccgtccaccaacgaccccaacgccggtgtcggtcccatgggtgcctgctgcgctgagatcgacgtttgggagtccaacgcctatgcttatgccttcaccccccacgcctgcggcagcaagaaccgctaccacatctgcgagaccaacaactgcggtggtacctactcggatgaccgcttcgccggctactgcgacgccaacggctgcgactacaacccctaccgcatgggcaacaaggacttctatggcaagggcaagaccgtcgacaccaaccgcaagttcaccgttgtctcccgcttcgagcgtaacaggctctctcagttcttcgtccaggacggccgcaagatcgaggtgccccctccgacctggcccggcctcccgaacagcgccgacatcacccctgagctctgcgatgctcagttccgcgtcttcgatgaccgcaaccgcttcgccgagaccggtggcttcgatgctctgaacgaggccctcaccattcccatggtccttgtcatgtccatctgggatgaccaccactccaacatgctctggctcgactccagctacccgcccgagaaggccggcctccccggtggcgaccgtggcccgtgcccgaccacctctggtgtccctgccgaggtcgaggctcagtaccccaatgctcaggtcgtctggtccaacatccgcttcggccccatcggctcgaccgtcaacgtc

SEQ ID NO: 1025 - protein, 451 aa, Humicola grisea var. thermoidea
MQIKSYIQYLAAALPLLSSVAAQQAGTITAENHPRMTWKRCSGPGNCQTVQGEVVIDANWRWLHNNGQNCYEGNKWTSQCSSATDCAQRCALDGANYQSTYGASTSGDSLTLKFVTKHEYGTNIGSRFYLMANQNKYQMFTLMNNEFAFDVDLSKVECGINSALYFVAMEEDGGMASYPSNRAGAKYGTGYCDAQCARDLKFIGGKANIEGWRPSTNDPNAGVGPMGACCAEIDVWESNAYAYAFTPHACGSKNRYHICETNNCGGTYSDDRFAGYCDANGCDYNPYRMGNKDFYGKGKTVDTNRKFTVVSRFERNRLSQFFVQDGRKIEVPPPTWPGLPNSADITPELCDAQFRVFDDRNRFAETGGFDALNEALTIPMVLVMSIWDDHHSNMLWLDSSYPPEKAGLPGGDRGPCPTTSGVPAEVEAQYPNAQVVWSNIRFGPIGSTVNV

SEQ ID NO: 1026 - DNA, 2552 bp, Humicola grisea
atagctaggctcgatgcgcccgttcaggtagcaacgtggacgagatctccgggggatgcagcgggcgcataccccagatttccaggggcgtttaatctatctcggtcttggggcccgtctgggcggagtgcggccaagaagactcgcgtccttgtctccaataacgacgaagcgactgttggctgatcaattagctggcgatgggtctgtggtatggaacgtcggctgagtcttccatctcccaccgtagacgtgttccgcggatcaaggtctcccgctccgtaaccgcccaggtggctcggttcttgatgatgggaaaggggccgacggcagtataaagagccatggaagcatccctcgaggccggaaggaaatcttgctcagccacccgcagtcgacttgtctatcgatctgagcagcagttgaccggtcttctctgtcatctcagcagcagtctttcaagatgcagatcaagagctacatccagtacctggccgcggctctgccgctcctgagcagcgtcgctgcccagcaggccggcaccatcaccgccgagaaccaccccaggatgacctggaagaggtgctcgggccccggcaactgccagaccgtgcagggcgaggtcgtcatcgacgccaactggcgctggctgcacaacaacggccagaactgctatgagggcaacaagtggaccagccagtgcagctcggccaccgactgcgcgcagaggtgcgccctcgacggtgccaactaccagtcgacctacggcgcctcgaccagcggcgactccctgacgctcaagttcgtcaccaagcacgagtacggcaccaacatcggctcgcgcttctacctcatggccaaccagaacaagtaccagatgttcaccctgatgaacaacgagttcgccttcgatgtcgacctctccaaggttgagtgcggtatcaacagcgctctgtacttcgtcgccatggaggaggatggtggcatggccagctacccgagcaaccgtgctggtgccaagtacggcacgggcgtacgttctctccgtcccgcccctaccaaaagtatgactcgtgctgacgtttgacagtactgcgatgcccaatgcgcccgtgacctcaagttcattggcggcaaggccaacattgagggctggcgcccgtccaccaacgaccccaacgccggtgtcggtcccatgggtgcctgctgcgctgagatcgacgtttgggagtccaacgcctatgcttatgccttcaccccccacgcctgcggcagcaagaaccgctaccacatctgcgagaccaacaactgcggtggtacctactcggatgaccgcttcgccggctactgcgacgccaacggctgcgactacaacccctaccgcatgggcaacaaggacttctatggcaagggcaagaccgtcgacaccaaccgcaagttcacgtaagttccctggccgcctcttcgacgacgcagaatgtccggatgctgacccagaacagcgttgtctcccgcttcgagcgtaacaggctctctcagttcttcgtccaggacggccgcaagatcgaggtgccccctccgacctggcccggcctcccgaacagcgccgacatcacccctgagctctgcgatgctcagttccgcgtcttcgatgaccgcaaccgcttcgccgagaccggtggcttcgatgctctgaacgaggccctcaccattcccatggtccttgtcatgtccatctgggatgacgtatgtggcaccaacctccaaccgggcatgagacctgtactgacgtgtcttgacagcaccactccaacatgctctggctcgactccagctacccgcccgagaaggccggcctccccggtggcgaccgtggcccgtgcccgaccacctctggtgtccctgccgaggtcgaggctcagtaccccaatgcgtacgttactaccgccgctgcatctgcaaaaaataccggtgctaaccattgtgcagtcaggtcgtctggtccaacatccgcttcggccccatcggctcgaccgtcaacgtctaagctatcacggctcaaaatcagcgcccgctctgctcgtcctgttcggcgcgccagtagggggatatggggcatttctttgttcaagcatttttctcttcgtcctgctacatattgagattgtgtatcgtatgcacgcgtacaaagtagaaaccatgatcaagtctcattgaactatactgctgctcccaagattaattatgccgtaatggtctgtttgcttttttttttttttttttggtgcacttgatcgtgtggcacattggccgctgtatgtatggctttccctcaatcgccgactgactcaaaacggcagtacaacagaagcccccattgcatcagaagagaggttttataatgccatgaggtgttctcagatgaaagacttcgagtatgatatcagatccaggtggatcggcttgctacatgtttggactttggtctaggctcaggaggattcattgccatgcctccctgaacttcttcacacgctgacaagaaacagcca

SEQ ID NO: 1027 - protein, 451 aa, Humicola grisea; identical to SEQ ID NO: 1025

SEQ ID NO: 1028 - DNA, 2774 bp, Trichoderma reesei
gaattctaggctaggtatgcgaggcacgcggatctagggcagactgggcattgcatagctatggtgtagtagaactcccgtcaacggctattctcacctagactttccccttcgaactgacaagttgttatattgcctgtgtaccaagcgctaatgtggacaggattaatgccagagttcattagcctcaagtagagcctatttcctcgccggaaagtcatctctcttattgcatttctgccttccactaactcagggtgcagcgcaacactacacgcaacatatcacatttattagccgtgcaacaaggctattctacgaaaaatgctacactccacatgttaaaggcgcattcaaccagcttctttattgggtccatacagccaggcggggatcaagctcattagccgccactcaaggctatacaatgttgccaactctccgggctttatcctgtgctcccgaataccacatcgtgatgatgcttcagcgcacggaagtcacagacaccgcctgtataaaagggggactgtgaccctgtatgaggcgcaacatggtctcacagcagctcacctgaagaggcttgtaagatcaccctctgtgtattgcaccatgattgtcggcattctcaccacgctggctacgctggccacactcgcagctagtgtgcctctagaggagcggcaagcttgctcaagcgtctggtaattatgtgaaccctctcaagagacccaaatactgagatatgtcaaggggccaatgtggtggccagaattggtcgggtccgacttgctgtgcttccggaagcacatgcgtctactccaacgactattactcccagtgtcttcccggcgctgcaagctcaagctcgtccacgcgcgccgcgtcgacgacttctcgagtatcccccacaacatcccggtcgagctccgcgacgcctccacctggttctactactaccagagtacctccagtcggatcgggaaccgctacgtattcaggcaacccttttgttggggtcactccttgggccaatgcatattacgcctctgaagttagcagcctcgctattcctagcttgactggagccatggccactgctgcagcagctgtcgcaaaggttccctcttttatgtggctgtaggtcctcccggaaccaaggcaatctgttactgaaggctcatcattcactgcagagatactcttgacaagacccctctcatggagcaaaccttggccgacatccgcaccgccaacaagaatggcggtaactatgcgggacagtttgtggtgtatgacttgccggatcgcgattgcgctgcccttgcctcgaatggcgaatactctattgccgatggtggcgtcgccaaatataagaactatatcgacaccattcgtcaaattgtcgtggaatattccgatatccggaccctcctggttattggtatgagtttaaacacctgcctccccccccccttcccttcctttcccgccggcatcttgtcgttgtgctaactattgttccctcttccagagcctgactctcttgccaacctggtgaccaacctcggtactccaaagtgtgccaatgctcagtcagcctaccttgagtgcatcaactacgccgtcacacagctgaaccttccaaatgttgcgatgtatttggacgctggccatgcaggatggcttggctggccggcaaaccaagacccggccgctcagctatttgcaaatgtttacaagaatgcatcgtctccgagagctcttcgcggattggcaaccaatgtcgccaactacaacgggtggaacattaccagccccccatcgtacacgcaaggcaacgctgtctacaacgagaagctgtacatccacgctattggacgtcttcttgccaatcacggctggtccaacgccttcttcatcactgatcaaggtcgatcgggaaagcagcctaccggacagcaacagtggggagactggtgcaatgtgatcggcaccggatttggtattcgcccatccgcaaacactggggactcgttgctggattcgtttgtctgggtcaagccaggcggcgagtgtgacggcaccagcgacagcagtgcgccacgatttgactcccactgtgcgctcccagatgccttgcaaccggcggctcaagctggtgcttggttccaagcctactttgtgcagcttctcacaaacgcaaacccatcgttcctgtaaggctttcgtgaccgggcttcaaacaatgatgtgcgatggtgtggttcccggttggcggagtctttgtctactttggttgtctgtcgcaggtcggtagaccgcaaatgagcaactgatggattgttgccagcatactataattcacatggatggtctttgtcgatcagtagctagtgagagagagagaacatctatccacaatgtcgagtgtctattagacatactccgagaataaagtcaacctttctgtgatctaaagatcgattcggcagtcgagtagcgtataacaactccgagtaccagcaaaagcacgtcgtgacaggagcggctttgccaactgcgcaaccttgcttgaatgaggatacacggggtgcaacatggctgtactgatccatcgcaaccaaaatttctgtttatagatcaagctggtagattccaattactccacctcttgcgcttctccatgacatgtaagtgcacgtggaaaccatacccaaattgcctacagctgcggagcatgagcctatggcgatcagtctggtcatgttaac

SEQ ID NO: 1029 - protein, 471 aa, Trichoderma reesei
MIVGILTTLATLATLAASVPLEERQACSSVWGQCGGQNWSGPTCCASGSTCVYSNDYYSQCLPGAASSSSSTRAASTTSRVSPTTSRSSSATPPPGSTTTRVPPVGSGTATYSGNPFVGVTPWANAYYASEVSSLAIPSLTGAMATAAAAVAKVPSFMWLDTLDKTPLMEQTLADIRTANKNGGNYAGQFVVYDLPDRDCAALASNGEYSIADGGVAKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEKLYIHAIGRLLANHGWSNAFFITDQGRSGKQPTGQQQWGDWCNVIGTGFGIRPSANTGDSLLDSFVWVKPGGECDGTSDSSAPRFDSHCALPDALQPAAQAGAWFQAYFVQLLTNANPSFL

SEQ ID NO: 1030 - DNA, 2193 bp, Trichoderma reesei
tcgaactgacaagttgttatattgcctgtgtaccaagcgcgaatgtggacaggattaatgccagagttcattagcctcaagtagagcctatttcctcgccggaaagtcatctctcttattgcatttctgcccttcccactaactcagggtgcagcgcaacactacacgcaacatatacactttattagccgtgcaacaaggctattctacgaaaaatgctacactccacatgttaaaggcgcattcaaccagcttctttattgggtaatatacagccaggcggggatgaagctcattagccgccactcaaggctatacaatgttgccaactctccgggctttatcctgtgctcccgaataccacatcgtgatgatgcttcagcgcacggaagtcacagacaccgcctgtataaaagggggactgtgaccctgtatgaggcgcaacatggtctcacagcagctcacctgaagaggcttgtaagatcaccctctgtgtattgcaccatgattgtcggcattctcaccacgctggctacgctggccacactcgcagctagtgtgcctctagaggagcggcaagcttgctcaagcgtctggtaattatgtgaaccctctcaagagacccaaatactgagatatgtcaaggggccaatgtggtggccagaattggtcgggtccgacttgctgtgcttccggaagcacatgcgtctactccaacgactattactcccagtgtcttcccggcgctgcaagctcaagctcgtccacgcgcgccgcgtcgacgacttctcgagtatcccccacaacatcccggtcgagctccgcgacgcctccacctggttctactactaccagagtacctccagtcggatcgggaaccgctacgtattcaggcaacccttttgttggggtcactccttgggccaatgcatattacgcctctgaagttagcagcctcgctattcctagcttgactggagccatggccactgctgcagcagctgtcgcaaaggttccctcttttatgtggctgtaggtcctcccggaaccaaggcaatctgttactgaaggctcatcattcactgcagagatactcttgacaagacccctctcatggagcaaaccttggccgacatccgcaccgccaacaagaatggcggtaactatgccggacagtttgtggtgtatgacttgccggatcgcgattgcgctgcccttgcctcgaatggcgaatactctattgccgatggtggcgtcgccaaatataagaactatatcgacaccattcgtcaaattgtcgtggaatattccgatatccggaccctcctggttattggtgagtttaaacacctgcctccccccccccttcccttcctttcccgccggcatcttgtcgttgtgctaactattgttccctcttccagagcctgactctcttgccaacctggtgaccaacctcggtactccaaagtgtgccaatgctcagtcagcctaccttgagtgcatcaactacgccgtcacacagctgaaccttccaaatgttgcgatgtatttggacgctggccatgcaggatggcttggctggccggcaaaccaagacccggccgctcagctatttgcaaatgtttacaagaatgcatcgtctccgagagctcttcgcggattggcaaccaatgtcgccaactacaacgggtggaacattaccagccccccatcgtacacgcaaggcaacgctgtctacaacgagaagctgtacatccacgctattggacctcttcttgccaatcacggctggtccaacgccttcttcatcactgatcaaggtcgatcgggaaagcagcctaccggacagcaacagtggggagactggtgcaatgtgatcggcaccggatttggtattcgcccatccgcaaacactggggactcgttgctggattcgtttgtctgggtcaagccaggcggcgagtgtgacggcaccagcgacagcagtgcgccacgatttgactcccactgtgcgctcccagatgccttgcaaccggcgcctcaagctggtgcttggttccaagcctactttgtgcagcttctcacaaacgcaaacccatcgttcctgtaaggctttcgtgaccgggcttcaaacaatgatgtgcgatggtgtggttcccggttggcggagtctttgtctactttggttgt

SEQ ID NO: 1031 - protein, 471 aa, Trichoderma reesei; identical to SEQ ID NO: 900

SEQ ID NO: 1032 - protein, 1377 aa, Pyrococcus horikoshii
CTACCTGGGAGCCCTTCTTAAGAGAAGAGAGAATACTGCTAGGATGATAAGAATTGCTGGTCCACAAATCTTCTTACTTGTATTTGACTTTGTAGGGGTGGTACTCCGAATAACGGATTGAGTACTTGAAGAACTTTTGGAACAACTATCCATCAATCTCTTCAGGTTATTATACTTATCTTCCCATATTGTTGTCCAATCATCCTGTAGAATCCCTCCGGTATCTCCACTATCTGGATTCCAGCTCCAGTAAAAGAAATCACAAAATTTATTCTCTATCATCCAATCAACTAGCTTATTTTGCCATATAACATCCCTTGGATCGCCTCCATGCCCATATTTTCCTCCAAACTCTCCTATTACAACTGAATATCCTAGTTCTAATTTTACGTATCCAAAGTGGTGATACCAGATATCTGGAAGATTATCCGGAAAACCCTTAGCGGGACCAAAGTACGGTTGATTATAGACATCTGGCCCATATACGTGAGGGCTGTATACTAGCTTATTCCTAGGTAAGTTAACTGGATAATCCTTTACGGCCATTAGATTTCCTCCCCACCAAGCGTTGTAGCCCCATTTGTAACTACTGTCAGTCTTCGGATTAGTAAATTGTGTCCCCTCCACGAATATCAACCAATGAGGGGCAACCTTCAGAATCGCTTTTCCTATCCTCTCAGCCGCCAAGTTCCAATCGGTTGCAGGGTTTCCCATACCCCATGTAGCCCCGGTACCATCTGTATAAGCAGCTGGGGGTGAGGTAACACTATGAGGCTCATTCTTTAGATCAGCCCCTATTACGTTCCAGTACTTACCGAACCTTTTGGCAACCTCTATCCATGTGTTAATAAAGTCTTCCTCTGAGAAGTCTTCCGTGTACCAGAGGGGTTCTATGTGAGTGCATCCTATCCTATGATAGTCGAGTAAGACAAAGATACCAAGATCTCCGGCCTTCTTTATGATCTTTTCCATAATCTGTAGGCTATCTAGTCCACGAAGATCTGGATTTTTACTGTAATCTATTCCAATTGGTTGTGTTCCTGGTTTTACAGACTCAGTACAGAAAGGAAGTCTTATTGCATTGAAGCCTAAGCTTTTGATCTGAAGAAGCATGTCTTCCCAGTTTCTCTTCCAAAGTCCGTGCACTACATGATTAGGTGTTTCAAAGCCAAACCAGTTTACACCAAAGAGATGAATGGGAGTTTCCTCTCCACTGGTGACATTAATCATGTATATCGTATCTCCTCTCACTTCGTAGTAAATTCCAGTCGGTGTTTGATATGTTGTATTTTCTGCATATACTGGCACGACTTGCCCGAATAGGCCTGCTAAAATAGTGCAAATTAGTACGATTTTAAGAATAGTATTCCCCTCCAT

SEQ ID NO: 1033 - protein, 458 aa, Pyrococcus horikoshii
MEGNTILKIVLICTILAGLFGQVVPVYAENTTYQTPTGIYYEVRGDTIYMINVTSGEETPIHLFGVNWFGFETPNHVVHGLWKRNWEDMLLQIKSLGFNAIRLPFCTESVKPGTQPIGIDYSKNPDLRGLDSLQIMEKIIKKAGDLGIFVLLDYHRIGCTHIEPLWYTEDFSEEDFINTWIEVAKRFGKYWNVIGADLKNEPHSVTSPPAAYTDGTGATWGMGNPATDWNLAAERIGKAILKVAPHWLIFVEGTQFTNPKTDSSYKWGYNAWWGGNLMAVKDYPVNLPRNKLVYSPHVYGPDVYNQPYFGPAKGFPDNLPDIWYHHFGYVKLELGYSVVIGEFGGKYGHGGDPRDVIWQNKLVDWMIENKFCDFFYWSWNPDSGDTGGILQDDWTTIWEDKYNNLKRLMDSCSKSSSSTQSVIRSTTPTKSNTSKKICGPAILIILAVFSLLLRRAPR

SEQ ID NO: 1034 - protein, 3004 aa, Acidothermus cellulolyticus
GGATCCACGTTGTACAAGGTCACCTGTCCGTCGTTCTGGTAGAGCGGCGGGATGGTCACCCGCACGATCTCTCCTTTGTTGATGTCGACGGTCACGTGGTTACGGTTTGCCTCGGCCGCGATTTTCGCGCTCGGGCTTGCTCCGGCTGTCGGGTTCGGTTTGGCGTGGTGTGCGGAGCACGCCGAGGCGATCCCAATGAGGGCAAGGGCAAGAGCGGAGCCGATGGCACGTCGGGTGGCCGATGGGGTACGCCGATGGGGCGTGGCGTCCCCGCCGCGGACAGAACCGGATGCGGAATAGGTCACGGTGCGACATGTTGCCGTACCGCGGACCCGGATGACAAGGGTGGGTGCGCGGGTCGCCTGTGAGCTGCCGGCTGGCGTCTGGATCATGGGAACGATCCCACCATTCCCCGCAATCGACGCGATCGGGAGCAGGGCGGCGCGAGCCGGACCGTGTGGTCGAGCCGGACGATTCGCCCATACGGTGCTGCAATGCCCAGCGCCATGTTGTCAATCCGCCAAATGCAGCAATGCACACATGGACAGGGATTGTGACTCTGAGTAATGATTGGATTGCCTTCTTGCCGCCTACGCGTTACGCAGAGTAGGCGACTGTATGCGGTAGGTTGGCGCTCCAGCCGTGGGCTGGACATGCCTGCTGCGAACTCTTGACACGTCTGGTTGAACGCGCAATACTCCCAACACCGATGGGATCGTTCCCATAAGTTTCCGTCTCACAACAGAATCGGTGCGCCCTCATGATCAACGTGAAAGGAGTACGGGGGAGAACAGACGGGGGAGAAACCAACGGGGGATTGGCGGTGCCGCGCGCATTGCGGCGAGTGCCTGGCTCGCGGGTGATGCTGCGGGTCGGCGTCGTCGTCGCGGTGCTGGCATTGGTTGCCGCACTCGCCAACCTAGCCGTGCCGCGGCCGGCTCGCGCCGCGGGCGGCGGCTATTGGCACACGAGCGGCCGGGAGATCCTGGACGCGAACAACGTGCCGGTACGGATCGCCGGCATCAACTGGTTTGGGTTCGAAACCTGCAATTACGTCGTGCACGGTCTCTGGTCACGCGACTACCGCAGCATGCTCGACCAGATAAAGTCGCTCGGCTACAACACAATCCGGCTGCCGTACTCTGACGACATTCTCAAGCCGGGCACCATGCCGAACAGCATCAATTTTTACCAGATGAATCAGGACCTGCAGGGTCTGACGTCCTTGCAGGTCATGGACAAAATCGTCGCGTACGCCGGTCAGATCGGCCTGCGCATCATTCTTGACCGCCACCGACCGGATTGCAGCGGGCAGTCGGCGCTGTGGTACACGAGCAGCGTCTCGGAGGCTACGTGGATTTCCGACCTGCAAGCGCTGGCGCAGCGCTACAAGGGAAACCCGACGGTCGTCGGCTTTGACTTGCACAACGAGCCGCATGACCCGGCCTGCTGGGGCTGCGGCGATCCGAGCATCGACTGGCGATTGGCCGCCGAGCGGGCCGGAAACGCCGTGCTCTCGGTGAATCCGAACCTGCTCATTTTCGTCGAAGGTGTGCAGAGCTACAACGGAGACTCCTACTGGTGGGGCGGCAACCTGCAAGGAGCCGGCCAGTACCCGGTCGTGCTGAACGTGCCGAACCGCCTGGTGTACTCGGCGCACGACTACGCGACGAGCGTCTACCCGCAGACGTGGTTCAGCGATCCGACCTTCCCCAACAACATGCCCGGCATCTGGAACAAGAACTGGGGATACCTCTTCAATCAGAACATTGCACCGGTATGGCTGGGCGAATTCGGTACGACACTGCAATCCACGACCGACCAGACGTGGCTGAAGACGCTCGTCCAGTACCTACGGCCGACCGCGCAATACGGTGCGGACAGCTTCCAGTGGACCTTCTGGTCCTGGAACCCCGATTCCGGCGACACAGGAGGAATTCTCAAGGATGACTGGCAGACGGTCGACACAGTAAAAGACGGCTATCTCGCGCCGATCAAGTCGTCGATTTTCGATCCTGTCGGCGCGTCTGCATCGCCTAGCAGTCAACCGTCCCCGTCGGTGTCGCCGTCTCCGTCGCCGAGCCCGTCGGCGAGTCGGACGCCGACGCCTACTCCGACGCCGACAGCCAGCCCGACGCCAACGCTGACCCCTACTGCTACGCCCACGCCCACGGCAAGCCCGACGCCGTCACCGACGGCAGCCTCCGGAGCCCGCTGCACCGCGAGTTACCAGGTCAACAGCGATTGGGGCAATGGCTTCACGGTAACGGTGGCCGTGACAAATTCCGGATCCGTCGCGACCAAGACATGGACGGTCAGTTGGACATTCGGCGGAAATCAGACGATTACCAATTCGTGGAATGCAGCGGTCACGCAGAACGGTCAGTCGGTAACGGCTCGGAATATGAGTTATAACAACGTGATTCAGCCTGGTCAGAACACCACGTTCGGATTCCAGGCGAGCTATACCGGAAGCAACGCGGCACCGACAGTCGCCTGCGCAGCAAGTTAATACGTCGGGGAGCCGACGGGAGGGTCCGGACCGTCGGTTCCCCGGCTTCCACCTATGGAGCGAACCCAACAATCCGGACGGAACTGCAGGTACCAGAGAGGAACGACACGAATGCCCGCCATCTCAAAACGGCTGCGAGCCGGCGTCCTCGCCGGGGCGGTGAGCATCGCAGCCTCCATCGTGCCGCTGGCGATGCAGCATCCTGCCATCGCCGCGACGCACGTCGACAATCCCTATGCGGGAGCGACCTTCTTCGTCAACCCGTACTGGGCGCAAGAAGTACAGAGCGAACGGCGAACCAGACCAATGCCACTCTCGCAGCGAAAATGCGCGTCGTTTCCACATATTCGACGGCCGTCTGGATGGACCGCATCGCTGCGATCAACGGCGTCAACGGCGGACCCGGCTTGACGACATATCTGGACGCCGCCCTCTCCCAGCAGCAGGGAACCACCCCTGAAGTCATTGAGATTGTCATCTACGATCTGCCGG

SEQ ID NO: 1035 - DNA, 3004 bp, Acidothermus cellulolyticus
ggatccacgttgtacaaggtcacctgtccgtcgttctggtagagcggcgggatggtcacccgcacgatctctcctttgttgatgtcgacggtcacgtggttacggtttgcctcggccgcgattttcgcgctcgggcttgctccggctgtcgggttcggtttggcgtggtgtgcggagcacgccgaggcgatcccaatgagggcaagggcaagagcggagccgatggcacgtcgggtggccgatggggtacgccgatggggcgtggcgtccccgccgcggacagaaccggatgcggaataggtcacggtgcgacatgttgccgtaccgcggacccggatgacaagggtgggtgcgcgggtcgcctgtgagctgccggctggcgtctggatcatgggaacgatcccaccattccccgcaatcgacgcgatcgggagcagggcggcgcgagccggaccgtgtggtcgagccggacgattcgcccatacggtgctgcaatgcccagcgccatgttgtcaatccgccaaatgcagcaatgcacacatggacagggattgtgactctgagtaatgattggattgccttcttgccgcctacgcgttacgcagagtaggcgactgtatgcggtaggttggcgctccagccgtgggctggacatgcctgctgcgaactcttgacacgtctggttgaacgcgcaatactcccaacaccgatgggatcgttcccataagtttccgtctcacaacagaatcggtgcgccctcatgatcaacgtgaaaggagtacgggggagaacagacgggggagaaaccaacgggggattggcggtgccgcgcgcattgcggcgagtgcctggctcgcgggtgatgctgcgggtcggcgtcgtcgtcgcggtgctggcattggttgccgcactcgccaacctagccgtgccgcggccggctcgcgccgcgggcggcggctattggcacacgagcggccgggagatcctggacgcgaacaacgtgccggtacggatcgccggcatcaactggtttgggttcgaaacctgcaattacgtcgtgcacggtctctggtcacgcgactaccgcagcatgctcgaccagataaagtcgctcggctacaacacaatccggctgccgtactctgacgacattctcaagccgggcaccatgccgaacagcatcaatttttaccagatgaatcaggacctgcagggtctgacgtccttgcaggtcatggacaaaatcgtcgcgtacgccggtcagatcggcctgcgcatcattcttgaccgccaccgaccggattgcagcgggcagtcggcgctgtggtacacgagcagcgtctcggaggctacgtggatttccgacctgcaagcgctggcgcagcgctacaagggaaacccgacggtcgtcggctttgacttgcacaacgagccgcatgacccggcctgctggggctgcggcgatccgagcatcgactggcgattggccgccgagcgggccggaaacgccgtgctctcggtgaatccgaacctgctcattttcgtcgaaggtgtgcagagctacaacggagactcctactggtggggcggcaacctgcaaggagccggccagtacccggtcgtgctgaacgtgccgaaccgcctggtgtactcggcgcacgactacgcgacgagcgtctacccgcagacgtggttcagcgatccgaccttccccaacaacatgcccggcatctggaacaagaactggggatacctcttcaatcagaacattgcaccggtatggctgggcgaattcggtacgacactgcaatccacgaccgaccagacgtggctgaagacgctcgtccagtacctacggccgaccgcgcaatacggtgcggacagcttccagtggaccttctggtcctggaaccccgattccggcgacacaggaggaattctcaaggatgactggcagacggtcgacacagtaaaagacggctatctcgcgccgatcaagtcgtcgattttcgatcctgtcggcgcgtctgcatcgcctagcagtcaaccgtccccgtcggtgtcgccgtctccgtcgccgagcccgtcggcgagtcggacgccgacgcctactccgacgccgacagccagcccgacgccaacgctgacccctactgctacgcccacgcccacggcaagcccgacgccgtcaccgacggcagcctccggagcccgctgcaccgcgagttaccaggtcaacagcgattggggcaatggcttcacggtaacggtggccgtgacaaattccggatccgtcgcgaccaagacatggacggtcagttggacattcggcggaaatcagacgattaccaattcgtggaatgcagcggtcacgcagaacggtcagtcggtaacggctcggaatatgagttataacaacgtgattcagcctggtcagaacaccacgttcggattccaggcgagctataccggaagcaacgcggcaccgacagtcgcctgcgcagcaagttaatacgtcggggagccgacgggagggtccggaccgtcggttccccggcttccacctatggagcgaacccaacaatccggacggaactgcaggtaccagagaggaacgacacgaatgcccgccatctcaaaacggctgcgagccggcgtcctcgccggggcggtgagcatcgcagcctccatcgtgccgctggcgatgcagcatcctgccatcgccgcgacgcacgtcgacaatccctatgcgggagcgaccttcttcgtcaacccgtactgggcgcaagaagtacagagcgaacggcgaaccagaccaatgccactctcgcagcgaaaatgcgcgtcgtttccacatattcgacggccgtctggatggaccgcatcgctgcgatcaacggcgtcaacggcggacccggcttgacgacatatctggacgccgccctctcccagcagcagggaaccacccctgaagtcattgagattgtcatctacgatctgccgg

SEQ ID NO: 1036 - protein, 562 aa, Acidothermus cellulolyticus
MPRALRRVPGSRVMLRVGVVVAVLALVAALANLAVPRPARAAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1037 - DNA, 2405 bp, Clostridium cellulolyticum
aagcttgcaggtgtactctcggaaggcatgcttttatgtgcggaggaagaaaatggagagcttgcacttatggtacctgaaaaaacaatgccatcaggggctgaaatcagataacagtgtgtgtttggcaaagggataataaatatttagcagtgtatgggatgtaccgaggtcattggtacatcccctttttatatcaataaaaataaaattaattgaatagtgggaactattaaagtataatatgaacagtaattaactgtaaaatttgcaattctttactttaactgttaaagtaatttatgaagtaattctttggataatcggtgttttggaaagggggggagaaaagtagttatatgaggtaagaaatacagcactttatgaaatttatatatacactttcacacttcctgtctttagttaattcgtaattcccggaacgttgctcttaacgtcaattcgtatgctacaccatacattattcaaatacagcaccttaaattatacctcttaacccaagcaacaagtcacatggttattccaatgtggacttgcattacaaaagacaaatcagaagaataaacttctactgctaccactattattattaatcaagggggtcaaatttaatgaaaaaaacaacagcttttttattatgttttctaatgatttttacagcattattgccaatgcaaaatgctaatgcgtatgatgcttcacttattccgaatcttcagattccacaaaagaacattccgaataatgatggaatgaattttgtaaaaggtttaagactcggatggaatctgggtaatacatttgatgcttttaacggtacaaatattactaatgaattggattatgaaacatcatggagcggtatcaaaacaactaagcagatgatagatgcaataaagcaaaaaggattcaatactgttcgtattcctgtatcctggcatccacacgtaagtggttcagattacaaaatcagtgatgtatggatgaatcgtgttcaagaagtagtaaattattgtatagataataaaatgtatgtcattttaaacacacatcatgacgttgacaaagtaaaaggttatttcccaagcagtcaatatatggcaagctccaagaaatatataactagtgtctgggcacagattgctgctaggtttgcaaactatgatgagcatcttatttttgaaggaatgaacgagcctcgtcttgtaggacatgcaaatgagtggtggcctgagctgacaaattcagatgtagttgattctattaattgtattaatcaacttaatcaggattttgttaatacagtacgtgcaacaggtggaaaaaatgcaagcagatatcttatgtgtccaggatatgttgcatctcctgacggagcaacaaacgattacttcagaatgccaaatgatatttctggtaataacaacaaaataattgtatctgtacatgcatattgtccatggaattttgcagggttggcaatggctgatggaggtacaaatgcttggaatataaatgattcaaaagatcaaagtgaagttacttggtttatggataatatttataataagtatacaagcaggggtattcctgtaataatcggtgaatgtggagcagtagataagaacaatctgaagacaagagtagaatatatgtcctattatgttgcacaagctaaagcacgtggtatattatgcatattgtgggataacaataatttctcaggtactggtgaattatttggtttcttcgatagaagaagctgtcagttcaagttccctgaaattatagatggaatggtgaaatatgctttcgaagccaagacagatcctgacccagtaattgtatatggagattataacaatgatggaaatgttgatgcacttgattttgcaggcttaaagaaatatattatggctgctgaccatgcttatgtaaagaatttggatgttaatctcgacaatgaagtgaatgcatttgaccttgctattttgaaaaaatatctgcttggtatggtaagtaagcttccaagcaactaaacaattgtttctgaaaaaaagtatcattcagtaggggataataaccttctgaatgatatttttttaagacataggttaccgtacaaaatactttataaattacctgaataatatgtaaataaaatatagtaagctaatgaataaaggtatataatgtatattgcagaaactgcaaatattatacatagataggggaatatgtaaaggtatgatagaatcaggtaaagaatttataatggaaaatgttctctctcttagaaaaaagatgactcagaaggaattagataatcaattggagaaaataggagaagaatttcttcaaaacaatggtgcaacccaagccgg

SEQ ID NO: 1038 - protein, 475 aa, Clostridium cellulolyticum; identical to SEQ ID NO: 845

SEQ ID NO: 1039 - DNA, 3471 bp, Clostridium thermocellum
gatcatgaaggtcactcaggatggatcgattccccagatagcaagcaatatcaacaactggcttaatacccataacccggatgtggtatttctgtggattggaggaaatgacctgcttttgagcggaaacgtgaatgcaacaggccttagtaatcttatagaccagattttcacagtgaaacccaatgtaacactgtttgtggccgattattatccgtggcctgaagcggtcaagcaatacaatgcggtgattccgggaatagttcaacagaaggccaatgccggcaagaaagtttattttgtaaagcttagtgagattcagtttgacaggaacaccgatatttcatgggatggtttgcacttgagcgaaataggatacacaaagattgcaaatatttggtacaagtatacgattgacatactaaaagctttggcaggacaaacgcagccaactccaagtccgtctccgactcccacagattctcctctggttaaaaaaggtgatgttaatttggacggtcaggtcaattcgacagatttcagccttttgaaaagatatatactgaaagttgtggatataaattcaataaatgtgacaaatgctgatatgaacaatgatggcaatatcaactctacagacatttcaatactaaagagaatacttcttagaaattagaaaatatattgtggatttttaaagtttttaataaacggatatataaaagaagctccaaattctttggagcttcttttatatatcccgggtttccaacaaagtgcaaccttttttcagcagaggttactatgtttttaattatttttttgctttgcgctgtccaaaagaaaatgatttttcgaattaatataataaacagtaacattaccgtttagtttgttataatgttttatttcaagccaaataggaagggggagctgtaagaataaagttgattgatgcaagaaaagaggatttaaagtaaaagattattgttttttgtaaaggatttttgtaaaggagagggtaatgtgaaaaaaattgtttctttggtttgtgtgcttgtgatgctggtaagcatcttaggctcgttttcagtcgtagcggcatcaccggtaaaaggctttcaggtatcgggaacaaagcttttggatgcaagcggaaacgagcttgtaatgaggggcatgcgtgatatttcagcaatagatttggttaaagaaataaaaatcggatggaatttgggaaatactttggatgctcctacagagactgcctggggaaatccaaggacaaccaaggcaatgatagaaaaggtaagggaaatgggctttaatgccgtcagagtgcctgttacctgggatacgcacatcggacctgctccggactataaaattgacgaagcatggctgaacagagttgaggaagtggtaaactatgttcttgactgcggtatgtacgcgatcataaatcttcaccatgacaatacatggattatacctacatatgccaatgagcaaaggagtaaagaaaaacttgtaaaagtttgggaacaaatagcaacccgttttaaagattatgacgaccatttgttgtttgagacaatgaacgaaccgagagaagtaggttcacctatggaatggatgggcggaacgtatgaaaaccgagatgtgataaacagatttaatttggcggttgttaataccatcagagcaagcggcggaaataacgataaaagattcatactggttccgaccaatgcggcaaccggcctggatgttgcattaaacgaccttgtcattccgaacaatgacagcagagtcatagtatccatacatgcttattcaccgtatttctttgctatggatgtcaacggaacttcatattggggaagtgactatgacaaggcttctcttacaagtgaacttgatgctatttacaacagatttgtgaaaaacggaagggctgtaattatcggagaattcggaaccattgacaagaacaacctgtcttcaagggtggctcatgccgagcactatgcaagagaagcagtttcaagaggaattgctgttttctggtgggataacggctattacaatccgggtgatgcagagacttatgcattgctgaacagaaaaactctctcatggtattatcctgaaattgtccaggctcttatgagaggtgccggcgttgaacctttagtttcaccgactcctacacctacattaatgccgaccccctcgcccacggtgacagcaaatattttgtacggtgacgtaaacggggacggaaaaataaattctacagactgtacaatgctaaagagatatattttgcgtggcatagaagaattcccaagtcctagcggaattatagccgctgacgtaaatgcggatctgaaaatcaattccaccgacttggtattgatgaaaaaatatctactgcgctcaatagacaaatttcctgcggaggattctcaaacacctgatgaagacaatccgggcattttgtataacggaagattcgatttttcagatccgaacggtccgaaatgcgcctggtccggcagcaatgttgagctgaatttttacggcacggaagcaagtgtgactatcaaatccggcggtgagaactggttccaggctattgtagacggcaatcctcttcctcctttttcggttaacgctactacctctaccgtaaagcttgtaagcggtcttgcagaaggagctcatcatcttgtattgtggaagaggacagaggcatccttgggagaagttcagttccttgggtttgattttggttcaggaaagcttcttgccgcaccgaagcctttggaaagaaagattgagtttatcggagactccatcacatgtgcatacggaaatgaaggaacaagcaaggagcagtcttttacaccgaaaaatgaaaacagctatatgtcttatgcggcaattacagcccgtaatttgaatgcaagtgcaaatatgattgcgtggtccggaatcggacttaccatgaactacggcggagcccccggacctcttataatggaccgttatccttatacccttccttacagcggagtcagatgggattttagcaaatatgtgcctcaggttgttgtaatcaatcttggtaccaatgatttttctacatcatttgcagataaaacaaagtttgtaacggcatataaaaaccttataagtgaagttcgcaggaactatccggatgcccatatattctgctgtgtcggtccgatgctttggggaacgggcctggatttgtgccgcagttatgttacggaagttgtaaatgattgtaacagaagcggggatttaaaggtgtattttgttgagtttccgcagcaggacggaagcaccggatacggagaagactggcatccaagtattgccacccaccagctgatggctgagcggcttactgcggaaataaaaaacaagcttggatggtaa

SEQ ID NO: 1040 - DNA, 3471 bp, Clostridium thermocellum; identical to SEQ ID NO: 1039

SEQ ID NO: 1041 - protein, 224 aa, Clostridium thermocellum
IMKVTQDGSIPQIASNINNWLNTHNPDVVFLWIGGNDLLLSGNVNATGLSNLIDQIFTVKPNVTLFVADYYPWPEAVKQYNAVIPGIVQQKANAGKKVYFVKLSEIQFDRNTDISWDGLHLSEIGYTKIANIWYKYTIDILKALAGQTQPTPSPSPTPTDSPLVKKGDVNLDGQVNSTDFSLLKRYILKVVDINSINVTNADMNNDGNINSTDISILKRILLRN

SEQ ID NO: 1042 - protein, 814 aa, Clostridium thermocellum
MKKIVSLVCVLVMLVSILGSFSVVAASPVKGFQVSGTKLLDASGNELVMRGMRDISAIDLVKEIKIGWNLGNTLDAPTETAWGNPRTTKAMIEKVREMGFNAVRVPVTWDTHIGPAPDYKIDEAWLNRVEEVVNYVLDCGMYAIINLHHDNTWIIPTYANEQRSKEKLVKVWEQIATRFKDYDDHLLFETMNEPREVGSPMEWMGGTYENRDVINRFNLAVVNTIRASGGNNDKRFILVPTNAATGLDVALNDLVIPNNDSRVIVSIHAYSPYFFAMDVNGTSYWGSDYDKASLTSELDAIYNRFVKNGRAVIIGEFGTIDKNNLSSRVAHAEHYAREAVSRGIAVFWWDNGYYNPGDAETYALLNRKTLSWYYPEIVQALMRGAGVEPLVSPTPTPTLMPTPSPTVTANILYGDVNGDGKINSTDCTMLKRYILRGIEEFPSPSGIIAADVNADLKINSTDLVLMKKYLLRSIDKFPAEDSQTPDEDNPGILYNGRFDFSDPNGPKCAWSGSNVELNFYGTEASVTIKSGGENWFQAIVDGNPLPPFSVNATTSTVKLVSGLAEGAHHLVLWKRTEASLGEVQFLGFDFGSGKLLAAPKPLERKIEFIGDSITCAYGNEGTSKEQSFTPKNENSYMSYAAITARNLNASANMIAWSGIGLTMNYGGAPGPLIMDRYPYTLPYSGVRWDFSKYVPQVVVINLGTNDFSTSFADKTKFVTAYKNLISEVRRNYPDAHIFCCVGPMLWGTGLDLCRSYVTEVVNDCNRSGDLKVYFVEFPQQDGSTGYGEDWHPSIATHQLMAERLTAEIKNKLGW

SEQ ID NO: 1043 - DNA, 9760 bp, Clostridium thermocellum
aatagtatttcaattgaaaatgatgaaggcattattgggatttatgaaagcgaaataaaatcaattgaagtaatgaaaggctaaacaccatctatcatgaataacgatagatggtgtttttatatctatggaagcacttggtgaaggccaagtgcttttattatgccgtcttttcggtactgcagacgtaaaagaacaggacactcgtggaagcgaccacgaaaaaaagcgtagtgaagatgaaaggagaatggaaatgacaaaagaacagttaatggaaatggggttaactgaagaacaagctgagaaggttctagttatatataaagaagatttaaaaagctttatccctaaagctagatttgatgaagtaaatgaagccaaaaagaatttagaggaacaacttaaagacagagataagcagttaaaggatcatatacatatgttagttagtataccaccaaaaataagtgtatcaagttttatgggatatttgaaaggaaaaagctcgttaatgatttttaataggcatgcaaatttaaagtataaatatgggaacagacatttttggtgcaggggatactatgtagacacagtaggaaggaacagaaaagcaattgagcaatatataaggagacaattacaagaagatatagcaagcgaccagataagtttaaatgagtatatagacccgtttacggtgagcgagtaaataaaagcaaaaaataaaaccactttagtggtggcttgagaagaatatgcggttggcgaaccattcaacgcgtcttaagacgctgcaaggaccatcgccttatagggctaggaggcaaaccgcgctgagccggtggttatgattattttatctttagttattccaaagaattattaacatccggcaagtcgtcaatttcaacatgttctccaaagacattgtaataaatgccgtcctttaaaaacatgatcctgtacttcgtatggtcacagccaaaggcaatggcattgaaatgacactttacatcggtggaaaaattgccattgtaaacggagaagaaaaagaacttgatgtacctgctgaaataacggacgacaggacttttgttccgttaagatttgtcagtgaaaactgtggagcggtggttgcctgggatgacagcacgaagtccgtatacataacaatgcccaataacataccgtcctctccaggagaagtattgccaaccgtcgaaagaaaaagtttgggtagtgagtttaaatataaagacttggccgtttcctttgacgaaatcattatcgaagaaatagaaaaaactaatgacgttaaaataactgtaaaaggcaaaaccaatattgaagattccacttttattctcgagctttataatgcttccggtagatcgtaaggccgctgatttgctttgtatatgcagtatcggaaaaaactgaagaagatatttttacacattttgaaccgtaaataccggtgccgttttcaattaccacagttgaaccggggtcggaacttacaacggtccaaccgttggctccgttttcgaaatcttccgtaaatattgcctgaggaacctcgtcaataaatccgtgatttactgtaaatattctttcatcactaaaagttgaaccatacttgtttatcaattcgcatttgtatttatactgtcctgcaggtcttgtaaacggctccaatattattacttgtggttcgggagtattatcttcctcctaaccgcattgaataagtttgccattctcatataatctccaacgggttccgttattattgtcggctaaaagtataattttacagctgattacaccattgtcttccactattcccagtataggctttcccggtgccccggttgcttcgccaaatgccggcgttgctgtgtttgcaaaaacagagattagaagcagacagcttgccacaacagctaaaatcttgttctttttcattttaactcctcctttttattaattggtgtgttgtttgtaagaacgcttagtcgtaagttttatgtaacctaaaactgtttaatcaataaaattataacatattacttcaaaagtggggacaaaaaagaacaaaaaaattgaaattttgatgaaaaatacaagataaattaagtgggccgaataaaaactgaacagagaagaagaaaacgtgatataattaaattagaacgaacgcgcgtacattattgaataacccagtgttaaatggtttcagtttacgattccaaatgtttatatccaatttacatttaaaaacatacaaaacatcaaaagtatttaataccaatatttaaaacacaatatttcaggaggaaaaaaatggtgagttttaaagcaggtataaatttaggcggatggatatcacaatatcaagttttcagcaaagagcatttcgatacattcattacggagaaggacattgaaactattgcagaagcagggtttgaccatgtcagactgccttttgattatccaattatcgagtctgatgacaatgtgggagaatataaagaagatgggctttcttatattgaccggtgccttgagtggtgtaaaaaatacaatttggggcttgtgttggatatgcatcacgctcccgggtaccgctttcaagattttaagacaagcaccttgtttgaagatccgaaccagcaaaagagatttgttgacatatggagatttttagccaagcgttacataaatgaacgggaacatattgcctttgaactgttaaatgaagttgttgagcctgacagtacccgctggaacaagttgatgcttgagtatataaaagcaatcagggaaattgattccaccatgtggctttacattgggggcaataactataacagtcctgatgatcttaaaaaccttgcagatattgatgatgattacatagtttacaatttccatttttacaatccttttttctttacgcatcagaaagcccactggtcggaaagtgccatggcgtacaacaggactgtaaaatatccgggacaatatgagggaattgaagagtttgtgaaaaataatcctaagtacagttttatgatggaattgaataacctgaagctgaataaagagcttttgcgcaaagatttaaaaccagcaattgagttcagggaaaagaaaaaatgcaaactatattgcggggagtttggcgtaattgccattgctgacttggagtctaggataaaatggcatgaagattatataagtcttctagaggagtatgatatcggcggcgcggtgtggaactacaaaaaaatggattttgaaatttataatgaggatagaaaacctgtctcgcaagaattggtaaatatactggcgagaagaaaaacttgattattaaaactacatttttgcaaaagtttgtaatttaaaaaatacaacagctgtttgaaagcatgtttttgcttcaaagtggtactgtaaatacaaactttgaggggaggtggacgatgaccagtgaagaaatagcaaaattatgtggtgtttccagagccacggtatccagggttattaacaacagtcccaacgtaaaagaggaaacgcggcaaaagattctggcagtgataaaagaaaaaaattatgttccgatagcgccggcacggcgtttggccgggatagacagcaatataattggcctgtttgttttggatattgacatatctgagtcaaagtcaagggtctcggaaagtacatacttttcacggctgataaatctgataatagaccaggcaaacaattttggctttcaagtattggtgtcaattataacttcacagaaacagctgagtgaaattagaaatctcttcatgagcagaaccattttcagcggcatttttatcggtgcgttcaatgatgaaatccaacttgatgatgatattataatgcaacatcccacaattattattgaccgccaatcagaaaggatggtgaaaaagccaaacagattggttgtaaacctggacaactttgagggtgcttataatgcgacacagtttttgattaaattggggcataccagaattgggcacatatccggggaccttagaaaactttcgggcatagaacgctatgaaggatacaaaaaagcattggaagatgcaggattaggttttgacaaaaatttggttcgtgaagggaacttccttgatgacagcggctataggcttgcacgtgagatattaaaagagaacgtgacggctattttctgtgccaatgatgtaatggcaattagtgcaattaaagccataaaagaaacgggtttgagtgtaccggatgatatatctgtaatagggtttgataatacagcaatcggaaattatatcatgcctgcattgacaactgtgaacgcgccgttggagcatattgcagaagcatgtattgagtcattgaaatacttttgcgagcacaaacattttaaacaaaaggaaatcagggttaaaaccgatttgataatccgggattcaaccaagagggctttggaattctgattgattgttttataatcatccaaagatgtactcggatacatataattggggtaataattacccctgaggtatttattataaattaaaaaaatatgcaggagggtgaaaaatgtataaaagattattgtcgtcagtactgataattatgctgttattatcagcctggtcgccaatatccgtacaagcttctgatggaatcaatgacattagaggtcattgggctgaagaagacttgaacaaatggatggaaaaaggtattttggtgggctaccaggatgggacgataaggcccgataataatatcacaagagccgaatttgtcacattaattaacaaggttttcgggctttatgaattaagccgggagcaattcgcagatgttgaagactcaaaatggtattcccgtgaaatattaaaagccagggctgcgggatatattgcaggttatggaagcaatgttttcaaacctgacaattatattacaagacaagaagccgttgttataatcgcgaaagtttttgaactccaaagcggcagcaattatacaagcaagtttaaagatggaagtctggtaaaggaatacgcaaaagattccgttagcgcgttggttgaaaaaggctacatagcaggttatgaagatggcactttcaggccggacaactacattacccgtgcagaaacaataaaaattctgaataaaattattccttccttgtataacgagaaaggagattataaaaatgaagaagtagccggaaacgctctgattaacaccgaaggagttattttaaaagataccgtaataaacggggatttgtatcttgctcagggaattcagaacggcgatgttacccttgacggtgtgaatgtaaaaggaacggttttcgtaaatggtggaggaagcgacagcatacattttataaatacgaaaataaacagggttgttgtcaataaaacaggagttagaattgtaacttccggcaatacctcggttgaaagtgttgtcgttaaatccggtgcaaaacttgaagaaaaagaattgacgggcgacggctttaaaaacgttacagtcgattctcaactttcagccggcaatgaaataatatttgtcggggattttgaacaggtcgatgttctggcggatgatgccttgctggaaaccaaagaggcaaaaatgaaactgagaatattcggccaaaggattaaagtaaatggaaaggcaatagaaaaatcatcaaagaactatattgtaaacggggaacttatatcaactgaggaagaacccggtccttccgacgcacccggtgcggaagacgatcaaaattcaggtagtccgggctcatcgactaatcctgcaccaaccaagaatccgaatgaagagtggcgtctggtttggagcgatgagtttaacggttctgaaataaatatggctaattggagctatgacgacccgaccaacggaagatggaacggggaagtacaatcctacacacaaaacaatgcctatatcaaagacggcgcgttggttattgaagcaagaaaagaagacattacggaaccaagcggtgagacttatcattatacatcgtcaaagctgattaccaaaggcaaaaagtcatggaagtacggaaaatttgaaataagggcaaaaatgccacagggacaaggtatatggcctgcaatctggatgatgccggaagacgaacccttctacggaacatggccaaagtgcggcgaaatagatattatggagcttttgggccacgagcctgataaaatttatggaacgatccattttggagagcctcataaagaatcccagggaacgtataccttgccggaaggccagacttttgctgatgatttccacgtttattcgattgaatgggaaccgggagaaatacgctggtatatagacggcaagctgtatcatgtcgctaatgactggtactcgagggacccgtaccttgccgatgactacacttatcccgcaccttttgaccagaatttcttcttgattctcaatatatccgttggtggcggctggccgggatatcctgacgaaacgacagttttcccgcagcaaatggttgtggactatgtgagagtatatcaaaaagataaatatcctcacagggaaaaaccggcaaaggaagaagtgaagccaagagagcctcttgaggacggcaattatatctataacggcggttttgatgtggatgattctgcagcagttggtgtggacggtgttccctatacgtcttactggacattcttaacagcatccggtggagctgcgacagtcaatgtagaggaaggtgttatgcacgtacagatagaaaacggagggacaaccgactacggcgtacaattgcttcaagctccgattcatcttgaaaaaggcgcaaaatataaagcatcttttgacatgaaagctgaaaatccaaggcaggtaaaactgaaaataggcggagacggcgacaggggatggaaagattatgcggctattccaccgtttacggtctcaacagagatgaccaactatgagtttgagtttactatgaaagatgataccgatgttaaggcacggtttgagtttaatatgggtttggacgataatgatgtctggattgacaatgttaaactgattaaaacagaagatgcgccggttatagatccttccgaaatagcaagacctccgcttctttccggcaactatatatacaacggtacctttgaccaaggtccgaacagaatgggattctggaattttgttgtggatagcactgcaaaggctacatactatattggaagcgatgttaatgagcgcaggtttgaaacaagaatagaaaaaggcggaacatcgaggggagccataagattggttcagccgggaattaacattgaaaacggcaaaacatacaaggttagcttcgaagccagtgcggcaaatacaagaactattgaggtggaaattgcaagcaatcttcacaacagcagcatttttgcgacaacttttgaaataagcaaagagagcaagatatacgaatttgagtttacaatggacaaagattcggacaagaacggagaacttaggttcaatctgggcggaagcaacgtgaacgtctatattgataatgtcgttatgaaaagagtaagtaccgatgaagttgaaggaaacctgattttaaacggggtatttaacggcctggcaggctggggatatggagggtatgaacctggatcggcagattttgaaagtcatgaggaacaatttagggcaattattagctctgtcggtaatgaaggttggaatgtacagttgtatcaggataatgttccgctggaacaagggcaaacctacgaagtttcttttgatgcaaaatcaacgattgacagaaagataattgttcagctgcaaaggaacggtacttcggataataattgggactcctatttctatcaagaagttgaacttactaatgaacttaaaacattcaaatatgaatttacaatgagtaaacctacagattcggcgtcaagatttaattttgctttgggtaatactgaaaacaaaacttatgctcctcatgaaataataattgacaatgttgtagtaagaaaagttgcgactccttctgcgctgatattgaacggaacctttgacgatggaatggatcattggctgctatactggggagacggtgaaggcaattgcgatgtaactgacggagagcttgaaattaacattaccaaggtaggtaccgcggattacatgccgcagattaaacaggaaaacatagcgttgcaagagggtgtgacgtatactttgtctcttaaagcgagagcgcttgaggcaagaagtattaaagtggacatattggattcttcttataactggtatggcggaactattttcgatttaacaacggaagatgccgtatacacgtttacatttacccaaagcaagtcgataaataacggtgtcttaactataaatttaggtaccatagaaggtaagacatccgccgcaactactgtctatcttgatgatattttgctggaacaacagtaagttgtaagtttgtaacggatgtaaaaataattaacagttgagtttttaaaggcattatattggttgtaaaactgtataatgccttttttttattgggtgcaacatttaacatacattttacaaagcgtttgattaaaatatgatataatttctttgattttgatgaaaagggaatgggtgaggtatggatctgtttggttttttagagcttataggcggcttgtccctgttcctctttggtatgagccttatgggaacaggtcttgaaaaaagtgcgggcaacaagctgaaggtcttgctggagcgtttgacgtcgaaaaagctgaatggttttttgatgggtctggcggtgaccaccatcatacaaagctcttcagctactacagttatggtggttgggttcgtaaactccggtataatgaccctaaagcaagcgatacacgttatcatgggagcaaacgtcggtacgacggttacagcatggattttaagcctggcgggaattgaaggcagcaatttgtttttaaaattattaaagccttcttcttttacgccggtgctggctttagttggtattatatattatttgtttatcaaaaatgaaagaaagaaagatattggattaattctgcttgggtttgcaacgctgatttacggtatggaaggaatgtcggcggcagttagaccgttaggtgaaatggaagaatttcgcaatatactgttaattttttcaaatccagtacttggggtgctgcttggtgccattgtgacaggtattatccaaagttcgtccgcttcggtgggaatccttcaggccttgtccgctacgggacaggtcacgatgggaacagctatacctataataatggggcagaatatcggtacttgtgttacagcgttaatttcatcggtgggaacaaataaaaatgcccgtcgtgctgcaatggttcacctttacttcaatcttatcggtacagtggtatttcttacgttgtttaccgtattagacagtttgtttaatttcgcttttcttgattggccgtcaaatcacttctttattgccgttgcccattcgttgttcaatattttgtgtacggctatgcttcttccctttagcggacttcttgaaaagctggcatacaagactata

SEQ ID NO: 1044 - protein, 1321 aa, Clostridium thermocellum
MYKRLLSSVLIIMLLLSAWSPISVQASDGINDIRGHWAEEDLNKWMEKGILVGYQDGTIRPDNNITRAEFVTLINKVFGLYELSREQFADVEDSKWYSREILKARAAGYIAGYGSNVFKPDNYITRQEAVVIIAKVFELQSGSNYTSKFKDGSLVKEYAKDSVSALVEKGYIAGYEDGTFRPDNYITRAETIKILNKIIPSLYNEKGDYKNEEVAGNALINTEGVILKDTVINGDLYLAQGIQNGDVTLDGVNVKGTVFVNGGGSDSIHFINTKINRVVVNKTGVRIVTSGNTSVESVVVKSGAKLEEKELTGDGFKNVTVDSQLSAGNEIIFVGDFEQVDVLADDALLETKEAKMKLRIFGQRIKVNGKAIEKSSKNYIVNGELISTEEEPGPSDAPGAEDDQNSGSPGSSTNPAPTKNPNEEWRLVWSDEFNGSEINMANWSYDDPTNGRWNGEVQSYTQNNAYIKDGALVIEARKEDITEPSGETYHYTSSKLITKGKKSWKYGKFEIRAKMPQGQGIWPAIWMMPEDEPFYGTWPKCGEIDIMELLGHEPDKIYGTIHFGEPHKESQGTYTLPEGQTFADDFHVYSIEWEPGEIRWYIDGKLYHVANDWYSRDPYLADDYTYPAPFDQNFFLILNISVGGGWPGYPDETTVFPQQMVVDYVRVYQKDKYPHREKPAKEEVKPREPLEDGNYIYNGGFDVDDSAAVGVDGVPYTSYWTFLTASGGAATVNVEEGVMHVQIENGGTTDYGVQLLQAPIHLEKGAKYKASFDMKAENPRQVKLKIGGDGDRGWKDYAAIPPFTVSTEMTNYEFEFTMKDDTDVKARFEFNMGLDDNDVWIDNVKLIKTEDAPVIDPSEIARPPLLSGNYIYNGTFDQGPNRMGFWNFVVDSTAKATYYIGSDVNERRFETRIEKGGTSRGAIRLVQPGINIENGKTYKVSFEASAANTRTIEVEIASNLHNSSIFATTFEISKESKIYEFEFTMDKDSDKNGELRFNLGGSNVNVYIDNVVMKRVSTDEVEGNLILNGVFNGLAGWGYGGYEPGSADFESHEEQFRAIISSVGNEGWNVQLYQDNVPLEQGQTYEVSFDAKSTIDRKIIVQLQRNGTSDNNWDSYFYQEVELTNELKTFKYEFTMSKPTDSASRFNFALGNTENKTYAPHEIIIDNVVVRKVATPSALILNGTFDDGMDHWLLYWGDGEGNCDVTDGELEINITKVGTADYMPQIKQENIALQEGVTYTLSLKARALEARSIKVDILDSSYNWYGGTIFDLTTEDAVYTFTFTQSKSINNGVLTINLGTIEGKTSAATTVYLDDILLEQQ

SEQ ID NO: 1045 - protein, 322 aa, Clostridium thermocellum
MDLFGFLELIGGLSLFLFGMSLMGTGLEKSAGNKLKVLLERLTSKKLNGFLMGLAVTTIIQSSSATTVMVVGFVNSGIMTLKQAIHVIMGANVGTTVTAWILSLAGIEGSNLFLKLLKPSSFTPVLALVGIIYYLFIKNERKKDIGLILLGFATLIYGMEGMSAAVRPLGEMEEFRNILLIFSNPVLGVLLGAIVTGIIQSSSASVGILQALSATGQVTMGTAIPIIMGQNIGTCVTALISSVGTNKNARRAAMVHLYFNLIGTVVFLTLFTVLDSLFNFAFLDWPSNHFFIAVAHSLFNILCTAMLLPFSGLLEKLAYKTI

SEQ ID NO: 1046 - DNA, 3885 bp, Clostridium thermocellum
gatcttaaaggtataacatggagcggaaaaaaatttgctgtcgcaggtacgaatatcatattatcttcagaaaacggaatcacgtggaatgccgttgaagttaatgccattcttcatgacattgcttttggcaacggaatatttgcagccgtcggttatgaccggttatcatgtcttctgtggatggagaacattgggaaacaaaagttgaagctttgcgttatgatttgactaatatagtgtggtacgataacaaatttattgccattggttcaggcagtacaccctccatagttgtatccggggacggaaaaacgtgggttgcaagaggtccaaaagatgcctcttacaagtgtgactcctctttgcataacgtggaatggcgaaaaactggttgcagccggctacgacagtactattctgaccgccgtgccaaaggatatagttaaagtgaaggtgaatgacagacccatagtatttgatgtggcgccaataatcggtgaaggaagaacactggtgcctctcaggcacatcttcgaagccctgggagcagaagtaaaatgggatgcatcaaccagaacagtaaccggaatcaaaggttcggacaagattatactgaaaattgacagcaaagaagcccttgtaaacggtgaaacaaaagagctggatgtacctgcaactatagtaaacggaaggacacttgtacctgtaaggtttatttcggaaagcttgggcgccgaagtttcatgggatgataattcaaaaaccgtcataattaaaacaaacttctaatgaaagcaacactattattcatactttgcttttagcatcagacgcctttgctgacaataaatttataaaaaccaaccgcttcagataactctttcattgcaaggttttaggacccattttcgtctcgaaaatactatattaacacacagtgataatgatataattaaaatagcacatgtttttttatttacacaatttttgtttttatttttccataatttatggagttggggagggtagttttaatgggtcaaaaacattttaaaagaagtctgttgtctgtattaacaatttcagccctgattatctcctgccttttcagttttattttcgttaacgcagatgacacttctgaagaacccgctttggaaggcctgtctatacactatatggacggcacactggacgtaaaatatcagagcatgcgtccttacataattattcataacaacagcggcatggatgtggacatggccgaccttagggtaaggtattactacgaaaaagagggtgttaccgaagaagtccttacatgcttttatacagcaataggtgcggacaaaatatttgccgaatttcatcccgagctgggatacgctgaaatcggctttaccagtgatgccggaattataaaaagcggtggcaacagcgggcagctgcagctggtactgaaaaaaatatcgaacggttactacgaccaaagcaatgattattcttatgacccaagttacactgattatgcagaatatgataaaataacactctattacaaaggtaaactggtatggggaaaagaaggacctcctcctccaccggaaccgacacctccgccaaacaacgacgactggcttcatgtggagggaaatctaatcaaggatgcccagggaaataccgtttatcttacaggaatcaactggtttggatttgaaactgacggagcaaacggttttcacggccttaacaaatgcaaccttgaggattctcttgatttaatggcaaaattaggtttcaatattctcagaatccccatcagtgctgaaattattctgcaatggaaaaacggcgaacgtgtagaaacttcctttgtaaacacctatgaaaacccgcgtcttgacggtctcagcagtcttgaaatactggactatacaataaatcacatgaagaaaaacggtatgaaagccatgattgacatgcacagttcaaccaaggactcataccaggaaaacctctggtataacaaggatataaccatggaagaatttatcgaagcctggaaatggattgtcgaaagatacaaggacgatgatacggtcattgcggtagatcttaaaaatgaacctcatggaaagtactccggtccgaatatcgccaaatgggatgattcgaatgacccgaacaactggaagagagcagctgaaatcattgccgaagaaattcttgcaatcaatccaaatcttttaatcgtcgtagagggtgttgaggcatacccgatggaagggtatgattacaccaactgcggtgagtttaccacatactgtaactggtggggcggaaatttaagaggagttgccgaccatcctgttgtcatatccgctccggacaagctcgtatattccgtacatgattacggaccggacatctatatgcagccgtggtttaaaaaagatttcgacattaacaccctttatgaggaatgctggtacccaaactggtactacattgtcgagcaaaatattgcgcctatgttaatcggcgaatggggaggcaagcttatcaatgaaaacaaccggaagtggcttgaatgtttggctacctttattgcagaaaagaaactgcatcataccttctgggcttttaatcccaactcagccgacaccggcggtctaatgcttgaggattggaaaaccgttgatgaggaaaaatatgcaataattgtgcccacattgtggaagaaaggtctggatcatgtaataccgctgggaggaattacggaggatacctttaaatatggtgacgttaacggtgattttgccgtaaactccaacgaccttacattgataaaacgctacgtccttaaaaatattgacgaattcccctctcctcatggattgaaagctgccgacgtggacggaaatgaaaaaataacctccagtgatgctgctcttgtaaaaaggtacgttctaagagccataacatcattcccggtggaagaaaaccaaaatgaataattagaaataaatcattaatctaaaaagctgtggaaaatgcaacttccacagctttttttacttattttttatacgcattatcaggcttcattcaaaattttttcaaattgcacattactcttttttatcactgctgtctttcgttgatttaacaattctttggcctggaataataatattgtatggtcgccaaagcaattgccgagactataggccaaaaccacgtatatttgccctgtgtgcttcctgtcgagttcttttggtcgtcctctgaagaatccgaagaagtattgtcgggattttcgacaatcacacatcttgcgccatccggtacgttatccactttctccagcatcacattgtcgaatgaagcttttccggtattcaaattaccatatccgcccaaacccaaagacacttttatcgtctctacattctcaccagttttaatatacaactcagtgtattgccattcatcaacagtacctcttatatcttttgaatatgtagtaactccttccaaagacaagttcgctcccaaaacatcgttgcccacattttcagttttaatccagcctgaaagtttgtaatatgagttcgggctgaccgtcacttcctgaagatatcttgcatctcttgcctctctattctcaatagtaacatagtactgcccgctttgagcaccttcctgctccactttaaactcgacaacaccgttctgataattccaaacccatgtactccagccaacaggcatattattatccacttcttcaaaagacggattttttaataaattttccgccgcgaatccccactgacaaagcagcatactaaacagcaaagcagaagcaacacagacgtg

SEQ ID NO: 1047 - protein, 660 aa, Clostridium thermocellum
MGQKHFKRSLLSVLTISALIISCLFSFIFVNADDTSEEPALEGLSIHYMDGTLDVKYQSMRPYIIIHNNSGMDVDMADLRVRYYYEKEGVTEEVLTCFYTAIGADKIFAEFHPELGYAEIGFTSDAGIIKSGGNSGQLQLVLKKISNGYYDQSNDYSYDPSYTDYAEYDKITLYYKGKLVWGKEGPPPPPEPTPPPNNDDWLHVEGNLIKDAQGNTVYLTGINWFGFETDGANGFHGLNKCNLEDSLDLMAKLGFNILRIPISAEIILQWKNGERVETSFVNTYENPRLDGLSSLEILDYTINHMKKNGMKAMIDMHSSTKDSYQENLWYNKDITMEEFIEAWKWIVERYKDDDTVIAVDLKNEPHGKYSGPNIAKWDDSNDPNNWKRAAEIIAEEILAINPNLLIVVEGVEAYPMEGYDYTNCGEFTTYCNWWGGNLRGVADHPVVISAPDKLVYSVHDYGPDIYMQPWFKKDFDINTLYEECWYPNWYYIVEQNIAPMLIGEWGGKLINENNRKWLECLATFIAEKKLHHTFWAFNPNSADTGGLMLEDWKTVDEEKYAIIVPTLWKKGLDHVIPLGGITEDTFKYGDVNGDFAVNSNDLTLIKRYVLKNIDEFPSPHGLKAADVDGNEKITSSDAALVKRYVLRAITSFPVEENQNE

SEQ ID NO: 1048 - DNA, 2155 bp, Clostridium thermocellum; identical to SEQ ID NO: 759

SEQ ID NO: 1049 - protein, 563 aa, Clostridium thermocellum; identical to SEQ ID NO: 760

SEQ ID NO: 1050 - DNA, 1800 bp, Bacillus subtilis; identical to SEQ ID NO: 31

SEQ ID NO: 1051 - protein, 499 aa, Bacillus subtilis; identical to SEQ ID NO: 32

SEQ ID NO: 1052 - DNA, 2323 bp, Bacillus lautus
ggggttttgttcatttcaagaaagagcacgaataaacatcgctaatttacacatgatttattctctaattattatggtgcatgccaattggaaaatgtagtagattagtcatcgtaacctgctttcatgccaagatatgtaatttttaaaaaagagtaaaggagaattcagatgaaaaaacgtagaagcagtaaagttattctttcgttggccatcgttgttgcattattggcagccgtcgaacctaatgccgctttagcagcggctccaccaagtgccatgcagtcctatgttgaagcgatgcagcctggctggaaccttggcaattctctggatgctgtcggtgcggatgagacgctggcacggggcaatccgcggatcacgaaagagctcattcagaacatcgctgcgcaaggctataagagcatacggattcctgttacctgggattcccatatcggcgcggccccaaattatcaaattgaagctgcgtacctcaatcgagtgcaggaggtcgtacagtgggctttggacgcgaacctctatgtgatgattaatgtccatcatgattcctggctatggatcagcaaaatggagtcgcagcacgatcaagtactggcccgttataatgcgatttggacgcaaattgccaacaagttcaagaacagcccgagcaagctgatgttcgagagcgtgaatgagcctcgctttacggatggcggaactacggatgaagccaagcagcaaaaaatgctggacgagctgaacgtatcctttttcaacatcgtcagaaattccggcggccagaacgcgactcgcccgctagttctttctacgttggaggcctctcccacccaagagagaatgacggcgctttataatacgatgaccaaactgaacgacaagaatctgatcgcaaccgttcatttttatggattctggccgtttagcgtaaatatcgcaggatatacgaaatttgatgcggagacgcaaaatgatattataacgaccttcgataacgtgtataacacatttgtagcaaagggaatcccggtggtagtcggcgaatatggccttcttggattcgataagaataccggcgtcattgaacagggtgagaaattgaaatttttcgagttttttgcccagtatgtgaagcaaaaaagcatttccactatgctatgggataacggacagcacttcaaccgcacgagcttcaagtggtctgacccggatttattcaatatgatcaaggccagttggaccggacgttcatccacggcttccagcgacctgatccatgtcaagcagggcacggcggtaaaagatacttcggttcagctcaatcttaacgggaatacgctaacttccctttccgtaaatggaacgacactgaaatcaggcacagattacactttaaacagcagcagattaacttttaaagcgagccagttgaccaagctgacctccttgggcaaattgggggtcaacgcgacgatcgtgactaaattcaatagaggcgccgactggaagttcaacgtagtcctgtacaatacgcctaagcttagcagtacgacggggactacttcttcctttgcgattccaacggctttcaacggggatcagcttgctacgatggaagcggtctatgtaaacggcggcaatgccggtccgcataactggacttcctttaaggaattcgaaacgacgttcagccccgcttatagcgaggggaaaatcaaactgcagcaggcgttctttaatgaagtgaatgataccacagtcacgctcaagttccaattctggagcggggagatcgtcaactacacgattaaaaagagcggttcgacggtgacgggtacggcttcataagcgagtttggcaaaaaaggaccgatatactgcctaatttggtattgccttagttgaaagcaattgctccgaataaacagaatgaagccccggccagctggccgggacttatgcgtttaggaagtataaacgaatcatcagcaatttatttagctcgtctcagttcagcaatatcggcttcatgtgaaacggagcggatgaacaatctttcgagcaatttctcatgctcctgctgggtttggagaacggtttgctgattagttttaagtacagatatatcctcacggacttgattgattcatgtggtccgttagttcttctacctttgtatttgtggcagcaacgatatgaattaattgttgaatgtgcccgccatgactgtttagctgctcattgtggctttgtaactgttctcggatttctttgaattcttggtcgtgctcattaagctt

SEQ ID NO: 1053 - protein, 566 aa, Bacillus lautus
MKKRRSSKVILSLAIVVALLAAVEPNAALAAAPPSAMQSYVEAMQPGWNLGNSLDAVGADETLARGNPRITKELIQNIAAQGYKSIRIPVTWDSHIGAAPNYQIEAAYLNRVQEVVQWALDANLYVMINVHHDSWLWISKMESQHDQVLARYNAIWTQIANKFKNSPSKLMFESVNEPRFTDGGTTDEAKQQKMLDELNVSFFNIVRNSGGQNATRPLVLSTLEASPTQERMTALYNTMTKLNDKNLIATVHFYGFWPFSVNIAGYTKFDAETQNDIITTFDNVYNTFVAKGIPVVVGEYGLLGFDKNTGVIEQGEKLKFFEFFAQYVKQKSISTMLWDNGQHFNRTSFKWSDPDLFNMIKASWTGRSSTASSDLIHVKQGTAVKDTSVQLNLNGNTLTSLSVNGTTLKSGTDYTLNSSRLTFKASQLTKLTSLGKLGVNATIVTKFNRGADWKFNVVLYNTPKLSSTTGTTSSFAIPTAFNGDQLATMEAVYVNGGNAGPHNWTSFKEFETTFSPAYSEGKIKLQQAFFNEVNDTTVTLKFQFWSGEIVNYTIKKSGSTVTGTAS

SEQ ID NO: 1054 - DNA, 3240 bp, Cellulomonas fimi; identical to SEQ ID NO: 865

SEQ ID NO: 1055 - protein, 872 aa, Cellulomonas fimi; identical to SEQ ID NO: 866

SEQ ID NO: 1056 - DNA, 2199 bp, Cellulomonas fimi
ggatccggacggtgggcgtcgtggccgacaccgacgcgctggagacgaccttcgcggacgtcgcggacctcgcgcggcagtgccggttcggcgactgccggcacgagcgggagccggggtgcgcggtgcgggcggccgtcgagtcgggcgacctgccggcccggcggctggactcgtggcggcgcctggagcgcgaggcggcctaccaggcacggcgcagcgacggcggctggccgcggaggagcgcgcacgctggaagaagatcaccaaggagtaccagcgggggatgcgcgggccggggcgtccgcggagctgacgggcccgggaggcccgcagccgggcggtggggagtccgctcggcgccagcgggtgtcgaagcgacgggtcgaagcgcgccaacgtcgcccgatccggaactgaagcgattaggaaatcctcatccgctcgcgccgtggggcattcgtcgggtttcctcgtcgggacccgcacgagcgtgccacgaggcccgaacccagggagctccttgatgtccacccgcagaaccgccgcagcgctgctggcggccgcggccgtcgccgtcggcggtctgaccgccctcaccaccaccgccgcgcaggcggctcccggctgccgcgtcgactacgccgtcaccaaccagtggcccggcggcttcggcgccaacgtcacgatcaccaacctcggcgaccccgtctcgtcgtggaagctcgactggacctacaccgcaggccagcggatccagcagctgtggaacggcaccgcgtcgaccaacggcggccaggtctccgtcaccagcctgccctggaacggcagcatcccgaccggcggcacggcgtcgttcgggttcaacggctcgtgggccgggtccaacccgacgccggcgtcgttctcgctcaacggcaccacctgcacgggcaccgtgccgacgaccagccccacgccgaccccgacgccgacgacccccacgccgacgccgaccccgacccccacccccacgccgacggtcacgccgcagccgaccagcggcttctacgtcgacccgacgacgcagggctaccgcgcgtggcaggccgcgtccggcacggacaaggcgctgctcgagaagatcgcgctcaccccgcaggcgtactgggtcggcaactgggccgacgcgtcgcacgcgcaggccgaggtcgccgactacaccggccgcgccgtcgcggccgggaagacgccgatgctcgtcgtctacgcgatcccgggccgcgactgcggctcgcactccggcggtggtgtgtccgagtccgagtacgcgcgctgggtcgacaccgtcgcgcagggcatcaagggcaacccgatcgtgatcctcgagcccgacgcgctcgcgcagctcggcgactgctccggccagggtgaccgcgtcggcttcctcaagtacgccgccaagtcgctcaccctcaagggcgcgcgcgtctacatcgacgcgggccacgcgaagtggctgtcggtcgacacgccggtgaaccgcctcaaccaggtcggcttcgagtacgcggtgggcttcgcgctcaacacgtcgaactaccagacgacggcggacagcaaggcgtacggccagcagatctcgcagcggctgggcggcaagaagttcgtcatcgacacctcgcgcaacggcaacggctcgaacggcgagtggtgcaacccgcgcggccgcgcgctcggcgaacgcccggtcgcggtgaacgacggctccggcctggacgcgctcctgtgggtcaagctgcccggcgagtccgacggcgcgtgcaacggcggcccggccgccggccagtggtggcaggagatcgccctggagatggcgcgcaacgccaggtggtgagctgagacctcgcccacgacgagcccgcggacggcgcacgtgcgtccgcgggctcgtccgtccggccgcgggcgcccggacgtcggggcggcggggacaatggggcggtggcagggcagacgacggaccgcacccgacgacggacgcgccgcgctcgacgtgtggcgcgccgaccccgcaggcgtgccgaccccggcgcggcggaccgcggtccggttcacgctcgaggagctcgccgacgtggcccccggcaacgcggtcgaggtgcgcgtcccgccggacggcggccgtgcaggccgtgcagggcccgcggcacacccggg

SEQ ID NO: 1057 - protein, 449 aa, Cellulomonas fimi
MSTRRTAAALLAAAAVAVGGLTALTTTAAQAAPGCRVDYAVTNQWPGGFGANVTITNLGDPVSSWKLDWTYTAGQRIQQLWNGTASTNGGQVSVTSLPWNGSIPTGGTASFGFNGSWAGSNPTPASFSLNGTTCTGTVPTTSPTPTPTPTTPTPTPTPTPTPTPTVTPQPTSGFYVDPTTQGYRAWQAASGTDKALLEKIALTPQAYWVGNWADASHAQAEVADYTGRAVAAGKTPMLVVYAIPGRDCGSHSGGGVSESEYARWVDTVAQGIKGNPIVILEPDALAQLGDCSGQGDRVGFLKYAAKSLTLKGARVYIDAGHAKWLSVDTPVNRLNQVGFEYAVGFALNTSNYQTTADSKAYGQQISQRLGGKKFVIDTSRNGNGSNGEWCNPRGRALGERPVAVNDGSGLDALLWVKLPGESDGACNGGPAAGQWWQEIALEMARNARW

SEQ ID NO: 1058 - DNA, 1621 bp, Thermobifida fusca; identical to SEQ ID NO: 827

SEQ ID NO: 1059 - protein, 441 aa, Thermobifida fusca; identical to SEQ ID NO: 828

SEQ ID NO: 1060 - protein, 596 aa, Thermobifida fusca
MSKVRATNRRSWMRRGLAAASGLALGASMVAFAAPANAAGCSVDYTVNSWGTGFTANVTITNLGSAINGWTLEWDFPGNQQVTNLWNGTYTQSGQHVSVSNAPYNASIPANGTVEFGFNGSYSGSNDIPSSFKLNGVTCDGSDDPDPEPSPSPSPSPSPTDPDEPGGPTNPPTNPGEKVDNPFEGAKLYVNPVWSAKAAAEPGGSAVANESTAVWLDRIGAIEGNDSPTTGSMGLRDHLEEAVRQSGGDPLTIQVVIYNLPGRDCAALASNGELGPDELDRYKSEYIDPIADIMWDFADYENLRIVAIIEIDSLPNLVTNVGGNGGTELCAYMKQNGGYVNGVGYALRKLGEIPNVYNYIDAAHHGWIGWDSNFGPSVDIFYEAANASGSTVDYVHGFISNTANYSATVEPYLDVNGTVNGQLIRQSKWVDWNQYVDELSFVQDLRQALIAKGFRSDIGMLIDTSRNGWGGPNRPTGPSSSTDLNTYVDESRIDRRIHPGNWCNQAGAGLGERPTVNPAPGVDAYVWVKPPGESDGASEEIPNDEGKGFDRMCDPTYQGNARNGNNPSGALPNAPISGHWFSAQFRELLANAYPPL

SEQ ID NO: 1061 - DNA, 2919 bp, Thermomonospora fusca
gacccctggcgcgtcataaaaagtaaatttatttcgttcctggcgcgccaactgctaccttttactaacaaaccacgccccgccaagagggtgatataaattacgggtaactccgcattacccgcgcatcgagagcaaaaaatcaccacggcatttatttccagttccttagataggcctttaccaggctgttacacaatcaggtcatacctatgaaagatgatttccctcaacgcttgttgcgcgtgagtgccgcatcgcttttggtgctggcggcactggcgggttgttattcccgcgctccctctacaacagactctacgacgacagtatctgccgatactgtgacgacccaggccaccgaaaaggtggagtggccagtgctcaacagcgccattaaaaaagacccggcagtcgaggcgcgtgtggatgacttgctggcgcgcatgacactggaagaaaaaatcggccaactggtccagccggaaattcgccatgtgacgcccgaggacattaagcaataccacgtcggttcggtcttaaacggcggtggcagcacacccggtgccaacaaatatgccagccttgaagactggtgtaagctggcagacagcttctattacgcctcggtggataaatctgatggtcgtatcggtattccggtgatctgggggaccgatgcggtacacggcctgggtaacgttataggtgcaaccctgtttccgcacaacataggtctgggcgcgaccaacaacccggagttgctcaagcaaatcggttgggcgacagcgcgtgaaattgctgcgactggcctggattggtatttctcgcctacagtcgccgtagcgcgcgatgatcgctggggccgcacctacgaatcctggtcggaagatccgcagattgtccatgccttcgccggcaagatggtggagggactgcagggcacaggaggttctgaccgactgtttacccatgaacatgtgatcgccacggccaagcactttattggcgacggcggtacgttgaatggtgtggatcgcggtgaaacccagggcgatgaaaaagtcctgcgcgatatccacggtgccggttatttcagtgcgattgagtctggcgtgcaggtggtgatggcctcctttaccagttgggaaggcacgcgcatgcacggccacaagtacctgctgaccgatgtgcttaaagacctgagtggttttgatggcctggtggtgggggattggagcggccacagttttattcccggttgtaccgcgcttaattgcccacaatcgctgatggcagggctggatatttacatggtgcccgagccggattgggaagagctgtataaaaatctgctggcgcaggccaaaaccggcgagcttcccatggcgcgggtcgacgacgcggtgcgggccatcctgcgcgtgaaaatccgtgcgggcctgtttgaaaaaggcgcaccatcgacgcgaccgctggctggtaaaaaagacgtgctcggtgcccccgaacaccgcgaggttgcccgccaggccgtgcgtgaatccctggtgttgctgaaaaacaaaaataatctcctgcctctcgcccgccagcaaaccgtgttggtcaccggggatggtgccgacaatagcggcaagcaatccggtggctggtcagtgtcctggcagggcacgggcaacaccaatgcggacttccccggcgctacttccatctatgccggtatcaacgccgtggtggagcaggccggtggtaaaaccctgctgagtgacgatggcagctttagtgaaaaacccgatgtggcgattgtggtattcggtgaagatccctatgccgaaatgcagggcgatgtgggcaacatggcctataaaccacgcgacaccagcgattgggaactgttgaagaaattacgcagccagggtattccggtggtatcgctgtttatttccggccgcccactgtgggtgaaccgcgagatcaatgcctcggatgcgtttgtggccgtctggttgccgggcactgaaggccaggggattgccgatgtcatcttcaggaatgcgcagggcgagatcaattacgacgtgaaaggccgcctgagtttctcctggcccaagcgccccgaacaaacaccgctgaaccgcggtgatgccaattacgatccgctgttcccctatggctatggcctgagctatggcgataaagataccctgggtgacaacctgtccgaggagggtattcaattggctgaggctctggatgtgctcgacctgttcaaccgtcgtccgattgagccctggcaattggaaatcatcggttaccagaatgaccgtgtgcccatggccagcagtacagtgaccgcttcctcgctgaaaattcaggcggtggatcgcaacgagcaagaggacgcgcgccgcgtgcaatggaatggctcgggacctggccaggttgccctgtcagtgggtgatcgccaggattttatcggctacgttaaatccgattcggcgctggtctttgatatcaaggtgaatgcggctcccacagtgacgacttacctgcgcttgggttgcggttcttactgcgcatcggatatcgacctgacggaaaaacttaaaggctttgccggacaggatgtgcagacagtgaccgtgccactccactgctacccgaattccggcgcaaacttcggtgtaacccaaccgccggaagagttctggacccaggtgctgcaacccttctcactgttaaccagtggcacattggatgtgacctttgcgcaggtgcgtgtcgtaaaaggtgctggaaaagacgtcgcctgcccctgaggtgaagtgaattttccaccataaaaaatcccccgccagtgctattctggcgggggatttttttatcggttatccacagtggaaacgcgcagattac

SEQ ID NO: 1062 - protein, 869 aa, Thermomonospora fusca
MKDDFPQRLLRVSAASLLVLAALAGCYSRAPSTTDSTTTVSADTVTTQATEKVEWPVLNSAIKKDPAVEARVDDLLARMTLEEKIGQLVQPEIRHVTPEDIKQYHVGSVLNGGGSTPGANKYASLEDWCKLADSFYYASVDKSDGRIGIPVIWGTDAVHGLGNVIGATLFPHNIGLGATNNPELLKQIGWATAREIAATGLDWYFSPTVAVARDDRWGRTYESWSEDPQIVHAFAGKMVEGLQGTGGSDRLFTHEHVIATAKHFIGDGGTLNGVDRGETQGDEKVLRDIHGAGYFSAIESGVQVVMASFTSWEGTRMHGHKYLLTDVLKDLSGFDGLVVGDWSGHSFIPGCTALNCPQSLMAGLDIYMVPEPDWEELYKNLLAQAKTGELPMARVDDAVRAILRVKIRAGLFEKGAPSTRPLAGKKDVLGAPEHREVARQAVRESLVLLKNKNNLLPLARQQTVLVTGDGADNSGKQSGGWSVSWQGTGNTNADFPGATSIYAGINAVVEQAGGKTLLSDDGSFSEKPDVAIVVFGEDPYAEMQGDVGNMAYKPRDTSDWELLKKLRSQGIPVVSLFISGRPLWVNREINASDAFVAVWLPGTEGQGIADVIFRNAQGEINYDVKGRLSFSWPKRPEQTPLNRGDANYDPLFPYGYGLSYGDKDTLGDNLSEEGIQLAEALDVLDLFNRRPIEPWQLEIIGYQNDRVPMASSTVTASSLKIQAVDRNEQEDARRVQWNGSGPGQVALSVGDRQDFIGYVKSDSALVFDIKVNAAPTVTTYLRLGCGSYCASDIDLTEKLKGFAGQDVQTVTVPLHCYPNSGANFGVTQPPEEFWTQVLQPFSLLTSGTLDVTFAQVRVVKGAGKDVACP

SEQ ID NO: 1063 - DNA, 2919 bp, Cellvibrio japonicus; identical to SEQ ID NO: 1061

SEQ ID NO: 1064 - protein, 869 aa, Cellvibrio japonicus; identical to SEQ ID NO: 1062

SEQ ID NO: 1065 - DNA, 3955 bp, Thermobispora bispora
ggcgcggcgctcgacggcgcggggaggtggcgggcgctgtggcggatcgtcgtgccgatcagccggcccaccctcaccgtgctgctcatcttcttcttcatctggacctggaacgagttcttcctgccgctgatctttctgatctccaacgagaaccagaccgtgccggtcgtgctcggcgtcctgcaaggggagaagatgatggacgccaccatgtcagcctcgcgctgctcggcatcctcccggccgtcgttcttctttcctgatcttccagcgcacgctgacccgcggcatcacggtcggtgcgatcaagtgagcccgcacgcgtccctcacgcctgacctggaggcgcaatgccgttacctaggcccctccgcgcgatgccgttacgtaggcccctccggcgcgctccccgcgtcacgctcgtcctcgccctgacggccgcccccgcgcgagccgacgccgaccttcccttccgcgaccccacgctcccgctcgcccagcggatcgacgacctgctcggcaggctgacgctcgacgagaagatctccctcctccaccagtaccagccgccgatcgagcgcctcggcatcaagagcttcaagaccggcaccgaggcgctgcacggggtcgcctggtccaccgacgtcaccgacaacggcgccgtcgtcacggcgaacggcaccgtgttcccccaggcggtcggcctggcgagcacctgggacccggagctgaatcagcgggtcggcaccgtcggcgaggaggcgcgcggattccacgcgcagaacccggtggtctgggggctcaacctgtgggccccggtcgtcaacctgctgcgcgacccgcgctgggggcgcaacgaggaggggtactccgaggaccccctgctcaccggcgcgatcgccatcgcgtacggctcgggcatccagggggacgaccccgaccacctcagggcggcccccacgctcaagcactacctcgccaacaacaacgagatccgccgcgacaccacctcgtcgaacctgccgccccgggtcaagcacgagtactacgaggcgccgttccgggcggcgatcacggccggcgcggccaccggtgtcatgaccgcgtacaacctggtgaacggccggccggccacggtcaaccccgacctcaacgacaccgtccggacctggaccgaccgggacctgctcaacgtcaccgacgccggggcgcccaacaacctcgtcggctcgcaggcctacttcgccaccctggccgaggccgacgccgccgcgctcaaggcggggatcgacagcttcaccacggacgagacgaacagcgcccccacgatcaccgcgatcaagacggcgctgtcgcagggcctgctcaccgaacaggacatcgacaccgccgtccggcacatcctcggcatccgcttccggctgggcgagttcgacccggacggcgggccgtacgcgaagatcaccccggatgtgatcgacagcccggcccaccggaggctcgcccgcgagaccgcggccaaggccatggtgctgctgaagaacgagcgcggcaccctgccgctcgaccccgggaagaaggtcgcggtggtcgggccgctcgccgacgtgctctacaccgactggtactcgggcaggccgacgtaccaggtcaccccgctcgacggcatccgggagcgggcggcctcggtgacctcctcggagggcgtcgaccgggtcgcgttcaaggacctcgccaccgggcaggtacatcaccgcggggagcgccccgagggcgccgacctcaggctgagcgccaccacgatcggcgagaccgagcagttcgacgtgttcgactggggccagggcatcgtgacgctgcgcagcgtcgccaacggcaagtacgtcagccgggccaactggtcgacgctggtcaacaacgccgaccagccgagcggctggttcgtgcaggagcagttcaagctggaggagcaggacgacggctcctacctgatcaggtacgccgggtacgagaccgcctacgactggttcggcccgaacacctacgtcaaggccgcccccgacggcacgctcaccctcaccacggccggcgacgccacgcggttcgccaaggaggtggtccgcagcggcatcgacgacgcggtcgccaaggcgaaggaggccgacgtggcggtggtcgtcgtcggcagcatgccgttcatcaacggccgcgaggaccacgaccgcaccgacatgaacctggccgagggccaggaggcgctggtcaaggcggtgttcaacgccaacccccgcaccgtcgtcgtgctggagaacagctacccgacgacgatcaactggatcgacgagcacgtgccggccatcctctggaccacccacgccggggcggagaccgggaacgcgctcgccgacgtgctctacggcgacgtcaacccggccgggcggctcacccagacctggtacctcggcggacgactgccggacatcctcgactacgacatcgtgcagcgggaccggacctacctgtacttcaagggcaccccgctctaccccttcgggcacggcctgtcgtacacgaccttccgctaccagggcctgcgggtggccgagaagggcgacgcctacgaggtctcggtacgggtgaccaacaccggccaccgggcgggcgacgaggtcgtccaggtctacacccaccagcggacctcgcgggtgaagcagccggtcaagcagctccgcgccttccagcggatcacgctcgccccgggccagagcaagaccgtgaccttcaccatccgcaaggccgacctggcgctgtgggacgtgacccggaacaagtggacggtcgagacctccgcccacgacgtcatggtcggggcgtcctcggccgacatccggcagcgggccacgatccacgtcaagggtgagcggatccccgaccgggacctgagcgtccccacccgggcgatcgacttcgacggctattcgggcgtcgagctggtggacgagaccaaggcgcgcggggacgccgtggcgggctccaccggtgactggatcgtcttcaaggacgtcgacctcaagcggcggccgtcccgggtgaccgccggggtcgcctccacctccggcggctccatcgagctccgcctcggctcgcccaagggcaagctgatcgccaccgtgcccgtcgccgccaccggcgacgtctaccggtacgagacggcggccgcccgggtcaccgggccgtccggggtcaaggacctctacctggtgttccagggcgacgtgcggatcaaggacctgagcctcacctcggggtgaccggacgccgcgccgtccgtacggccacgccggaccgccggccgggccgcccaccacgcgggcccgtccggaggtccggcaccggccgggaggagcggtccccggtgcggccgcggggaacgcgcgcgtccgccggggccatcgaagagaagacaagccgtccggcggccgccgcagggggaggaggagcggcgatctccggggggcgcgcaccacgtgcggggacgtgcgcgaacgcgggtgatccagggctgtttcgctattctccccgatatggccgaatcggtgagccagacgctggctcgcggtatcagctggctgcgcccgctcggcaccggcggtatgggcacggtgtggctggccagggacacggtgctcgaccgcgaggctggtcaaggagctgcgcctcaccgacggcctctccgaggcggaacggccgagctgatggccagggtcatgcgggaggcggaggtgaccgcccgcctccggcaccccggcatcgtggccctgcacgacgtctgatcgagggcggccggccgtggctcgtcatggagctcctccacggccgggacctcgcccgggagatcgcggccaacggccgatgccgccccacgtggtggccggcatcggcgcccgggtgc

SEQ ID NO: 1066 - protein, 986 aa, Thermobispora bispora
MPLPRPLRAMPLRRPLRRAPRVTLVLALTAAPARADADLPFRDPTLPLAQRIDDLLGRLTLDEKISLLHQYQPPIERLGIKSFKTGTEALHGVAWSTDVTDNGAVVTANGTVFPQAVGLASTWDPELNQRVGTVGEEARGFHAQNPVVWGLNLWAPVVNLLRDPRWGRNEEGYSEDPLLTGAIAIAYGSGIQGDDPDHLRAAPTLKHYLANNNEIRRDTTSSNLPPRVKHEYYEAPFRAAITAGAATGVMTAYNLVNGRPATVNPDLNDTVRTWTDRDLLNVTDAGAPNNLVGSQAYFATLAEADAAALKAGIDSFTTDETNSAPTITAIKTALSQGLLTEQDIDTAVRHILGIRFRLGEFDPDGGPYAKITPDVIDSPAHRRLARETAAKAMVLLKNERGTLPLDPGKKVAVVGPLADVLYTDWYSGRPTYQVTPLDGIRERAASVTSSEGVDRVAFKDLATGQVHHRGERPEGADLRLSATTIGETEQFDVFDWGQGIVTLRSVANGKYVSRANWSTLVNNADQPSGWFVQEQFKLEEQDDGSYLIRYAGYETAYDWFGPNTYVKAAPDGTLTLTTAGDATRFAKEVVRSGIDDAVAKAKEADVAVVVVGSMPFINGREDHDRTDMNLAEGQEALVKAVFNANPRTVVVLENSYPTTINWIDEHVPAILWTTHAGAETGNALADVLYGDVNPAGRLTQTWYLGGRLPDILDYDIVQRDRTYLYFKGTPLYPFGHGLSYTTFRYQGLRVAEKGDAYEVSVRVTNTGHRAGDEVVQVYTHQRTSRVKQPVKQLRAFQRITLAPGQSKTVTFTIRKADLALWDVTRNKWTVETSAHDVMVGASSADIRQRATIHVKGERIPDRDLSVPTRAIDFDGYSGVELVDETKARGDAVAGSTGDWIVFKDVDLKRRPSRVTAGVASTSGGSIELRLGSPKGKLIATVPVAATGDVYRYETAAARVTGPSGVKDLYLVFQGDVRIKDLSLTSG

SEQ ID NO: 1067 - DNA, 2997 bp, Prevotella bryantii
agcttctgcactgattcgcaagctagaccctaatcatctgatttctatcggtagtgaaggttcttggggatgcgagaatgatgaaaaagtatatgagcagatttgtgctgataaaaatatcgattactgtaatgttcatttatggccttataattggagttgggctaaggctgactccttgatagaaaatttgcctcgggccaaaaaaaatacgaaagagtatatagatcatcatttgattatctgtaagcgattgcaaaaacctcttgttatggaagaatatggatacccacgtgacggattcaaatttgatcttgaggcatctacccatgctcgtgacagctattatcagtatgtatttgggctggttgctgaaaatgctacgaaaggcgggctctttgccggatgtaacttctggggatggggtggtgaagccaaaccgaaacatgaacagtggcaggtaggtgatgactatacgggtgatcctgcacaagaagcgcaagggctaaattccgtttttgtaacagataagtctacattggctatagtcaaaaagtattgtaaaatcttatcttctattcgataatcacgaatagaataatctataatctaactatttatcaacagaatgaataaaaaaattggtgtttttgcgttaggaatttgtttgtctggagcatcaatggcacaggctcctcagttacgagctgacaatattgacgagattattgctgctatgacgttggaagagaaagcccaactcttaacaggttgtggtaatgctggattcccaggaagtggagctgctatggggcatcaaacgaagttggtggcgggtgctgcgggtgttactgcaggaatcccacgtttgggtataccacagacggttgttgccgatggtcctgctggagttcatattgatgcatatcgtaagggtacaaatcaaactttctttgctacaggtttccctataggtacttgtttggcttcaacctggaatttagatttggtagaaaaagtaggtaaggctattggtaatgaaactttggaatatggatgtgatgccattttaggtccaggtatgaatctgcatcgtaacccgctttgtggccgtaatttcgaatattatagtgaagatcctattgttacgggattgataggtgctgctatggtaaaaggaatccaaagtcagggggtaggtgtatctgctaagcattttgctgtaaactcgcaagagtctgatcgtacacgtgtagatgaacgtgtcagtcagcgtgctttgcgtgaactttatctcaagggttttgagataatggtacgtaagagtgctccgtggactctcatgtcttcttataatcgtattaatggagtatattctcagggcaattatgatttgttgactaaagtgcttcgacaagactggggatttaagggtatcgttatgaccgattggataggtgaacgtgctgatttaccaataagtgatgttgtcaaagctggtaatgatttgttgatgcctggtttccctactcaagtaaatcatatcattgagggagtgaaaagtggaaaaatagatataaaagatgtagaccgtaatgtgcgtaatatgttggaatatatcgtgaaaacgcctcgttttaagggttataaattctcgaatacaccaaatttaaaagcacatgctgctataactagacagtcttctactgaaggtatggtcttactgaagaatggtaaactgaatggtcagcatattttgccgatgaagcagatgagtaaggtcgccctctttggtgtaaatagctatgactttatgagtggtggtctcggttctggctgtgttaatgttccttatgtggtagatatggttcaaggattgaaaaatgctggtatcagtacaacagcacagttgactgacatttatgaaaagtacgtagcttatgccaagtcaaagttgaaagcagataagaatcctgaaatgtggttcttggatcagggacagcctaaactagatgaaattgaaatttctcgtcgttgtgttgaacatgaagtgtcggaggctcaggctgctattattacaatcggtagacaggctggtgaaggtcttgatcgtaagatagaaggtgaatttaatctttctgctcaagaaaaggatatgatatcaaacgtcagtgctgttttccataatcaaggtaaaccggttattgttgtaattaattctggtagtgttatggaaactgcaagttggcgtgatttagtagatgctattcttgtagcatggcaacctggtgaagaaggtggtaactctgtagtagatgtattaacaggtaaagcaaatccttcgggaagacttacgatgacatggcctatagctgcggtagatcatccttctacagctaatttccctcagcagcctgattattataatcttacagaaaaactttatgctaataatcttgcaggtgtaaactatactaatcatgatgaagatatttatgtaggatatcgttatttcgatgcttttgataagccggtagcttatcctttcggttatggtttgagttatacaactttcagtatgagtaactttgctgttaaacaaataaaagataaggtacaggtgaaggttacagtcaagaatacgggtaaaacaagtggcaagcaggtggcacagatctatgttcaagctccaaaaggtaattatgaaaaacctgtcaaggaattgaaatcttttgctaaaactcaggaattagctccaggtcagagccagattttaacaatgacaatagaccgtcgtgacttaacgagctttgatgaggctaacagtcagtggaaaggtgatgctggtgagtatgtatttatggtaggtgataatgctgctcatatggttggtacagctaaacttcgtttggtggaatatacagagaaggtcagtgaggccatgaagccacagcatacgcttaacttattgagaagaaataaataatctttgtatag

SEQ ID NO: 1068 - protein, 785 aa, Prevotella bryantii
MNKKIGVFALGICLSGASMAQAPQLRADNIDEIIAAMTLEEKAQLLTGCGNAGFPGSGAAMGHQTKLVAGAAGVTAGIPRLGIPQTVVADGPAGVHIDAYRKGTNQTFFATGFPIGTCLASTWNLDLVEKVGKAIGNETLEYGCDAILGPGMNLHRNPLCGRNFEYYSEDPIVTGLIGAAMVKGIQSQGVGVSAKHFAVNSQESDRTRVDERVSQRALRELYLKGFEIMVRKSAPWTLMSSYNRINGVYSQGNYDLLTKVLRQDWGFKGIVMTDWIGERADLPISDVVKAGNDLLMPGFPTQVNHIIEGVKSGKIDIKDVDRNVRNMLEYIVKTPRFKGYKFSNTPNLKAHAAITRQSSTEGMVLLKNGKLNGQHILPMKQMSKVALFGVNSYDFMSGGLGSGCVNVPYVVDMVQGLKNAGISTTAQLTDIYEKYVAYAKSKLKADKNPEMWFLDQGQPKLDEIEISRRCVEHEVSEAQAAIITIGRQAGEGLDRKIEGEFNLSAQEKDMISNVSAVFHNQGKPVIVVINSGSVMETASWRDLVDAILVAWQPGEEGGNSVVDVLTGKANPSGRLTMTWPIAAVDHPSTANFPQQPDYYNLTEKLYANNLAGVNYTNHDEDIYVGYRYFDAFDKPVAYPFGYGLSYTTFSMSNFAVKQIKDKVQVKVTVKNTGKTSGKQVAQIYVQAPKGNYEKPVKELKSFAKTQELAPGQSQILTMTIDRRDLTSFDEANSQWKGDAGEYVFMVGDNAAHMVGTAKLRLVEYTEKVSEAMKPQHTLNLLRRNK

SEQ ID NO: 1069 - DNA, 2163 bp, Fibrobacter succinogenes
atgcgtatctataagctttccccgattttttcggccgctgttcttttgagcgcgggcgttgcctctgccgaaaccaagtttttctacaatcaggttggttacgatgtcgaccagccgatttccgtgattgtccaaagcgaaaatcttgcggacggagctgaatttagcgtgatgtcgggtgggactgcggtcaagacgggtaagctctcgacgggttcgaatccggataactggctgaatagtggcaagttttatgtggcggacttgacgggccttaaggcgggcaagtatacgctccaggtttccgagaatggtcaaccgcagaaatcgggcgaatttacggtgggcgaaaacgctttggctgcaaatacgcttgcgtcagtgctcaattacttctatgatgatcgtgcagatgaccctactgttgaaggctgggataagcagatgccggtgtacaagtccgacaaaaagcttgatgtgcatggcggttggtatgatgcgagcggcgatgtcagtaagtatttgagtcacctttcttatgcgaattatctgaacccgcagcagattcctttgacggtctggtcgcttgcttttgcttcggaacgcatcccgaagttgcttggttcgacatcgacaaaggcgaaaacggctgatgaagcggcttacggtgccgattttttggtccgcatgctcgatgaacagggctttttctatatgaccgtgtttgataactggggtagccccatgggtaaacgtgaaatttgtgctttcagcggttccgatggcatcaagagtaccgattaccaaacggccttccgtgaaggcggtggcatggcgattgcagctctcgctagtgctgcaaggctaaagctgaagggtgactttacgagcgaacagtatttggctgctgcggaaaaggcttataagcatttgtccgaaaaacagagtgttggcggcgactgcgcttactgcgatgaccataaagaaaatatcattgatgattatacggcgcttttggcggcgacggaactttatgccgctacaaaaaaacaggagtatctggaagatgcttatgaccgtgccgaacatttatcttctcgtgtaagtaaagatggctatttctggagcgatgatgcaaagactcgtccgttctggcatgctagcgatgcggggcttccgttggttgcccttgctcgttatagtgaggttgttggcgctattgacgaagatgccggcataaaagttcatggtcggccattcccttattggggttgcgttactatgattggtggtggttgcgtgaacgaatctatcgataatgttcgtaatgccattaggtctcattttgactggcttgttaaaattacgaataaggttgataacccgtttggttatgcccgccagacttacaagactcaggacaaaataaaggatggattctttatcccgcacgataacgaaagtaattattggtggcagggtgaagatgctcgccttgcaagtctttctgcggcgataatgtacgcaaatcgcattattgacggcgaatataggaatgttaccacgagtgatgtgcaaaaatatgctacggatcagcttgactggattttgggcaagaatccctatgcgacttgcatgatgtatggcaagggaacgaagaacccgcaaaagtatgatggccagtcaaaatatgacgcaacgcttgaaggcggtattgcaaacggcattagcggcaagaatcaggatggctcgggtattgcctggacggatgacggtgtcgctgctgtgggttttgattctgaaaaggaatcttggcaggtgtggcgctgggatgaacagtggctgccgcacagcacatggtacttgatggcgcttgtggaacgctatgatgaattgactaagcctgtggaattctctgttggactttcgaagtctacggttgctgcaaaggcgagtgtttctcttgttggcaagatgctctcgctgaatttgccgcgttctgtcgtaggcaagtccgtcaaggttcttgatgtgcgcggcaatgtgctgatgcaaaagacggtgcagggtgtgagcgagacgatggatgtgagtacgcttaatcgcggactttacctcgtgcaaatccaaggcttcgctgccaagaagtttgttgtgaagtaa

SEQ ID NO: 1070 - protein, 720 aa, Fibrobacter succinogenes
MRIYKLSPIFSAAVLLSAGVASAETKFFYNQVGYDVDQPISVIVQSENLADGAEFSVMSGGTAVKTGKLSTGSNPDNWLNSGKFYVADLTGLKAGKYTLQVSENGQPQKSGEFTVGENALAANTLASVLNYFYDDRADDPTVEGWDKQMPVYKSDKKLDVHGGWYDASGDVSKYLSHLSYANYLNPQQIPLTVWSLAFASERIPKLLGSTSTKAKTADEAAYGADFLVRMLDEQGFFYMTVFDNWGSPMGKREICAFSGSDGIKSTDYQTAFREGGGMAIAALASAARLKLKGDFTSEQYLAAAEKAYKHLSEKQSVGGDCAYCDDHKENIIDDYTALLAATELYAATKKQEYLEDAYDRAEHLSSRVSKDGYFWSDDAKTRPFWHASDAGLPLVALARYSEVVGAIDEDAGIKVHGRPFPYWGCVTMIGGGCVNESIDNVRNAIRSHFDWLVKITNKVDNPFGYARQTYKTQDKIKDGFFIPHDNESNYWWQGEDARLASLSAAIMYANRIIDGEYRNVTTSDVQKYATDQLDWILGKNPYATCMMYGKGTKNPQKYDGQSKYDATLEGGIANGISGKNQDGSGIAWTDDGVAAVGFDSEKESWQVWRWDEQWLPHSTWYLMALVERYDELTKPVEFSVGLSKSTVAAKASVSLVGKMLSLNLPRSVVGKSVKVLDVRGNVLMQKTVQGVSETMDVSTLNRGLYLVQIQGFAAKKFVVK

SEQ ID NO: 1071 - DNA, 1515 bp, Thermococcus sp
taacgggccccccctcgaggtcgacggtatcgataagcttgatatcgaattcctgcaggtcgagataatcgagaaggcgggggagattgagagaacccaggaagatttgaaagctttaacggagtgggccttcagggaggaggccaggctcctcgaaaggtgggagaagattgtgaggcccggaaggcttcccctcctcttcgggcggagctggagaaaggttaacgaagaggctggacttaggctggagggttgaggatgttcaggtttccggatggatttctcctcggaacggcaacgtcttcctaccagatagagggcgacaacgtctggagcgactggtggtactgggcggagaaggggaagcttccccctgccgggaaggcctgcaactcctgggagctgtacgagaaagaccttgaactgatggccgggctgggttatgcggcctaccgcttctccatcgaatggggcagggtctttcccgaggagggaagaccgaacgaggaggcattaatgcgctaccaggggataatcgacctactcagagagaacgggattactccgatgctcacgctccaccacttcaccctgccggcgtggttcgccctcaggggtggcttcgaaagggaggagaacctggagcactggaggggctacgttgagctgatagccgacaacatcgagggcgttgagctggtggcgaccttcaacgagccgatggtttacgtcgtggcctcatacgtcgagggaacctggccgcccttcaggaagaacccgctgaaggccgagaaggtcgcggcaaatctcatcagagcccacgccatcgcctacgagattcttcacggtaagttcagggtcggaatagtgaagaaccgcccgcacttcattccggcgagcgattccgagagggacaggaaagctaccgatgagatagactacaccttcaaccgctctctcttggacggaatcctgaccgggagattcaagggcttcatgaggaccttcgacgttcccgcgagcggcctcgactggctcgggatgaactactacaacatcatgaaggttagggcagtgcggaacccgctcagacgcttcgccgtcgaggatgccggtgtgagcagaaagaccgacatgggctggagcgtctatccgaagggcatctacgatgggctgagggcctttgcggagtacggtcttccactctacgtcaccgagaacggcatagcaacgcttgacgacgagtggcgggtggaattcatagtccagcacctccagtacgtccacaaagccctaaaagagggcatcgacgttaggggctacttctactggtcgctggtagacaactacgagtgggccgagggtttcaggccgcgctttgggctggtggaggttgattacgagaccttcgagaggaagccgaggaaaagcgcccacatctacggggaaatcgctaagaaaggggagatacgcggcgagctgcttgaggggtacggacttggggaaaagctttaa

SEQ ID NO: 1072 - protein, 418 aa, Thermococcus sp
MFRFPDGFLLGTATSSYQIEGDNVWSDWWYWAEKGKLPPAGKACNSWELYEKDLELMAGLGYAAYRFSIEWGRVFPEEGRPNEEALMRYQGIIDLLRENGITPMLTLHHFTLPAWFALRGGFEREENLEHWRGYVELIADNIEGVELVATFNEPMVYVVASYVEGTWPPFRKNPLKAEKVAANLIRAHAIAYEILHGKFRVGIVKNRPHFIPASDSERDRKATDEIDYTFNRSLLDGILTGRFKGFMRTFDVPASGLDWLGMNYYNIMKVRAVRNPLRRFAVEDAGVSRKTDMGWSVYPKGIYDGLRAFAEYGLPLYVTENGIATLDDEWRVEFIVQHLQYVHKALKEGIDVRGYFYWSLVDNYEWAEGFRPRFGLVEVDYETFERKPRKSAHIYGEIAKKGEIRGELLEGYGLGEKL

SEQ ID NO: 1073 - DNA, 1636 bp, Bacillus circulans
gtgaagagctatgtgatgaagcacgccagtcccgtctatcaacgttcggggcggcgtgcttttcctatcatttagtataaattcggtatgagatccaacgtgagggaaagcgtttcatccattgtcctggctgtgatttaatactttgcgaaaggcctcttccgagcgttaccataatgatatatactgggctagtaagcttgaaaggagtcggataaatttatgagtattcatatgtttccttctgattttaagtggggagtggccacggccgcgtatcagattgaaggcgcttataatgaagatggacgggggatgtccatctgggacacattcgctcacacgccgggcaaagtgaagaatggcgataacggaaacgtcgcttgcgacagttatcaccgggtagaggaagatgtgcagctattgaaggatctgggcgtgaaggtgtaccgcttctcgatctcgtggccgcgcgttcttccgcaggggaccggagaggtgaatcgtgccggactggattattatcatcggctcgtggacgagctgttggctaacggaattgagcccttctgcaccctgtaccactgggatcttccgcaagcgcttcaagatcagggcggatggggcagccgcatcaccatcgatgcatttgctgagtacgccgaattgatgttcaaggaactcggtggaaaaatcaagcaatggataacctttaatgagccttggtgcatggcgttcctgtccaactatctgggcgtgcatgctccgggaaataaagatttgcagctggctatcgacgtaagccatcatctgctggttgcgcatggacgtgctgtaacgctcttccgcgagctgggcatctcgggcgagatcgggatcgcgccgaacacgtcatgggccgttccttaccgacgcaccaaggaggatatggaggcttgcctgcgcgtgaacggctggtctggcgactggtatctggacccgatctatttcggggaatatccgaaattcatgctggattggtacgagaacctgggctacaagccgccgattgtggacggcgatatggagctgattcaccagccgattgatttcatcggcatcaactactatacctcttccatgaatcgttacaatcctggagaagcgggcggcatgctttccagcgaagcgatctccatgggcgctccgaagacggatatcggctgggaaatctatgccgaggggctgtacgatttgctccgctatacggcggacaaatacggcaatccgacgctgtatattacggagaacggggcttgctataatgacggtctttccctggacgggcgcattcatgatcagcgccggattgattacttggcgatgcacctgattcaggcgagccgcgcgattgaggatggaatcaatctgaagggatatatggaatggtccttgatggacaactttgagtgggcggaagggtacggcatgcgcttcggtctggtgcatgtcgattatgacacgctggtccgcaccccgaaagacagcttctactggtacaaaggcgtcatctcaagaggctggcttgatctgtaacagctgaacattgtgattcatctgctccgtggttatcttcggagcagtttttctaagagat

SEQ ID NO: 1074 - protein, 450 aa, Bacillus circulans
MSIHMFPSDFKWGVATAAYQIEGAYNEDGRGMSIWDTFAHTPGKVKNGDNGNVACDSYHRVEEDVQLLKDLGVKVYRFSISWPRVLPQGTGEVNRAGLDYYHRLVDELLANGIEPFCTLYHWDLPQALQDQGGWGSRITIDAFAEYAELMFKELGGKIKQWITFNEPWCMAFLSNYLGVHAPGNKDLQLAIDVSHHLLVAHGRAVTLFRELGISGEIGIAPNTSWAVPYRRTKEDMEACLRVNGWSGDWYLDPIYFGEYPKFMLDWYENLGYKPPIVDGDMELIHQPIDFIGINYYTSSMNRYNPGEAGGMLSSEAISMGAPKTDIGWEIYAEGLYDLLRYTADKYGNPTLYITENGACYNDGLSLDGRIHDQRRIDYLAMHLIQASRAIEDGINLKGYMEWSLMDNFEWAEGYGMRFGLVHVDYDTLVRTPKDSFYWYKGVISRGWLDL

SEQ ID NO: 1075 - DNA, 2869 bp, Bacillus sp. GL1
ggatccaaaatgaacatgacgacaaaagaggcgaaaagaaataaggttttcagatggcctgcatacggtcttgcgctgctgttggccggcggtcttgccgcctgctccggaggctcgaacgacggcgccccggcctcggctacggcgccctcttcggggccgcctcagacgtcttcggcgagtccgtccggtccgtccgcctctcctgccgcgagtccgacatccgaagcggacaacgacgccgcgctgctcgaagcgttcaaggagcaggcccaatccgacctgtcggccgccgagctgaacaaggcgctcgacgacaaactggcgcaggcctcgccggagaccggagatgcgctgcttcgcgagatgcttgcctactacgaccgaagcttgccgggcatggagaaaaaactggaagcgcaaaacgtccagcaggcgctgcagaagctcgaatggccgccgacgtccgatcagatcggtcaaatcaaagacgaacaagcgcgctcgctcgttcaggaggctatcgacggcggctacaagctcgagacgaccgagggcttttatttccccgtcgtagactatggcaagctgaagcgaacggacccgagggtgaccgccgtcacgaaggattatgtcgcgctgctggccgtcgagtcggatcaaaagtcggcctcggacggggggctcgtcatcgaacgctcggaggtcgccgcgcgcgccgcgcaagcggaagcttacgtcgcggcccatcccgaagcgccggagcggaagcaagccgaagatttgtttgcgacgcgctacattccgtttttgctgatgggactggataatacgcccgtattcgatttcgatacgtttaagatcgatacgcaggtcaaggcggcgattgaaaaggccatttccgattatccaggcacggtcacggcgaagctggcccaggagtatctggccatcctggacaaaacgggaggcgccgtctacaaaaagggcaagaacggagagcagatcgccattcccgaggtcaaggcgtattacgacgggctcgaggcgcatgcccgcacgctgctcgacgaggccaatccgaataagtaagcgccaatatcgcacagcataacctatgggcgcatgcggtctttttgtataaaatagagttggaaaacgttttacatgacgcgtgcgccatacgaatactttgtgcggaggggttaggaatggcttcgattcaatttccgaaagatttcgtctggggaacggctaccgcttcctatcagatcgaaggggcctacaacgaagacgggcggggaatgtcgatctgggatacgttctcccgcacgccgggcaaggtcgttaacggcgacacgggcgacatcgcttgcgacagctatcatcgctacgaagaagatatcgcgctgctcaaaaacctgggcgtcaaggcataccgcttctcgatcgcctggccccgtatctatccggacggagacggcgagctgaaccagaagggcctcgattattacgccaaggtcatcgacggcttgctggccgccggcatcgagccttgcgtgacgctgtaccactgggatctgccgcaagcgcttcaggacaagggcggttgggacaaccgggatacgatccgcgcgttcgtccgatacgcggagaccgcgttcaaggcgttcggaggcaaggtgaagcagtggatcacgtttaacgagacctggtgcgtgtcgttcctctccaactatatcggggcgcatgcgccgggcaacaccgatctgcagctcgccgtcaacgtcgcgcacaattgcatggtggcgcacggcgaagcggtgaaggcgttccgcgcgctcggcatctccggcgagatcggcacgacgcacaatttgtactggttcgagccatatacgaccaagccggaggacgtcgcggccgcgcaccgcaatcgcgcttacaacaacgagtggttcatggacccgaccttcaagggtcaatacccgcagttcatggtcgactggttcaagggcaagggcgtcgaagtgccgattcagccgggcgacatggagacgatcgcgcagccgatcgacttcatcggcgtgaacttctacagcggcggcttcggccgttacaaggaaggcgaagggctgttcgactgcgaggaggtgcaggtcggcttcgacaagacttttatggactggaacgtatacgcggaaggtctgtacaaggtgctgtcgtgggtgcacgaggaatacggcgacgtgccgatctacatcacggagaacggcgcgtgctacgaggacgagctcacccaggaaggccgcgttcacgacgcgaagcgcgccgactatttcaaaaagcactttatccagtgtcatcgtctgatcgagtcgggcgtgccgttgaagggctacttcgcctggtcgctgctcgacaacttcgagtgggcggaagggtacgtcaagcgcttcggcatcgtctataccgactacaagacgcttaagcggtatccgaaggacagctatcggttcattcaaagcgtgatcgagaacgacggattcgaggcttgagcaaatgaaaagcggcagccgggcacatccggtctgccgcttgtatttatgttgcgtccgagttcgtgggagccatgtcttccggcagcaagccgagcaggtccgcgatttccgagtcggaaaaacctctggatcgcatgcgcccgatggtggccgcttgctcgtcttttttaccctgttcaatgccttccttaatccctcgttcgtatccccatcgttcccacgccggcatcagttccataatccgttcctcctcttcgggatgcaagctgacgaattctcgcataatcgacttctcttctataggatcc

SEQ ID NO: 1076 - protein, 448 aa, Bacillus sp. GL1
MASIQFPKDFVWGTATASYQIEGAYNEDGRGMSIWDTFSRTPGKVVNGDTGDIACDSYHRYEEDIALLKNLGVKAYRFSIAWPRIYPDGDGELNQKGLDYYAKVIDGLLAAGIEPCVTLYHWDLPQALQDKGGWDNRDTIRAFVRYAETAFKAFGGKVKQWITFNETWCVSFLSNYIGAHAPGNTDLQLAVNVAHNCMVAHGEAVKAFRALGISGEIGTTHNLYWFEPYTTKPEDVAAAHRNRAYNNEWFMDPTFKGQYPQFMVDWFKGKGVEVPIQPGDMETIAQPIDFIGVNFYSGGFGRYKEGEGLFDCEEVQVGFDKTFMDWNVYAEGLYKVLSWVHEEYGDVPIYITENGACYEDELTQEGRVHDAKRADYFKKHFIQCHRLIESGVPLKGYFAWSLLDNFEWAEGYVKRFGIVYTDYKTLKRYPKDSYRFIQSVIENDGFEA

SEQ ID NO: 1077 - DNA, 2497 bp, Bifidobacterium breve
caccgaatcgccgtagatcatgcgcggctcgctcggtggctgtgcgggccccgacacgcgcatcgtcacgagcacgccggcgaactcaagataatgctcgacgggcagtggtcgcgatgtgaacgtgagcatacgtacttcggcgcaccgcgggcatatcggctcggcggggctggggatgctacgctgtactgcgtgttgtcaatgatcagccgagcggatgtcgccgtaattccaatggttggccaggcgtacggcgagcgtgcggccggtgaagcggaagcgcacctgcgtgtacgggtagacccacacacagctggccgtcggtggcggtgatgcggcctcggtgcgcaatgactcgtctgaggccgagatgaactgcatgacactccttgtgtgtggctgtgtgcgcgggttttacgtgcgccgggcactgtcgattatcggcgataaccctatgtgtgtccaccggtatcgatgatagcgaacggtccgcgcgacactgtgaagcgctacagtattggaatagttatggttgtgataatctattcaacaaggcaagcgcaggcaatggttgccgcgtgatcgcacactcaccccagctgcacgggcataacagcatcggcgccaactagaaaggaatcaccgatgacgatgatcttccccaagggattcatgttcggcacggccaccgcggcgtatcagatcgaaggcgcggttgccgaaggcggccgtacgccgtcgatctgggacacgttctcgcacaccggccacacgctcaacggcgacaccggcgatgtggccgatgatttctaccaccgttgggaagacgacctcaagctgctgcgcgacctgggggtgaacgcctaccgcttctcgatcggcatcccgcgcgtcatccccacgccggatggcaagccgaaccaggaaggccttgatttctacagcaggatcgtcgaccgcctgctcgaatacggcatcgcgcctatcgtgacgctctaccactgggacctgccgcagtacatggcgtctggagacggccgtgagggcggctggctcgagcgcgagacggcgtacaggatcgccgattacgccggcatcgtggccaagtgcctgggggaccgcgtgcacacgtacacgacgctcaacgaaccctggtgctcggcccatctgagctatggcggcaccgagcatgcgccgggcctcggcgcggggccgcttgcgttccgcgcggcgcaccacctcaacctcgcccatggcctcatgtgcgaagccgtgcgcgccgaagccggggcgaagccggggctgtccgtgacgctcaacctgcagatttgccgcggagacgccgacgcggtgcaccgcgtggacctcatcggcaaccgcgtgttccttgatccgatgctgcgcgggcgctaccctgacgagctgttctcgatcacgaagggcatctgcgactgggggttcgtgtgcgacggcgacctcgacctcatccaccagccgatcgacgtgctcggcctcaactattactccacgaatctggtgaagatgagcgaccgcccgcagttcccgcagagcacggaagcgtccacggcgcccggtgcgagcgatgtcgactggctgccgacggccggtccgcacaccgagatggggtggaacatcgacccggatgcgctgtacgagacgcttgtgcggctcaacgacaactatccgggcatgccgcttgtggtgaccgaaaacggcatggcgtgccccgacaaggtggaagtgggcaccgacggtgtgaagatggtgcacgacaacgaccgcatcgactacctgcgccgacaccttgaagcggtgtaccgcgcgatcgaggagggcaccgatgtgcgcggttacttcgcgtggtcactgatggacaacttcgagtgggccttcggctatagcaagcgcttcggcctgacctacgtggactacgagtcgcaggagcgcgtcaagaaagacagcttcgactggtaccgccgcttcatcgccgaccatagcgcgcgctgagggcatccgcagctctctacaacggctgcttccggctttttcgccggaagtagccgttgttgtgtctggggcatcttcgagcatagagagctaaacgtgtgtcatctcgccgtcacgaggccgagcctctgagcatcctgacgaagtatatccgaggccgctgaggatgacaaccgtcgtacctgtccgaaaaaacggaaaggcaccgactttttgagacagatacgcctataactgtccgaaaaaacggaagggtaccgatatttcagagaagaatgcctcgccaaggaaaagcgcgatatcaatggcgcccccaatgcagacaggccggtgcgcttgctgtcacaacatggtgccgacagatagacaacacgctcggttcctatacgctcatcttcgtggtcctatatatgaagtgagcaggtgcgctgtacacgcggcacattgagacacgccgaattgggga

SEQ ID NO: 1078 - protein, 460 aa, Bifidobacterium breve
MTMIFPKGFMFGTATAAYQIEGAVAEGGRTPSIWDTFSHTGHTLNGDTGDVADDFYHRWEDDLKLLRDLGVNAYRFSIGIPRVIPTPDGKPNQEGLDFYSRIVDRLLEYGIAPIVTLYHWDLPQYMASGDGREGGWLERETAYRIADYAGIVAKCLGDRVHTYTTLNEPWCSAHLSYGGTEHAPGLGAGPLAFRAAHHLNLAHGLMCEAVRAEAGAKPGLSVTLNLQICRGDADAVHRVDLIGNRVFLDPMLRGRYPDELFSITKGICDWGFVCDGDLDLIHQPIDVLGLNYYSTNLVKMSDRPQFPQSTEASTAPGASDVDWLPTAGPHTEMGWNIDPDALYETLVRLNDNYPGMPLVVTENGMACPDKVEVGTDGVKMVHDNDRIDYLRRHLEAVYRAIEEGTDVRGYFAWSLMDNFEWAFGYSKRFGLTYVDYESQERVKKDSFDWYRRFIADHSAR

SEQ ID NO: 1079 - DNA, 2894 bp, Clostridium thermocellum
aacaggataaagcttaccggtgagataaacaacattccgtttacgtttacaggcacgggttacagttttgtagttgaaagcttcaaaataaaagtaaaattcctcaaaccgggcacaatagtatttgacggggcagattccagactaagatacaattttaattacgttgacggagcaggaaacattcattcaaagagcgtggacaaacattttgacgacatgacggtgaatgtcacgatgaaggttgatataaactgatgggttgccaaaagacgatttaacatatatatgcacatataaacgcaaagcatgaggaggatagaaatggcggtagatatcaagaaaataataaagcagatgactttggaagaaaaagcagggttgtgctcgggactggatttttggcataccaagcctgttgagagactgggcattccttcaataatgatgactgacggacctcatggactgagaaagcagagggaagatgcagagattgcggacatcaacaacagcgttccagcaacctgttttccgtctgcagcaggtttggcatgttcctgggacagagaactggttgagagagtaggtgcagcactaggagaagaatgtcaggcggaaaatgtctcaatactgcttggaccaggtgcaaatataaagcgttcacctttgtgtggaagaaattttgaatattttcccgaagacccttatctttcgtcagagctggcggcaagccatataaaaggagttcaaagtcagggagtgggtgcatgtcttaaacattttgccgcaaacaaccaggaacaccggagaatgaccgttgataccattgtagatgaaagaacgttgagggaaatatattttgcaagctttgagaatgctgtaaaaaaagcacggccttgggtggttatgtgtgcatataacaagctcaacggtgaatattgttcggagaacagatatcttttgacggaagttttaaagaatgaatggatgcatgacggctttgtggtatccgactggggtgcggtaaatgacagggtcagcggcctggatgcaggtcttgacctggaaatgcccaccagtcatggtattacggataaaaagatagttgaagccgtaaaaagcggaaagctgtctgaaaatattttaaacagagctgtggaaagaattttgaaagtaattattatggcactggaaaacaaaaaagaaaacgcgcagtatgaacaagatgctcatcacagactggcaaggcaggctgcggccgaatcgatggttcttcttaaaaacgaggacgatgtgcttcctttaaaaaagagcggaaccatagctttgataggagcttttgtgaaaaaaccaagataccagggttcgggcagttctcatattaccccgacaagacttgatgatatttatgaagagataaaaaaggccggagccgacaaagtaaaccttgtatattcggaaggatacaggcttgaaaatgacggtattgatgaggaattgataaacgaagctaaaaaggcggcatcaagctcggatgttgcggtagtatttgcagggcttccggatgaatatgaatctgaaggatttgacagaactcacatgagtattccggaaaatcaaaacaggctgatagaagcggtggccgaagtccagagtaatattgttgtggtattgcttaacggctcaccggttgaaatgccgtggattgacaaggtaaaatccgtgcttgaagcttatcttggaggccaggcgctgggaggccgctggcggatgtgctattcggtgaagtcaatcgtcggaaaacttgcggagaccttcccggtgaaattaagccataatccgtcctatttgaattttcccggagaggatgaccgagtggagtataaagaagggttgtttgtcggatacagatattatgatacaaagggaattgagccattgttcccctttggtcacggacttagctataccaaatttgaatacagtgatatatcagtcgataaaaaagatgtttcggacaatagcatcataaatgtcagcgttaaagtcaaaaatgttggaaaaatggcaggaaaagaaattgtgcagctgtatgtaaaagatgtgaaaagcagcgtcagaagacctgagaaagagcttaaaggatttgaaaaggtcttccttaatccgggagaagaaaagacggttacatttactttggacaaaagggcttttgcatattacaatactcagattaaggactggcatgttgaaagcggagagtttctgatattaataggaaggtcctccagggacatagttttaaaagaatcagtgagagtaaattcaacggtgaagataagaaaaagattcacagtgaattcagcggttgaagatgtaatgtccgattcttcggctgcggccgttttagggcctgtactaaaagagataaccgatgcactgcagattgatatggacaatgctcatgacatgatggcggccaatataaagaatatgcctttgcgctcacttgtcggttactctcagggaaggttaagcgaagaaatgctggaggaactggttgacaaaataaacaacgtggaataaatgggtttggtgcagataaaaggtaatgccgaagtatataaaacttcgcattaccttttgtttaatttaagaaatggaataatattaaatatttttatgtaatatattaaaataaataattaaatataaagcaaaaaacttttgcatgtaaaaaacatgatttttaatgtacgttgtctaattgtggcagggtgaatacgggaaagaaggaggagatccggatgctgccggtgaatacatttctttatgcctttgttttaatagcttttttggcggcttttttaacaggaatagttctcattata

SEQ ID NO: 1080 - protein, 754 aa, Clostridium thermocellum
MAVDIKKIIKQMTLEEKAGLCSGLDFWHTKPVERLGIPSIMMTDGPHGLRKQREDAEIADINNSVPATCFPSAAGLACSWDRELVERVGAALGEECQAENVSILLGPGANIKRSPLCGRNFEYFPEDPYLSSELAASHIKGVQSQGVGACLKHFAANNQEHRRMTVDTIVDERTLREIYFASFENAVKKARPWVVMCAYNKLNGEYCSENRYLLTEVLKNEWMHDGFVVSDWGAVNDRVSGLDAGLDLEMPTSHGITDKKIVEAVKSGKLSENILNRAVERILKVIIMALENKKENAQYEQDAHHRLARQAAAESMVLLKNEDDVLPLKKSGTIALIGAFVKKPRYQGSGSSHITPTRLDDIYEEIKKAGADKVNLVYSEGYRLENDGIDEELINEAKKAASSSDVAVVFAGLPDEYESEGFDRTHMSIPENQNRLIEAVAEVQSNIVVVLLNGSPVEMPWIDKVKSVLEAYLGGQALGGRWRMCYSVKSIVGKLAETFPVKLSHNPSYLNFPGEDDRVEYKEGLFVGYRYYDTKGIEPLFPFGHGLSYTKFEYSDISVDKKDVSDNSIINVSVKVKNVGKMAGKEIVQLYVKDVKSSVRRPEKELKGFEKVFLNPGEEKTVTFTLDKRAFAYYNTQIKDWHVESGEFLILIGRSSRDIVLKESVRVNSTVKIRKRFTVNSAVEDVMSDSSAAAVLGPVLKEITDALQIDMDNAHDMMAANIKNMPLRSLVGYSQGRLSEEMLEELVDKINNVE

SEQ ID NO: 1081 - DNA, 2470 bp, Paenibacillus sp. HCI
gatcatccgccgttccagatcgatggcaattttggtggcactgccggtattgccgagatgctgttacaaagccatttgggtgaattacatctgctgcccgcactgcctgagcactgggccagtggcagtgtaaaaggacttcgggcacgaggtgcatatacagtggcaatcgattggacagacggcagactcaccagcgccgaaattaaggctgatcacgccggttcaataaccattcgaagtgcatgcccactccgtgtggaaggaaacgatcaggtcaaggcgcagcttacacctcagggtgatgatgtagttaatttaaccatgaccgcaggacagacgatccgcgtgtcatcatgagacggaggagtaaacgatgacgatttttcaatttccacaagatttccgctggggaacagcaacagcttcctatcaaatagaaggggcagcgcaggaaggcggacgcggggtatccatctgggatacatttgcccgcacgcccggcaaagtatttaatggagacaatggtgatgtggcttgtgacagctatcaccgttacgaggaagacatcgagctgatgaaaaagcttgggatcaacacctaccgattctcgatcgcctggccacgtattattcctgatggagatggcgagatcaatcgggaaggattggacttctatcatcgattcgtggataagctgcttgaagcgggaatcgaaccattctgtacgctgtatcactgggacctgcctcagacgttggaggatatcggaggttggggcaatcgcagaacggtggatgcatttgtaaaatatgctgaagtcatcttcaaggaattttccggtaaaattaacttttggctgactttcaatgaaccatggtgtattgcgtttctgtccaacctgcttggtattcatgcgccaggaaataaggacctgcaaacatccattaatgttgcacacggactgcttgttgctcacggtaaagctgttcaatcgttccgtcgcttgggtacaacaggacagattgggattgcacccaatgtatgctgggctgagccttacagcaaatctcctgaagatcaggcagcctgcgaccgttccattgcactgaataccgattggttccttgatccgatctataaaggagcttatccacaatttatggtggactggttcgcagaagctggcgcgaccgtacctattcaggaaggcgatatggagatcatctcgcaacccattgatttgctgggcatcaactattacaccatgggaatcaatcgtttcaatccagaggcgggtgtattgcaatctgaagaggtggatatgggacttaccaagactgacatcggctggcctgtggaatcacgaggactgtatgagttcatgcattatttgcaaaaatacggaaatgtggatgtctacatcacagaaaatggtgcttgcatcaatgatgatttggaaaatggcaaaatcaatgatgaccgccggattgcatactatgagcagcatttggctcaaattcatcggattatcaacgacggcattaatttgaaaggctacatggcgtggtctttgatggataactttgagtgggcggaaggttaccgtatgcgctttggtcttgtgcatgtcgattaccgttcgctggtcagaacacctaaagagagcttttattggtatcagaatgtcatcaaaaataattgggtggaaacacgaatttaggctgctcttcaatgttgaggaagtaacgtagtgaacttatcattaaataagtaatttaacattagttcaattgttaaaagcagggacaaacgtgtttaattaaatagaaggcggtacatcggaaatccgatgcaccgtctttttttgttattaatttcagcgaagagagcacatgttcatgaaggtttcataaggtcaaagcagtttcatgttatgagaagagcatttttgggttataagaagtaagaagaagtgatctggcccttgtcaacagttaaaatacaaataaagtgtccaaattgcgaaagaaatttgaacatttgttgactaaaaatcatactgatgtggtatattggtataaggaaatcacttacaaaaagggaaaaggaagtgtttactatggcatcgaagacagcaatggtaagccaattggagcgcaaagataaaaatatgcggcgtgcagtgttaacgatgacagttctggcttggattgccctcattacgggagtagtcatgtgcctgatcaacctgaatgattttaatgatcgcaacctcggattaatgatgggtatcggtttcttggtgggtagtgtatttatttatgtaattgccaaatcgattggactagttcatacacgccgggaagacgaaggcgccgattaaataatcttgcgttaattcgttcataataagactggatgagcacccggaatcccagtcaataaagccctttgcggattcgtgatc

SEQ ID NO: 1082 - protein, 448 aa, Paenibacillus sp. HCI
MTIFQFPQDFRWGTATASYQIEGAAQEGGRGVSIWDTFARTPGKVFNGDNGDVACDSYHRYEEDIELMKKLGINTYRFSIAWPRIIPDGDGEINREGLDFYHRFVDKLLEAGIEPFCTLYHWDLPQTLEDIGGWGNRRTVDAFVKYAEVIFKEFSGKINFWLTFNEPWCIAFLSNLLGIHAPGNKDLQTSINVAHGLLVAHGKAVQSFRRLGTTGQIGIAPNVCWAEPYSKSPEDQAACDRSIALNTDWFLDPIYKGAYPQFMVDWFAEAGATVPIQEGDMEIISQPIDLLGINYYTMGINRFNPEAGVLQSEEVDMGLTKTDIGWPVESRGLYEFMHYLQKYGNVDVYITENGACINDDLENGKINDDRRIAYYEQHLAQIHRIINDGINLKGYMAWSLMDNFEWAEGYRMRFGLVHVDYRSLVRTPKESFYWYQNVIKNNWVETRI

SEQ ID NO: 1083 - DNA, 1626 bp, Sphingomonas paucimobilis
cggccgcgcgaggcgatgatcgccaccgagaccccgctgctcctcgcctgcgccgagcacgaacccgcccgcttccagcaggaagcgatcggcctgctcgccgcccgtctcgacgcgcacggcaaggcatcgcccttcttctacggcagcggacacaatcatttcagtctcgcctatcatctcggcaccgcagacaggcggctgtccgacgcggtgctggcctttatcggagatctcccttgaacctcgaccgtcgctccttcgccgcagccgccgcagccggtgtcctgctgccacatgccgtacgggccgccccaccccgcgtcacctttccgaagggctttctgtggggcgccgcgacggcggggcaccagatcgagggcaacacctcaacaagcgacatctggctgctcgaacaggtcaagccctcggtcttctcggaaccctcgggcgatgcctgcaacagcctggaactctggccgatcgaccttgatctggtgaagtccctcgggctgaactgctatcggttcagcctggaatgggcgcgcatcgagcccgaaccgggccagttctcgatcgcgatgctcaaccattacaaggcgattgtcgacggctgccgggcccgcgggctcgccccgctggtcacctactgccactatgcagcgccgcgctggttcgccgcgcgcggcggctggctcaacccggaagcgccgcagttgttcgcccgtttctgtgatcgcgcgacgcgccatctgggcgcgggcatccacaccgcgatgacgctgaacgagccgaacatcgtgccgatgctccaggtcgtgctgccaccccaggcgcagacgatcatcgccctgacgctggacggcgcggccaaggcgctcggcgtgccggaactagcggtggcgaacaccgccaagcaggccgacgttccccggctcaccgccgcgctgcttgccgcgcacaaggcaggcaaggcagcgatcaaggcggcgcgccccgatctcccggtcgggctgacgctggcgatgttcgacgacgaggcggtcggcgcgcccgccatgcgcgaccggatgcgtcagcagctttacggcacgtggctcgaagcggcacgcgacgacgatttcatcggcgtgcagaattacgagaaggtgcgctgggggccggaaggtcgcctgccgccgcccgccggcgcggtgcgcaacgacaatggcggcgaagtctatgggccgtcgctggccaatgcctgccgctatgcccatgcggtcgcacgcgtaccggtgctggtgagcgaacacggcgtcgcaacctccgacgacaggatccgggccaagctgatccccggcgccttggtcgaactccacaaggcgatggtggaagggttgccggtgctcggctatgtccattggtcgctgctcgacaattacgaatgggtcgccggctacaagtcccatctcgggctgttcgccgtcgatcgcacgacctttgcccgcaccgcgaagccaagcgccggcgtgctgggtgcgatcgcccgggccaacgggctgtgaaagcctggctgctcgcgaccgtcgccctgctcgcgccgctccaggcgctgggccaggaggccgatccgctggcggccgc

SEQ ID NO: 1084 - protein, 435 aa, Sphingomonas paucimobilis
MNLDRRSFAAAAAAGVLLPHAVRAAPPRVTFPKGFLWGAATAGHQIEGNTSTSDIWLLEQVKPSVFSEPSGDACNSLELWPIDLDLVKSLGLNCYRFSLEWARIEPEPGQFSIAMLNHYKAIVDGCRARGLAPLVTYCHYAAPRWFAARGGWLNPEAPQLFARFCDRATRHLGAGIHTAMTLNEPNIVPMLQVVLPPQAQTIIALTLDGAAKALGVPELAVANTAKQADVPRLTAALLAAHKAGKAAIKAARPDLPVGLTLAMFDDEAVGAPAMRDRMRQQLYGTWLEAARDDDFIGVQNYEKVRWGPEGRLPPPAGAVRNDNGGEVYGPSLANACRYAHAVARVPVLVSEHGVATSDDRIRAKLIPGALVELHKAMVEGLPVLGYVHWSLLDNYEWVAGYKSHLGLFAVDRTTFARTAKPSAGVLGAIARANGL

SEQ ID NO: 1085 - DNA, 1382 bp, Thermotoga neapolitana
gatgatcttccctcatgtttcaaactttgaagaaggggccatccccttctttttttggggtacaatacttcggcaaacaaactacagcaaagagcgaggtgatgatcgtgaaaaagtttcccgaagggttcctctggggagttgcgacagcttcctaccagatcgaaggctctccccttgcagacggagcaggtatgtccatctggcacaccttctcccatacacccggaaacgtgaaaaacggtgacactggagatgtggcctgcgatcactacaacagatggaaagaggacatcgagatcatcgaaaaaatcggtgcaaaggcctacagattctccatcagctggccaaggatccttccggaaggaacgggaaaagtgaaccagaaaggtctggacttctacaacaggatcatagacaccctcctggagaagaacataacaccatttataaccatctaccactgggaccttcccttttctctgcagttgaagggtggctgggcaaatcgggacatagccgactggttcgcagagtactcaagggttctctttgaaaacttcggtgaccgcgtcaaacactggatcactttgaacgaaccctgggtcgtcgctatagtgggacatctgtacggagtccatgcccctgggatgaaagacatctacgtagcattccatacggttcacaacctcttgagagcgcacgcaaaatccgtgaaggtgttcagagaaacggtgaaagacggaaagatagggattgttttcaacaacggatacttcgaacctgcaagtgagagagaagaagatatcagagccgccagattcatgcatcagttcaacaactacccgctctttttgaaccccatctacaggggagaatacccggatcttgtcctggaatttgcaagagagtacctccccagaaactatgaggatgacatggaagagataaaacaggagatcgacttcgttgggctgaactactattcaggtcacatggtgaaatacgatccgaactcaccggccagggtgtccttcgtcgaaagaaaccttcccaaaaccgccatgggatgggagatcgttcctgagggtatctactggattctcaaaggtgtcaaagaagagtacaacccacaggaggtgtacatcacagagaacggagctgcattcgacgacgtggtaagtgagggcggaaaagttcacgaccagaacaggatagattacttgagagcccacatcgaacaggtctggagagcaatccaggatggagtcccactgaagggttacttcgtgtggtcactccttgataacttcgagtgggcggaaggatattcgaagaggttcggtatagtgtacgtggactacaacacacagaagaggatc

SEQ ID NO: 1086 - protein, 425 aa, Thermotoga neapolitana
MKKFPEGFLWGVATASYQIEGSPLADGAGMSIWHTFSHTPGNVKNGDTGDVACDHYNRWKEDIEIIEKIGAKAYRFSISWPRILPEGTGKVNQKGLDFYNRIIDTLLEKNITPFITIYHWDLPFSLQLKGGWANRDIADWFAEYSRVLFENFGDRVKHWITLNEPWVVAIVGHLYGVHAPGMKDIYVAFHTVHNLLRAHAKSVKVFRETVKDGKIGIVFNNGYFEPASEREEDIRAARFMHQFNNYPLFLNPIYRGEYPDLVLEFAREYLPRNYEDDMEEIKQEIDFVGLNYYSGHMVKYDPNSPARVSFVERNLPKTAMGWEIVPEGIYWILKGVKEEYNPQEVYITENGAAFDDVVSEGGKVHDQNRIDYLRAHIEQVWRAIQDGVPLKGYFVWSLLDNFEWAEGYSKRFGIVYVDYNTQKRI

SEQ ID NO: 1087 - DNA, 2028 bp, Thermus sp. Z-1
ggatccccatctacatcatgtacatctacgtgcagaactgggtccgctccgctttgggcctcgaggtgcgcctcgtgggcagctacggggggctcgtcttcacctacaccgccttcttcgttcccctgagcatctggatcctcaggggcttcttcgcctccattcccaaggagctggaggaggcggccatggtggacggggccacgcccttccaggccttccaccgggtgatcctgcccctggccctcccgggcctcgcggccacggccgtctacatcttcctcaccgcctgggacgagctcctcttcgcccaggtcctcaccaccgaggccaccgccaccattcccgtgggcatccgcaacttcgtgggcaactaccaaaaccgctacgatctggtcatggccgccgccacggtggccacgctgcccgtcctcgtcctcttcttcttcgtgcagcgccagctcatccaaggcctcaccgccggggcggtgaagggctaggttcttggaggagaaacgcctatgaccgagaacgccgaaaaattcctttggggagtggccaccagcgcctaccagattgagggggccacccaggaggacggccgggggccttccatctgggacgccttcgcccagcgcccgggggccatccgggacgggagcacaggggagcccgcctgcgaccactaccgccgctacgaggaggacatcgccctgatgcaatccctcggggtgggggcctaccgcttctccgtggcctggccccggatcctccccgagggccgggggcggatcaaccccaagggcctcgccttctacgaccgcctggtggaccggcttctcgcttccgggatcacgccctttctcaccctctaccactgggacctgcctttggcccaggaggagcggggaggctggcggagccgggagaccgccttcgccttcgccgagtacgccgaggcggtggcccgggccctcgccgaccggttgcccttcttcgccaccctgaacgagccctggtgctcggccttcctcgggcactggacgggggaacacgcccccggcctcaggaacctggaagcggccctccgcgccgcccaccacctcctcctgggccacggcctcgccgtggaggccttgagggccgcgggggcgaagcgggtggggatcgtcctcaacttcgccccgcgctacggcgaggaccccgaggcggtggacgtggccgaccgctaccacaaccgcttcttcctggaccccatcctgggcaaggggtatcccgaaagccccttccgagaccccccgcccgtccccatcctctcccgcgacctggagctcgtggcaaggcccctggacttcctgggggtgaactactacgcccccgtccgcgtggccccggggacggggaccttgcccgtgcgctaccttcccccggaagggccggccacggccatggggtgggaggtctaccccgaggggctttaccacctcttgaagcgcctcggccgggaggtgccctggcccctttacgtcacggaaaacggggccgcctaccccgacctctggacgggagaggccgtggtggaggaccccgagcgggtggcctacctcgaggcccacgtggagggccgcctccgggcccgggaagaaggggtggacctccggggctacttcgtctggagcctcatggacaactttgagtgggcgttcggctacacccggcgcttcggcctctactacgtggacttccccagccagaggcgcatccccaaaaggagcgccctctggtaccaatgacatactccagatcggcttcgccaaagtgttcaagacaggtttcttccgccactttggccagacgggcggcgcgttcaaccacgatgtcatcagttaagggaatcggatcgtcctgacaggacatgctgcaatcagggtggatttttttgaatcctgccgcaacgtagcttttaatcaaatcatcggcattggccattgcctgagcggccggcagttttgccagcggtttggcccc

SEQ ID NO: 1088 - protein, 423 aa, Thermus sp. Z-1
MTENAEKFLWGVATSAYQIEGATQEDGRGPSIWDAFAQRPGAIRDGSTGEPACDHYRRYEEDIALMQSLGVGAYRFSVAWPRILPEGRGRINPKGLAFYDRLVDRLLASGITPFLTLYHWDLPLAQEERGGWRSRETAFAFAEYAEAVARALADRLPFFATLNEPWCSAFLGHWTGEHAPGLRNLEAALRAAHHLLLGHGLAVEALRAAGAKRVGIVLNFAPRYGEDPEAVDVADRYHNRFFLDPILGKGYPESPFRDPPPVPILSRDLELVARPLDFLGVNYYAPVRVAPGTGTLPVRYLPPEGPATAMGWEVYPEGLYHLLKRLGREVPWPLYVTENGAAYPDLWTGEAVVEDPERVAYLEAHVEGRLRAREEGVDLRGYFVWSLMDNFEWAFGYTRRFGLYYVDFPSQRRIPKRSALWYQ

SEQ ID NO: 1089 - DNA, 3124 bp, Butyrivibrio fibrisolvens
aacaaacagaattgttggaaacttttttatatgcaatattactttaacacagaatgtctggtgatggtatatgttttttcttcctgagttatatatttcaaatcttagatgtgctatgcttttatggcagaaacatgttatatacaaggtaaagataagtaggataacgaggtatttataatggagaaatgggcaagaatcaaatatacaccaaatcttccgcttggagagaatggtgaaagggttacagcgagtcagaagcacattgagctttcatgcgaggcagcatgtgagggaatggtacttctcaagaatgacagaaacgttcttcctatcagaaagggcacaagagtagccctctttggaaagggagtatttgactatgtaaaaggcggcggtggtagcggagatgtaacagttccttacatcagaaacctctacgaaggcctttctcagtacacatcagacatttcaatttacgacaaatctgtcagattctatcaggaatatgtagcagaccagtacagacttggaattgcaccaggcatgatcaaagagccggctcttccggaagatattcttgcagatgcagcagcctatgcagatactgcaatcatcgcaatcagcagattctccggagaaggctgggacagaaaggttgcaggcgttgacagagaaatcaagtgcgaagccaaggacctcgtagagcagggcaacaagatatttgatcatggtgatttctacctcacaaatgctgagaagaagatggtcaagatggtaaaagagaacttctcaagcgtcattgtagtcatgaatgtcggaggagtcgtagacacaacatggtttaaaaaggatgaccagatttcatcagtcctcatggcatggcagggtggaattgaaggcggacttgccgcagccaggatccttcttggcaaggttaatccttcaggtaagctctcagatacattcgcagcaaggcttgaagactatccttcaacagagggcttccacgaagatgatgactacgtggattacacagaagatatctacgttggctatagatatttcgagaccattcccggggcaaaagagaaagttaactacccctttggctatggcctttcctatacaactttcctgcttgaagactataaggcagagccttttgtggcttcagcagcagacgaggtcggtaaatctgatagcgaccttgcagatgcaatcgtagcctcagttacagtcacaaacattggcaagattccgggcaaagaggttgttcagctctactacagcgctcctcagggcaagctcggtaagcctgctaaagtccttggcggctatgccaagacaaggctactgcagccgggagagagccagagagtgacaattgctctttatatggaggatatggcatcttacgacgaccttggcaaggttaaaaaggctgcctggctccttgaaaaaggtgaatatcatttcttccttggaacatcagtaagagacacaaggcttcttgattacacctatgaactttctaagaacataatagttgaacaggtctcaaacaagctcgttccaacatctcttcccaagagaatgcttgctgatggcacatatgaggaacttcctcagacagaacctgtagatacttatgcaacaatcttcccaagacctaagaactggaaagaaacaattgagcacgacgtattaaagactcctgtagttcgtccacaggacagattccagctctttttgccacctaaggaaggtgaccctaagaaatttatcgaagttgcagaatgcaaggtgacacttgaagactttattgcacagctatctaacgagcagcttgcaagccttcttggaggacagccaaatgtcggaatggctaacacctttggatacggcaaccttcctgaggttggagttcctaatgcccagacctgtgatggtcctgcaggtgtccgtattgcaccggaagttggtgttgtgactacagcattcccatgttcaacccttcttgcatgcacatggaatgaagatatctgctacgaagtcggagttgcaggcggagaagaggccaaggagtgcaattttggtgcatggcttactcctgctgttaacatccatagaagccctctttgcggcagaaactttgagtactactccgaagatccattccttgcaggtaaacaggcagcagctatggttcgtggtatccagagcaacaacataattgctacacctaaacattttgccctcaacaacaaggaatccaatagaaaaggcagcgattcacgtgcttctgagcgtgcgatcagagaaatatatttaaaggcctttgaaatcattgttaaagagcagagccctggagcatcatgtcttcaatacaatatagttaacggtcagagatcatccgaatctcacgacctcctcacaggaatcctccgcgatgagtggggctttgaaggtgttgtagtcagcgactggtggggctttggtgagcattacaaggaagtccttgcaggcaacgatatcaagatgggctgtggctatacagaacagctccttgaagcaattgataagaaagctcttaagagaaaagatttggaaaagaggcagagcgagtcctcaagatgcttctcaaactcgactaagctcaaagccgcttagaataaacgtttaagtcataaaaaagtaatgtattgttcataaactatcaatatttttctgacaatttgtcgtataatataaatatgatatagttgttgggaatatcttctgagaattgtatcaggagaaagttgtagaactacaactctcggaggtatgtctatgaacaaaaaagctattgttggtatttttatgtccattttgatggcagggctcgttggatgtgccggtagcagtgatgcccaggcaggagatgacctcaagccggttatttatctttatccacaggaagataataccgagatttcagtaagccttgattataacggaaatctggttgacctgattcctgagtttaatgcagataagacatggaatgttacagctaacaaagatggcaagattacctttgaaggacagacttatgactatctgttttgggaaggcgatc

SEQ ID NO: 1090 - protein, 830 aa, Butyrivibrio fibrisolvens
MEKWARIKYTPNLPLGENGERVTASQKHIELSCEAACEGMVLLKNDRNVLPIRKGTRVALFGKGVFDYVKGGGGSGDVTVPYIRNLYEGLSQYTSDISIYDKSVRFYQEYVADQYRLGIAPGMIKEPALPEDILADAAAYADTAIIAISRFSGEGWDRKVAGVDREIKCEAKDLVEQGNKIFDHGDFYLTNAEKKMVKMVKENFSSVIVVMNVGGVVDTTWFKKDDQISSVLMAWQGGIEGGLAAARILLGKVNPSGKLSDTFAARLEDYPSTEGFHEDDDYVDYTEDIYVGYRYFETIPGAKEKVNYPFGYGLSYTTFLLEDYKAEPFVASAADEVGKSDSDLADAIVASVTVTNIGKIPGKEVVQLYYSAPQGKLGKPAKVLGGYAKTRLLQPGESQRVTIALYMEDMASYDDLGKVKKAAWLLEKGEYHFFLGTSVRDTRLLDYTYELSKNIIVEQVSNKLVPTSLPKRMLADGTYEELPQTEPVDTYATIFPRPKNWKETIEHDVLKTPVVRPQDRFQLFLPPKEGDPKKFIEVAECKVTLEDFIAQLSNEQLASLLGGQPNVGMANTFGYGNLPEVGVPNAQTCDGPAGVRIAPEVGVVTTAFPCSTLLACTWNEDICYEVGVAGGEEAKECNFGAWLTPAVNIHRSPLCGRNFEYYSEDPFLAGKQAAAMVRGIQSNNIIATPKHFALNNKESNRKGSDSRASERAIREIYLKAFEIIVKEQSPGASCLQYNIVNGQRSSESHDLLTGILRDEWGFEGVVVSDWWGFGEHYKEVLAGNDIKMGCGYTEQLLEAIDKKALKRKDLEKRQSESSRCFSNSTKLKAA

SEQ ID NO: 1091 - DNA, 3179 bp, Cellvibrio gilvus
cccgggtcaagggcgtgagcaccgtggtacgcgaagcgcccctcgctgcgggcaaggtggagctgagcgtgcgcgccagcccggagcgttacgtgttcggctacagcatcggcggccgggaagtcgcggacttcggcagcgcgcccaccgcgccgctcagttccgaggacgcgggcggcttcaccggggtggtgctcgggatggtcgcgcacagcccgacggcgcccccatgccgccggccgatttcgactggttcgactaccggccggccgacggcaagaattaacagcatcaagccgccggacaacgagccggcgtcagcacacaacaagaaatcaatcaggagacatcatgcatcgcaagaaccacgccgccgccgcggcgcgcaccgccctggtcgcggccattgccgcagccttcccgctgttcacccccggcgccttcgccgcgcccgagccggccgagccggcccagaagccctggctggatgcttccctggacgccgaccagcgtgcccgcctggccgtgcaggccatgacccagcaggagaagctgcgctgggtgttcggctatttcggtcacgatttcggcaagagcaagaagcatccggatgcactgcctcagtcggccggctacatcccgggcacgccgcgcctgggtctgccggcattgttcgagaccgatgcgggccagggcgtggcctcgcagtccggcgccaacgtgcgcgagcgcaccgccttgccctcgggcctgagcaccgcctcgacctgggacccgaaggtggcctacgccggcggcgccatgatcggctcggaggcgcgcgcttccggcttcaacgtcatgctggcaggtggcgtgaacctgcagcgcgagccgcgcaacggccgcaacttcgaatacgcgggcgaggatccgctgctggccggcaccatgatcggccaggcaatcaagggcgtggaatcgaacaggatcatctcgacgctcaagcacttcgtgctgaacgaccaggaaaccggccgcaacgagctcgatgcgcgcatcgacaaggcggcgctgcgcatgtccgacctgctggcgatggagctggcgctggagcagtccgacgccggctcggtgatgtgcgcctacaaccgcctcaacggaccgtatacctgcgaacatccgtggctgctgagcgaggtgctcaagcgcgactggggtttccgcggttatgtcatgtccgactggggcgccacccacagcaccgtggccgccgccaacagcggcctggaccagcagtccggccaggaattcgacaagtccccgtacttcggcggcgcgctggaagaagccgtcaagaccggggccgtgccgcagaagcgcctggacgacatggtcacccgcatcgtgcgcaccatgttcggcaagggcgtggtcgacaacccgctcaagccgggcgtcgcgatcgacttcgccgccaacggcggtcagccgccagacggcgaagagggcatggtcctgctcaagaacgaaggccgcctcctgccgctcgcgaaaaccgtgcgcacgatcgccgtcattggcggacatgcggatgccggcgtgctctcgggcggcggctcgtcccaggtgtacccagtgggcggcatcgcggtcaagggcttgttgcctgccacctggccgggtccggtggtgtactacccgtcctcgccgctgcgcgcgatccaggcccaggccccgaatgcgaaagtcgtgttcgacgacggccgcgacccagcccgcgccgcgcgcgtggccgctggggccgacgtcgccctggtcttcgccaaccagtggatcggcgaggccaacgacgcccagacgctcgcgctgccggacggccaggaagagctgatcacgtcggtggcgggcgccaacgggcgcaccgtggtcgtgctgcagaccggcggaccggtcaccatgccctggctggcgcgcgttccggccgtgctggaagcctggtatccgggcaccagcggcggcgaggcgatcgcgaatgtgctgtttggcgcggtcaatccgtccggccacctgccggccaccttcccgcaatccgagcagcaactgccgcgcccgaaactcgatggcgatccgaagaaccccgagctgcagttcgccgtcgactaccacgaaggtgcggcggtcggctacaagtggttcgacctgaagggccacaagccgctgttcccgttcgggcacggcctgtcctacacaaccttcgcgtactccggtctgtccggccagctcaaggatggccgcctgcacgtgcgcttcaaggtgaccaacaccggcaacgtggccggcaaggacgtgccgcaggtgtacgccgcgccgatgtccaccaaatgggaggcgccgaagcgcctggccgcctggagcaaggtcgccctgctgccgggcgagaccaaggaagtcgaggtcgcggtggagccgcgcgtgctggccatgttcgacgagaagtcgcgcacctggcgccgtccgaaaggcaagatccgcttgacgctggccgaagacgcctccgccgccaacgccaccagcgtgaccgtcgagctgcctgccagcacgctggacgcacgcggccgcgcacgctgacaccaggggagacgcatgcgacaactcatcctctcggccgtcttgctggcgcaagcggcgccaggcctggccgcggaagcgccacgcctgcaactggacagcctgttccaggaccacatggtgctgccacgccagggggccgtcgtgtcgggtcgcctgtcgcccgcgagctcatcacggtgagcggcttcggcggtagtggaagaccagcgccgacgcggccggacgcttctctgtcaccttgccgagcctgcccgcgggacggaccgataccctcgcggtcgcgagcagcagcggccagcaggtgattctgggcgacgtggtcacgggcgacgtgttcctgtgctcgggccagtcgaacatgcagcttaccgtgaaccgcgccctgaatgcggacacggtgatcggcacggcgacgaattcggacctgcgcatggcgacggtcgccgtcgatcctcagccggcgccgctggcgcggctggccaagccggtggcgtggcgaggcggcatcgccgcagaccgtcggcgactggtcggccacctgttacttcttcggcaaggaactgcag

SEQ ID NO: 1092 - protein, 752 aa, Cellvibrio gilvus
MHRKNHAAAAARTALVAAIAAAFPLFTPGAFAAPEPAEPAQKPWLDASLDADQRARLAVQAMTQQEKLRWVFGYFGHDFGKSKKHPDALPQSAGYIPGTPRLGLPALFETDAGQGVASQSGANVRERTALPSGLSTASTWDPKVAYAGGAMIGSEARASGFNVMLAGGVNLQREPRNGRNFEYAGEDPLLAGTMIGQAIKGVESNRIISTLKHFVLNDQETGRNELDARIDKAALRMSDLLAMELALEQSDAGSVMCAYNRLNGPYTCEHPWLLSEVLKRDWGFRGYVMSDWGATHSTVAAANSGLDQQSGQEFDKSPYFGGALEEAVKTGAVPQKRLDDMVTRIVRTMFGKGVVDNPLKPGVAIDFAANGGQPPDGEEGMVLLKNEGRLLPLAKTVRTIAVIGGHADAGVLSGGGSSQVYPVGGIAVKGLLPATWPGPVVYYPSSPLRAIQAQAPNAKVVFDDGRDPARAARVAAGADVALVFANQWIGEANDAQTLALPDGQEELITSVAGANGRTVVVLQTGGPVTMPWLARVPAVLEAWYPGTSGGEAIANVLFGAVNPSGHLPATFPQSEQQLPRPKLDGDPKNPELQFAVDYHEGAAVGYKWFDLKGHKPLFPFGHGLSYTTFAYSGLSGQLKDGRLHVRFKVTNTGNVAGKDVPQVYAAPMSTKWEAPKRLAAWSKVALLPGETKEVEVAVEPRVLAMFDEKSRTWRRPKGKIRLTLAEDASAANATSVTVELPASTLDARGRAR

SEQ ID NO: 1093 - DNA, 2899 bp, Flavobacterium meningosepticum
gagctccggaagttaaacaggttttaaataagctgggttttacctcttctaaatatcctttatccggaaattaatgtaagaaagtataaataaatttgaattttgaatgttctgtttttaagaatgtaaacagaacgaaaaatataaaataacatgaaaaaattatcaattatagccgggttcgttttagcacctttgttttctgcacagcttgtacatcagccggtgcagagctttcagagtggaacttacgcggtgaaaaagaaatcttttattgatcagctggttgcaaaaatgacactggatgaaaaaatcggacagcttaacctgccgtcatccggagattttacaacaggacaggcacaaagttctgatatcggtaaaaaaattgaacaggggcttgtaggtggtttatttaacattaaaggtgttaataaaattaaagccgtgcagaaagtagcgatagaaaaaagccgtctgaaaataccaatgatttttggaatggatgttattcatggttatgaaaccactttccctattccattaggcttagcttcttcatgggatatggaccttattcagagatctgctcagattgctgcaaaggaagcttcggcagacggaattaactggaccttttctccaatggtagatgtttcccgtgaaccaagatggggaagagtatcggaaggttctggtgaagatccttatctgggaagtgaaattgcaaaagccatggtatatggttatcagggaaaagacctgtctcttaaaaataccatattggcttgcgtaaaacattttgcactttatggtgcacctgaagggggacgtgattacaatactgttgatatgagccatatccgaatgtttaacgagtatttcccgccttataaagcggcagttgatgccggagtaggttctgtaatggcttcatttaatgaagtagatggtgttcctgcaaccggaaataaatggttgatggatgatgtattacgtaaacaatggggattcaatggctttatcgtaacggactatacaggaattaatgaaatgattcagcacggaatgggtgacctgcagcaggtatcggcattagcactaaatgcaggtgttgatatggatatggtaggtgaaggttttttaaccacattgaaaaaatcattaagtgaaggaaaggtaaccgaacaacagattaccctggctgccagaagaatacttgaagcgaagtatgatcttggattatttgatgacccttatcgctataccgacgaaaagcgtgcgaaagctgaggttttcagtaagcctcatcgtgaagaagcaagaaatatagcggcgcagtctatggtattgcttaagaacgataaacagactttgccattaaaagcaggtggaactgttgctgtaatcggaccattagccaataataatgagaatatgacggggacatggagtgtagcgtcccgtatgaaagatgctgtttctataatgactggtttgaaggaaacggtgaaaggagttaactttatttacgccaaagggagcaatgttttctatgacgctaaaatggaagagaaggcaacgatgtttggaaaaacagcaaacagagacagccgttccaaggaagagttattaaaggaagctgtagcaacagctaataaagcagatgttgttgtattagcaattggtgaaacagccgaactaagtggggaatccagctcaagagctaatattgagattcctcaggcgcagaaagatttacttacagaactgaagaaaacaggaaaacctattgtgatggtattatttaccggacgtcctttggtactgaatgatgaaaataaacaagcagatgctattgttaatgcatggtttgcaggaagcgaagcaggttatgctattgcagacgttttatatggaaaggtaaatccttccggaaaattaccaatgactttcccaagaagcgtagggcaggtgccaatttattacaatgctaaaaatacaggacgcccgttaagtgatgaaagatcagataagtgtgagtttgagaaattcagatccaattatattgatgaatgtaatacacctcttttcccgtttggctacggattaagttatacgacttttaattattcggatatccagcttaataagacacaattaagcggtaatgaccagctaacagcaagtgttacactaacgaataatggtaaatatgacggaaatgaagtggtgcagctatatatccgcgatatggtaggatctgtaacccgtccggtaaaagaactgaaaggattccaaaaagtattcttaaaagcaggagaatctaaaatagtaactttcaatattactcctgaagacctgaagttttataattcagcattaaaatatgactgggaaccgggagagtttgatattatgatcggaacgaattctcatgatgttaaacatgcaaaaataaactggaataaataataatgaaagcagctgtaaggctgctttttatatatcaactgaaatatgataaagaaactaagttttgttttgatcttgttctggggttgctttttactggctcaggacttttctttatttaagaaatttaaatttactcaggatgagcaggcaatgccttacaggattttacttcctaaaaattatgatcccggtaaaagctatccgttagtgatgttcctgcatggaagaggtgaaagtggtgcagataatgaaaagcaactgactcacggagcacagttatttctgaatgaaaataacagggataatttcccggcgattgtcgtatttccgcaatgccctgaaaattcttactggagcaatgtacaaatgatttatgatgaacagggaaaaaggactttttactttacaaacggcggagctc

SEQ ID NO: 1094 - protein, 726 aa, Flavobacterium meningosepticum
MTLDEKIGQLNLPSSGDFTTGQAQSSDIGKKIEQGLVGGLFNIKGVNKIKAVQKVAIEKSRLKIPMIFGMDVIHGYETTFPIPLGLASSWDMDLIQRSAQIAAKEASADGINWTFSPMVDVSREPRWGRVSEGSGEDPYLGSEIAKAMVYGYQGKDLSLKNTILACVKHFALYGAPEGGRDYNTVDMSHIRMFNEYFPPYKAAVDAGVGSVMASFNEVDGVPATGNKWLMDDVLRKQWGFNGFIVTDYTGINEMIQHGMGDLQQVSALALNAGVDMDMVGEGFLTTLKKSLSEGKVTEQQITLAARRILEAKYDLGLFDDPYRYTDEKRAKAEVFSKPHREEARNIAAQSMVLLKNDKQTLPLKAGGTVAVIGPLANNNENMTGTWSVASRMKDAVSIMTGLKETVKGVNFIYAKGSNVFYDAKMEEKATMFGKTANRDSRSKEELLKEAVATANKADVVVLAIGETAELSGESSSRANIEIPQAQKDLLTELKKTGKPIVMVLFTGRPLVLNDENKQADAIVNAWFAGSEAGYAIADVLYGKVNPSGKLPMTFPRSVGQVPIYYNAKNTGRPLSDERSDKCEFEKFRSNYIDECNTPLFPFGYGLSYTTFNYSDIQLNKTQLSGNDQLTASVTLTNNGKYDGNEVVQLYIRDMVGSVTRPVKELKGFQKVFLKAGESKIVTFNITPEDLKFYNSALKYDWEPGEFDIMIGTNSHDVKHAKINWNK

SEQ ID NO: 1095 - DNA, 2672 bp, Erwinia chrysanthemi
gtcaccactatttctttgaactctatccagaattttatcccgctgacttgaaggccacctgaaggctgcactagtgttgatgtggactattgatgtgaattgttaatgtgaacgacctctctggcaggacaacggcgagcgctctcccacatgcgctgtgaagcggtattgctgttgtctgcaaccgctgtaccacctcaaataacgagaaatctacacatggaaaaaagtgcgacacgacaaaaggcgcttctcatcgcgcttcccttactgttttcccctctggcaagcgcagtacaacaggccgtgctcgatacccgtggcgcaccgttgatcacggtcaacgggctgacatttaaagatctgaaccgcgacggaaaactcaacccgtacgaagactggcgtttacctgcggcagagcgggcggcggacctggtctcacgcatgacgctggcggaaaaagccggggtgatgatgcacggttccgcgccaacggcaggcagcgtcaccggtgccggtactcagtatgatctcaatgcggcaaagaccatgattgccgatcgctacgtcaacagctttattacccggctttccggcgataatccggcccagatggccgaggaaaacaataaattacagcaactagccgaagccacccggctggggatccctctcactatcagtaccgacccgcgcagttcgttccagtcactggtcggcgtcagcgtgtcggtgggtaaattcagcaaatggccggaaacgcttggactggcagcaattggcgacgaagaactggtcagacgctttgccgatattgtgcgccaggaataccgcgccgtcggcatcaccgaagcgttatcaccgcaggcagacctcgccaccgaaccacgctggccacgtattgatggcacctttggcgaagaccctgacctgacgaaaaaaatggtgcgcggttatgtcaccggtatgcagaacggtaaaaatggtctcaacgcacaaagcgtcatttcgatagtaaaacactgggtcggttacggtgcggcgaaagacggttgggacagtcacaatgtttacggcaagtacgcgcaattccggcaaaacaacctgcaatggcacatcgacccgtttaccggagcgtttgaagcccatgcggcgggtatcatgccgacttactccatcttgcgaaacgcgagctggcacggcaaacccattgaacaggtcggggccgggttcaatcgcttcctgctcactgacctgctgcgcggtcagtatggttttgatggcgtcatcctcagcgactggcttatcaccaacgactgcaaaggcgattgcctgactggcgtgaagccgggggaaaaaccagtgccgcgcggtatgccatggggtgtggagaaactgacacccgccgagcgcttcgtcaaagccgtgaatgccggggttgatcagttcggcggcgtcaccgactcagcgctgctggtgcaggcggtacaggacggcaaactgacggaagctcgccttgatacctccgtcaaccgcatactgaaacagaaattccagaccggattattcgaacgcccctacgttaatgccacacaagccaacgacatcgtcggcagagcagactggcaacaactggcagatgacacccaggcccgctcactggtcctgttgcaaaacaataatctgttaccactgcgtaaaggcagccgggtctggctgcacggtattgcggcaaacgcggcacaggaggttggctttatcgtcgtgaatacgccagaacaggccgacgtagcgctgatccgcacccacacgccatacgaacagccacacaagaactttttcttcggcagccgccatcatgaggggtcactggcgtttcgcaacgacaacccggactatcaggctatcgtgcgcgccagcgctaaagtgccaacgctggtgaccgtctatatggaacgccccgccatcctgaccaatgtggtggataaaacccgtgcggtggtcgccaactttggcgttagcgatagcgtattgctcaaccggctgatgtcaggcgcggcttatacggcaaaattgccgtttgaactgccgtcgtctatgtcggcggtgcgcaaccagcagcccgatctgccttatgacagcgcaaaaccgctgttcccattcggttatggcctgcctcactgagccgccgtcacggttccatgctatttagtccatggcatggaaccaatgtgatggagcgaacgtaacaaacgtaatggtacacaagtcgtcccggcgtccccggcgtcatggcggcgacttgttccccccagccaatctgaatctatccacgccccagtcaatctgctgtcattcatgaaaagccgaacggcagaggtgaaactcccctctcatttttgtgattcgtagcacactagcgacattagcgttatcatcatcttaacggttcttcaggattttcctctatgcgcaataccatcacactgtgctggcagtatttacgcgctttcgcattgatttatctgtgtctgtttattggcaatgcgatatccgcgctactcccgattaccattcccggcagcattctcggcatgttggtgctgtttgccttgctggcatcgcaaattctgccgtcgcgctgggtcaagccgggttgccagttactgatc

SEQ ID NO: 1096 - protein, 654 aa, Erwinia chrysanthemi
MEKSATRQKALLIALPLLFSPLASAVQQAVLDTRGAPLITVNGLTFKDLNRDGKLNPYEDWRLPAAERAADLVSRMTLAEKAGVMMHGSAPTAGSVTGAGTQYDLNAAKTMIADRYVNSFITRLSGDNPAQMAEENNKLQQLAEATRLGIPLTISTDPRSSFQSLVGVSVSVGKFSKWPETLGLAAIGDEELVRRFADIVRQEYRAVGITEALSPQADLATEPRWPRIDGTFGEDPDLTKKMVRGYVTGMQNGKNGLNAQSVISIVKHWVGYGAAKDGWDSHNVYGKYAQFRQNNLQWHIDPFTGAFEAHAAGIMPTYSILRNASWHGKPIEQVGAGFNRFLLTDLLRGQYGFDGVILSDWLITNDCKGDCLTGVKPGEKPVPRGMPWGVEKLTPAERFVKAVNAGVDQFGGVTDSALLVQAVQDGKLTEARLDTSVNRILKQKFQTGLFERPYVNATQANDIVGRADWQQLADDTQARSLVLLQNNNLLPLRKGSRVWLHGIAANAAQEVGFIVVNTPEQADVALIRTHTPYEQPHKNFFFGSRHHEGSLAFRNDNPDYQAIVRASAKVPTLVTVYMERPAILTNVVDKTRAVVANFGVSDSVLLNRLMSGAAYTAKLPFELPSSMSAVRNQQPDLPYDSAKPLFPFGYGLPH

SEQ ID NO: 1097 - DNA, 2620 bp, Clostridium stercorarium
attctgtatgtatagcagggcatgcggtcgttgaattatgttacgtaatttgatatatttatcaaaatttacttataaagactttttgtggtaataccaattgttgcaagagtgtctgagaaagttataatttattatgccggaacggtttacgaaattgacgataaaggcataacaggagtgataaaaatgcaaagggacatcaaaaaaattatttcacaaatgacgctggaagaaaaggcgagcttatgctcggccttggacgcctggaccttaaaaggcgtagaacgtttgggcattccgtccattatggtatctgacggcccccatggtctcagaaagagacaacgggatcccactgatcccggtaagaaaaccactgtcccggccacatgtttccccactgcggtgggccttgcaagctcatggaaccgtgaactggtggagaaagtaggccccgcattgggggaagaatgccaggctgaaggaatagcagtgcttcttggcccgggaaccaatataaaactttcccctctttccggaagaaactttgaatatttttcggaagacccgtacctttcttcggagatggccagaagccatataaaaggagtgcagagccggggagtggggacgtccctgaagcattttgcggcaaataaccaggaacaccgcagaatgagcgtggatgcggtaattgacgaaagaacgctgcgtgaaatttacctcgccagtttcgaaggggcggttaaaaaggcgaagccgtggacgatcatgtgttcatacaacagggtaaacggcgagtatgcatctgaaaataaatttctgttaacagatgtactgagaaatgaatggggttttgaaggcattgtggtatccgactggggagcggtgaatgagagggtaaagggactggaagccggacttgatcttgaaatgccgtcaagcttcggtattggcgaccaaaaaatagttgaagccgtaaagaagggtgagctgcccgaagaggtattggacagaaccgttgaaaggatacttaatttaatttttaaagcggtggataacaggaaagaaaatgccggatatgaccgggaagctcatcacaaactggccagagaagcggcaagggagtgcatggtgctgcttaagaacgaggacaaaatacttccgcttaggaagcagggaaccatagccgtaataggcgaatttgctaaaagaccacggtatcagggcggaggaagctcccatgtaaatccaacaatcatggatagtccatatgaagaaatcaaaaaatcagcgggaaacaatgcagatgttatatatgcgcaaggttatattattgaaaaggacgagccagatgaaaaactcctggaggaagcaaagcagacggcgctgaaggcagatgtcgccgtgatatttgcagggcttcccgagcattatgaatgcgagggctatgaccgtacgcatatgagaatgcccgaaagccactgcacgcttatcgaagaagtggcggaagtaacaaccaatgtggtggtggtattatgcaacggttcaccggtggagatgccatggattgacaaagtgaagggattgctggaggcttacctgggcggacaagccatgggcgggccattgccgatcttctgttcggagacgccaatcccagggaagctcgccgagactttcccgaaacagttaagcgataacccttcatatttgaatttccgggaacgggacagggttgaatacagggaaggcatattcgtgggctacaggtattatgacaaaaagaatatggaaccgctgttcccgttcggatacgggctcagctacactacgtttgagtacggcgatctgaaaataagcaggaaagaaatatctgataacgaaacggtgactgtgagcgtaaaggttaagaataccggagatatggcgggtaaggagattgtgcagctttacgtaagggatattgaaacctcggtaatagaccggagaaggactgaagggtttgaaaaagttgaacttcagcccggcgaggaaaaaacggtggtgtttgaacttgacaagagggcgtttgcttatacacaccggtataaggactggcatgttgaaaccggtgaatttcgagattttataggcagatcctcaagggacatagtgcttaaagacaagatattcgtcaaatcaaccgttaccataaaaaaacggtggacagtaaacacgctggtgggggatttgctttctgatcgggttcttgagcctgtattcagagagtttattattaacgagataaaaacatggtacttgttggatttactggacgaggataatcacctcctgagtgtgtggatgaggtatactcctctgcgttcattggcgaacagtacgggtggggaactgaacgaggaaaagctgaacaggctgattgatacactgaatgcaaatattaaataatgttacgaattatggggctgtctcaaaatctgagacagccaaaatttatataaaacaaaagtgcaactcaaaataaccattcttcttctatgaattcgcctattacggctatggttccctgcttcctaagcggaagtattttgtcctcgttcttaagcagacacca

SEQ ID NO: 1098 - protein, 754 aa, Clostridium stercorarium
MQRDIKKIISQMTLEEKASLCSALDAWTLKGVERLGIPSIMVSDGPHGLRKRQRDPTDPGKKTTVPATCFPTAVGLASSWNRELVEKVGPALGEECQAEGIAVLLGPGTNIKLSPLSGRNFEYFSEDPYLSSEMARSHIKGVQSRGVGTSLKHFAANNQEHRRMSVDAVIDERTLREIYLASFEGAVKKAKPWTIMCSYNRVNGEYASENKFLLTDVLRNEWGFEGIVVSDWGAVNERVKGLEAGLDLEMPSSFGIGDQKIVEAVKKGELPEEVLDRTVERILNLIFKAVDNRKENAGYDREAHHKLAREAARECMVLLKNEDKILPLRKQGTIAVIGEFAKRPRYQGGGSSHVNPTIMDSPYEEIKKSAGNNADVIYAQGYIIEKDEPDEKLLEEAKQTALKADVAVIFAGLPEHYECEGYDRTHMRMPESHCTLIEEVAEVTTNVVVVLCNGSPVEMPWIDKVKGLLEAYLGGQAMGGPLPIFCSETPIPGKLAETFPKQLSDNPSYLNFRERDRVEYREGIFVGYRYYDKKNMEPLFPFGYGLSYTTFEYGDLKISRKEISDNETVTVSVKVKNTGDMAGKEIVQLYVRDIETSVIDRRRTEGFEKVELQPGEEKTVVFELDKRAFAYTHRYKDWHVETGEFRDFIGRSSRDIVLKDKIFVKSTVTIKKRWTVNTLVGDLLSDRVLEPVFREFIINEIKTWYLLDLLDEDNHLLSVWMRYTPLRSLANSTGGELNEEKLNRLIDTLNANIK

SEQ ID NO: 1099 - DNA, 5652 bp, Paenibacillus sp.
gaattcgtaagtgaagataatcaaatcgagacgggggaatgtcgtaaaatgactattgcagcaggtattaatattttttctgtttaccgggaattaggtgaagattactttggcacactggagaagatcgccgcagcagggtatgtgaatattgaacttatcggattcaacatgaagacatttacacgatacatcgatgaaatcccaatggagtcacttagagataaactccaagatctgggtcttaaggcggtatctgttcatgagggtacggcaccgggtcaagaattgattacgcatgattgggactccgtcatgaagtattatgctggtcttgagtgcgcgagtattgtactcccgtccgtgtggattaaaaaccgtgaggacacgctgagagcagcagaacagatgaacagcgtcggcaagaaaatgaaagagggtggatttcagttctatctgcacaatcacgcccatgagtttaaaacaatcggcgatcaaacactgtttgacttgcttttgcaaaatacggatccatcctatgttaaatttgaacttgatctggcatgggtgatgcgcgcaggagtggatccaatcgccgtcctagaaaagctaggagatcgctgcgatatgatccatcagaaggacttaagtagaaatcttacaagtcagcttaatattatggaggcagctcaagagagtggagatgaggatctcgaaccatttgaggtctaccaaaaatatataggccccgctgattttgtagatctcggcacgggtacgttcgatttcatcacgatatatgagcaaatccgatccatgggacatatccgttattcgcttgtagagaacgagggcgagtcggaagacaaatttagcagcatccgcaatgatctaactgtgctgaagaaatatgtatagaccataaggaggagagtttaacatgcccaacttaaaactgaagatcggaataatcggctgtggcggcattgccaaccaaaaacatatgccatcgttagccaaacttacagaattgggagaaatggttgccttctgtgatgttattgaagaaagagccaagaaagcggccaaagattttgggagtgaacatgctaaagtatacgaagattataaagaattgttgaaagatgaatccatcgatgttgtccatgttcttacccctaaccttcatcattcctatataacagtagacgcactagaagcgggtaaacatgtcatgtgtgaaaagcctatggcaatcaattcgattgaagctcaaaaaatgctggatgctgcaaagcgaacaggaatgaaactgacgattggttatcaaaataggttccgaaatgattcccaggtcttgcataaagcatgccgcgcaggtgaattgggagatatttatgtttccaaagcacacgccgttcgcagacggggagtacccacctggggcgtattccttgacaaagagcagcagggtggtggaccgttaattgatttaggtactcatgcactagatttaacattatggttcatggacaattataagccgaaatctgtgtctggctctgtttttcataaaatgtcggataagtttgaaggtaatatgatgggaccatgggatccgcaaaaatttgatgtggaagactctgctttcggatttataaagatggaaaatggtgctactattttcttggaagcggcgtgggcgttaaatacaacggatgctagagaagcgatgacatcactttgcggaacggagggtggagcagaaatgagagccagttctgttctaggtaaaagtgatgttatttttaatagtactaagtatggtcagcttgtagaaacgcaaccatcttttagcggaggcattgcttatttcggcccaggtgccgagaatgagggtgtgaaagaggcgagacaatggcttgaaagcattcaaaatgacacagagcctctcgtcaaaccagagcaagcccttgttgtcactcaaatattagaggccatttatacctcggccgaaacaggtaaagtcgtagaattttagtcggtaattttgatggtttgtcatattaattcagagtacaatgaagttgaaggagggagtgcgctcctccccccttcaaccaacgtgtccaaggaggcggaagtaacatgaataataagtgggtggaaacaaatgtgaaagcgattacatacgtaacaaatgaagggggtcccacactagggtatgcagacgcttcaggcgtaaatatcatctttgatgacggatatgcatttaaagatcttaacaaagacggtaagttggacaaatacgaggactggcgtttgcctgttgacatacgggcaaaggatctggcatcaaagatgtccattgagcaaattgctggtctgatgttatacagcaggcatcaggctgtgccggcctcaaacggattttttccggctacatataacggtgaatcatatacggaaagtggcgtgaagccgtatgatctctcagatgaacaaatcgagtttctgacgaaagaccatctgcggcatgtgttgcttaccactgtcgaaagccctgagattgcggcttgttggaacaataatgttcaagccttagcggaaagcatcggactcggcattccggtcaataacagcagcgatccgcggcatggctctgatgcgagcaaagaatataatgcaggggcggggggctctatctcgatgtggccggaatcgctcggacttgcagcatcgtttgatcctgaacttgtacagaggtatggagagattgcgtctaaggaatacagggcgctcggtattgcaaccgccctttctcctcaaattgatatcgcaaccgatccgcgctggtctcgctttgatggcaccttcggggaagattcgaagttgtcggtggatttgacgagagcctatatcgacggtttccagacctcgtttggagagcggttagttacggacggatggggatgtgacagcgtgaatgcgatggtcaagcattggccaggcggtggttccggcgaaggcggtagggatgctcattttggttacggtaaatatgcggtatatccgggtaacaacttcgaagaacatctgattcctttcctggaaggggcattccaattgaagggaggaacggagaaggcttctgcaatcatgccatattatacgatttcatataatcatgatcaggtgaacggcgagaatgttggtaactcttataacgctcacattataggcgatcttctgcgcgataaatacggatacgacggtgtcgtgtgtaccgactgggggataacagatgatgagggctccgatatcagtcgtttgtttcctggcggacgttcatggggggtagaggaaggctataccgttgcggatcggcattacaaggcgcttatggctggagtggaccaattcggcggaaataacgatggtggaccagtcctggaggcgtaccgcattggtgtcgctgagcatggagaagcctacatgcgccagcgtttcgagcaatcagccgtgcgtctcttgaagaacatgttccgagttggcttattcgaaaacccttattgccaaacggaagaaaccgtccgaattgtcggcaatgccgaatatatggcggcaggctatgaagcacagctcaaatcactcgtgttgttaaaaaacaaagatcaagttcttccgttacagaaaatgaagacggtctatattcctaaacgatacagaccggccggcacgaattggattggcttccctactcctgaagttgacggttatcccgttaatatggatgtgatccgtaaatacttcaatttcacggatgagcccgagacagcagattttgcaatcgtttttattaccggggcagattccggcagcggatacagtaagggcgatgtcgaagccggcgggaacggttacgttccaatcagcttgcaatatgctccttatacagccgagcacgctagggaaaagagtattgccggcgacgaaagggatattgtgaaccgctcatataaaggtaaaatgatatcggcaacgaatgcatcggacttggatgcggtattgaaagctaaagctttaatgaaagggaaacctgttattgtatccctgcaactatcgaagccatcgatcgttgcagaatttgaagcagtagctgatgcggtcgttgccacctttggggtacaggatcaggcgtttctggatattctaatcggtgaagcggagccttcaggtctgttgcccatgcagatccctgccaatatgaagaccgtcgaagaacaattagaagacgttccgcacgacatggaagtgcatgtcgattccgaggggaacgcctacgatttcgcatatggtctaaactggagcggcgttataagtgatgaaaggaccaaacgctacggcaaaaaaaagtagactgaagaagaggggccggggatcactccccggctattcgtggtataatgctccttattcatttaacaagcagaagggggcaaggcagccttgaaaatattcaaacgttcgctctttaattcgcttcgttttaagcttgtaacagggcttttactcatcatgttgcctatggtatcctttctgatctacaacaacctatattcgatcgatgtcgttcgtaaccaagtggcgcaatccaacagcaacatgctcaaactctatatgggattaatcgatatgacgcttgaggacatcgataagtacctgctccaattcgctgcagaagaatccggcctaaatatcctcgaccgtccacccgaggtcgatcttgacatgtacaaactacaacgaatatggctctttatggaattaagggatcatgccacttattataaatcattggattacttcttcgtttattcgccattaaatcaggatttggtgttcgcacctaagttgacaggctcggcttattcgaatagtgatcccattaaggctgcaattacaaggctcctaaacgatgaacaaaggatgagagactatccgtacgatcagtggtccgtttatcatgtcggcgagcaggcctacttgctccataccattaagtccggcaacttatacataggagcaggagttaatgcggatgatgtcatgggaccgcttgatcttctcgacctaggcgccgaaggcacgtcgctgcttgtggatggtagcattgcaccgcttgagaacggggacttctttaaagagaaggaaattgatctggcatataccgctaatacataccggctttccggcgtcgatgacaaatacctggtgattggagaaaagtcaggtaagggccaattcggtttagtcgccgtactgcacgaccaaaacatattagaaaaacttccttatctgcaaagaattatacttttcattgcgacaggatccatcctgattctgctgatttccgtttacttcctgcgtaaagttgtcctgcttccaatcaaccgaatcgttgtggccatgcgaaaaattaaagatggctatctggaggcaagaataccagacaaaccggcatccgatgaattcgagctgatgaacaagacgttcaacagcatggtttccgacattcaacaattgaaaattgacgtttacgaggaacagttgattaaccagaaggccgagcttaagcaactacagctgcag

SEQ ID NO: 1100 - protein, 289 aa, Paenibacillus sp.
MTIAAGINIFSVYRELGEDYFGTLEKIAAAGYVNIELIGFNMKTFTRYIDEIPMESLRDKLQDLGLKAVSVHEGTAPGQELITHDWDSVMKYYAGLECASIVLPSVWIKNREDTLRAAEQMNSVGKKMKEGGFQFYLHNHAHEFKTIGDQTLFDLLLQNTDPSYVKFELDLAWVMRAGVDPIAVLEKLGDRCDMIHQKDLSRNLTSQLNIMEAAQESGDEDLEPFEVYQKYIGPADFVDLGTGTFDFITIYEQIRSMGHIRYSLVENEGESEDKFSSIRNDLTVLKKYV

SEQ ID NO: 1101 - protein, 366 aa, Paenibacillus sp.
MPNLKLKIGIIGCGGIANQKHMPSLAKLTELGEMVAFCDVIEERAKKAAKDFGSEHAKVYEDYKELLKDESIDVVHVLTPNLHHSYITVDALEAGKHVMCEKPMAINSIEAQKMLDAAKRTGMKLTIGYQNRFRNDSQVLHKACRAGELGDIYVSKAHAVRRRGVPTWGVFLDKEQQGGGPLIDLGTHALDLTLWFMDNYKPKSVSGSVFHKMSDKFEGNMMGPWDPQKFDVEDSAFGFIKMENGATIFLEAAWALNTTDAREAMTSLCGTEGGAEMRASSVLGKSDVIFNSTKYGQLVETQPSFSGGIAYFGPGAENEGVKEARQWLESIQNDTEPLVKPEQALVVTQILEAIYTSAETGKVVEF

SEQ ID NO: 1102 - protein, 756 aa, Paenibacillus sp.
MNNKWVETNVKAITYVTNEGGPTLGYADASGVNIIFDDGYAFKDLNKDGKLDKYEDWRLPVDIRAKDLASKMSIEQIAGLMLYSRHQAVPASNGFFPATYNGESYTESGVKPYDLSDEQIEFLTKDHLRHVLLTTVESPEIAACWNNNVQALAESIGLGIPVNNSSDPRHGSDASKEYNAGAGGSISMWPESLGLAASFDPELVQRYGEIASKEYRALGIATALSPQIDIATDPRWSRFDGTFGEDSKLSVDLTRAYIDGFQTSFGERLVTDGWGCDSVNAMVKHWPGGGSGEGGRDAHFGYGKYAVYPGNNFEEHLIPFLEGAFQLKGGTEKASAIMPYYTISYNHDQVNGENVGNSYNAHIIGDLLRDKYGYDGVVCTDWGITDDEGSDISRLFPGGRSWGVEEGYTVADRHYKALMAGVDQFGGNNDGGPVLEAYRIGVAEHGEAYMRQRFEQSAVRLLKNMFRVGLFENPYCQTEETVRIVGNAEYMAAGYEAQLKSLVLLKNKDQVLPLQKMKTVYIPKRYRPAGTNWIGFPTPEVDGYPVNMDVIRKYFNFTDEPETADFAIVFITGADSGSGYSKGDVEAGGNGYVPISLQYAPYTAEHAREKSIAGDERDIVNRSYKGKMISATNASDLDAVLKAKALMKGKPVIVSLQLSKPSIVAEFEAVADAVVATFGVQDQAFLDILIGEAEPSGLLPMQIPANMKTVEEQLEDVPHDMEVHVDSEGNAYDFAYGLNWSGVISDERTKRYGKKK

SEQ ID NO: 1103 - protein, 381 aa, Paenibacillus sp.
MKIFKRSLFNSLRFKLVTGLLLIMLPMVSFLIYNNLYSIDVVRNQVAQSNSNMLKLYMGLIDMTLEDIDKYLLQFAAEESGLNILDRPPEVDLDMYKLQRIWLFMELRDHATYYKSLDYFFVYSPLNQDLVFAPKLTGSAYSNSDPIKAAITRLLNDEQRMRDYPYDQWSVYHVGEQAYLLHTIKSGNLYIGAGVNADDVMGPLDLLDLGAEGTSLLVDGSIAPLENGDFFKEKEIDLAYTANTYRLSGVDDKYLVIGEKSGKGQFGLVAVLHDQNILEKLPYLQRIILFIATGSILILLISVYFLRKVVLLPINRIVVAMRKIKDGYLEARIPDKPASDEFELMNKTFNSMVSDIQQLKIDVYEEQLINQKAELKQLQLQ

SEQ ID NO: 1104 - DNA, 5943 bp, Thermoanaerobacter brockii
gatccattggatgcttacgcttctggtaaagtaagtaaagaggaagcggtaaagcaatttaaagacaatgttaaaaatgctcttcccaatgttcaagttaattaatatattagctagagaaaatgttaacgttttgttggcattttctctaggcttcttagtaattttataaaagtgagggaatacaaatatggaagcttttaatttaaagtcgaaaagcaagattaataagaactattatggttatatctttactttgccatttatagttatatttttagtttttaatctatatccacttatttatacattttacttaagtttaacagatatgactctgatgaattcgtcttatcattttgttggacttgcgaatttcaaacaattattttctgataactattttttaaaatcagtaataaatacttggaaaatttggcttattaattttattccccaattaactattgctatgcttttagctatttggtttgtcaataacagattgaaaattaaatttattgggttatggagaacgatttattatttaccaaatatacttatgccagttgcagtagctgcacttttttataattttttctccctatatggtcctgtaaatcaaatagcagttcgtacaggaattttaaaagaagcttttgacttttttaggagtactacttggacacaacttattgtggcgtttattcaatggtggatgtggtatggagtaacaataatccttttaatggcagggctatcttcaatttcaccttcatattatgaatcagctttagtggatggtgctaattcatggcaaatgtttactaaaattactcttcctcttttaaaaccggttctaatatatgtacttgtgacttcgttatcaggcggaatgcagatgtttgatataccctatttattaactgatgggacaggatctcctgacggagctataagaacaatgagcgttttaatgtatatgaaattttcaagcggcgatggttatattggtgctgctgcttctgttggtgttatgatttttcttataactgctattgcagcatttattataataaacctgctaaaagagagggaataaagacaaaaattaggctaagaaaggatgggattatgaattataaaccccgtataaaatttatgaagataggagtatatatctttttaattatacttttcttacttgctattttacctatatggcttttgcttgttaatgctacacgttccacacctgaaatacagcaaggagttagtttgttgccaagcagtaatctgtgggtaaattggaatcatcttacaggtatgggagtaaacatatggagaggctttttaaacagccttattatatctgttccagttacttttttaactgtttatttttcaatgatgacggcttatgcaattcatgtatatgattttaaatggaaaaaaatgctatataatactgtggtacttttgacaattgttccaactcaattagtaccaataataggattttataaatatatggcatctctaaaattattaaatagttatattccgctaattgttccagctattgcttcgcctccaatggtattttttgcactacaatatttggaatctacgatagtaaaggatttaatagaagctgcccgtatcgaaggaagtggagaacttggaatttttcataaaattattttacctatagcaaaacctggtgcatttacaatgggaattttatcttttgttgcttcttggaataacttttttactccatttatgttaatttcaaaaatagaaaaatatacgcttccaatgattgttaaattattacgtggggatatgtatagaacagaatatggagcaatataccttggtcttgcaatcacgatgattcctattataatagtttatgctatattttcaaaatatattgtaagtgggattgcaatgggagctataaaagagtaaaaaaactaatagcaaaagggggatttttaaatgacgccattatatttagattccactcactcagtggaaaaaagagtagaatgatttattacagcatatgactatagaagaaaaggtagcacaactaaacagtttttgggtatacgaaatattagatgatatgaaatttttcttttgataaagctaaaagattgatgtcatatggaataggtcaaatcacccgccttggtggagcaagtaatttatcaccacgggaaacagtgagaatagcaaatcagattcaaaaatttttgattgaaaatacaaggcttggcatacctgctttgattcatgaggagtcttgtagtggatatatggcaaaaggggcaactatttttccacaaactataggagttgcgagtacgtggaataatgaaattgttgaaaaaatggcttctgtaataagggaacagatgaaagctgttggagcaaggcaagctcttgcgcctttattggatattacaagagatccacgttggggaagaacagaagaaacttttggagaagacccttatttagtaatgcgtatgggtgtttcatatattcgtgggcttcaaactgaaagtttaaaggaaggcattgtagctacaggaaaacattttgtgggatatggaaattcagagggaggcatgaattgggctcctgctcatattcctgaaagggagcttagagaagtttttctttatccttttgaggcggcggtaaaagaggcgaaattaagttcgattatgccgggataccacgaacttgatggggtaccgtgtcacaaatcaaaaaaattgttaaacgatattttacgtaaagattggggtttcgagggaattgtagtatctgattactttgctataagccagctttacgagtaccatcatgtgacatcagataaaaagggagctgcaaaattggctttagaggctggtgttgatgtggaattaccaagcaccgactattatggcttgccgcttagagagttaattgaaagtggtgagattgatatagattttgtaaatgaagctgtaaagagagttttaaaaataaaatttgaattagggttatttgagaatccttatataaatgaagaaaaggctgttgagatttttgatacaaatgaacaacgagaactagcttataaaatagcgcaggagtctatagtattgttgaaaaatgaaaataatttgctgcctttaaagaaagatttgaaatctattgcagttattggccccaatgctgatagtattcgcaatatgattggtgattatgcatatccttgtcatattgaatcattacttgaaatgagagagaccgacaatgtttttaatacacctttgccagaaagcttagaagcaaaagatatttatgtacctattgtaactgtgctacagggaattaaggcaaaagtttcttctaatacagaagttttatatgcaaaaggctgcgatgttcttaacaatagtaaggatggttttaaagaagcggttgagattgcaaaacaggctgatgttgctgttgtagtagtaggagataaatcagggctaacagatggctgtacttctggtgaatcaagagatcgggcagaccttaatttgccgggtgtacaagaagagctgataaaagcaatttatgaaactggtacaccagtaatagtggtacttataaatggaagaccaatgtctatttcttggatagctgaaaaaattccagcaattattgaagcttggttacctggtgaagagggtggaagagctgttgcagatgtgatttttggtgactataatcctggaggtaaactaccaatttctattcctcaatcagtagggcagttaccagtatattattaccataaaccttctggaggccgcagtcactggaagggggactatgtagaattaagcacaaagcctttatatccctttggttatggtcttagctatacagagttttcatacactaatcttaatatttctaatagaaaggtttctttaagggacagaatggttgaaatctctgttgatataaaaaatacaggtacattaaagggagatgaagttgttcaactttatatacatcaagaagctttaagtgttacaaggcctgttaaagagcttaaagggtttaaacgcattactttagatgctggtgaagaaaagacagttattttcaaactttctattgaacaactgggtttttatgatgagaatatggagtatgtggtagaaccaggacgtgtagatgtaatgatagggagctcttctgaagatataaggctaagggattattttgaaattgtaggagaaaaagagaaagtagctaaaaaatttattacggaagtaagggtagagaataaatagaaagccaaataatagagataggagtgataaaattggcaaaatttccaagagatttcgtttgggggacagccacatcatcataccaaatagaaggagcggtaaatgaagacggaaggaccccttccatatgggacacattttcaaaaacagaagggaagacctataaaggccatacaggagatgtagcctgtgaccattaccaccgctataaagaagatgtagagatattaaaagaaataggagtaaaagcttacagattttcaattgcatggccaagaattttccctgaggaagggaaatacaatccaaaagggatggacttttacaagaagttaatagatgaattacagaaaagagatatagtaccagctgcaacaatttatcactgggatttaccccaatgggcttatgacaaaggaggaggctggctaaatagggaaagtataaaatggtatgtagaatacgccacgaaactatttgaagaattaggcgatgcgatacccctatggataactcataatgagccatggtgttcctcaatattaagctatggaataggagaacatgcgccagggcacaaaaactacagagaggcactaatagcagctcatcatatactactttcccatggagaagcagtaaaagcctttagagaaatgaatataaaagggagtaagattggtataacactaaacttaacccctgcatatccagccagcgaaaaagaagaagacaaattagcagcccaatatgctgacggatttgctaacagatggtttttagatccaatattcaaaggcaattatccagaggatatgatggaattatatagtaaaataattggagaatttgactttataaaagaaggagatttagagactataagtgttccgatagattttcttggagtcaattattatacaagaagtattgtaaaatatgatgaagattccatgctaaaggcagagaatgtgccggggccaggtaagaggacggagatgggatgggagataagcccagagtctttgtatgaccttttaaaaaggctagatagagaatatacaaaactgcctatgtatatcacagagaatggagcagcatttaaagatgaagtgacagaggatggacgagtacacgacgatgaaagaatagaatacattaaagagcacttaaaagcagcagcaaaatttataggagaaggaggtaacttaaaaggatatttcgtatggtcgctgatggacaattttgaatgggcccatggatattcaaaaagatttgggatagtttatgtggattatactacacaaaagagaatattaaaagacagtgcattatggtataaagaggtaatattggatgatggtatcgaagattgaacccaatccctctgataagggatggaataaagcatttttcatagtaatgttgaaatgttttctctttataatctaacttagctgtataattaaaaggtaactacaaaataaaaaattattttaattttcttttaagatttaatgtgttataattcacactagaaacaacaatataaatagaagggtgaagaaatgataacagc

SEQ ID NO: 1105 - protein, 303 aa, Thermoanaerobacter brockii
MEAFNLKSKSKINKNYYGYIFTLPFIVIFLVFNLYPLIYTFYLSLTDMTLMNSSYHFVGLANFKQLFSDNYFLKSVINTWKIWLINFIPQLTIAMLLAIWFVNNRLKIKFIGLWRTIYYLPNILMPVAVAALFYNFFSLYGPVNQIAVRTGILKEAFDFFRSTTWTQLIVAFIQWWMWYGVTIILLMAGLSSISPSYYESALVDGANSWQMFTKITLPLLKPVLIYVLVTSLSGGMQMFDIPYLLTDGTGSPDGAIRTMSVLMYMKFSSGDGYIGAAASVGVMIFLITAIAAFIIINLLKERE

SEQ ID NO: 1106 - protein, 280 aa, Thermoanaerobacter brockii
MNYKPRIKFMKIGVYIFLIILFLLAILPIWLLLVNATRSTPEIQQGVSLLPSSNLWVNWNHLTGMGVNIWRGFLNSLIISVPVTFLTVYFSMMTAYAIHVYDFKWKKMLYNTVVLLTIVPTQLVPIIGFYKYMASLKLLNSYIPLIVPAIASPPMVFFALQYLESTIVKDLIEAARIEGSGELGIFHKIILPIAKPGAFTMGILSFVASWNNFFTPFMLISKIEKYTLPMIVKLLRGDMYRTEYGAIYLGLAITMIPIIIVYAIFSKYIVSGIAMGAIKE

SEQ ID NO: 1107 - protein, 730 aa, Thermoanaerobacter brockii
MSYGIGQITRLGGASNLSPRETVRIANQIQKFLIENTRLGIPALIHEESCSGYMAKGATIFPQTIGVASTWNNEIVEKMASVIREQMKAVGARQALAPLLDITRDPRWGRTEETFGEDPYLVMRMGVSYIRGLQTESLKEGIVATGKHFVGYGNSEGGMNWAPAHIPERELREVFLYPFEAAVKEAKLSSIMPGYHELDGVPCHKSKKLLNDILRKDWGFEGIVVSDYFAISQLYEYHHVTSDKKGAAKLALEAGVDVELPSTDYYGLPLRELIESGEIDIDFVNEAVKRVLKIKFELGLFENPYINEEKAVEIFDTNEQRELAYKIAQESIVLLKNENNLLPLKKDLKSIAVIGPNADSIRNMIGDYAYPCHIESLLEMRETDNVFNTPLPESLEAKDIYVPIVTVLQGIKAKVSSNTEVLYAKGCDVLNNSKDGFKEAVEIAKQADVAVVVVGDKSGLTDGCTSGESRDRADLNLPGVQEELIKAIYETGTPVIVVLINGRPMSISWIAEKIPAIIEAWLPGEEGGRAVADVIFGDYNPGGKLPISIPQSVGQLPVYYYHKPSGGRSHWKGDYVELSTKPLYPFGYGLSYTEFSYTNLNISNRKVSLRDRMVEISVDIKNTGTLKGDEVVQLYIHQEALSVTRPVKELKGFKRITLDAGEEKTVIFKLSIEQLGFYDENMEYVVEPGRVDVMIGSSSEDIRLRDYFEIVGEKEKVAKKFITEVRVENK

SEQ ID NO: 1108 - protein, 450 aa, Thermoanaerobacter brockii
MIKLAKFPRDFVWGTATSSYQIEGAVNEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDKGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSIVKYDEDSMLKAENVPGPGKRTEMGWEISPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIED

SEQ ID NO: 1109 - DNA, 2166 bp, Thermotoga maritima
atggaaaggatcgatgaaattctctctcagttaactacagaggaaaaggtgaagctcgttgtgggggttggtcttccaggactttttgggaacccacattccagagtggcgggtgcggctggagaaacacatcccgttccaagacttggaattcctgcgtttgtcctggcagatggtcccgcaggactcagaataaatcccacaagggaaaacgatgaaaacacttactacacgacggcatttcccgttgaaatcatgctcgcttctacctggaacagagaccttctggaagaagtgggaaaagccatgggagaagaagttagggaatacggtgtcgatgtgcttcttgcacctgcgatgaacattcacagaaaccctctttgtggaaggaatttcgagtactactcagaagatcctgtcctttccggtgaaatggcttcagcctttgtcaagggagttcaatctcaaggggtgggagcctgcataaaacactttgtcgcgaacaaccaggaaacgaacaggatggtagtggacacgatcgtgtccgagcgagccctcagagaaatatatctgaaaggttttgaaattgctgtcaagaaagcaagaccctggaccgtgatgagcgcttacaacaaactgaatggaaaatactgttcacagaacgaatggcttttgaagaaggttctcagggaagaatggggatttggcggtttcgtgatgagcgactggtacgcgggagacaaccctgtagaacagctcaaggccggaaacgatatgatcatgcctgggaaagcgtatcaggtgaacacagaaagaagagatgaaatagaagaaatcatggaggcgttgaaggagggaaaattgagtgaggaggttctcgatgagtgtgtgagaaacattctcaaagttcttgtgaacgcgccttccttcaaagggtacaggtactcaaacaagccggatctcgaatctcacgcggaagtcgcctacgaagcaggtgcggagggtgttgtccttcttgagaacaacggtgttcttccgttcgatgaaaatacccatgtcgccgtctttggcaccggtcaaatcgaaacaataaagggaggaacgggaagtggagacacccatccgagatacacgatctctatccttgaaggcataaaagaaagaaacatgaagttcgacgaagaactcgcttccacttatgaggagtacataaaaaagatgagagaaacagaggaatataaacccagaaccgactcttggggaacggtcataaaaccgaaactcccagagaatttcctctcagaaaaagagataaagaaacctccaaagaaaaacgatgttgcagttgttgtgatcagtaggatctccggtgagggatacgacagaaagccggtgaaaggtgacttctacctctccgatgacgagctggaactcataaaaaccgtctcgaaagaattccacgatcagggtaagaaagttgtggttcttctgaacatcggaagtcccatcgaagtcgcaagctggagagaccttgtggatggaattcttctcgtctggcaggcgggacaggagatgggaagaatagtggccgatgttcttgtgggaaagattaatccctccggaaaacttccaacgaccttcccgaaggattactcggacgttccatcctggacgttcccaggagagccaaaggacaatccgcaaagagtggtgtacgaggaagacatctacgtgggatacaggtactacgacaccttcggtgtggaacctgcctacgaattcggctacggcctctcttacacaaagtttgaatacaaagatttaaaaatcgctatcgacggtgagacgctcagagtgtcgtacacgatcacaaacactggggacagagctggaaaggaagtctcacaggtctacatcaaagctccaaaaggaaaaatagacaaacccttccaggagctgaaagcgtttcacaaaacaaaacttttgaacccgggtgaatcagaagaaatctccttggaaattcctctcagagatcttgcgagtttcgatgggaaagaatgggttgtcgagtcaggagaatacgaggtcagggtcggtgcatcttcgagggatataaggttgagagatatttttctggttgagggagagaagagattcaaaccatga

SEQ ID NO: 1110 - protein, 721 aa, Thermotoga maritima
MERIDEILSQLTTEEKVKLVVGVGLPGLFGNPHSRVAGAAGETHPVPRLGIPAFVLADGPAGLRINPTRENDENTYYTTAFPVEIMLASTWNRDLLEEVGKAMGEEVREYGVDVLLAPAMNIHRNPLCGRNFEYYSEDPVLSGEMASAFVKGVQSQGVGACIKHFVANNQETNRMVVDTIVSERALREIYLKGFEIAVKKARPWTVMSAYNKLNGKYCSQNEWLLKKVLREEWGFGGFVMSDWYAGDNPVEQLKAGNDMIMPGKAYQVNTERRDEIEEIMEALKEGKLSEEVLDECVRNILKVLVNAPSFKGYRYSNKPDLESHAEVAYEAGAEGVVLLENNGVLPFDENTHVAVFGTGQIETIKGGTGSGDTHPRYTISILEGIKERNMKFDEELASTYEEYIKKMRETEEYKPRTDSWGTVIKPKLPENFLSEKEIKKPPKKNDVAVVVISRISGEGYDRKPVKGDFYLSDDELELIKTVSKEFHDQGKKVVVLLNIGSPIEVASWRDLVDGILLVWQAGQEMGRIVADVLVGKINPSGKLPTTFPKDYSDVPSWTFPGEPKDNPQRVVYEEDIYVGYRYYDTFGVEPAYEFGYGLSYTKFEYKDLKIAIDGETLRVSYTITNTGDRAGKEVSQVYIKAPKGKIDKPFQELKAFHKTKLLNPGESEEISLEIPLRDLASFDGKEWVVESGEYEVRVGASSRDIRLRDIFLVEGEKRFKP

SEQ ID NO: 1111 - DNA, 2574 bp, Uncultured bacterium
atgggagcttccatgaatcagtatttcgcgaccacctccgatgcggtgaccgaacaggagcgggcccacgagcggcttgtccgccgggtcggcgccgaatgcgtcgtgcttttggaaaacgacggcgcgctgccgtttaaagcggcggggccgctggcgcttttcggcgacggcgcccgccatacggtcaagggcggcaccgggtcgggcgatgtgaacacgcgcacgacggtcacagtggagcgggggcttgaagcggccggtttcacgatcgcgtcgaaatcctggctcgatcgcaacgaggcgaaccgcgttgaggccaagcgcgtctacgtcgaggagtttgtgccgcgcatcgcgaaagaacagggcgttcccgaattcctcgtcagcttctccgatccgttcaccgcgcctgacccgatcgcgatcaccgatgaggatctggccgaagcggcctgcgaccgggcgatctatgtgctttcccgcaattccggcgagggttccgaccgcagcgctatccgcggcgactacctgctctccgaggtcgaacgcggccatctcgagttgctcgcgaagacctataagcagttcgtcgtcgtgctcaatgtcggcggcgtcatggacctcgccgagctttcatccatcgaaggcgtcaacggcatcgtgctgatgggccaactcggcagcaccggcggcgcggccatcgccgacgtgctttccggcgccgtcaacccctcgggaaagctgaccgatacctgggcccgagattacgacgactatccctcatcggcgacgttcagctcgaacgacggcgatgtcgatgacgagtattatgccgaaggcatcttcgtcggctaccgctatttcgatagcttcggcgtcgaaccgctctatccgttcggtttcgggcgctcctacacgacctttacggtggcggccgacggagcgacgctcggcggtcggacggcgcgggtcaaggcgctcgtgacgaacaccggcgaccgggccggcaaggaggtcgtacagctctacgcctcggcgcctcgcggcagcctcgccaaggccgagcaggtgctcgtcgcctcgatcaagacccctgaaatcgcgccgggcgacaccgccaccgtcgagctgacgttcgatatcggcgcgatggcatcgttctgcacaaaccacagttcctggtgtctgcagtcgggcgattacatcctgcgactcggcgccgattcccgccacaccgaaccggcggcggtgctcgtgatggaatcgagcacacgcatccgggccctgaagagcctctttaaggatgaggatccggttcatgacatcacgcccccggatcgcgagccgttcgagcggcctgccggcgtgccggtgctcacgatcgaccccgcggcgatcgagctcgaaacggtcgtctacagcgacggacgcgagcccttcgccaagccggacaccgaagtgcagctgacagccgatgacgtgcgggcgggccgctgcagcgtcgaggatctcgtcgctcagctgacccttgaggaactcgccgaactctgcgtcggcaccgcccgttccgatgacggctcgatcgtcggcaacgcgtcgcttgacctgccgggcgcggcgggggacacctcgccgatcatcaaggcgtcgcggcatgtgcgaaacctcatcatggccgacggccccgcgggcctgcggctccagccgatcttcaagaccgacaaagagggcaacctgctgccgggcggcgagatgctcggcgacagttacacgcccttcgatccgtcgatcaccgacgaaaactcgatcacctattaccagtactgtacggcgattccgatcggttggtcgttggcccaaagctgggatatgacgatgctcgaagaggtcggctcgatcgtcggcgaggagatggagaccttcggcgtcgacatctggcttgcgccggcgctcaacatccatcgcaatccgctctgcggccgcaatttcgagtattacagcgaggatccgctcgtgagcggccgctgcgcagcggcgatcaatcgcggcgtccagagccacgaaggcaggttcacctgcatcaagcacttcgcgaccaacaaccaggagaacaatcgctacttcacgaactcccacgtcagcgagcaggcgctgcgcgagatctatctgcgcggcttcgagatcgcgattcgcgagagccagcccggcacgatcatgacctcgtacaacctgctgaacggcattcacacggccaacagccacgatctgttgcaggcggtggcccgagatgagtggggtttccagggtttcatcatgaccgactggtatacctcccaggatgtcgcgagcttcacgggaacgagcgacaagtacccgatctcggcatcgaccggctgcgtctacgcgggcaacgacgtgcagatgccgggctgccagaaaaacgtcgacgacatcgtcaaggcggtggaaagcggacagcccctcgatggcttcaggatcaccctcgccgacgtgcagcactgcgccgcgaatgtgattcgcatcgcccttaaggcaacggcacgctga

SEQ ID NO: 1112 - protein, 857 aa, Uncultured bacterium
MGASMNQYFATTSDAVTEQERAHERLVRRVGAECVVLLENDGALPFKAAGPLALFGDGARHTVKGGTGSGDVNTRTTVTVERGLEAAGFTIASKSWLDRNEANRVEAKRVYVEEFVPRIAKEQGVPEFLVSFSDPFTAPDPIAITDEDLAEAACDRAIYVLSRNSGEGSDRSAIRGDYLLSEVERGHLELLAKTYKQFVVVLNVGGVMDLAELSSIEGVNGIVLMGQLGSTGGAAIADVLSGAVNPSGKLTDTWARDYDDYPSSATFSSNDGDVDDEYYAEGIFVGYRYFDSFGVEPLYPFGFGRSYTTFTVAADGATLGGRTARVKALVTNTGDRAGKEVVQLYASAPRGSLAKAEQVLVASIKTPEIAPGDTATVELTFDIGAMASFCTNHSSWCLQSGDYILRLGADSRHTEPAAVLVMESSTRIRALKSLFKDEDPVHDITPPDREPFERPAGVPVLTIDPAAIELETVVYSDGREPFAKPDTEVQLTADDVRAGRCSVEDLVAQLTLEELAELCVGTARSDDGSIVGNASLDLPGAAGDTSPIIKASRHVRNLIMADGPAGLRLQPIFKTDKEGNLLPGGEMLGDSYTPFDPSITDENSITYYQYCTAIPIGWSLAQSWDMTMLEEVGSIVGEEMETFGVDIWLAPALNIHRNPLCGRNFEYYSEDPLVSGRCAAAINRGVQSHEGRFTCIKHFATNNQENNRYFTNSHVSEQALREIYLRGFEIAIRESQPGTIMTSYNLLNGIHTANSHDLLQAVARDEWGFQGFIMTDWYTSQDVASFTGTSDKYPISASTGCVYAGNDVQMPGCQKNVDDIVKAVESGQPLDGFRITLADVQHCAANVIRIALKATAR

SEQ ID NO: 1113 - DNA, 2565 bp, Uncultured bacterium
atggagaagtattttgcatccacctctgatgaaatcaccgcgacggaaacagcccatggaaatctttcccgttctttggcgggggagtgtgtcgttcttttagagaacaacggcgcgctgccgatcccgcctgacggaaggatagcgctgtttggcaatggcgcccgaaacaccgtcaaaggcggtacgggttcgggcgacgtgaacacgcgcaccaatatcaccatcgagcagggccttattgaggctggctataccatcgtcaccactgattggcttgaccgtaatcaaaagatctacgacgatgcccgacgctactatatcgaagagtatcttccccaaaaggctgctgaagatggcatccccgagtttttggtcgccttcaatgagccgtttttgggcgtcgaccccttggagatcaccgaggacgacatttccgacacccataccgacacggctatctatgtgatttcccgcaattccggcgaagggagcgaccgtcgcaacgtgcgtggcgactatcagctattcgaacaggaacgggaatccattgaagtgctggcccacagcttttcaaagcttatcgtggttttgaacgtgggcggcgttatcgacatgagtgaactgaaggccatccatgggatcgatgccattttgctcatgagccagctgggcaatatcagcgggcaggttttggccgacgtgctgtcgggcaaggtgaacccttcgggcaagctgaccgacacctgggcgaaaagctatagcgattatccctcgtcggcgacgttttcatctaatgacggcgacgtgaacgacgagtactacaccgagggcattttcgtcgggtatcgctacttcgacacctttggcgtcgagcccatctatcctttcggctatggcaagtcttacaccacgttcgacattctgctcgatggggcggaactggtcgacttgatcggcgtcaaggtgaacgtgaccgtggtcaacaccggaagcgtagccggcaaagaggtcgtgcaggtgtactattcggcaccggcgggaaagctccccaagccttatcaggaactcataaccttcgctaaaaccgacgaattggaacccggtcaaagccagaaactggaactgttcttcgatgcccgcgatatggcttcttactgcgaagaatgcgcttcgtgggtgcttgagcccggcgattactacatccgtgtgggtgctcattcccgcgccacctatgtagccgccgtcatcacgctggatgaaaaggcgaagacggcccagctcaagaacctgtttgcgctcgatgagccgatggatgaaatcaagcgtccggctgctaccttagaagcgattcccgaagaagtgccccagctgttcttgaaggcagccgatattccctgcgagactgccgaatatcagggtgttcgcaccgaactttccaccgacgcagccgcagacctgaccgttgacgacatcaaggcgggcaacgccagtgttgaagacttggtggcccagctcaccgtggaagagctcgccgattattgcgtcggtaccctgcgtgccgagggtggctctatcgtgggcaatgcttcccataccgtaccgggagctgcgggcgatacgtcttccgtctgcaaggaaagccgcggtatcaagaatctggtgctggccgatggccccgccggattgcgcttgcaaccggtattcaagaccgatttggaaggcaatctgcttcccggcggtgccatactgggcgattcctatgaacctttcgacccggcgctggatgactccaattctattacctattaccagtattgcaccgctatccccatcggctgggctctggcccaagcttggaacccggctttgctcgagcaggtgggctccatggtaggcgaggaaatggtgcagttcggcgttgacatttggttggctcccgccttgaacatccatcgcaacccgctttgcgggcgcaatttcgaatactattccgaagatccgctggtgggaggccttgcggctgcggctatcacgcggggcgtccaaagccatgagggcaagggcacctgcatcaagcatttcgccgtcaacaaccaagaaaacaatcggtatttcacgaattcccatatcagtgagcgggctatgcgcgaaatctattgcaaaggcttcgagatcgccatcaagcagagccaacctctttcgatcatgaccagctataacctgatcaacggcacgcacacggcaaattatcacgacctgcttcagggcgtggcgcgcgatgagtgcgggttcgccggattcatcatgaccgactggttcacgtctcaggaccaacctgcatttaccggtggctccaccaagtatcccatcagcgcttcgaccggctgcgtttacgccggcaacgacaatcagcagcccggctgcttgaagaacgtcaccgacctcattgaagccgttgaaagcggggaagagaaggatggatttaccatcaccaaagccgacctgcaattctgcgcggctaacgtcattcgcatagcggttttgtgcgacacggaagcctga

SEQ ID NO: 1114 - protein, 854 aa, Uncultured bacterium
MEKYFASTSDEITATETAHGNLSRSLAGECVVLLENNGALPIPPDGRIALFGNGARNTVKGGTGSGDVNTRTNITIEQGLIEAGYTIVTTDWLDRNQKIYDDARRYYIEEYLPQKAAEDGIPEFLVAFNEPFLGVDPLEITEDDISDTHTDTAIYVISRNSGEGSDRRNVRGDYQLFEQERESIEVLAHSFSKLIVVLNVGGVIDMSELKAIHGIDAILLMSQLGNISGQVLADVLSGKVNPSGKLTDTWAKSYSDYPSSATFSSNDGDVNDEYYTEGIFVGYRYFDTFGVEPIYPFGYGKSYTTFDILLDGAELVDLIGVKVNVTVVNTGSVAGKEVVQVYYSAPAGKLPKPYQELITFAKTDELEPGQSQKLELFFDARDMASYCEECASWVLEPGDYYIRVGAHSRATYVAAVITLDEKAKTAQLKNLFALDEPMDEIKRPAATLEAIPEEVPQLFLKAADIPCETAEYQGVRTELSTDAAADLTVDDIKAGNASVEDLVAQLTVEELADYCVGTLRAEGGSIVGNASHTVPGAAGDTSSVCKESRGIKNLVLADGPAGLRLQPVFKTDLEGNLLPGGAILGDSYEPFDPALDDSNSITYYQYCTAIPIGWALAQAWNPALLEQVGSMVGEEMVQFGVDIWLAPALNIHRNPLCGRNFEYYSEDPLVGGLAAAAITRGVQSHEGKGTCIKHFAVNNQENNRYFTNSHISERAMREIYCKGFEIAIKQSQPLSIMTSYNLINGTHTANYHDLLQGVARDECGFAGFIMTDWFTSQDQPAFTGGSTKYPISASTGCVYAGNDNQQPGCLKNVTDLIEAVESGEEKDGFTITKADLQFCAANVIRIAVLCDTEA

SEQ ID NO: 1115 - DNA, 2598 bp, Uncultured bacterium
atgaggaatgtgcgtacttcaaagagttctgcgagtgaaagggctcagacgatcatgacgaaaatctatgctatgacctcttccgagatcacccctgaagaagcgaaccatgagcagatcgtgaaacgggccggcggcgaatgcgtcgtgctgttggaaaacgacggcatcctgccatgggaaaaccctgggcagctggctctgtatggcatgggtgcgcgccgcacgatcaagggcggcacggggtcgggcgacgtgaacacgcgctcgaatacgtcgatcgagcaggggctcgaagccgccggcttcgagattctcacgaaaagctggctcgatcgttgcgaggccgaagcggttgaggcgaagcggtattacctcgaagactacctgccgaaacgggcgcaggagctgggagtcgatccgtttatcgtcaccttcaacgagcccttccatgatcccgacccgaccgctatcagcgaggccgatctggcgtcgtgcgaccgagcggtgtacgtgatctcgcgtaactccggcgagggagccgaccggcgcaacgcacccggcgactatcagttctctgaaactgaaatcgctcagatgaggcaactcgcgaacgcctatgccgaattcgccgtcgtgctcaatatcggcggcgtgatggatctttccgtgctctccgagatcgagggcgttaatgcggtggtgctcatggggcagttgggaagcgtcggaggcgccgtgctcgccgatgtgctcaccggtgcggtgaacccgtcgggcaagctgaccgacacgtgggcgcgcgcctatgaagactacccgtcttcggctgggttcagctcaaacgatgggaacgtcgacgacgaatactacactgagggtatttacgtcggttaccggtatttcgacaccttcggcgttgagccgttgtatccgttcggctttggccgttcgtacaccacgttccagatcacgcctgcggctcttgagcttgacgggctgaccgtgcgcgtgaaggccaccgtgaaaaacaccggcgatcgtgccggcaaagaggtcgttcaggtgtacgtctcaacaccggcgggacatcttccggtcgcttatcagtcgctcgtcggcttcgcgaaaaccgaggaacttgccccgggcgccgagaccacggtcgagattgtcttcgacgtgcgcgatgtggcgtcctattgtgcgaaccattcgaattgggcgctgctcggcggcaactacgttgtgcgcgtgggctcctgctcgcgtgatacggttatttgtggcgttcttacgttggcggagaacacgcccttcaagcactgcaagaagctgttcgacgactcagaccccgtgagtgtcatcatgccttcgtccgtacccgtgagcgaacttccggatggagtgcccgttctgccaatcgatcctcaggatattccacgggaagcggtttcctacaccgcctcgcacccagagcttgcggctccgactaccgatgacatcatctgcgcgaacgatgtccgcgaaggtcgtgcgagcgtcgaagacctcgtcgcacagcttccgctcgatgaacttgccgagttctgtgcgggcaccttgcgggccgacgatggctcgttggtcggcaatgcctcttacacggtgccgggcgcggcgggcgatacgacttccgtcatcagggagtcgcgcggcgtgaagaacctggtgatggctgacggtcccgcaggtcttcgcctgcagccggtgttcaaaaccgacctcgagggcaatctgctgcccgggggagaggtgctcggcgatagctacacaccctttgatccttcgctcaccgacgagaactcgatcacgtattatcagtattgcacggcgatcccgatcggctggtcgctcgcccaaagctggaacatgccgcttttggaggagcttggctcgctggtggggcaggagatggagaccttcggcgtcgacatttggcttgccccggcgttcaacattcaccgcaatccgctgtgcggccgtaacttcgagtattacagcgaagacccggtggtgagcgggaaatgtgccgcagccatcacgcgtggggtgcaaagccatcagggtcgctatacctgcatcaagcactatgcggccaacaaccaagaggataatcgctacttcacgaactcgcacatcaatgagcaggccattcgcgagatctacctcaaagggttcggcatcgcgattcgcgaaagtcagccggggacgatcatgacctcctacaacctgctcaacggcattcacacggcgaacagccacgacctgctgcaggcggtggcgcgcgatgagttcgggttcgagggcttcatcatgaccgactggttcacgtcgcaagatcaaccggcgtttaccggtggaagcacgaagtatccgatttccgcctcaaccggttgcgtttacgcgggaaacgatgtgcagatgcccggatgtcgcaagaacgtgacggacatcatcgaggccgtcgaaagcggagaagcgctcgacggtttctcgatcacgcttggtgatgtgcaattctgcgctgccaacgtcattcgtctcgccatttcgtaa

SEQ ID NO: 1116 - protein, 865 aa, Uncultured bacterium
MRNVRTSKSSASERAQTIMTKIYAMTSSEITPEEANHEQIVKRAGGECVVLLENDGILPWENPGQLALYGMGARRTIKGGTGSGDVNTRSNTSIEQGLEAAGFEILTKSWLDRCEAEAVEAKRYYLEDYLPKRAQELGVDPFIVTFNEPFHDPDPTAISEADLASCDRAVYVISRNSGEGADRRNAPGDYQFSETEIAQMRQLANAYAEFAVVLNIGGVMDLSVLSEIEGVNAVVLMGQLGSVGGAVLADVLTGAVNPSGKLTDTWARAYEDYPSSAGFSSNDGNVDDEYYTEGIYVGYRYFDTFGVEPLYPFGFGRSYTTFQITPAALELDGLTVRVKATVKNTGDRAGKEVVQVYVSTPAGHLPVAYQSLVGFAKTEELAPGAETTVEIVFDVRDVASYCANHSNWALLGGNYVVRVGSCSRDTVICGVLTLAENTPFKHCKKLFDDSDPVSVIMPSSVPVSELPDGVPVLPIDPQDIPREAVSYTASHPELAAPTTDDIICANDVREGRASVEDLVAQLPLDELAEFCAGTLRADDGSLVGNASYTVPGAAGDTTSVIRESRGVKNLVMADGPAGLRLQPVFKTDLEGNLLPGGEVLGDSYTPFDPSLTDENSITYYQYCTAIPIGWSLAQSWNMPLLEELGSLVGQEMETFGVDIWLAPAFNIHRNPLCGRNFEYYSEDPVVSGKCAAAITRGVQSHQGRYTCIKHYAANNQEDNRYFTNSHINEQAIREIYLKGFGIAIRESQPGTIMTSYNLLNGIHTANSHDLLQAVARDEFGFEGFIMTDWFTSQDQPAFTGGSTKYPISASTGCVYAGNDVQMPGCRKNVTDIIEAVESGEALDGFSITLGDVQFCAANVIRLAIS

SEQ ID NO: 1117 - DNA, 2238 bp, Uncultured bacterium
atgaaacacatcctaaacctatgcctgttggccgttctttgcgccgtcctttcctgccaggagcagaagccttccaccgtgggggctactgccgaagtggaaagccgcgtagaggcgctgctgtcccggatgaccctggccgaaaaaataggtcagatgaaccaggtctcggccggcggcgacgtgtccaactatgccgaatctatccgcaagggccaggtgggctctatcctcaacgaggtggatccggtaaagatcaacgccttccagcgcctggccgtggaggagtcccgtctggggattccccttctggtgggccgcgacgtcattcacggttttcatacggttttccccattcccctgggactggcggccacttttgaccccgacctggtagaggagggggcccgtgtggcggctgtggaggccacgtcgcagggtgtccgctggactttctcgcccatgctggacattgcccgcgacccccgctgggggcgtattgccgagggcagcggtgaagatacgtacctggacacccgaatggcggaagccatggtatacggttatcagggccgcacggccgattccacctccatggcagcctgcatcaagcatttcgtcggctacggtgctgcggaaggcggccgggactataacagtacctacctcaccgagcgccagttgcgcaacgtataccttcctcctttcgaggcggcggtaaaggccggcgccatgacgctgatgacgtcttttaatgacaacgacggcgtgccctccacgggcaacaccttcgttgtgaaagacgtactgcgtggcgaatggggcttcgacggcctggtggtcaccgactgggattccatgggagagatgatagcccacggatttggcgtcgaccgcaaggacgtggccgaaaaggcagctaacgccggcgtagacatggacatgatgactttcggcttcctctcccatctggaagaactggtgaagagcggtgccgtgaagcagaataccattgacaatgccgtgcgcaacatccttcgcgtgaagttcatgttgggcctgtttgagaacccttatgtaaacgttgaggcgtcccaggcggttcagtatgcccccgaacacctggctgccgcccaaaagacggcggaagaatcggccattctcctgaagaacgacggcgtactgcctctgaaggcgggtgtccgtatcctggtcaccggccctatggccgacgccccgcacgaccagctgggaacctgggctttcgacgggcagaaagcgcataccgttacgcccctgaaggccttgcaggcccgtttccccggcctggtggactatgtccccggactcacgtacagccgtgagaagcgcagcggcttctcggacgttgtggccgccgcccgcagtgccgacgtagtgctggcgttcctgggcgaggaagccatcctctccggagaggctcacagtctggccgatcttaacttgatgggttcccagagcgaattgctcgaagccctgaagactgcgggcaagccggtggtggccaccgtaatggccggccgcccgcttaccattgagcgcgacctccccaacgtgaacgccatgctgtatagcttccatcccggcaccatgggcggtccggctctggccaacctcctcttcggcgatgtgaatccttccggcaagacgcccatcacattcctgcgcaccgtgggacaggcccccctgtactacagccacaatatgacaggacgtccctacaagggagaaacccttctggacgacatcccggccgaagcaggacagacctctctgggcaatacatcctattacctggactatggtgcctatccgctattccccttcggcttcggtctcagctacacctctttcgcttattccgacatcgctctggataaggagagttatgcggcggacgatgtcctgcatgtaagtttcaacctggccaataccggcacctttgacggaacggaagtggcccaggtttatatccgtgacctggtgggctccgtgacccgtccggtgaaagaactcaaggcattccggcgcgtgagcctgaaggcgggtgaaagccgccgcctcacgctggatattccggtttctgagttggctttctatgggttagatatgcaaaaaaaggtagaaccggggcagttccagctttgggtggctggtgacagctcctccggtgaagcccttacttttagcgtacgataa

SEQ ID NO: 1118 - protein, 745 aa, Uncultured bacterium
MKHILNLCLLAVLCAVLSCQEQKPSTVGATAEVESRVEALLSRMTLAEKIGQMNQVSAGGDVSNYAESIRKGQVGSILNEVDPVKINAFQRLAVEESRLGIPLLVGRDVIHGFHTVFPIPLGLAATFDPDLVEEGARVAAVEATSQGVRWTFSPMLDIARDPRWGRIAEGSGEDTYLDTRMAEAMVYGYQGRTADSTSMAACIKHFVGYGAAEGGRDYNSTYLTERQLRNVYLPPFEAAVKAGAMTLMTSFNDNDGVPSTGNTFVVKDVLRGEWGFDGLVVTDWDSMGEMIAHGFGVDRKDVAEKAANAGVDMDMMTFGFLSHLEELVKSGAVKQNTIDNAVRNILRVKFMLGLFENPYVNVEASQAVQYAPEHLAAAQKTAEESAILLKNDGVLPLKAGVRILVTGPMADAPHDQLGTWAFDGQKAHTVTPLKALQARFPGLVDYVPGLTYSREKRSGFSDVVAAARSADVVLAFLGEEAILSGEAHSLADLNLMGSQSELLEALKTAGKPVVATVMAGRPLTIERDLPNVNAMLYSFHPGTMGGPALANLLFGDVNPSGKTPITFLRTVGQAPLYYSHNMTGRPYKGETLLDDIPAEAGQTSLGNTSYYLDYGAYPLFPFGFGLSYTSFAYSDIALDKESYAADDVLHVSFNLANTGTFDGTEVAQVYIRDLVGSVTRPVKELKAFRRVSLKAGESRRLTLDIPVSELAFYGLDMQKKVEPGQFQLWVAGDSSSGEALTFSVR

SEQ ID NO: 1119 - DNA, 2556 bp, Uncultured bacterium
atgagatcaccgatggctgagtttcatgcgccgacttcccctgcgatcacccctcaagaagaggcccatgccgctgccgtgcgtcgtgccggcggcgaatgtgtcgttttgcttgaaaacgatggagctctgccgtttaaagccgaaggggcagtcgcgctttatggcatgggcgcccgcaagacgatcaaaggcggcaccggctcgggcgacgtgaacacccgggcgaacgtctcggtggaagagggccttgaagcggctggcttcgaaatcgcgtccaaggcctggatcgagcgctgcgacgccgcggccaaggaggctaagcgggcctatctggaagagtatgtgccgaagcgcgccgcagagctcggcgtcgatgagttcatcgtctcgttcaccgaaccgttccaggagatcgaagcgatcccgattgaagaggacgacatcgccgcctgcgatcgcgcgatctatgtgatctcgcgcaattccggcgaggccaccgaccgcaaaaacgcacctggcgactaccagctctccgaggtcgaaaagacccagatcgcccagctcgcaacggcctatccccagctggtcgtcgtgctcaacatcggcggcatcataaacctcagcgagctttccgccatcgagggcgtgaacgctatcgtgttgatgggccagctcggcgccgtcggcggcacggccatcgcagacgtattgacaggggctgtgaacccctcaggcaaactcaccgacagctgggcgcgggcctatgaggactacccctcctccgcgacgttttccggcaacgacggcgatgtggatgatgagtattacaccgagagcatctacgtgggctatcgctacttcgacaccttcgacgtcgagccgctctatccgttcggattcggccgctcctacacgaccttcaccatcgaaccggccggattcgcgttagatggcgccacggtgtctgtgaaggccaccgtcaccaacaccggacaggtcgccggcaaagaggtggtgcaggtctatgcctcaacgccgcgggggcatcttcccaaggccgcccagtcgcttatgggctttgcgaaaacctcggagctcgccgctggcgaaagcgagaccgtcgagatcgccttcgacgtgcgggatatggcctccttctgcgcgaaccactccaattgggcgcttgtggccggcgactacctgatccgcgtcggcgcatcctcccgcgacaccatctgctgcggcgtgctcactctcgatgagaacacgcccttccgtcactgcacgcgcctctttgtcgatccggatccggtgacgccgatcaccgctcccgaggccgcgccactttctcggcccgatggcgtgccggtgattccgattgacacggccgccatcccgatggaggacgtggactacactaaggcccatcccatcctcgaggccccgctcacggaaaacgtcctcggcgccgatgacgtgcatgagggccgcgccaccgtcgaagacctcgtcgcccagctgaccctcgaggagcttgccgagttttgcgcgggcacgcttcgggccgccaccggctcgctcgtgggcaacgcctcgcttgaggtgcccggcgccgccggcgacaccaccggcatcatcaaagccagccgcggcgtcaaaaacctcgtgatggccgacggcccggcaggcctgcgcctgcagccggtgttcaaaaccgatctcgagggcaacctgcttcccggcggcgagcttctcgccgacagctacacgcccttcgatccctcctacaccgacgagaacacgatcacccactatcagtactgcacggcgattccgatcggctggtcgctcgcgcagagctggaacatggaactgctcgaggagatgggctcgcttgtgggcgaggagatggagacattcggcgttgacatctggctggcgcctgccctcaacatccaccgcaacccgctttgcggacgcaacttcgaatacttcagcgaagatccgcttgtgggcggcaagtgcgccgcagcgatcacccgcggtgtgcagagccatccgggccgctacacctgcatcaaacactatgcggccaacaaccaggaggacaaccgctacttcacgaactcccacatcgatgagcaggccatccgcgagatctacctcaagggattcgagatcgcgatcaaggaaagccagccgggcacgatcatgacctcctataacctcttaaacggcatccacacggccaacagccacgatctgctccaagcctgcgcccgcgacgaattcggttttgagggcttcatcatgaccgactggttcacctcccaagaccaaccggcgttcaccggtgagagctcgaaatatccgatctcggcatccactggatgcgtctttgcgggcaacgacgtgcagatgccggggtgtgaaaagaacgtgaccgacatcatcgacgccgtcacgcgcggagaagagctcgacggctaccgcatcacccttggtgatgtgcagttctgcgccgccaatgtgatcaggctcgcgctcgcctag

SEQ ID NO: 1120 - protein, 851 aa, Uncultured bacterium
MRSPMAEFHAPTSPAITPQEEAHAAAVRRAGGECVVLLENDGALPFKAEGAVALYGMGARKTIKGGTGSGDVNTRANVSVEEGLEAAGFEIASKAWIERCDAAAKEAKRAYLEEYVPKRAAELGVDEFIVSFTEPFQEIEAIPIEEDDIAACDRAIYVISRNSGEATDRKNAPGDYQLSEVEKTQIAQLATAYPQLVVVLNIGGIINLSELSAIEGVNAIVLMGQLGAVGGTAIADVLTGAVNPSGKLTDSWARAYEDYPSSATFSGNDGDVDDEYYTESIYVGYRYFDTFDVEPLYPFGFGRSYTTFTIEPAGFALDGATVSVKATVTNTGQVAGKEVVQVYASTPRGHLPKAAQSLMGFAKTSELAAGESETVEIAFDVRDMASFCANHSNWALVAGDYLIRVGASSRDTICCGVLTLDENTPFRHCTRLFVDPDPVTPITAPEAAPLSRPDGVPVIPIDTAAIPMEDVDYTKAHPILEAPLTENVLGADDVHEGRATVEDLVAQLTLEELAEFCAGTLRAATGSLVGNASLEVPGAAGDTTGIIKASRGVKNLVMADGPAGLRLQPVFKTDLEGNLLPGGELLADSYTPFDPSYTDENTITHYQYCTAIPIGWSLAQSWNMELLEEMGSLVGEEMETFGVDIWLAPALNIHRNPLCGRNFEYFSEDPLVGGKCAAAITRGVQSHPGRYTCIKHYAANNQEDNRYFTNSHIDEQAIREIYLKGFEIAIKESQPGTIMTSYNLLNGIHTANSHDLLQACARDEFGFEGFIMTDWFTSQDQPAFTGESSKYPISASTGCVFAGNDVQMPGCEKNVTDIIDAVTRGEELDGYRITLGDVQFCAANVIRLALA

SEQ ID NO: 1121 - DNA, 2565 bp, Uncultured bacterium
atggagaagtattttgcatccacctcaaatgaagtcacggcaacggagactgcccacggagagctttcccgttctttggcgggggagtgcgtcgttctcttggaaaacaacggcgtgctgccgattccgcccgacggaagaatcgcgctgttcggcaacggtgcccgcaacaccgtcaaaggcggcacaggctcgggcgatgtgaacacccgcaccaatatcactatcgagcagggtctggtcgaagcgggctacaccatcgtcaccaccgattggctcgaccgcaaccagaagatctacgacgaagccaagcgctactacatcgaggaatatattcccaagaaggccgctgaagaagacattcccgagttcctggctaccttcaatgagccgtttttgggcgtcgacccgctggaaatcaccgacgacgacatttccgacactcataccgatacggctatctacgtgatttcccgtaactccggcgaaggaagcgaccggcgcaacgtgcgcggtgattaccaattgttcgagcaagaacgggaatccatcgaagtgctggcccatagcttttcgaagctcatcgtcgtcttgaatgtaggcggcgtcatcgacatgagcgagttgaaagccatccacggaatcgatgccattctgctcatgagtcaactgggcaatatcagcggccaggtgctggccgacgtgctgtcgggtaaggtgaacccttcgggcaagttgaccgacacctgggcgaaaagctatagcgattatccctcgtcggcgacgttttcctctaacgacggcgatgtgaacgacgaatactacaccgagggcattttcgtggggtaccgctacttcgacaccttcggcatcgagcccatttaccccttcggctatggtaaatcctacaccactttcgatataaggctcgacggagcggaattggtggacttgatcggcgtcaaggtaaatgtgacggtggtcaataccggcaacgtggccggcaaagaggtcgtacaggtctattattcggcaccggcaggaaagctccccaagccttaccaggaattgatagtctttgccaagaccgatgagcttgaacccggccaaagccaaaagcttgagctgttcttcgacgcccgcgacatggcgtcctattgcgaagagtgcgcttcttgggtgttggagccgggcgactatttcatccgtgtaggcgcccattcccgcgccacctatgtggccgccatcgtcacgttggatgagcgggtgaagacggcccagctcaagaacctgtttgccctcgatgagccgatggaagaaatcaagcgtccggcagccgttatcgaggccattcccgaagaagtgccccagctgttcctgaaagccgccgacatcccctgcgaaactgtgtcataccagggcgctcgcaccgagcttaccaccgaagctgccgacggtgtgactgttgccgatatcaaggcgggcaatgccggcgtcgacgatttggtggcgcagcttaccgtggaagaactggcaaattactgcgtcggtacgttgcgtgccgaaggcgggtccatcgtgggcaacgcttcctataccgtgcccggagccgcgggtgatacgtcttccatctgcaaagaaagccgcggcatcaagaatctggtgttggccgatggccccgccggcctgcgcttgcaaccggtgttcaagaccgacctggaaggcaacctgcttcccggcggctcggtgttaggcgattcttacgagcccttcgacccgtcgttggatgacaccaattccattacctattaccagtactgcaccgccattccgattggctgggccttggctcaggcttggaacccgacgttgctcgagcaggtgggctctatggtgggcgaggaaatggtgcagttcggtgtggacatttggctggcccctgccttgaacgtccatcgcaacccgctttgcggccgcaacttcgaatattattctgaagacccgctggtgggcggtctggcagcggcggctatcacgcgaggcgtccaaagccacgagggcaaaggcacctgcatcaagcatttcgccgctaacaaccaggagaataaccgctatttcacgaattcccacatcagcgagcgagctatgcgcgagatttactgcaagggcttcgaaatagccatcaagcagagccagccgctgaccatcatgaccagctacaaccttatcaacggcacgcacacggcgaattaccatgacttgttgcagggtgtggcgcgcgacgagtgtgggtttgccggcttcgtcatgaccgactggttcacgtcccaagacattccggcatttaccggtggctccaccaagtatcccatcagcgcttcgaccggttgcgtctatgccggcaacgacaatcagcagcccggctgcttgaagaacgtcaccgaccttatcgaggccgtggaaagcggggaagaaaaggacgggttcgctatcaccaaggctgacctacaattctgcgccgccaacgtgattcgtatagcggtggagtgcgacaccgaggtttaa

SEQ ID NO: 1122 - protein, 854 aa, Uncultured bacterium
MEKYFASTSNEVTATETAHGELSRSLAGECVVLLENNGVLPIPPDGRIALFGNGARNTVKGGTGSGDVNTRTNITIEQGLVEAGYTIVTTDWLDRNQKIYDEAKRYYIEEYIPKKAAEEDIPEFLATFNEPFLGVDPLEITDDDISDTHTDTAIYVISRNSGEGSDRRNVRGDYQLFEQERESIEVLAHSFSKLIVVLNVGGVIDMSELKAIHGIDAILLMSQLGNISGQVLADVLSGKVNPSGKLTDTWAKSYSDYPSSATFSSNDGDVNDEYYTEGIFVGYRYFDTFGIEPIYPFGYGKSYTTFDIRLDGAELVDLIGVKVNVTVVNTGNVAGKEVVQVYYSAPAGKLPKPYQELIVFAKTDELEPGQSQKLELFFDARDMASYCEECASWVLEPGDYFIRVGAHSRATYVAAIVTLDERVKTAQLKNLFALDEPMEEIKRPAAVIEAIPEEVPQLFLKAADIPCETVSYQGARTELTTEAADGVTVADIKAGNAGVDDLVAQLTVEELANYCVGTLRAEGGSIVGNASYTVPGAAGDTSSICKESRGIKNLVLADGPAGLRLQPVFKTDLEGNLLPGGSVLGDSYEPFDPSLDDTNSITYYQYCTAIPIGWALAQAWNPTLLEQVGSMVGEEMVQFGVDIWLAPALNVHRNPLCGRNFEYYSEDPLVGGLAAAAITRGVQSHEGKGTCIKHFAANNQENNRYFTNSHISERAMREIYCKGFEIAIKQSQPLTIMTSYNLINGTHTANYHDLLQGVARDECGFAGFVMTDWFTSQDIPAFTGGSTKYPISASTGCVYAGNDNQQPGCLKNVTDLIEAVESGEEKDGFAITKADLQFCAANVIRIAVECDTEV

SEQ ID NO: 1123 - DNA, 2583 bp, Uncultured bacterium
atgccgtcgatgggagcttccatgaatcagtatttcgcgaccacctccgatgcggtgaccgagcaggaaagggcccatgagcggcttgtccgccgtgctggcgctgattgcgtcgtgctgctggaaaacgacggcgcgctgccgtttgagccttcgggcccgcttgccctgttcggtgacggcgcccgccatacggtcaagggcggcaccggttcgggcgacgtgaacgcgcggacgacggtttcggtggagcaggggcttgaggcggccggtttcacgatcgcgtcgaagtcctggctcgaccgcaacgaggcgaatcgcgtcgagggcaaacgcgtctatatcgaggagttcgtgccgcgcgttgtgaaggagcagggcatccccgagtttctcgtcagcttttccgaccccttcaccgcgccggatcccattccgatcaccgaggaggatctggccgccgcaagctgcgaccgggcgatctatgtgctttcacgcaattccggcgaggggagcgaccgcagcgccacccgcggtgactatctgctctccgaggccgagcgcgcccatctcgagttgctcgcgaagacctaccggcagttcgtcgtcgtgctcaacatcggcggtgtcatggacctcaccgaactttcgtccatcgagggaataagcggcatcgtgctgatgggacagctcggcagcaccggcggcgcggcgatcgccgatgtgctttccggcgccgttaatccttcgggtaagctgaccgacacctgggcgcgggattacgacgattacccctcctcggcgacgttcagctcgaacgacggagacgtcaatgacgagtactatgccgagggcatcttcgtcggctatcgctatttcgacagcttcggcgtggagccgctctatccgttcggcttcggacgctcctacacgacgttttcgatggcggccgacggggcgaccctcggcggccggacggtgcgggtcaaggcgctcgtgacgaacaccggaagtcgcgccggcagggaagtcgtgcaactctacgcctcggcgcctcggggcagccttgcgaaggccgagcaggtgctcgtggcctcgatgaagacccccgaaatcgcccccggtgacaccgcgaccgtcgagctgacgttcgatatagcagcgatggcctcgttttgcaccaatcacagttcctggtgcctgcagcagggcgactacattctgcggctcggcgccgattcccgtcacaccgagccggcggcggtgctcgtgatggaggcgagcacgcggattcgggcgctgaagagccttttcaaggacgacgatccggttcgcgacatcacaccgccggaccgcgagccgtttgagcgtcccgcgggcgttccggtgcttccgatcgacgcctcggcgatcgaactggaaacggtcgtctacagcggaaagcgcgagcccttcgccaaaccggacacggacgtccagctcacggctgaagacgtgcgagcgggccgctgcagcgtcgaggatctcgtcgcttcattgaccctcgaggaactcgccgagctctgcgtcggcaccgcgcgttccgatgacggttcgatcgtcggcaacgcgtcgcttgacctgccgggggcggcgggggacacctcgtcggtcatcaaggcgacccgtggcgtgaagaacctcgtgatggccgacggcccggcgggactgcggctgcagccggtctttaagaccgacaaggagggaaatctgctgccgggcggcgagatgctcggcgacagctacacgccgttcgatccgtcgctcaccgacgagaactccatcacctactaccagtactgcacggcgattccgatcggttggtcgctcgcccaaagctgggatatgacgatgctcgaggaggtcggctcaatcgtcggcgaggagatggagaccttcggcgtcgacatctggcttgcgccggcgctcaacatccaccgcaatccgctctgcggccgcaacttcgagtactacagcgaggatccgctcgtgagcggccgttgcgccgcggcgatcaatcgcggcgttcagagtcacgagggcaaattcacctgcatcaagcacttcgtggccaacaaccaggagaacaaccgctatttcacgaactcccacgtcagcgaacaggcgttgcgcgagatctatctgcggggctttgagatcgcggttcgcgagagtcagcccggcacgatcatgacctcctataacctgctcaacggcatccacacggccaacagtcacgacttgctgcaagccgtggctcgagatgagtggggcttcaaaggtttcgtgatgaccgattggtacacctcccaggacgtcgcgagcttcacgggggcaagtgataagtacccgatctcggcatcgaccgggtgcgtgtacgccggcaacgacgtgcagatgccgggctgccagcaaaacgtcgacgacatcgtcgaggcggtgaaaagcggtcgtccgctcgacgggtttacgatcacgctcgccgacgtgcaacattgcgccgcaaacgtgattcgcatggcgcttcaggtgccgccacgctaa

SEQ ID NO: 1124 - protein, 860 aa, Uncultured bacterium
MPSMGASMNQYFATTSDAVTEQERAHERLVRRAGADCVVLLENDGALPFEPSGPLALFGDGARHTVKGGTGSGDVNARTTVSVEQGLEAAGFTIASKSWLDRNEANRVEGKRVYIEEFVPRVVKEQGIPEFLVSFSDPFTAPDPIPITEEDLAAASCDRAIYVLSRNSGEGSDRSATRGDYLLSEAERAHLELLAKTYRQFVVVLNIGGVMDLTELSSIEGISGIVLMGQLGSTGGAAIADVLSGAVNPSGKLTDTWARDYDDYPSSATFSSNDGDVNDEYYAEGIFVGYRYFDSFGVEPLYPFGFGRSYTTFSMAADGATLGGRTVRVKALVTNTGSRAGREVVQLYASAPRGSLAKAEQVLVASMKTPEIAPGDTATVELTFDIAAMASFCTNHSSWCLQQGDYILRLGADSRHTEPAAVLVMEASTRIRALKSLFKDDDPVRDITPPDREPFERPAGVPVLPIDASAIELETVVYSGKREPFAKPDTDVQLTAEDVRAGRCSVEDLVASLTLEELAELCVGTARSDDGSIVGNASLDLPGAAGDTSSVIKATRGVKNLVMADGPAGLRLQPVFKTDKEGNLLPGGEMLGDSYTPFDPSLTDENSITYYQYCTAIPIGWSLAQSWDMTMLEEVGSIVGEEMETFGVDIWLAPALNIHRNPLCGRNFEYYSEDPLVSGRCAAAINRGVQSHEGKFTCIKHFVANNQENNRYFTNSHVSEQALREIYLRGFEIAVRESQPGTIMTSYNLLNGIHTANSHDLLQAVARDEWGFKGFVMTDWYTSQDVASFTGASDKYPISASTGCVYAGNDVQMPGCQQNVDDIVEAVKSGRPLDGFTITLADVQHCAANVIRMALQVPPR

SEQ ID NO: 1125 - DNA, 2598 bp, Uncultured bacterium
atggacccacgagagtttgacccaagaaaggacgacgtgagtatgaccacctatctcgctcccaccaccgatgaggtcacccccgaggaactcgcccatgaacgtttggtgcgcagggccggcgcccagtgcgtcgtgctgttggaaaacgacggggcccttccctttgaaccctcaggtcagttggcgcttttcggcagtggcgcgagaaacaccgtgcgcggcggcaccggttccggggatgtgaacacgcgccattccacgtcggtggaggagggtttggccgcggccggattcgagattgtcacaacgggctggcttgacgctatggatgcggccatcgtcgaggccaaacgcgcctatagggaggatttcgttaagccggaggcgcaaaagcgcgggattcctgagtttctcgtcacctttgagaagccgtttcacccgatcgaccccattgacccgcggcctgaggacctggcgttggccgagaccgtgacccgctgcgtctatgtggtggcccgcaactccggcgaaggcgccgaccgcacggacacgcccggtgactatcggttctccgaggctgagctcacccagatcgaagctttggccaaggtcttcgaccagttcgtcgtcgtgctcaacatcggcggcgtgatggacctcacaccccttacgaccctggagggaatcagcgccgtcgtgctgatgggtcagttgggaagtgtgggcgggctggcgctggccgatgtgctcaccggcgccgagaatccttcgggcaaacttaccgacacctgggcccgggcctatggcgactatccctcatcggcgggattctcctccaacgacggggacgtggacgatgagtactataccgagggcattttcgtcggctaccgctactttgacacctttggcgtggagcccctctatccgttcggttttggccgttcctataccacctttgaggtgacgcccaccggatttgagtatgaggggacgactgcgcgggtgaaggccctcgtgaaaaacaccgggtcggtggcaggacgcgaagtgctgcaggtctatggcgcgacctgtcaggaccatcttcccaaagcgacccaggtgctcgtcggattccacaagaccgcgttgatcgcccccggtgagagtgaaaccgttgagattccctttgacgtgcgcgagatggcctcctattgtgccaaccactccaactgggccatgcttggcggtgactacgtgatctctgtgggaacttcctcccgggaccatactccctgtggcgtgctcacccttgaagggaacgtgccgtttaagcatatggcgaagctgtttgccgatgatgtgcccttaagtcagattgcgcctaagacgctgccggcggtggaacgacctgagaatgtgcctgtctatgccatcaatcctgaggcgttgatgatggcgccggcggtctatcagcagtcccgtaccgagatgaaggccccggtaactaaggcagttatcggcgctgatgacgtggtggctggtcgtgccaccctggaggacctggtggcccaactgtcggtggaggagttggcggaactttgcgtgggaaccctgaggtcagaagggggctccattgtcggtaacgcctctgccaaagtgccgggggcggctggtgacacctcgccggtgcttaaggagacccggggtgttaaaaacctgattatggccgatggaccggcgggtttgcgcctccaaccggtgtttaagaccgatctggagggcaatcttttgccgggtggtgacctgctgggcgacagctataccccctttgacccttctcttaccgatgagaactccattacccactaccaatattgcacggccattcccattggctggatgttggcccagagctgggatatgacccttttggaggaactcggtttcatggtgggcgaggagatggagacttttggggtggacatctggctggcgccggccctgaacatccaccgaaatccgctctgtgggcgtaactttgagtactacagcgaagatccgctggtgtcgggcaagtgtgctgcggccatcacccgtggcgtccaaagtcacccggggaagttcacctgcgtgaagcactacgccctgaacaaccaggagaacaaccgctacttcaccaattcccactgcggtgagcaggccatacgcgagatctatctccgggggtttgagattgccattcgggaaagccagccggggacgattatgacgtcctacaaccttttgaacgggattcatacggccaacagtcacgacctcattcaggccgtggcccgggacgaatggggctttgagggctttgtgatgaccgactggttcacctcccaggaacagccgggatttatgggcgtgtccgacaaatacccgatttcggcctcgacggggtgtgtctatgcgggtaatgacgtgcagatgcccgggtgccagaaaaacgtggacgacctggtggaggctgtgaagacggggaagaccattgacgggtttgagatctcggtggcggatttgcagttttgcgccgccaatgtgattcgggtggccctgcgccagtaa

SEQ ID NO: 1126 - protein, 865 aa, Uncultured bacterium
MDPREFDPRKDDVSMTTYLAPTTDEVTPEELAHERLVRRAGAQCVVLLENDGALPFEPSGQLALFGSGARNTVRGGTGSGDVNTRHSTSVEEGLAAAGFEIVTTGWLDAMDAAIVEAKRAYREDFVKPEAQKRGIPEFLVTFEKPFHPIDPIDPRPEDLALAETVTRCVYVVARNSGEGADRTDTPGDYRFSEAELTQIEALAKVFDQFVVVLNIGGVMDLTPLTTLEGISAVVLMGQLGSVGGLALADVLTGAENPSGKLTDTWARAYGDYPSSAGFSSNDGDVDDEYYTEGIFVGYRYFDTFGVEPLYPFGFGRSYTTFEVTPTGFEYEGTTARVKALVKNTGSVAGREVLQVYGATCQDHLPKATQVLVGFHKTALIAPGESETVEIPFDVREMASYCANHSNWAMLGGDYVISVGTSSRDHTPCGVLTLEGNVPFKHMAKLFADDVPLSQIAPKTLPAVERPENVPVYAINPEALMMAPAVYQQSRTEMKAPVTKAVIGADDVVAGRATLEDLVAQLSVEELAELCVGTLRSEGGSIVGNASAKVPGAAGDTSPVLKETRGVKNLIMADGPAGLRLQPVFKTDLEGNLLPGGDLLGDSYTPFDPSLTDENSITHYQYCTAIPIGWMLAQSWDMTLLEELGFMVGEEMETFGVDIWLAPALNIHRNPLCGRNFEYYSEDPLVSGKCAAAITRGVQSHPGKFTCVKHYALNNQENNRYFTNSHCGEQAIREIYLRGFEIAIRESQPGTIMTSYNLLNGIHTANSHDLIQAVARDEWGFEGFVMTDWFTSQEQPGFMGVSDKYPISASTGCVYAGNDVQMPGCQKNVDDLVEAVKTGKTIDGFEISVADLQFCAANVIRVALRQ

SEQ ID NO: 1127 - DNA, 2390 bp, Uncultured bacterium
gatcttcttcaggttagtccctcccaaaaccaaacacctccgttggcctgatacaacgccggatgcggaacatccaccccggctgtcagtatgtgttttttcaacagtataagtatatcatccggaaagaaaaatttcagcaccattgcagaggactggccggcttcggcggcgacatctgtttgacaatgccgtccgggggccataaaatagaataaggcggcactttttctgatttgccgatgctgcgggttcacggtaatcagatgttgctcttgatgctgcaccaatcatcataatcgttcaaggaggatctgtatatgaaaacatggaaagggtacatgagaggcatcaatatcggcggatggatctcacagtgtccgcgcgaacagtcccactacgacagtttcataggcgaagaggacataaaaacgatcgcttcatggggactcgaccatatccgcctgccgatcgactatgacgtagtgtccgatgacgaagggaaactcacagaaggcataaagtatgtcgacaactgcgtcgaatggtgcaggaacaacggtctgaacctgatactggacctgcacaaggcacccggttacgccttttacaacgaggacaacacgcttttcacagaatcgcgtgtacaggatgccttcgtaaacctctggaaggaattcgcggcaaggtacggcaaatacagcgatttcgtctcatttgagctgctcaacgaagtggtggatgcggaccccggcctttggaacgatctcatacgaagggccatcaccgagatccgcaggacagctcctgaaacaaagattgttgtgggcggcatccgctggaacagcgccagcaccctcgaactgctcgatccgccgtacgatgagaatataatcttcacattccatttctatgacccgttcctgttcactcaccagggggcaacgtgggtcaagcctcttaccgacgtatccattgaatatcccggcagcatggatgattaccggagaattgcaaaagaactcaatcaatatgattcgcagttctccgccgtcgccgaaatgggcagggactacctggtcaaaaggatggaacctgccataaaaacagcagaaaaacataatgtgccggtttactgcggtgaatacggagtcatcctgagcgcacctgccgaatgcgccgttgaatggtacagggatatgcactcgattttcgaagagtatggtatcggccgtgcagcgtggacatacaaatccatgagtttcggcgttatcaactggccggcggatttcccggagcaaattatcagatacctctgatgcagttgcatatatatgcatctcaattgcatgaggcgacttacatatgaaaacacaggaggatatcaggctatgataccaaaatacaaggatagatccctgtccgtcgaggaaagggtagacgaccttatcgcaaggatgaccccggaagaaaaagtaggccagatgatgcagatcagcttcatttccgtaagtaaggaagaagctgaagaatggatcacggaaaggtgcgccggttcattcctccatgccctcggtgatgacgcggtacgcctgcaggaaatcgccatgggcacacggctgggcatcccgctgcttttcgggattgatgccgtccgcggacatgccctgtacaacggggctacaattttcccgactcagctggcaatggcatgcagctggaatcctgaacttgtaaagaaagcaggaagcatcaccgcaaaagaggtggcggccgacggtctccactggacattctcccccatcctctgccttggaagggacctcaggtggggcaggataaatgagactttcggcgaagacccgtacctggcaggcgaactggctgcttcgatcatacagggataccagggcgattcgctgtctgatcccgacagtatactcgcgtgtgcgaaacattacatcgcatacggcgaggcgaccggcggcagggacgcttatgacgcccagatcagcatcaggaaggtcagggacgtcttccttccgccgttcaggaaagcggtcgaagctggatgtgcgacattcatgtcaagttaccagtccatcgacggtacgccggtgaccgcaaataaaaaggtcctgcgaaaactgcttaaggaagagctcggatttgacggcttcgtcgtaacagactggaacaatgtcggcagcctcatctgcaaccagcatgtggcgggcgacatggaaactgccgcaaggaaagccatcgaggccggaaatgacatgataatgaccaccaacgaattctatgaagccgctctcagcctcatcaggaacggagtcgtgcctggggaacttatcgatgaagctgtccgcaggatactcaggatc

SEQ ID NO: 1128 - protein, 332 aa, Uncultured bacterium
MKTWKGYMRGINIGGWISQCPREQSHYDSFIGEEDIKTIASWGLDHIRLPIDYDVVSDDEGKLTEGIKYVDNCVEWCRNNGLNLILDLHKAPGYAFYNEDNTLFTESRVQDAFVNLWKEFAARYGKYSDFVSFELLNEVVDADPGLWNDLIRRAITEIRRTAPETKIVVGGIRWNSASTLELLDPPYDENIIFTFHFYDPFLFTHQGATWVKPLTDVSIEYPGSMDDYRRIAKELNQYDSQFSAVAEMGRDYLVKRMEPAIKTAEKHNVPVYCGEYGVILSAPAECAVEWYRDMHSIFEEYGIGRAAWTYKSMSFGVINWPADFPEQIIRYL

SEQ ID NO: 1129 - protein, 352 aa, Uncultured bacterium
MHLNCMRRLTYENTGGYQAMIPKYKDRSLSVEERVDDLIARMTPEEKVGQMMQISFISVSKEEAEEWITERCAGSFLHALGDDAVRLQEIAMGTRLGIPLLFGIDAVRGHALYNGATIFPTQLAMACSWNPELVKKAGSITAKEVAADGLHWTFSPILCLGRDLRWGRINETFGEDPYLAGELAASIIQGYQGDSLSDPDSILACAKHYIAYGEATGGRDAYDAQISIRKVRDVFLPPFRKAVEAGCATFMSSYQSIDGTPVTANKKVLRKLLKEELGFDGFVVTDWNNVGSLICNQHVAGDMETAARKAIEAGNDMIMTTNEFYEAALSLIRNGVVPGELIDEAVRRILRI

SEQ ID NO: 1130 - DNA, 1839 bp, Phanerochaete chrysosporium
acgcgggggacctctcagagagcaacatgtctgcgtccgccgctcctccaaacaagctccctgcagactttctatggggcttcgcaactgcgagcttccagattgaaggcgcaactgacgtggacggacgtggcaagtccatttgggacgacttctcgaaaatacctggcaagacgctcgacggaaagaacggagatgtcgcgaccgactcttacaaccgctggcgagaagacgtcgacctgctcgtccagtacggcgtgaagagctaccgcttctccatctcctggtctcgtatcattcccctcggaggccggaacgacccagtaaacgaggccggaattaaattctactcggatctcattgatgcgctgctcgagcggggcatcgtgccctttgtgactctctaccactgggacctcccgcaggccctgcacgaccggtaccttggctggctgaacaaggacgagatcgtccaggactatgttcgctacgcgggggtctgcttcgagcgttttggcgatcgagtaaaacactggttgacgatgaacgagccgtggtgcatctctattctggggtacggccgcggggtgttcgcgcctggccggtcaagtgaccgcatgcgctcgccagagggtgattcctcgacagaaccttggatcgtcggccacagtgtgatcctggcccatgcgtacgcggtcaagctctaccgcgagcagttcaaggcgaacaggggcggccagatcggcatcaccctcaacggcgactgggccatgccgtacgacgacagtccgcaaaacattgaggctgctcagcacgcactggatgttgccatcggttggttcgcggaccccatttacctcggccaatacccggcgtatatgaaagagatgctgggcgacaggcttccggagtttaccccggaggaactcgctgtcgtcaaggggtcgtcggacttctatggcatgaacacgtacaccacgaacctctgcaaggctggtggtgaagacgagttccaagggaacgtcgaatacaccttcactcgccccgacggcacgcagctcggcactgctgcccactgctcctggctgcaggattacgcgccgggcttccgcgacttgctcaactacctgtacaaacgttaccgcaaacccatctacgtgaccgagaacgggttcgcggtgaaggatgagaactccaagccgctcgaggaagccctcaaggatgacgaccgcgtgcactactaccagggtgtgaccgactccctgcttgcggccgtgaaggaggacggcgttgatgtccggggctactttggctggagtcttctcgacaacttcgaatgggcggacgggtacatcacccgcttcggtgtcacctatgtcgactacgacacccaaaagcggtacccgaaggactcgggcaagttcctctcacagtggttcccagcgcacatcgcggagagccccaagcccgccgcggagacaaagaaggcggcaacgccgtcgccgctgaagccccacggggcgatctccaacggtgtcagcaagaagtcctcggcgacgaaggaacccaagagtgcttcgcgcaaaaaggggaggaaagccccattcgcccgcttcacagcgtacatatctgcattcctcggcctctaaggcggatcctgttggcgttcccctgcttcaccggactagaataatgtgtttcctcactcactcgcctttccccatcgtcactgtaaatattccccactggagggtctaccttcagttgtagttgtagttgtatccttttcgctatcgttgatacctctgctatccggatttttatcattacctacagact

SEQ ID NO: 1131 - protein, 540 aa, Phanerochaete chrysosporium
MSASAAPPNKLPADFLWGFATASFQIEGATDVDGRGKSIWDDFSKIPGKTLDGKNGDVATDSYNRWREDVDLLVQYGVKSYRFSISWSRIIPLGGRNDPVNEAGIKFYSDLIDALLERGIVPFVTLYHWDLPQALHDRYLGWLNKDEIVQDYVRYAGVCFERFGDRVKHWLTMNEPWCISILGYGRGVFAPGRSSDRMRSPEGDSSTEPWIVGHSVILAHAYAVKLYREQFKANRGGQIGITLNGDWAMPYDDSPQNIEAAQHALDVAIGWFADPIYLGQYPAYMKEMLGDRLPEFTPEELAVVKGSSDFYGMNTYTTNLCKAGGEDEFQGNVEYTFTRPDGTQLGTAAHCSWLQDYAPGFRDLLNYLYKRYRKPIYVTENGFAVKDENSKPLEEALKDDDRVHYYQGVTDSLLAAVKEDGVDVRGYFGWSLLDNFEWADGYITRFGVTYVDYDTQKRYPKDSGKFLSQWFPAHIAESPKPAAETKKAATPSPLKPHGAISNGVSKKSSATKEPKSASRKKGRKAPFARFTAYISAFLGL

SEQ ID NO: 1132 - DNA, 1490 bp, Phanerochaete chrysosporium
ggttctccctaggttctgtgcgtctacacaatgtctgccgcgaaactacccaagtcgttcgtctggggctatgccaccgcggcgtaccagatcgagggatcgccagacaaggacgggcgtgagccgtcgatctgggacaccttctgcaaggcccccggcaagatcgcggacggctcgagcggcgacgtcgcgaccgactcgtacaaccggtggcgcgaggacgtgcagctcctcaagtcctacggcgtcaaagcgtatcgcttctcgctctcgtggtcgcggatcatacccaagggcgggcgcagcgatcctgtgaacggggcggggatcaagcactaccgcacgctcatcgaggagcttgtgaaggagggcatcactccgttcgtgacactgtatcattgggaccttccccaagcactagatgatcggtatggcggctggctgaacaaagaggaagcaattcaggactttacgaactacgcgaaactttgcttcgaatccttcggggatcttgtgcagaactggatcaccttcaacgaaccctgggtcatttccgtgatgggctacggaaacggcatctttgctcctggccatgtcagtaatactgagccttggatagtgtcgcaccacattatacttgcccatgcacatgcggtgaagctctatagagacgaattcaaagagaaacaaggcggacaaattggtatcacgctcgatagccactggctcatcccctatgatgacaccgatgcaagcaaggaggcgacgctccgcgcaatggagtttaagctcggtcgctttgcaaatccgatatacaagggagagtatcctccacgtatcaagaagatcctcggtgaccgcctccccgagttcacccccgaggaaattgagcttgtgaagggctcctccgacttcttcggcctgaacacgtacacgacgcatctcgtccaggatgggggcagcgacgagctggcgggcttcgtcaagacagggcacacgcgggccgacgggacacagctgggaacgcagtctgacatgggttggttgcagacttacggcccggggttccgatggctgctgaactacctgtggaaggcatatgataaacctgtctacgtcacagagaacggattcccagtcaagggcgagaacgaccttcccgtggaacaagcggtcgacgacacggacaggcaggcgtattaccgtgactacacggaggcgctgctgcaagccgtaacggaagacggcgccgacgtgcgggggtatttcggatggagtcttctcgataacttcgagtgggcggagggctacaaggttcgctttggcgtcacacatgttgactatgagacgcagaagcggacaccgaagaagtctgccgagttcctgtcccggtggttcaaggagcacatcgaagagtagatttcctgcctttgctgtccctatgcgaaactacaaatacacctagatgttacgaatacacttttgccgtc

SEQ ID NO: 1133 - protein, 462 aa, Phanerochaete chrysosporium
MSAAKLPKSFVWGYATAAYQIEGSPDKDGREPSIWDTFCKAPGKIADGSSGDVATDSYNRWREDVQLLKSYGVKAYRFSLSWSRIIPKGGRSDPVNGAGIKHYRTLIEELVKEGITPFVTLYHWDLPQALDDRYGGWLNKEEAIQDFTNYAKLCFESFGDLVQNWITFNEPWVISVMGYGNGIFAPGHVSNTEPWIVSHHIILAHAHAVKLYRDEFKEKQGGQIGITLDSHWLIPYDDTDASKEATLRAMEFKLGRFANPIYKGEYPPRIKKILGDRLPEFTPEEIELVKGSSDFFGLNTYTTHLVQDGGSDELAGFVKTGHTRADGTQLGTQSDMGWLQTYGPGFRWLLNYLWKAYDKPVYVTENGFPVKGENDLPVEQAVDDTDRQAYYRDYTEALLQAVTEDGADVRGYFGWSLLDNFEWAEGYKVRFGVTHVDYETQKRTPKKSAEFLSRWFKEHIEE

SEQ ID NO: 1134 - DNA, 2306 bp, Piromyces sp. E2
atgaagactctttctattttcactactttattagctgtttctgctgctaagaaatgtgtcgttagaaatccaactgatagtgctaagactaatgatgttaaagctccagttactgacgacattccatctgacaatgaaactccagttaatgtcgacgaaaacactccattagataaggaagaagattctggtattgaaaactctgatattgaaaattcagaagacaaaccaaaaggtaaacttccagccgatttcaaatggggtgctgctactgctgcttaccaagttgaaggtgcttggaatgaaggtggtcgtggtgaatccgtatgggatcacttcactcacctctacccaaagaacgttgaatctggtgacagatcaaatccaaactctaccaatggtaatgtggcttgtgattcataccacaaacttggtgaagatattaaaatgatgaaaatcatgaaaggtaaccactaccgtttctccatgtcatggtctcgtctcttcccagacggtcaagccaagaaagtcaaaggaaaatggaatgttaacaaagaaggtgttgaatactacgatatggttattgataccctccttgaaaacaacattacaccaatggctactctttaccactgggacttccatacgctctccatgaaaagtatggtggttggtagattaccgttcacaagacgattcgccaagtacgccgaattctgtttcgaacactttggtgaccgtgtcaagaactggattaccacaaatgaaccatgggttaactgtgtttccggttaccgtcttggtccaggtaaggctccatacagatgtactggtgaagctccacgtaaacttgctaatgacaccgctggtctcgatttactaggaggttgttcctacgaaattggtccatcacaatacaccaagaatcacgaagcgcttacagccaaccgtccaccacaaagattagaagatgtctggtgttctcacaacattcttattgcccacgctaaggccgtcaatgtctaccgtaagaagttccaaaagaagcaaaagggtcttattggtattaccattgatggtgaagctcaaattccatggcaagatgacaagaccactccagaagaattagaaaacaacaagaagtatgccaacttagctgctgaattccgtattggttggtactctgacccaccaatgatcggtgattatccagaatcagtcaagcaaagaatgagtaaggatatgccagtcttcactgatgaagaaaaggcactcttaaagggatcctcatccgatttcttaggttggaacacttacactgctcactgggctgaacaagtcaagaacgaagatggtacctacgtccaaccgccaactgacgaagaagccaacttcgaaaactccaagagagatatgtgggatgataactgtagaggacgtggtgaaggatggacttgtattccaccaactcttggttcacaagccggttcatcctggaacaccaaatatggtccaactattcgtgttggtcttaactggtttgctgaccgtcacaagggtttaatcaagatcggtattgttattaccgaaaacggttgtgcccaaccaaactacaaggtcagtcgtgctaacgatgaagttaccaagaagtacttcgaatctatcggtcaaccagaatacgccgatgtttatgatgaatctattattgaagatgaaaagaacatcgaaggatccattctccacgatgaataccgtattgactggtacaagcaataccttgaaaaccttcgtcttgcttatgtcgaagataaggttgatgttcgtggttacatggcctggtctttagtcgataacttcgaatgggaaaatggttacgaaactcgtttcggtatgacttacattgacttctacaatgacaagaaccttactcgtgttccaaaagattctcttaccttccttggtcaatggtacttagaaaacgtagaacaagcttaagtgtcttcattcttaaataatattattaaatagtattgattattattcaataatacaaatattataaaaaaataattatcaaaagaacgtattacattataataataaataataccaaaaaaataataattactatcgatttaataatacaaaaaaaaattagaaaaataatagttaatatcaaaatgattaatcaaaattatattttatattaatatatatttttttttatgtatacataaaaaaaaaaaaaaaaaaaaaaaaaaaaaaaaaattaataaaatttaaaatttaaaaaaaaaaaaaaaaaa

SEQ ID NO: 1135 - protein, 664 aa, Piromyces sp. E2
MKTLSIFTTLLAVSAAKKCVVRNPTDSAKTNDVKAPVTDDIPSDNETPVNVDENTPLDKEEDSGIENSDIENSEDKPKGKLPADFKWGAATAAYQVEGAWNEGGRGESVWDHFTHLYPKNVESGDRSNPNSTNGNVACDSYHKLGEDIKMMKIMKGNHYRFSMSWSRLFPDGQAKKVKGKWNVNKEGVEYYDMVIDTLLENNITPMATLYHWDFHTLSMKSMVVGRLPFTRRFAKYAEFCFEHFGDRVKNWITTNEPWVNCVSGYRLGPGKAPYRCTGEAPRKLANDTAGLDLLGGCSYEIGPSQYTKNHEALTANRPPQRLEDVWCSHNILIAHAKAVNVYRKKFQKKQKGLIGITIDGEAQIPWQDDKTTPEELENNKKYANLAAEFRIGWYSDPPMIGDYPESVKQRMSKDMPVFTDEEKALLKGSSSDFLGWNTYTAHWAEQVKNEDGTYVQPPTDEEANFENSKRDMWDDNCRGRGEGWTCIPPTLGSQAGSSWNTKYGPTIRVGLNWFADRHKGLIKIGIVITENGCAQPNYKVSRANDEVTKKYFESIGQPEYADVYDESIIEDEKNIEGSILHDEYRIDWYKQYLENLRLAYVEDKVDVRGYMAWSLVDNFEWENGYETRFGMTYIDFYNDKNLTRVPKDSLTFLGQWYLENVEQA

SEQ ID NO: 1136 - DNA, 2068 bp, TALAROMYCES EMERSONII
acatgccgagtaaggcaatccgaatccgcgattatcatctcctgcctactggtcacgatggccagaccttccttggctgtgtttttgtgagcgccagttgcggtggtggaatactggcttgtgatggccgggctactgtaatataatatataagggttcgagtctgcgtctaactaaggtacctcctaagaaataatcaacatcgttcgttgcttgtaacctcttaagggaattcgcaaaaaaggctaagttcattattgttctcgaaaaggaaactctatcaaccacgtgtctgtcagaaagatgactacgaccgagactcctaccactacgactacatccactcttcctcccgacttcctctggggtttcgcaactgccaggtgagctttgcatcgattgatcccctgtattttgatatagaataaacaggatagcaagctgactccatgttgctcccttcatttctagctaccagatcgaaggggccttcgacgaggatggccgtctgccttcgatatgggacactttcagcaagacgcccggcaaggtcgaggacgggaccaatggcgatgtcgcctgcgactcgtaccaccgtaccggtgaggacattgagatattgaagaaatacggtgccaagatctatcgcttctcgttgtcctggttgtcctggtatgtctgcctcttcttattttgtctggtctgtttttttgtctgacagaacaatccaggccacgtatcatccctctcggcgggcgaaacgaccccatcaatgaaaagggcctgcagttctactccaagttccttgatgacttacacgccgcgggcatcgagcccttcgtcacgctcttccactgggatctgcccgacgagctgatgaagcggtacgggggcatgctcaacaaggaggagtttgtggccgactacgccaactatgcccgtgtcgtcttcaacgcgctcggctcgaaggtcaagcactggatcactttcaacgagccctggtgcagttccgtgctcggccacaacaccggcaagcacgcccccgggcggacgagcgatcggacgaaaagtcccgagggagacggcactcgcgaaccttggatcgtgggtcacaaccttctcgtggctcatggtaccgttgtggacatctatcggagagagttcaaagagaaacaaggcggggaaatcggaatcaccctcaacggtaggcctcgcgctcatcctggattcgacttatgtctaaccgcatctatctaggcgactgggccgaaccatgggatcccgaaaacccagcagacgtcgaagcctgcgaccgaaagatcgaattcgccatctcgtggttcgcggacccgatctaccacgggaaatacccggacagcatggtgaaacagttgggcgaccgtctgccgaagttcacgccggaagaaatcgccttcgtgcacggcagcaacgatttttacggcatgaaccactactgcgaaaactacatccgcaaccggaccggcgaaccagacccggaggacattgctggcaacctggacatcctgatggaggacaagaacggcaaccccatcggccccgagacccaatgcgagtggctgcggccgttcccgctggggttcaggaagctgctgaagtggcttgcagaccggtacaacaaccccaagatctacgtgaccgagaacgggacgagcgtcaagggcgagagcgacaagccgctcgaggaggtgctcaacgatgagttccgcgtgcagtactaccgggactatatcggcgcgatggtggatgctgttgcacaggatggggtcaacgtcaaggcttacatggcttggagtttgttagagtaagtcgagaaagaaactacatccttagacttacctttcttttttcctttttactagatggtatatgactgactgatttcgccagcaacttcgaatggtccgaaggctaccggtccagattcggagtgacctacgtcgactacaagaacgggcagaagaggattccgaagaagagtgctcttgtcatcggggagctgttcaacaagtatatcaggaaggagtag

SEQ ID NO: 1137 - protein, 489 aa, TALAROMYCES EMERSONII
MTTTETPTTTTTSTLPPDFLWGFATASYQIEGAFDEDGRLPSIWDTFSKTPGKVEDGTNGDVACDSYHRTGEDIEILKKYGAKIYRFSLSWPRIIPLGGRNDPINEKGLQFYSKFLDDLHAAGIEPFVTLFHWDLPDELMKRYGGMLNKEEFVADYANYARVVFNALGSKVKHWITFNEPWCSSVLGHNTGKHAPGRTSDRTKSPEGDGTREPWIVGHNLLVAHGTVVDIYRREFKEKQGGEIGITLNGDWAEPWDPENPADVEACDRKIEFAISWFADPIYHGKYPDSMVKQLGDRLPKFTPEEIAFVHGSNDFYGMNHYCENYIRNRTGEPDPEDIAGNLDILMEDKNGNPIGPETQCEWLRPFPLGFRKLLKWLADRYNNPKIYVTENGTSVKGESDKPLEEVLNDEFRVQYYRDYIGAMVDAVAQDGVNVKAYMAWSLLDNFEWSEGYRSRFGVTYVDYKNGQKRIPKKSALVIGELFNKYIRKE

SEQ ID NO: 1138 - DNA, 2812 bp, Aspergillus aculeatus
ccatggtacccggatcctcgcttcaacatctttctcaaattctcgagagcgcaagctgtgtggctggctagctcgttgcttcctctttcttcagctacctctacgccatcatgaagctcagttggcttgaggcggctgccttgacggctgcttcagtcgtcagcgctgatgaactggcgttctctcctcctttctacccctctccgtgggccaatggccagggagagtgggcggaagcctaccagcgtgcagtggccattgtatcccagatgactctggatgagaaggtcaacctgaccaccggaactggatgggagctggagaagtgcgtcggtcagactggtggtgtcccaagactgaacatcggtggcatgtgtcttcaggacagtcccttgggaattcgtgatagtgactacaattcggctttccctgctggtgtcaacgttgctgcgacatgggacaagaaccttgcttatctacgtggtcaggctatgggtcaagagttcagtgacaaaggaattgatgttcaattgggaccggccgcgggtcccctcggcaggagccctgatggaggtcgcaactgggaaggtttctctccagacccggctcttactggtgtgctctttgcggagacgattaagggtattcaagacgctggtgtcgtggcgacagccaagcattacattctcaatgagcaagagcatttccgccaggtcgcagaggctgcgggctacggattcaatatctccgacacgatcagctctaacgttgatgacaagaccattcatgaaatgtacctctggcccttcgcggatgccgttcgcgccggcgttggcgccatcatgtgttcctacaaccagatcaacaacagctacggttgccagaacagttacactctgaacaagcttctgaaggccgagctcggcttccagggctttgtgatgtctgactggggtgctcaccacagtggtgttggctctgctttggccggcttggatatgtcaatgcctggcgatatcaccttcgattctgccactagtttctggggtaccaacctgaccattgctgtgctcaacggtaccgtcccgcagtggcgcgttgacgacatggctgtccgtatcatggctgcctactacaaggttggccgcgaccgcctgtaccagccgcctaacttcagctcctggactcgcgatgaatacggcttcaagtatttctacccccaggaagggccctatgagaaggtcaatcactttgtcaatgtgcagcgcaaccacagcgaggttattcgcaagttgggagcagacagtactgttctactgaagaacaacaatgccctgccgctgaccggaaaggagcgcaaagttgcgatcctgggtgaagatgctggatccaactcgtacggtgccaatggctgctctgaccgtggctgtgacaacggtactcttgctatggcttggggtagcggcactgccgaattcccatatctcgtgacccctgagcaggctattcaagccgaggtgctcaagcataagggcagcgtctacgccatcacggacaactgggcgctgagccaggtggagaccctcgctaaacaagccagtgtctctcttgtatttgtcaactcggacgcgggagagggctatatctccgtggacggaaacgagggcgaccgcaacaacctcaccctctggaagaacggcgacaacctcatcaaggctgctgcaaacaactgcaacaacaccatcgttgtcatccactccgttggacctgttttggttgacgagtggtatgaccaccccaacgttactgccatcctctgggcgggcttgcctggccaggagtctggcaactccttggctgacgtgctctacggccgcgtcaacccgggcgccaaatctccattcacctggggcaagacgagggaggcgtacggggattaccttgtccgtgagctcaacaacggcaacggagctccccaagatgatttctcggaaggtgttttcattgactaccgcggattcgacaagcgcaatgagaccccgatctacgagttcggacatggtctgagctacaccactttcaactactctggccttcacatccaggttctcaacgcttcctccaacgctcaagtagccactgagactggcgccgctcccaccttcggacaagtcggcaatgcctctgactacgtgtaccctgagggattgaccagaatcagcaagttcatctatccctggcttaattccacagacctgaaggcctcatctggcgacccgtactatggagtcgacaccgcggagcacgtgcccgagggtgctactgatggctctccgcagcccgttctgcctgccggtggtggctctggtggtaacccgcgcctctacgatgagttgatccgtgtttcggtgacagtcaagaacactggtcgtgttgccggtgatgctgtgcctcaattgtatgtttcccttggtggacccaatgagcccaaggttgtgttgcgcaaattcgaccgcctcaccctcaagccctccgaggagacggtgtggacgactaccctgacccgccgcgatctgtctaactgggacgttgcggctcaggactgggtcatcacttcttacccgaagaaggtccatgttggtagctcttcgcgtcagctgccccttcacgcggcgctcccgaaggtgcaatgagcagctgaaggtgttgtgaaggaagggctttgggcctcagcttcagcttgcagctgaagatgatgtatacatttttcccaagtcgtagagactacgaatttaatgactatgatgctgtc

SEQ ID NO: 1139 - protein, 860 aa, Aspergillus aculeatus
MKLSWLEAAALTAASVVSADELAFSPPFYPSPWANGQGEWAEAYQRAVAIVSQMTLDEKVNLTTGTGWELEKCVGQTGGVPRLNIGGMCLQDSPLGIRDSDYNSAFPAGVNVAATWDKNLAYLRGQAMGQEFSDKGIDVQLGPAAGPLGRSPDGGRNWEGFSPDPALTGVLFAETIKGIQDAGVVATAKHYILNEQEHFRQVAEAAGYGFNISDTISSNVDDKTIHEMYLWPFADAVRAGVGAIMCSYNQINNSYGCQNSYTLNKLLKAELGFQGFVMSDWGAHHSGVGSALAGLDMSMPGDITFDSATSFWGTNLTIAVLNGTVPQWRVDDMAVRIMAAYYKVGRDRLYQPPNFSSWTRDEYGFKYFYPQEGPYEKVNHFVNVQRNHSEVIRKLGADSTVLLKNNNALPLTGKERKVAILGEDAGSNSYGANGCSDRGCDNGTLAMAWGSGTAEFPYLVTPEQAIQAEVLKHKGSVYAITDNWALSQVETLAKQASVSLVFVNSDAGEGYISVDGNEGDRNNLTLWKNGDNLIKAAANNCNNTIVVIHSVGPVLVDEWYDHPNVTAILWAGLPGQESGNSLADVLYGRVNPGAKSPFTWGKTREAYGDYLVRELNNGNGAPQDDFSEGVFIDYRGFDKRNETPIYEFGHGLSYTTFNYSGLHIQVLNASSNAQVATETGAAPTFGQVGNASDYVYPEGLTRISKFIYPWLNSTDLKASSGDPYYGVDTAEHVPEGATDGSPQPVLPAGGGSGGNPRLYDELIRVSVTVKNTGRVAGDAVPQLYVSLGGPNEPKVVLRKFDRLTLKPSEETVWTTTLTRRDLSNWDVAAQDWVITSYPKKVHVGSSSRQLPLHAALPKVQ

SEQ ID NO: 1140 - DNA, 2538 bp, Emericella nidulans
atgagcttccaaaaggtcgatcctgcgcagatagagagcgtgctctctaagctgactctggaagagaagatctccctgctggcggggaagaacttctgggaaacacaagactatccagaaaagggggtgccacctgtcaagacttcagatggtcccaacggggcgcgcggtgccacattcaagggaggagtaacagctgcctgtttcccagcgtcctctctcttagctgcgacgtgggatctcgacgcggcaaagcacattggagaagcattggctgacgagacgcgctcgaaaggcgcaagggttctattagcacccacagtctgcattcatcgccatcctctgggaggccgcaacttcgaatcgttcagtgaagatcctttccttgcaggaaagctcgcggcgcagtatattaaaggccttcagggcaacggcgtcgctgcaaccatcaagcactatgccgcgaacgagcaagagacctgccgattcacagtcaacgaacatatcacagaacgagcactccgagaaatctacctgaaaccattcgagatcgccatcaaagagtcgaacccgctggcagttatgaccgcctacaacattgtgaatggaacccacgctgactcgaacaattttctcttgcgagatgtgctcaggggagaatggggatggaagggtcttgttatgagtgattggggcggtaccaactccacggccgacgctctgaatgctggtcttgacctagaaatgcccggtcctacaaggtggcgcaaggtagacgaagtgcttgcagtcgtaaagtctggtgccgtgttggaggagactatcgacgagcgcgcgcgcaacgttctggagcttcttgctaagctgaattgtttcgaaaatcctactattccagaagagaaggccatcaatcgtcctgaacaccagaaattaatccgctccgtgggaagtcaaggcctcgtcctcctcaaaaacgagggcgatgttcttcctctgagaaaagagatattgaccaacaagaaggtagctcttctgggctttgcgcgagaagctctcattcacggcggtggcagtgcttcagtcaatgcacattatcgagtcactccagaagagggtctccgcgccgctttaggcgacactgttgagtttgaatatgccaagggtgcacacactttccgccagctgcccttaatgagcgacaacgttgttaacctagaaggccaacctggttggaccctagacttttttgcggacgaggagcccaacggcgagccaggctcatcgatctcgtccgagcaacccagctatataccgctctttgtcaaggaatcatggggaagtgtccgagccagcgcccatttcacacccacgcaaagcgggaaacactattttggcatgtctgggttgggccggtccaaactcttgatcgacggcgaggtcatctacgaacagaagctgaattgtccggactccatgggattcttactcggcggcgtggaagagccagaaatccagtattcattcgaagctggaaagacctatgcggtcgaagtggtttcggtgaaacccaccagcaagggcggtctcgctctgctggacggcttcattggtttccgtctcgggttcatgaccgaggaagagcacaatagagatttgctgtctgaagccgtcgatgtagccaaacgtagtgatatcgcaattgtcttcactggccatactccagattgggagacggaagggcaggaccagataagcttccacctaccgtccaacggttcccaggaccggctcgtggcagctgttggagccgccaaccctaacaccgttgtcgtgaactgcactggcgtagcggttgctatgccttggttggacaaggtcaaggcggttgttcaagcgtggttcccaggacaggaagccggcaatgcaattgctgacgtactcaccggcgctgtgaacccttctggacgtctacctgtgtccttccctcgggcgatcgaggatgcccctgcacacggtaacttccccggtgactacacagacgggaaggacaaccggcgccatctcgaagttacatacaaggaaggtgtcttcgtgggctaccggcactatgatctctctgaagccaaccgcgccaaggtcctgttcccgttcggctacggtctatcctacaccacttttacacatgcgaatcacaaagcaagtgctacgagcaggaacaccgtcgaagtggccgtggatgtcactaacgtcggcacctgtgctggagctgatgttgttcaagtctacgctggtgcaaaactggcagtcccagagaacccagtcaaagagctagttggtttcgccaaggtacacctcaagccgggggagaccaagactgccaatatcacattcgaagtgcgccaactgactcacttcacggagaggagcggcaagtgggagctggaatcaggcgactatgaaatatcaatcggtcagtccgtgagggatatcactggcaaggtggagattggtctggaagcccagaattataaaccttga

SEQ ID NO: 1141 - protein, 845 aa, Emericella nidulans
MSFQKVDPAQIESVLSKLTLEEKISLLAGKNFWETQDYPEKGVPPVKTSDGPNGARGATFKGGVTAACFPASSLLAATWDLDAAKHIGEALADETRSKGARVLLAPTVCIHRHPLGGRNFESFSEDPFLAGKLAAQYIKGLQGNGVAATIKHYAANEQETCRFTVNEHITERALREIYLKPFEIAIKESNPLAVMTAYNIVNGTHADSNNFLLRDVLRGEWGWKGLVMSDWGGTNSTADALNAGLDLEMPGPTRWRKVDEVLAVVKSGAVLEETIDERARNVLELLAKLNCFENPTIPEEKAINRPEHQKLIRSVGSQGLVLLKNEGDVLPLRKEILTNKKVALLGFAREALIHGGGSASVNAHYRVTPEEGLRAALGDTVEFEYAKGAHTFRQLPLMSDNVVNLEGQPGWTLDFFADEEPNGEPGSSISSEQPSYIPLFVKESWGSVRASAHFTPTQSGKHYFGMSGLGRSKLLIDGEVIYEQKLNCPDSMGFLLGGVEEPEIQYSFEAGKTYAVEVVSVKPTSKGGLALLDGFIGFRLGFMTEEEHNRDLLSEAVDVAKRSDIAIVFTGHTPDWETEGQDQISFHLPSNGSQDRLVAAVGAANPNTVVVNCTGVAVAMPWLDKVKAVVQAWFPGQEAGNAIADVLTGAVNPSGRLPVSFPRAIEDAPAHGNFPGDYTDGKDNRRHLEVTYKEGVFVGYRHYDLSEANRAKVLFPFGYGLSYTTFTHANHKASATSRNTVEVAVDVTNVGTCAGADVVQVYAGAKLAVPENPVKELVGFAKVHLKPGETKTANITFEVRQLTHFTERSGKWELESGDYEISIGQSVRDITGKVEIGLEAQNYKP

SEQ ID NO: 1142 - DNA, 2771 bp, Aspergillus oryzae
ctgttctgctggttacctgccacgttatcatgaagcttggttggatcgaggtggccgcattggcggctgcctcagtagtcagtgccaaggatgatctcgcgtactcccctcctttctacccttccccatgggcagatggtcagggtgaatgggcggaagtatacaaacgcgctgtagacatagtttcccagatgacgttgacagagaaagtcaacttaacgactggaacaggatggcaactagagaggtgtgttggacaaactggcagtgttcccagactcaacatccccagcttgtgtttgcaggatagtcctcttggtattcgtttctcggactacaattcagctttccctgcgggtgttaatgtcgctgccacctgggacaagacgctcgcctaccttcgtggtcaggcaatgggtgaggagttcagtgataagggtattgacgttcagctgggtcctgctgctggccctctcggtgctcatccggatggcggtagaaactgggaaggtttctcaccagatccagccctcaccggtgtactttttgcggagacgattaagggtattcaagatgctggtgtcattgcgacagctaagcattatatcatgaacgaacaagagcatttccgccaacaacccgaggctgcgggttacggattcaacgtaagcgacagtttgagttccaacgttgatgacaagactatgcatgaattgtacctctggcccttcgcggatgcagtacgcgctggagtcggtgctgtcatgtgctcttacaaccaaatcaacaacagctacggttgcgagaatagcgaaactctgaacaagcttttgaaggcggagcttggtttccaaggcttcgtcatgagtgattggaccgctcatcacagcggcgtaggcgctgctttagcaggtctggatatgtcgatgcccggtgatgttaccttcgatagtggtacgtctttctggggtgcaaacttgacggtcggtgtccttaacggtacaatcccccaatggcgtgttgatgacatggctgtccgtatcatggccgcttattacaaggttggccgcgacaccaaatacacccctcccaacttcagctcgtggaccagggacgaatatggtttcgcgcataaccatgtttcggaaggtgcttacgagagggtcaacgaattcgtggacgtgcaacgcgatcatgccgacctaatccgtcgcatcggcgcgcagagcactgttctgctgaagaacaagggtgccttgcccttgagccgcaaggaaaagctggtcgcccttctgggagaggatgcgggttccaactcgtggggcgctaacggctgtgatgaccgtggttgcgataacggtacccttgccatggcctggggtagcggtactgcgaatttcccatacctcgtgacaccagagcaggcgattcagaacgaagttcttcagggccgtggtaatgtcttcgccgtgaccgacagttgggcgctcgacaagatcgctgcggctgcccgccaggccagcgtatctctcgtgttcgtcaactccgactcaggagaaagctatcttagtgtggatggaaatgagggcgatcgtaacaacatcactctgtggaagaacggcgacaatgtggtcaagaccgcagcgaataactgtaacaacaccgtggtcatcatccactccgtcggaccagttttgatcgatgaatggtatgaccaccccaatgtcactggtattctctgggctggtctgccaggccaggagtctggtaactccatcgccgatgtgctgtacggtcgtgtcaaccctggcgccaagtctcctttcacttggggcaagacccgggagtcgtatggttctcccttggtcaaggatgccaacaatggcaacggagcgccccagtctgatttcacccagggtgttttcatcgattaccgccatttcgataagttcaatgagacccctatctacgagtttggctacggcttgagctacaccaccttcgagctctccgacctccatgttcagcccctgaacgcgtcccgatacactcccaccagtggcatgactgaagctgcaaagaactttggtgaaattggcgatgcgtcggagtacgtgtatccggaggggctggaaaggatccatgagtttatctatccctggatcaactctaccgacctgaaggcatcgtctgacgattctaactacggctgggaagactccaagtatattcccgaaggcgccacggatgggtctgcccagccccgtttgcccgctagtggtggtgccggaggaaaccccggtctgtacgaggatcttttccgcgtctctgtgaaggtcaagaacacgggcaatgtcgccggtgatgaagttcctcagctgtacgtttccctaggcggcccgaatgagcccaaggtggtactgcgcaagtttgagcgtattcacttggccccttcgcaggaggccgtgtggacaacgacccttacccgtcgtgaccttgcaaactgggacgtttcggctcaggactggaccgtcactccttaccccaagacgatctacgttggaaactcctcacggaaactgccgctccaggcctcgctgcctaaggcccagtaaggggcaagtcctgattgtacagagcatttcgagatttatgatgtacatgtttatgaatgacctagggtagggtaatacttagtagggttagttctaattcttggagtcaagtattgactcactgggccgataaaaaaaaaaaaaaaaaaaaaaaaa

SEQ ID NO: 1143 - protein, 861 aa, Aspergillus oryzae
MKLGWIEVAALAAASVVSAKDDLAYSPPFYPSPWADGQGEWAEVYKRAVDIVSQMTLTEKVNLTTGTGWQLERCVGQTGSVPRLNIPSLCLQDSPLGIRFSDYNSAFPAGVNVAATWDKTLAYLRGQAMGEEFSDKGIDVQLGPAAGPLGAHPDGGRNWEGFSPDPALTGVLFAETIKGIQDAGVIATAKHYIMNEQEHFRQQPEAAGYGFNVSDSLSSNVDDKTMHELYLWPFADAVRAGVGAVMCSYNQINNSYGCENSETLNKLLKAELGFQGFVMSDWTAHHSGVGAALAGLDMSMPGDVTFDSGTSFWGANLTVGVLNGTIPQWRVDDMAVRIMAAYYKVGRDTKYTPPNFSSWTRDEYGFAHNHVSEGAYERVNEFVDVQRDHADLIRRIGAQSTVLLKNKGALPLSRKEKLVALLGEDAGSNSWGANGCDDRGCDNGTLAMAWGSGTANFPYLVTPEQAIQNEVLQGRGNVFAVTDSWALDKIAAAARQASVSLVFVNSDSGESYLSVDGNEGDRNNITLWKNGDNVVKTAANNCNNTVVIIHSVGPVLIDEWYDHPNVTGILWAGLPGQESGNSIADVLYGRVNPGAKSPFTWGKTRESYGSPLVKDANNGNGAPQSDFTQGVFIDYRHFDKFNETPIYEFGYGLSYTTFELSDLHVQPLNASRYTPTSGMTEAAKNFGEIGDASEYVYPEGLERIHEFIYPWINSTDLKASSDDSNYGWEDSKYIPEGATDGSAQPRLPASGGAGGNPGLYEDLFRVSVKVKNTGNVAGDEVPQLYVSLGGPNEPKVVLRKFERIHLAPSQEAVWTTTLTRRDLANWDVSAQDWTVTPYPKTIYVGNSSRKLPLQASLPKAQ

SEQ ID NO: 1144 - DNA, 3565 bp, Botryotinia fuckeliana
aaaccttataataaattcggatattcaatctctcaaaaattctatcaataaataagaaagtgcacggtacatacagacgaatttgtatataaatgagtgattcatcaggtgatacgacccactcggtgataaaccacgttatacgaaatacgattacgaacagtaattcgtcatttgacttcattctttcattctttccattcagattacgatgcagaactgaataggagaatgacaagacaacatagcctccaacagcacaccggtcgtaattactcatgataaatatgtatataatgtatgaagagctgaagacagagttcttcttttctctcatgttagattttctggagtatatcaagatgagacttttaccttctttatttgcggttttgtgtttttggggtgagggaagtgaggttgcagctatttcgggtgatacttttacctgtgagctgttttattttcgtttcttgtcgtgagggagtatgggggtgtgaggttttagagtcacaagaagatactccttttatccagttagttcaactcggatatggagaaatattatgggggtcaattcagcaattgagaagtcaatctttgaacaattgaattctgaacaaatagggaagactttgtatctctcccaagcttcccaagcctccttgtttgatactctttactcaatactttatctccctctctccctattcacttccacttcgcttcccctataccatgtccctcacacttctaacacgtgccagcacctctttccaaaactggactcacgcccaccacctcgctctcaccttcgtcaaccaattgaacatcaccgaaaagtcaaacatagtaacaggcacctaccacacctctactctcgacgggaaacccatgaattgtatcggcaacattggccccataccgcgtctcaatttcacaggaatttgtttgaacgatggacccgcgctgttgctcgtcagggatctaatcagtgttttcccttctggtgtcactttagctgcaacatgggatcgtgagttggtataccagagttacaaggcgctgggggaggaattcagagggaagggtacgcatgttgctttggggtatgtttattcctccaatccactttaactgtattattgtttggaaaatcaacactaaaaaaccccaagaccagtagcaggacccctcggtcgtcatcccctcggaggtcgcaattgggaaggattttcccctgatccctatctcaccggccatctaatgactgcttccataaccggcatgcaaagtgtcggtgttcaaacctcctcgaaacatttcatcggcaacgaacaagaaacccaacgatccaactccccacttccagacgggacaaacatcgatgctatttcttccaacatcgacgatcgaacgcttcatgaattatacctctggccctttgcagatgcagtacgtgctgggacgacttcaatattgtgtagctataaccgcattaatgaaacatacgcgtgcgaaaatccgcatctactcaacaatattcttaaaggcgaattgggattccaaggctacgtcgtctcggattggttcgccacacactccggatatccagccgcaaacgccggtctcgatatggatatgcccggctacatttcccaaagcgccatcaacaccggcgaaacgtatttcggtcctcatctcatctctgccatacaagcgggtaacatgacggaagacagattagacgatatggttacccgaatcatgacatcttatttcctcctcaatcaatccagcaattatcccactcccgatccgagccaaacgtacgtaatggcaaatatgtacggctatgattacggcgctcagattcccgcccgcgacgtccgcgctaaccactcctctctcatccgacaaatcggctctgcaggaaccgtcctcttgaaaaatacaaacaacatcctcccactatccaaacctctaaacataggcgtctttggcaattccgctcccgaccccaccgacggtcttacctggccgcaatcagacctccaaaccggcttcgacatcggcaccctcgatatcggcggtggttccggctccgctcgtcacactacccttatctccccccttaccgctctccgtacccgcgccgctacatacgcacgcgtccaatatctcaccaacaacgcactcctctcctcctcctcctcctcctccttcgctggtatctaccccatccccgaaatctgtctcgtgttcctcaaaaccttctcctccgaaggtgtagaccgcacttcctatcctctcgactggaactccaccctcgtcgtaaacaacgtcgcatctttctgccaaggcaatacaatcgtcattacccattcatccggaatcaacactctccccttcgctcaaaaccccaacgtctccgccatcctcctcgcacactaccccggccaagaatccggaaactccatagttgacgtcctcttcggcgtcgtcaacccctccggaaaactcccctacacaatccccgtccacgaatccgacatgcacatccccgttgtgaatctcagcacctcagaagtgctagcccaccaccagagccaaaacgcctggcaaagcaatttcaccgaaaaattagcaatcgattaccgcggcttcgaaatgaaaaatgtaacacccctctacgaattcggacacggattaagttacacgacatttaatctcaccacgccaaccccctccatcaaacacgtcacaacccaacccatcaccgcacgacccaaccccttatcccccatcctcccaggcggaaacgcagatctatatacccctctcttcactctcacaacgcgcgtcaaaaacacagggacgcgaaccggcgccacaattctccaactctacatatctctcccggaaacaagcacacccgaaggaacaccgaagaaagttctgcgcggctttgaaaaggtggagatgaggggaggggaggagcgagatgtggaattcgtgctgcagagacgagatgtgagttattgggacacggtattgggggattgggttgtgcccgagggggacataggggttatggtgggttttagcgtgcaggatttgagagcgagggtgggggttgtggttagataggatggagagaagaaatgtggggggaattggggggcgggggcttgacggagagaatggagaaatgaatgagggagggattgatgtgtaattggatgtaaattttctcctgtagatcgtaaatcataggacatgtattttgagattgcattcaatgtatcctaaaaactcacctattgttaaaatccgtaatgatctcaaacatacatcttccctcataacttcaacgctcataatcaacccactcactgttatcctgttaatacaatttcacaatccaaacacccagtcccaatattctcactttacaagcccccatccagcccatagataataaaaagataaaaatatctcccaaaacgccaaagtacacgcataaatccagagaaatccatcaacaaatatagtaagaggtacc

SEQ ID NO: 1145 - protein, 780 aa, Botryotinia fuckeliana
MSLTLLTRASTSFQNWTHAHHLALTFVNQLNITEKSNIVTGTYHTSTLDGKPMNCIGNIGPIPRLNFTGICLNDGPALLLVRDLISVFPSGVTLAATWDRELVYQSYKALGEEFRGKGTHVALGPVAGPLGRHPLGGRNWEGFSPDPYLTGHLMTASITGMQSVGVQTSSKHFIGNEQETQRSNSPLPDGTNIDAISSNIDDRTLHELYLWPFADAVRAGTTSILCSYNRINETYACENPHLLNNILKGELGFQGYVVSDWFATHSGYPAANAGLDMDMPGYISQSAINTGETYFGPHLISAIQAGNMTEDRLDDMVTRIMTSYFLLNQSSNYPTPDPSQTYVMANMYGYDYGAQIPARDVRANHSSLIRQIGSAGTVLLKNTNNILPLSKPLNIGVFGNSAPDPTDGLTWPQSDLQTGFDIGTLDIGGGSGSARHTTLISPLTALRTRAATYARVQYLTNNALLSSSSSSSFAGIYPIPEICLVFLKTFSSEGVDRTSYPLDWNSTLVVNNVASFCQGNTIVITHSSGINTLPFAQNPNVSAILLAHYPGQESGNSIVDVLFGVVNPSGKLPYTIPVHESDMHIPVVNLSTSEVLAHHQSQNAWQSNFTEKLAIDYRGFEMKNVTPLYEFGHGLSYTTFNLTTPTPSIKHVTTQPITARPNPLSPILPGGNADLYTPLFTLTTRVKNTGTRTGATILQLYISLPETSTPEGTPKKVLRGFEKVEMRGGEERDVEFVLQRRDVSYWDTVLGDWVVPEGDIGVMVGFSVQDLRARVGVVVR

SEQ ID NO: 1146 - DNA, 2591 bp, Dictyostelium discoideum
cgctttataaaatatttatttttaaatatttaattaaattcaattttatattatatatataaaaagatgaaaactattaaaagtttatttttactgtcattgttgatagtgaatttattaataagttcaacatatggaagttcaattagagtaagcattgttggaggtgaagaagctgaagtcattgaaaaaccacgtacttttggaaataaaagagaactcaaattagagtatagtcaaatttatccaaagaaacaattaaatcaagaaaatattaatttcatgtctgccagagatacttttgttgataatttaatgtcaaaaatgtcaatcactgaaaaaattggtcaaatgactcaattggatattacaacattaacatcaccaaatacaattacaattaatgaaacaacattagcatattatgctaaaacttattatattggatcatatttaaattcaccagtatcaggtggtttagcaggtgatattcatcatattaatagtagtgtttggttagatatgattaatactattcaaaccattgttatcgaaggtagtccaaataagattccaatgatttatggtttagattcagtacatggtgcaaattatgttcacaaagcaactttattcccacataatactggtttagccgctactttcaatattgaacatgctactactgctgcacaaattacttcaaaagatactgttgccgttggtatcccttgggtgtttgcaccagttttaggtattggtgttcaaccattatggtctcgtatctatgaaacttttggtgaagatccatacgttgcatcaatgatgggtgctgctgccgttcgtggtttccaaggtggtaacaattcattcgatggtccaatcaatgccccatctgcagtttgtactgctaaacattattttggttattccaacccaacctctggtaaggatagaactgccgcttggattccagagagaatgttaagacgttacttcttaccaagtttcgctgaagctatcactggtgctggtgcaggtacaattatgattaactctggtgaagtaaatggtgtaccaatgcacaccagctacaaatatctaactgaagtactcagaggtgaattacaatttgaaggtgttgcagtaactgattggcaagatattgaaaaactcgtttacttccatcataccgctggtagtgccgaagaggccatcttgcaagctttagatgctggtatcatatgtctatgtcatgatcttctttcccaattattctcgcttgaaatccttgctgctggtaccgttccagaatcacgtcttgatctttcagttagaagaatcttaaatcttaaatatgctctcggtcttttctctaatccatacccaaatccaaatgctgccatcgttgacaccattggtcaagttcaagatagagaagctgccgctgccactgctgaagaatcaatcactctcttacttttcaagaataatattcttccactcaataccaataccataaagaatgtacttttaactggtccatccgctgacagtattagaaatttaaatggtggttggtcagttcattggcaaggtgcttatgaagattctgaattcccattcggtacttcaattcttactggtcttcgtgaaattacaaatgataccgccgattttaacattcaatataccattggtcatgaaattggtgtaccaaccaatcaaacctcaatcgatgaagccgttgaattggctcaatcatcagatgttgttgtcgttgtaattggtgaacttccagaagctgaaactccaggtgatatttatgatctctctatggatccaaatgaagtactcttattacaacaattggttgacactggtaaaccagtagttttaattttggttgaagctcgtccaagaattttaccaccagatctcgtctacagttgtgctgcagttttaatggcttatctcccaggtagtgaaggtggtaaaccaatcgccaacattctcatgggtaatgtaaatccatctggtcgtcttcctttaacttatccaggtactactggagatatcggtgttccatattaccacaaatacagtgaaaatggtgtcaccactccactcttccaatttggtgatggtctttcttataccacttttaactataccaatctcgcctgtagcaattgtaaaccaatctctggtcaatctggtaactacactggtttaggtcaatcctatactttcactgtcactgtcactgtcacaaacaatggtaacgttcaaggtaaagactctgttctcttatatctctctgatctttgggctcaagttactccagaagttaaaatgttaagaggtttccaaaaagttgatcttatgccagctaaatctcaacaaatctcttttaccctcaatgcctatgaattctcctttattggtgtcgataataaaattactttagaatctggtccattcatcattatggttggtaatcaacaattaggtttatatttacaataaaaaaaaaaattaaaaaaattaaattaaattaaatagttaaaaataaatattttataaagatt

SEQ ID NO: 1147 - protein, 820 aa, Dictyostelium discoideum
MKTIKSLFLLSLLIVNLLISSTYGSSIRVSIVGGEEAEVIEKPRTFGNKRELKLEYSQIYPKKQLNQENINFMSARDTFVDNLMSKMSITEKIGQMTQLDITTLTSPNTITINETTLAYYAKTYYIGSYLNSPVSGGLAGDIHHINSSVWLDMINTIQTIVIEGSPNKIPMIYGLDSVHGANYVHKATLFPHNTGLAATFNIEHATTAAQITSKDTVAVGIPWVFAPVLGIGVQPLWSRIYETFGEDPYVASMMGAAAVRGFQGGNNSFDGPINAPSAVCTAKHYFGYSNPTSGKDRTAAWIPERMLRRYFLPSFAEAITGAGAGTIMINSGEVNGVPMHTSYKYLTEVLRGELQFEGVAVTDWQDIEKLVYFHHTAGSAEEAILQALDAGIICLCHDLLSQLFSLEILAAGTVPESRLDLSVRRILNLKYALGLFSNPYPNPNAAIVDTIGQVQDREAAAATAEESITLLLFKNNILPLNTNTIKNVLLTGPSADSIRNLNGGWSVHWQGAYEDSEFPFGTSILTGLREITNDTADFNIQYTIGHEIGVPTNQTSIDEAVELAQSSDVVVVVIGELPEAETPGDIYDLSMDPNEVLLLQQLVDTGKPVVLILVEARPRILPPDLVYSCAAVLMAYLPGSEGGKPIANILMGNVNPSGRLPLTYPGTTGDIGVPYYHKYSENGVTTPLFQFGDGLSYTTFNYTNLACSNCKPISGQSGNYTGLGQSYTFTVTVTVTNNGNVQGKDSVLLYLSDLWAQVTPEVKMLRGFQKVDLMPAKSQQISFTLNAYEFSFIGVDNKITLESGPFIIMVGNQQLGLYLQ

SEQ ID NO: 1148 - DNA, 3602 bp, COCCIDIOIDES POSADASII
ggatccctagtgtgtctggctgccacatccacttcttttgaccatgtcctgacgaacttatggctcacagcaaggacccagtgcggagttacatcgccccgtgactattaaagcatccccacagatcatcgtcccccggcataacagagaactgtaggtcaagtcaggccgtggacgtgggagagaaccccctatgacaggcgtcgtaccattccgtttaagggctatgaatactgatggatatggccaattttcaacgtccatttatggactttaaggacgtggtcatggggtagaatcgactccacaccttttctccctacaccctatctaccccataccctgttgaaagcaactgtagtacatatcccttgatcaaaatccccctaatggtttaaccaaagatcgacaacatgtgtataatcacatgtgattccatcagcgtttcggcccgttccctaatacccccaggttccggagatgcgcatacatatgtatgtatgccctcgttgcacccgttccccgtaaaagacggctttctcattctaccattgtcatggagtaacacagctccaggcactccagcgtacgttgagataacctgaatctcaacctttataccccttattaatgtttaatatctgcgttgcattaaaatcatgtcgcccacaatttggattgcgacactcctttattggttcgccttccaagcccgcaaatcagtcgcagcgccgccaggcgtaggggctctcgacgaccgagccgagcttccggatggcttccattctcctcagtactatcccgctccaagggggctgggtgccggaatggaagaggcttattccaaagcccataccgtcgtttccaagatgaccttggccggaaaggtgaatctcaccactggaacgggattcttgatggccctcgtgggccagactggaagcgcccttagatttggaattccaagactctgtctgcaggacggcccgctgggacttcgaaatacagatcacaacactgctttcccggcaggcatttcggtgggagctacatttgacaagaagcttatgtatgagcgaggctgtgctatgggggaggaatttcgtggaaagggcgcaaatgttcatctaggacccagcgttggaccgcttggccgtaaaccccgtggtggacgaaactgggaagggtttgggtcggatccctcactccaagctatcgctgccgtcgagacaatcaaaggtgtccagagcaagggtgtcatcgccacgatcaagcatctagtaggaaacgagcaagagatgtatagaatgactaacattgtacaacgagcgtactctgcgaacatagatgaccgaacgatgcacgaactttacctgtggccttttgctgaatctgttagagcgggagtgggagctgtcatgatggcttacaacgatgtaagtctccttctcgcatcccgaaacttgaacatttccaccaattcctctaaccaaagctaggtaaacgggtcggctagctgtcaaaatagcaagcttatcaacggcatcttaaaggatgaactcggcttccagggttttgttatgaccgactggtatgctcagattggaggtgtctcttccgccctggccggtttggacatgagcatgcctggagatggttctgtacccttatcaggcactagcttttgggcatcggaactttcgcgttctattctgaatgggacagtagctctggatcgtcttaatgatatggtaaagtctcatattttcggttatttatactcacagatgtgctgaacttgctttctaggtgacaaggatagttgcaacctggttcaaatttgggcaagacaaagattttcctctgccaaacttctcctcctacacgcaaaatgctaaagggctgctctaccctggagcactattttctcccctcggagttgtgaaccagttcgttaacgttcaggctgaccaccacaaattggctcgagtcattgctcgggagtccattactttgttgaagaatgaggacaatctgctgccgctcgacccgaatcgcgccataaagtattcggaacagatgcccggcaccaaccccaggggtattaatgcctgtcccgataaaggttgcaacaaaggcgtattaacgatgggatgggggagtggaacttctaacttgccttacctggtcacgcctgaggatgcaatcagaaacatctccaagaacacagagttccacattacggacaaatttcctaacaatgtccaacccggaccggatgatgttgccattgtctttgtgaacgcagactcaggcgaaaattatatcattgttgaaagtaacccaggagaccgaacagtagcacagatgaaactctggcataacggagacgaacttatcgaatctgcagcgaagaaattctcaaacgtggttgtcgtcgtcgttcataccgtcggcccaattatcatggagaagtggattgaccttcttcggtcaagagtgtcctgtttgcccgacttccaggacaagaagctggaaattctgttgctgatatcttgttcggagacttcagtccgagtggccgcctccatatacgataccgaaagcagaatcggattatccgatagcgtgtctcttatcaaccaacgtttcggccaaatccaggacactttcacagaagggctgttcatcgactatcggcatttccaaaaagaaaacattactcctcgatatcattttggttatggtctttcgtacacaacatttaatttcacagagccgcgtctggagagcgttactacacttagcgagtatcctcccgcccgcaaaccgaaggcaggagaccgacatactccaacgatatcccacctgcttcagaagtggcctggcccaaaaactttgacaggatctggcgcctatctctacccgtatctcgacaacccgtcggctatcaagccaaagccaggatacccatatcccgaagctatacaaccaaacctcaacctgaatcctcgcgctggtgggtccgaagcggtaacccggcgctatgggatgttgcgttctcggtttccattaaagctactaatactggaaagaaacccggttcgtgccgttgctcaattatacgtggaacttcccactgatgacgaacatcctaccccgaaattacagctcagacagttcgaaaagacagctacgttggaacctggacagagtgaagtcctgaagatggagattacaagaaaggatgtgagtatctgggatacgatggttcaggattggaaggttcctgcaactggaaaggggataaagctttggattggggcaagtgttggagacctaaaagctgtatgcgagacggggaagggaaagagttgccatgttttaaattagttgaagaaaggaaacaaatctccatgcggctgtaggttcgaagtactataactcagacgcactgctactagtgcaatcattgaccgcaaaccaagttaaatgacaggctgagaattcatacttatctctgcctgggctgaactgcttgcattacatatactcctcagtccactgacagagttcactcttcatgtttaatagatatttga

SEQ ID NO: 1149 - protein, 870 aa, COCCIDIOIDES POSADASII
MSPTIWIATLLYWFAFQARKSVAAPPGVGALDDRAELPDGFHSPQYYPAPRGLGAGMEEAYSKAHTVVSKMTLAGKVNLTTGTGFLMALVGQTGSALRFGIPRLCLQDGPLGLRNTDHNTAFPAGISVGATFDKKLMYERGCAMGEEFRGKGANVHLGPSVGPLGRKPRGGRNWEGFGSDPSLQAIAAVETIKGVQSKGVIATIKHLVGNEQEMYRMTNIVQRAYSANIDDRTMHELYLWPFAESVRAGVGAVMMAYNDVNGSASCQNSKLINGILKDELGFQGFVMTDWYAQIGGVSSALAGLDMSMPGDGSVPLSGTSFWASELSRSILNGTVALDRLNDMVTRIVATWFKFGQDKDFPLPNFSSYTQNAKGLLYPGALFSPLGVVNQFVNVQADHHKLARVIARESITLLKNEDNLLPLDPNRAIKYSEQMPGTNPRGINACPDKGCNKGVLTMGWGSGTSNLPYLVTPEDAIRNISKNTEFHITDKFPNNVQPGPDDVAIVFVNADSGENYIIVESNPGDRTVAQMKLWHNGDELIESAAKKFSNVVVVVVHTVGPIIMEKWIDLLRSRVSCLPDFQDKKLEILLLISCSETSVRVAASIYDTESRIGLSDSVSLINQRFGQIQDTFTEGLFIDYRHFQKENITPRYHFGYGLSYTTFNFTEPRLESVTTLSEYPPARKPKAGDRHTPTISHLLQKWPGPKTLTGSGAYLYPYLDNPSAIKPKPGYPYPEAIQPNLNLNPRAGGSEAVTRRYGMLRSRFPLKLLILERNPVRAVAQLYVELPTDDEHPTPKLQLRQFEKTATLEPGQSEVLKMEITRKDVSIWDTMVQDWKVPATGKGIKLWIGASVGDLKAVCETGKGKSCHVLN

SEQ ID NO: 1150 - DNA, 4063 bp, Rhizomucor miehei
atgctgctttgactgcgccccctcggaggattctatacgtgcgcaacatcatctgtatgatctcaacaaaggggacggtaaagtgcggaaatgcgtcccggaagttaccaaagggaaaacagcctcgtccccactttttaagtcgttggtgcaacgaagcaaagaagtaaagaaattctgcagtttgtgtcagctttttctttaccctacactatgtggcacaatgcaagaagagagagtaagcgtgagtatagtttaaagcggcggcggtctgaaatagtgttcagttatacataatcatattttagctttaaagttagtcatagaaaacccggggtttgtcatggaaactgtgaaagttaccggtgtcatgtcgcacacgaaaaacaagactttcccgtttccctggaaaacgcatcgaaaaagaaataatgcaacttgaaagcaaggaaccggagaattgcttacatgatgctgatttctcattcccttggagacaggaaagaatatataaaagggggcgcgtagattctctctctcgttttcttcaacaaattttcgcagcaacttaattcgagatgtttgcaaagactgcgttggctcttttgaccgcctggtcagctatgcaaggcgtagccggcggcatcaatttccgttcctgggacgaagctcacgagttggccaaggccgtgacagaccagatgagtctcgagcaatgggtcaatattaccaccggtaaatctatattacattgcaacaaacaaaacccctaaatatcaagttgctaacaaaaaaaaaataaaaggcactggctggatgaaatccgagtgtgttggtaacacacgcccaactaagaaccctgacttcccttcgctgtgtcttgaagatggtcctcctggtatcagattcggtgacaatgttactgccggcgtttctggcatcactgccgctgcttcgtttgacaaggaacagctcctgaaacgcggtcaatatatgggcaaggaattccgtggcaaaggtatccactttgctttgggaccttgcgtcgatatcatgcgtgctccacagactggacgtggctgggaaggttttggcgaggacccttacttggctggtgtcgctggtgctctcacagttgaaggtatccagagccagggcgtggtaagtttcagcctttttcgtttctcatacgtttcacgtgtaacttatcaattcacctttttagattgccactgccaaacactacattggtaacaaccaagaaactaaccgcaaaaacgtgagtgtgtcttattgcctcacttgatcaataactgctactcaatccttgttaattgatgtatttagtccacctccaatattagcaggcgtgcgttgcacgaaatctggacatggccatatgcccgcatgattgaagccggtattggtgccattatgtgtagctacaaccagcttcacggaacctgggcctgcgaagatgaatacacgctcaacaccatcctcaagcaagagtacaacttccgtggtctcatcatgagcgattggggtgcaactcactcgacggctcccgccatcaattccggtctggatatgaccatgcctgtaagttcaataatggtttcttagaagtcaatcttaactgacgcgtatattctatttaagggtgatcttgagatgggtgataactacacttactttggtgtcaacatgacaaaggccgtccggaacggtgaagtcactgaagaacgcgctcaggaaatggccacacgtatcattgccgcctactacaagttgggacaagacgaaggcttccctgaaatggctatcagagccttccaacgtgacgaagctccctatgtgcccgtgcaaggtacgttgtaaatactatcaaccgatatttaaagcaaaatacatcatggctcacaacaatcgttaaaaacaaatagaggatcacggaaagctcgtccgcgaaatgggtgctgctgcgtgcactttgctcaagaacgaggataaagtcttgcctatctccagctctgtcaagaagattgccattatcggcagtgatgctggaccaaaccctgagtatgatctctctcgctcatcctttttagcgttcttccatgcactaagtcattttctgctgcacgtagtggtctccacgatcccgactgtgtcgatcaaggctgtgccaagggcacaaccgctatgggtaggtcatccacttgaataactcggtatttttgacagttttatgaccgaaaatgcactttcttttacgtgtctcaggttggggctcaggcactgtcgacttcccttatcttgttactcctctggacggcattactgcccgtgctggcgatgatgttgaagttgtgcacacctttgacgactgggacgaagaaggcgctgctgaattggccaaagatgccgatattgctttcgttttctccatgaccaaggctggtgaagaatacattgtcgttgatggtaaccacgaccggaagaacctttctctttggaacaacggtgacaatttggtaagttacctgtaactagtccacggtttgctaagcaacagtagtaatgtttcatgttatctcttctttacagatccgagctgttgctgacgccaacgaaaacactgtcgtcgtcattcactctgttggtcctgtcgatatgccttggattgatcaccccaacattaaggctgtcgtttggcctcacttgcctggtcaagaaactggaaactctctcgccgacgtcctctttggtgatgtcaacccctcagggccgtcttccatagcaccattggcaggtctgcagaggactacgctgctggtatcagccctgactttacggcaagtattcagatattactttgttttgagtggacgctaaactaacttaatgttaataccagatcgagtacaccgaagagcttaacgtcggctaccgccactttgacgccaataacattgaacctcttttcccgttcggccacggtctttcctacaccacctttgagtacaacaagctcaaggtcaagaagggccgtaagaaggacaactctttgatccgtgccaccatctatatcaggaacactggcgaagtcgacggcgctgaaattcctcaagcttacatctcgttccccgcgtgcgagccacctaaagttctccgtggtttcgaaaaggtgttcctcaaggccggcaagcacgccaaggtcgaatttaactttggtgagaccgagctcagcatctgggatcctgagacggaagaatggactgtaccctctggagagtacactttgcatattggtgctagcagccgcgacattcgtcagactgccaagtttaggctgtaaacgtgtctagcttaatatgcagcgccgtagctatctttactaaattattcaacagtaaaagaaaataaaataaaatgaaaaataaagtgagctttgaatgagtacatcacaaaggcatgcaattttattccaaagtttaaagataatatcaaatggaaaatgacaagatgtcaacgacagtgttgaataatacgtacagctctttgttcatagtgttcactctcatatctatataaagtcactcgtccgggtatcctttgatgatctcttgtaaagtatacatccttcaggctttactgtcttttgcgtatcatccaatatcctcgtcttcctcttggtcaagttccaattccatgtcctccatatcctcattttccgtctcgtaatcgctttcttctggatcatcgtagtcattttcatcctcctcttccaaggccttgctcctcttcgtcagtagtaacgtcgccttcctcggagggtgtaaacacacttccctttccccgatttctactggcgattgttctgaagctcgtgtacgacgactggctaatgtccatggcctcagcacttagtctcttcgctttcttgagatgactggtcgacttgcattgattcaccggctcctttcgtgatagaatcgatgaatcaatttgagcccccaagctgtcaactgatcgaattcctgcagcccgggggatccac

SEQ ID NO: 1151 - protein, 717 aa, Rhizomucor miehei
MFAKTALALLTAWSAMQGVAGGINFRSWDEAHELAKAVTDQMSLEQWVNITTGTGWMKSECVGNTRPTKNPDFPSLCLEDGPPGIRFGDNVTAGVSGITAAASFDKEQLLKRGQYMGKEFRGKGIHFALGPCVDIMRAPQTGRGWEGFGEDPYLAGVAGALTVEGIQSQGVIATAKHYIGNNQETNRKNSTSNISRRALHEIWTWPYARMIEAGIGAIMCSYNQLHGTWACEDEYTLNTILKQEYNFRGLIMSDWGATHSTAPAINSGLDMTMPGDLEMGDNYTYFGVNMTKAVRNGEVTEERAQEMATRIIAAYYKLGQDEGFPEMAIRAFQRDEAPYVPVQEDHGKLVREMGAAACTLLKNEDKVLPISSSVKKIAIIGSDAGPNPDGLHDPDCVDQGCAKGTTAMGWGSGTVDFPYLVTPLDGITARAGDDVEVVHTFDDWDEEGAAELAKDADIAFVFSMTKAGEEYIVVDGNHDRKNLSLWNNGDNLIRAVADANENTVVVIHSVGPVDMPWIDHPNIKAVVWPHLPGQETGNSLADVLFGDVNPSGPSSIAPLAGLQRTTLLIEYTEELNVGYRHFDANNIEPLFPFGHGLSYTTFEYNKLKVKKGRKKDNSLIRATIYIRNTGEVDGAEIPQAYISFPACEPPKVLRGFEKVFLKAGKHAKVEFNFGETELSIWDPETEEWTVPSGEYTLHIGASSRDIRQTAKFRLYLY

SEQ ID NO: 1152 - DNA, 3631 bp, Thermoascus aurantiacus
ctgcagggtccagggacagccggccgtggtcgtttgcggggaaggcgacacagacgacttggcgcggcccgccggaaggcgaggaatcgtgagtgcgacggagacatggcaagaccacggccttcctggcgaagaagaagatgaatgatcgcaggggcagtgtggcatggaccgcacggccgccagggacctgcccagtgagggttttcgggtgtttccactggctccatcgctgggggcgatcccgagcccgtgtgcccgtgtaactattattgacgatcaacatgccatggccagccggcttctataataattgtatataacaccccccgttctcccgctgccttgctccgtggtcttcctggtcctgcttgaggttcacgagtctccttgcatggtcaactcgtcctctgcttcatcagctgcttgactccgtacctcagcaaccatgaggcttgggtggctggagctggccgtcgcggcggccgcgaccgtcgccagcgccaaggtgcgtcagaccctcccccggatcgaccttgaaggtgcttcttcagcaagggcgcgccggccgcgacatccgccgccgctgccctcaccgacgcagcacccgtatgcagcaggagagaaggcatctctgacgaaagctcctccaggatgacttggcctactcgccgcctttctacccgtcgccgtggatggacggaaacggagagtgggcggaggcctaccgcagggctgtcgacttcgtctcgcagctgaccctcgcggagaaggtcaacctgacgaccggtgtcgggtgagtccattgacctctaccgagtccccgttgcatgtccattgagcagttggctgacgtcttgaagctggatgcaggagaaatgtgtcggtgaaacgggcagcattccgaggtaggctcacttcccaatgccgctgcaaaaggaggtgtctaaactggaataaatcagactggggttccgtggactgtgcctccaagactcgccccttggtgtcagatttggtgggtctttcaacagagaacaagggtcgtcgcgggagagatgctgatcgatacctacttttagctgactacgtttctgccttccccgccggtgtcaacgtcgctgcaacgtgggataagaacctcgcctaccttcgtgggaaggcgatgggtgaggaacaccgtggtaagggcgtcgacgtccagctgggacctgtcgccggccctcttggcagacaccccgacggtggcagaaactgggagggtttctctcctgaccccgtcctgaccggtgtgcttatggcggagacgatcaagggtatccaggacgccggtgtgattgcttgcgccaagcacttcattggtaacgagatggagcacttccggcaagccagtgaggctgttggttatggtttcgatattaccgagagtgtcagctcaaatatcgacgacaagacgcttcacgagctgtacctttggccctttgcggatgctgttcgcggtaagcagtcccccccccctcataggtgattgtacatgtgtatttctgactcgctttcgaagctggcgttggttcgttcatgtgctcctacaaccaggttaacaacagctacagctgctcgaacagctacctcctaaacaagttgctcaaatcggagcttgattttcagggcttcgtgatgagtgactggggagcgcaccacagcggcgttggagctgccctggctggccttgacatgtcgatgccaggagacaccgcctttggtaccggcaaatccttctggggaaccaacctgaccatcgccgttctcaacggcactgttccggaatggcgtgtggatgacatggctgttcgcatcatggcggccttttacaaggttggtcgcgaccgttaccaggtgccggtcaacttcgactcgtggacgaaggatgaatacggttacgagcacgcactggttggccagaactatgtcaaggtcaatgacaaggtggatgttcgtgccgaccatgcggacatcatccgtcaaattgggtctgctagtgttgtccttcttaagaacgatggaggactcccattgaccggctatgaaaagttcaccggagtttttggagaggatgccggatcgaaccgttggggcgctgacggctgctctgatcgtggttgcgacaacggcacgttggcaatgggttggggcagtggcactgctgacttcccctaccttgtcactcccgagcaggcaatccagaatgaaatcctttccaaggggaaggggttagtgagtgctgtcaccgacaatggtgccctggaccagatggaacaggttgcgtctcaggccaggtattctttcctccgtatccctagcaatcgaatctccactgactttaggacagcgtttctatcgttttcgtcaacgccgactctggtgaaggctacatcaacgttgatggcaacgaaggtgatcggaagaacctcaccctctggaagggaggcgaggaggtgatcaagactgttgcagccaactgcaacaacaccattgttgtgatgcacactgtgggacctgtcttgatcgatgagtggtatgacaaccccaacgtcaccgccatcgtctgggccggtcttccaggccaggagagcggcaacagtctcgtcgatgtgctctacggccgtgtcagccccggaggaaagacgccgtttacgtggggaaagactcgcgagtcgtacggcgctcctctgctcaccaaacccaacaacggcaagggtgccccccaggacgacttcaccgagggcgtcttcatcgactacagaaggttcgacaagtacaacgagacgcccatctatgagttcgggtttggtctgagttataccacttttgaatactcggacatctacgtccagccccttaacgcacgaccttacaccccagcctccggcagcaccaaggcggctcctacctttgggaacatcagcacggactatgcagattacttgtaccctgaggatatacacaaggtcccattatacatctatccttggcttaacacgacggacccgaagaagtcctccggcgatcccgactacggaatgaaggccgaggactacatcccatctggcgcgactgatggatctcctcagcccatccttccggcaggcggtgctcctggtggcaacccgggtctctatgatgagatgtacagggtatctgcaatcatcaccaacaccggtaacgttgttggtgatgaggttcctcagctggtgagtttcgcagtctcattgatatatgtctttcgagttagtcactgacccgcgatctatagtatgtctctcttggtggtccagatgaccccaaggtcgtgctccgcaactttgaccgcatcacgctccaccccggccagcagacaatgtggaccacgacattgacgcgacgcgatatctcgaactgggaccctgcctcccagaattgggttgtgaccaaatatcccaagacagtctacatcggcagctcttcgcggaaactgcacctgcaggcaccgcttcccccttactgaggttttatccggaaggaggaagtaaaaacacaatgttttagttgtacaggcgtctttcgtttgtgattatcaatcactagtgaattc

SEQ ID NO: 1153 - protein, 861 aa, Thermoascus aurantiacus
MRLGWLELAVAAAATVASAKDDLAYSPPFYPSPWMDGNGEWAEAYRRAVDFVSQLTLAEKVNLTTGVGWMQEKCVGETGSIPRLGFRGLCLQDSPLGVRFADYVSAFPAGVNVAATWDKNLAYLRGKAMGEEHRGKGVDVQLGPVAGPLGRHPDGGRNWEGFSPDPVLTGVLMAETIKGIQDAGVIACAKHFIGNEMEHFRQASEAVGYGFDITESVSSNIDDKTLHELYLWPFADAVRAGVGSFMCSYNQVNNSYSCSNSYLLNKLLKSELDFQGFVMSDWGAHHSGVGAALAGLDMSMPGDTAFGTGKSFWGTNLTIAVLNGTVPEWRVDDMAVRIMAAFYKVGRDRYQVPVNFDSWTKDEYGYEHALVGQNYVKVNDKVDVRADHADIIRQIGSASVVLLKNDGGLPLTGYEKFTGVFGEDAGSNRWGADGCSDRGCDNGTLAMGWGSGTADFPYLVTPEQAIQNEILSKGKGLVSAVTDNGALDQMEQVASQASVSIVFVNADSGEGYINVDGNEGDRKNLTLWKGGEEVIKTVAANCNNTIVVMHTVGPVLIDEWYDNPNVTAIVWAGLPGQESGNSLVDVLYGRVSPGGKTPFTWGKTRESYGAPLLTKPNNGKGAPQDDFTEGVFIDYRRFDKYNETPIYEFGFGLSYTTFEYSDIYVQPLNARPYTPASGSTKAAPTFGNISTDYADYLYPEDIHKVPLYIYPWLNTTDPKKSSGDPDYGMKAEDYIPSGATDGSPQPILPAGGAPGGNPGLYDEMYRVSAIITNTGNVVGDEVPQLYVSLGGPDDPKVVLRNFDRITLHPGQQTMWTTTLTRRDISNWDPASQNWVVTKYPKTVYIGSSSRKLHLQAPLPPY

SEQ ID NO: 1154 - DNA, 2800 bp, PENICILLIUM BRASILIANUM
tgaaaatgcagggttctacaatctttctggctttcgcctcatgggcgagccaggttgctgccattgcgcagcccatacagaagcacgaggtttgttttatcttgctcatggacgtgctttgacttgactaattgttttacatacagcccggatttctgcacgggccccaagccatagaatcgttctcagaaccgttctacccgtcgccctggatgaatcctcacgccgagggctgggaggccgcatatcagaaagctcaagattttgtctcgcaactcactatcttggagaaaataaatctgaccaccggtgttgggtaagtctctccgactgcttctgggtcacggtgcgacgagccactgactttttgaagctgggaaaatgggccgtgtgtaggaaacactggatcaattcctcgtctcggattcaaaggattttgtacccaggattcaccacagggtgttcggttcgcagattattcctccgctttcacatctagccaaatggccgccgcaacatttgaccgctcaattctttatcaacgaggccaagccatggcacaggaacacaaggctaagggtatcacaattcaattgggccctgttgccggccctctcggtcgcatccccgagggcggccgcaactgggaaggattctcccctgatcctgtcttgactggtatagccatggctgagacaattaagggcatgcaggatactggagtgattgcttgcgctaaacattatattggaaacgagcaggagcacttccgtcaagtgggtgaagctgcgggtcacggatacactatttccgatactatttcatctaatattgacgaccgtgctatgcatgagctatacttgtggccatttgctgatgccgttcgcgctggtgtgggttctttcatgtgctcatactctcagatcaacaactcctacggatgccaaaacagtcagaccctcaacaagctcctcaagagcgaattgggcttccaaggctttgtcatgagcgattggggtgcccatcactctggagtgtcatcggcgctagctggacttgatatgagcatgccgggtgataccgaatttgattctggcttgagcttctggggctctaacctcaccattgcaattctgaacggcacggttcccgaatggcgcctggatgacatggcgatgcgaattatggctgcatacttcaaagttggccttactattgaggatcaaccagatgtcaacttcaatgcctggacccatgacacctacggatataaatacgcttatagcaaggaagattacgagcaggtcaactggcatgtcgatgttcgcagcgaccacaataagctcattcgcgagactgccgcgaagggtacagttctgctgaagaacaactttcatgctctccctctgaagcagcccaggttcgtggccgtcgttggtcaggatgccgggccaaaccccaagggccctaacggctgcgcagaccgaggatgcgaccaaggcactctcgcaatgggatggggctcagggtctaccgaattcccttacctggtcactcctgacactgctattcagtcaaaggtcctcgaatacgggggtcgatacgagagtatttttgataactatgacgacaatgctatcttgtcgcttgtctcacagcctgatgcaacctgtatcgtttttgcaaatgccgattccggtgaaggctacatcactgtcgacaacaactggggtgaccgcaacaatctgaccctctggcaaaatgccgatcaagtgattagcactgtcagctcgcgatgcaacaacacaatcgttgttctccactctgtcggaccagtgttgctaaatggtatatatgagcacccgaacatcacagctattgtctgggcagggatgccaggcgaagaatctggcaatgctctcgtggatattctttggggcaatgttaaccctgccggtcgcactccgttcacctgggccaaaagtcgagaggactatggcactgatataatgtacgagcccaacaacggccagcgtgcgcctcagcaggatttcaccgagagcatctacctcgactaccgccatttcgacaaagctggtatcgagccaatttacgagtttggattcggcctctcctataccaccttcgaatactctgacctccgtgttgtgaagaagtatgttcaaccatacagtcccacgaccggcaccggtgctcaagcaccttccatcggacagccacctagccagaacctggatacctacaagttccctgctacatacaagtacatcaaaaccttcatttatccctacctgaacagcactgtctccctccgcgctgcttccaaggatcccgaatacggtcgtacagactttatcccaccccacgcgcgtgatggctcccctcaacctctcaaccccgctggagacccagtggccagtggtggaaacaacatgctctacgacgaactttacgaggtcactgcacagatcaaaaacactggcgacgtggccggcgacgaagtcgtccagctttacgtagatctcgggggtgacaacccgcctcgtcagttgagaaactttgacaggttttatctgctgcccggtcagagctcaacattccgggctacattgacgcgccgtgatttgagcaactgggatattgaggcgcagaactggcgagttacggaatcgcctaagagagtgtatgttggacggtcgagtcgggatttgccgctgagctcacaattggagtaatgatcatgtctaccaatagatgttgaatgtctggtgtggatatt

SEQ ID NO: 1155 - DNA, 2601 bp, Aspergillus oryzae
atggctgccttcccggcctatttggctcttttgtcttacttggtcccgggggctctgtcccaccccgaggcgaagactctgacatcaagagcctctacagaagcttactcccctccgtattacccggctccgaacggaggatggatatccgaatgggccagtgcctacgagaaggcacaccgtgtcgtaagtaacatgacgttggccgagaaggtgaatctcacaagtggcacgggtatctatatgggaccttgtgccggtcagactggcagtgttccccggtttgggatccccaacctgtgccttcatgattctcccctcggagtccgcaattcggatcataatacggcattcccggccggcatcacggttggggccacatttgacaaggacctgatgtacgagcgcggagtcggcctgggcgaagaggcgcgtggaaagggtatcaacgttcttttagggccgtccgtgggccctattgggcggaagccacggggaggccgcaattgggagggtttcggagcggaccccagtttacaggcctttggtggctcgttgaccatcaaaggaatgcaaagtacgggtgctattgcttcgctcaagcatcttatcggaaacgaacaggagcagcatcggatgagcagtgttatcactcagggctattcgtcaaatatcgatgacaggactttgcatgagctgtatctgtggccattcgctgaaagtgtaagagccggtgctggttcggtcatgattgcgtataacgatgtgaacaggtccgcctgcagccagaatagcaagctcatcaatggaatcctcaaggacgagctgggcttccagggctttgtcgtgaccgactggttggctcatattggcggagtttcgtcagcgttggctggtctggacatgagcatgccgggtgatggagctatcccactcttgggcacgagttactggtcgtgggagctgtcgcgctctgtgctcaatgggtcggtcccggtcgagcgtctcaatgacatggtcacgcgaatcgtcgcaacatggtacaaaatggggcaggacaaagactatccgctaccaaacttctcctcaaacaccgaggatgagactgggccgttgtatcctggcgccttattttccccaagtggcattgtcaaccaatacgtcaatgtccaaggcaaccataatgtcacggcccgggcaatcgctagagacgcaatcacgttgctaaagaataacgagaatgtcctgcctctgaaacggaatgacaccttaaagatctttggcaccgatgccgggaccaattcggacgggatcaactcttgcacggacaaaggctgcaacaaaggcgtattgaccatgggttggggaagcggaacatccagactcccgtatctcatcacgccgcaagaagcgatagcgaatatctcatccaatgccgaattccacatcacagacacgtttcctttgggcgtcactgcaggccccgatgacatcgcgatcgtctttatcaattcggactccggcgagaactacatcaccgttgatggcaatccaggagaccgtacgctggcagggctgcacgcatggcacaatggcgacaacctggtcaaagctgccgcagaaaagttctcaaacgtagtggttgttgtgcataccgtgggacccatcctgatggaagaatggattgacctcgactccgttaaagcggtgctcgtcgctcacctcccaggacaggaggcaggctggtcactcaccgatatcctctttggggactatagtcctagcggccatctgccttacacaatccctcacagtgaatcagactacccggagagcgtcggtctaattgctcagccattcggccaaattcaagacgactacaccgagggcctctacatcgattaccgacacttcctgaaggcaaatatcaccccccgatacccattcgggcacggtctctcctacaccacgttcaactttaccgaacccaacctatccatcatcaaagccctagacacagcctaccccgccgcgcgaccccccaaaggctccacacccacataccccaccgccaaacccgacgcatcagaagtcgcctggcccaagaacttcaaccgcatctggcgctacctctacccctacctcgacaacccagaaggcgcagccgccaactcctcaaagacgtacccctaccccgacggctacaccacagaacccaagcccgcccctcgcgccggcggagcagaaggaggcaacccggccttatgggacgttaccttttcggtccaggtcaaagtgacgaacacaggttctcgggatggccgtgccgttgcgcagctgtatgtggaattgcccagtagtctggggctggatacgccatctcgacagctgcggcagttcgagaagacgaagatcttggctgcgggggagagtgaggtgcttacgttggatgtcacgcgcaaggatcttagtgtttgggatgttgttgttcaggactggaaggcgcctgtgaatggagagggagttaagatttgggttggggagagcgttgcggatttgagggttggatgtgtggttggagagggatgttctactttgtag

SEQ ID NO: 1156 - DNA, 1452 bp, Aspergillus oryzae
atgggttccacttcaacatcgactctcccacccgactttctatggggattcgcaacagcgagttaccagattgaaggagccgtaaatgaggacggacgaggtccatccatctgggatacattttgcaagatccccggtaaaattgctggaggcgccaatggcgatgtggcttgcgactcataccatcgcacacacgaggatattgccttgctcaaggcttgcggtgccaaggcataccgtttctcactctcttggtcccgcattattccactcggtggccgaaacgaccccatcaatgagaaaggcttgcaatattatataaagttcgtggacgacctgcatgctgctggtatcactcctctcgttactttgtttcactgggatcttcccgatgagctcgacaaacgctacggcggtctcctcaataaggaagagttcgtcgcagacttcgcccactacgcacgcatagttttcaaggctttcggctcgaaagttaagcattggatcacgttcaacgagccatggtgtagcagtgtgcttgggtataacgtcggtcagtttgcccccgggagaacaagtgatcggtccaagagtcctgtcggtgacagttcgcgggagtgttggatcgtgggccacagtcttcttgtagcccatggggcagcagtgaagatctaccgagatgagttcaaggccagcgatggtggagagattggcatcactcttaatggtgattgggccgagccttgggaccccgagaacccggcagacgttgaagcctgcgataggaagatcgaattcgcaatctcctggttcgcagaccccatttatcatgggaagtatccggacagcatggtgaagcagttgggtgaccgactgccgaagtggacaccagaggatattgcgctcgttcacggtagcaacgacttctatggcatgaaccattactgcgccaacttcatcaaagctaagaccggcgaagcggatcccaatgacaccgcaggcaacctggagattctgttgcaaaataggaagggtgaatgggtcggacccgagacgcaatctccctggctccgaccctccgcaattgggttccggaagctgttgaaatggctcagtgagcgatacaactaccccaagatctacgtgacggagaacggcaccagtctgaagggtgagaacgacttgccgctagagcagctactccaggacgacttccggacgcagtatttccgggattacattggcgctatggcggatgcctacactctagacggtgtcaatgtcagggcctacatggcttggagtttgatggataacttcgaatgggccgagggctacgagacacgattcggagtgacttacgtggactacgagaataaccagaagagaatccccaagcaaagtgccaaagctattggtgaaatcttcgaccaatacattgagaaagcttag

SEQ ID NO: 1157 - DNA, 2424 bp, Aspergillus oryzae
atgaagctgtcagcggcactttctacgcttgctgcattgcagccagcagtcggcgctgccgtgcagaatcgggcgtcagatgtcgcggatctggagcactactggtcgtatgggcattcagagcccgtctatccaacacctgaaacaaagggcttaggcgactgggaagaggccttcaccaaagcccggtcgctcgtcgctcagatgactgacaaagagaagaacaacctcacatatggctattcttctacagccaacggttgcggtgggacaagcggaggagtcccacgattgggattccccgggatctgcctccaagatgccgggaatggtgtgagaggaacggacatggtcaactcttatgcatccggagttcatgtgggagcgtcatggaaccgggacctcacatacagtcgggcccagtatatgggcgccgagttcaaacggaagggagtcaatgttgcacttggtccagtggctggacccattggccgcatcgcccgaggcggtcgcaactgggaaggcttcagcaacgatccctatctgtctggtgccttgactggagataccgttcgcggtttgcaagaatctgtcattgcttgcgtgaagcatctgataggaaatgaacaggaaacgcatcggagtacaccatcaatgttggccaactgtcgaaaccaatcgtcctcctccaacctggacgataaaaccatgcatgagctctatctgtggcccttccaagatgcagtcaaggcgggtgccggttccgtcatgtgcagttacaaccggatcaacaatagctacggttgtcagaatagcaaggcgatgaatggtctactcaaaggcgaactcggcttccagggttttgttgtctcagattggggtgctcaacacactgggattgctagtgcagcggccgggctagatatggcaatgccttcatcctcgtactgggagattggcactcttgccctagctgtcaagaacgagtcgctgccttccacacgccttgatgatatggccacccgtattgtcgctacttggtacaaatatgcggagattgaaaaccctggtcatggcctaccatacagccttcttgctccccacaacctaaccgacgcccgggatccaaagtccaagtccaccatcttgcaaggtgctgtagagggacatgtcttagtcaagaatacgaacaacgccctgccccttaagaaaccccagtttctctctctctttgggtatgacgccgtcgctgctgctcgtaacactatggatgaccttgattggaacatgtggtctatgggctatgataattccctaacatatcccaatggctcagctgtggatgcaatgatgctgaagtatatatttctctcaagtgcgaacccaagtgcgtttggccccggggtggcgctgaatggtacgacgattactggtggtggctctggtgccagcaccgcatcttatatcgacgcacccttcaatgccttccagcgccaggcatatgatgatgatacgttcctcgcctgggactttgaatctcagaaccccttggtgaacccagctagtgatgcttgtatcgtgtttattaacgagcagtcttcggagggatgggatcgaccatatctggcagatccctactctgacacattggttcagaacgtcgcttcacaatgcagcaacaccatggtcgttatccacaatgctggtgttcgccttgtggaccgctggattgaaaacgataacatcacggcggtcatctacgctcatctccctggacaagatagcggccgagccctcgtggaggtcatgtacggcaaacaatctccatctggccgtctgccttacactgtggcaaagaacgagtccgactacggtagcctcttgaacccggtaatccagtccggtaccgatgatatctactacccccaggataacttcaccgagggcgtctacattgactacaaggctttcgtggctgccaatattaccccacggtacgagttcggatacggattgacctactccactttcgactactccgacctgaaggtttccacctcctcaaacgtaagcactagctatctggctccaggtactactgtggctgagggtggtctcccttcactgtgggatatcatcgctaccgtgacttgtactgtttccaacaccgggtctgtggcggcggcggaagtggcccagctctatattggcatcccgggtggcccagccaaggttctgcgaggatttgagaagcaactcatcgagcctggacaacaggtgcaagtgactttcgatcttactcgtcgcgacctcagcacctgggataccgagaagcagaattgggggctacaagcagggagctacgctctctatgttggaaagagtgtgctagatatccagttgaccggatcattgagcttatag

SEQ ID NO: 1158 - DNA, 2697 bp, RHIZOCTORIA SOLANI
gaaaggggtctcccctctctcacctactcttcgtgtctcgattttcgctggctgagggcgcatacaatgacggccaccaacccattcttgcacgtcaacgttgaagagcttgtctctaagctctctcaagaggaaaagattcttttgttgggtgcacctaattggtggaatacgagcaagatcgagaggctaggcgtgccgagcgtgcgtatgagcgatggtccaaatggagttcgtgggtcatctcactttttgagctcccccgcacaatgtattccctgtgccacggctttggggtcaacttttgatcccgaactcatccacgaagtgggatccttccttgctgtcgaagccaaaaccaagtctgccacggttctccttgcgccaacatgtaatatacagcgttcacctctgggcggccgatcattcgaatccttctccgaaggccctcatctttcggggcaccttgccgctgcatacgtggctggactgcaagataatggtgtcgctgcaacaatcaaacactttgtggccaacgaccaagagcatgagcgcatggcagtggatacaatcctctcggagcgtgccttgagggagatttacttgatgccttttatgattgctcaaagagattctgggccatgggcatacatgactgcttacaaccaagtacacggtgtacatgtgagcgagtgcaaacgaatccttggagacattctgcgaaaagaatggggcttcaacggcttggtcatgagtgactggtatggtacatatagcgtcgacatcgcccttaacgctggtctcgatctcgaaatgcctggtcctccgagatggaggcagccagcgctcgtcaaccatgccatgacgtgtcgaaagcttctaccctctacgctcaacttgcgtgctaaaactgtgctcgactttgttcaaaagcttgctcaaaccagccccgatgtggtttttggtgatggagaagagcgtacccgagatgaccccgaagatcgcgaatttaaccgaaagctggccggccgagcgattgtgttgttgaagaacgaacaagaggttttgccgctcaagaagaaaaagctattggttgtgggacccaacgtacaagccagggtaatttccggaggaggttcggcattcttgaagccgagttatgtgatcacgccttgggatggtatcatagcagccaaacccgagggtgtggacgtcaagttcgaagttggatgctatgctcacaaattcctcccgactcttgaaaatctactcaaaacctccgatggccaacctggatgggaagcttgcttctacacccatgacgaaaaccaacaaccgaaagatgaagtcgccaaattcaatctcaacgatacacgtgtcaagttgaatgatttcttgcccgagggattgactccatcgtggactatcaagctcaaaggaaccttgaaagtagacaagaccgctccatttgagtttggtttgactgttgctggacgagccaagttgtgggtaaacggaaagatgacaattgacaactggacgcatcagcgacctggtgaattcttctatggacagggaagtgcggaggaaaaggctgtagtagatctcaaggcaggcgaagctgtggatatctatgtcgagtacgataacttggcacctgctcccaagggtgttcaaatgcaacctgcactcatgcgtggcgtgcgtctaggaggcgcagaaaagatcgatcccgacgaggctctcaaggcagcaacaaaagctgcggccgaggcggacgctgtgatcgctgtggttgggctaaaccacgagtgggaaagcgagggctttgatcgcccaaacttatcccttccaggacgccaggacgaacttattgaggcagttgcaaaggcgaacaagaacacagtggtagtgatccaagcgggatccgccgtgagtatgccttgggtagacgacgttgccggtgtccttcagagctggtaccttgcgaatgaagcaggcaatgcgattggcgatattctctttggcaaattgaacccgtctggccgcctcccgatcactctacctaagcgcgaggaagatatcccagcccatcttagctttggaagtgaaatgggcaaagtctactaccgcgaggatgtatttgtggggtacaagtattaccaggcgcgtaaagtggcgccactattcccgttcggttttggcttgtcgtatacgactttcgagttgtccgatctcaaggtcgaaggtcctagttctcatgatagtagcctagaagtcaaggcgagcgtcaatgtgaagaatactgggtcggtaaagggaagcgaaacaatccagctgtatgtggcacaacccgccggacctatcacacaccccaagctgcagctacgggcctttggcaaggcggcagacttggaaccaggggcgaacacaacagtcaagttgtcgtttggcaagtacggtgcgtcgttctggcacgaagaagacgagacatggcgtgcagatgcgggcaaatacggggttttagtggggacgtcctcggttgatttgccgctgtcttcttcgtttgagctgaaacagaccttttcatggaggggcctgtagtcataacattgtagctgtaatgtaaccgtaacacatcatagaagatataaagccacgtgatcgcgtgtaaaaaaaaaaaaaaaaaaaaaaaaa

SEQ ID NO: 1159 - protein, 845 aa, RHIZOCTORIA SOLANI
MTATNPFLHVNVEELVSKLSQEEKILLLGAPNWWNTSKIERLGVPSVRMSDGPNGVRGSSHFLSSPAQCIPCATALGSTFDPELIHEVGSFLAVEAKTKSATVLLAPTCNIQRSPLGGRSFESFSEGPHLSGHLAAAYVAGLQDNGVAATIKHFVANDQEHERMAVDTILSERALREIYLMPFMIAQRDSGPWAYMTAYNQVHGVHVSECKRILGDILRKEWGFNGLVMSDWYGTYSVDIALNAGLDLEMPGPPRWRQPALVNHAMTCRKLLPSTLNLRAKTVLDFVQKLAQTSPDVVFGDGEERTRDDPEDREFNRKLAGRAIVLLKNEQEVLPLKKKKLLVVGPNVQARVISGGGSAFLKPSYVITPWDGIIAAKPEGVDVKFEVGCYAHKFLPTLENLLKTSDGQPGWEACFYTHDENQQPKDEVAKFNLNDTRVKLNDFLPEGLTPSWTIKLKGTLKVDKTAPFEFGLTVAGRAKLWVNGKMTIDNWTHQRPGEFFYGQGSAEEKAVVDLKAGEAVDIYVEYDNLAPAPKGVQMQPALMRGVRLGGAEKIDPDEALKAATKAAAEADAVIAVVGLNHEWESEGFDRPNLSLPGRQDELIEAVAKANKNTVVVIQAGSAVSMPWVDDVAGVLQSWYLANEAGNAIGDILFGKLNPSGRLPITLPKREEDIPAHLSFGSEMGKVYYREDVFVGYKYYQARKVAPLFPFGFGLSYTTFELSDLKVEGPSSHDSSLEVKASVNVKNTGSVKGSETIQLYVAQPAGPITHPKLQLRAFGKAADLEPGANTTVKLSFGKYGASFWHEEDETWRADAGKYGVLVGTSSVDLPLSSSFELKQTFSWRGL

SEQ ID NO: 1160 - DNA, 2103 bp, Hypocrea jecorina
atgattctcggctgtgaaagcacaggtgtcatctctgccgtcaaacactttgtcgccaacgaccaggagcacgagcggcgagcggtcgactgtctcatcacccagcgggctctccgggaggtctatctgcgacccttccagatcgtagcccgagatgcaaggcccggcgcattgatgacatcctacaacaaggtcaatggcaagcacgtcgctgacagcgccgagttccttcagggcattctccggactgagtggaattgggatcctctcattgtcagcgactggtacggcacctacaccactattgatgccatcaaagccggccttgatctcgagatgccgggcgtttcacgatatcgcggcaaatacatcgagtctgctctgcaggcccgtttgctgaagcagtccactatcgatgagcgcgctcgccgcgtgctcaggttcgcccagaaggccagccatctcaaggtctccgaggtagagcaaggccgtgacttcccagaggatcgcgtcctcaaccgtcagatctgcggcagcagcattgtcctactgaagaatgagaactccatcttacctctccccaagtccgtcaagaaggtcgcccttgttggatcccacgtgcgtctaccggctatctcgggaggaggcagcgcctctcttgtcccttactatgccatatctctatacgatgccgtctctgaggtactagccggtgccacgatcacgcacgaggtcggtgcctatgcccaccaaatgctgcccgtcatcgacgcaatgatcagcaacgccgtaatccacttctacaacgaccccatcgatgtcaaagacagaaagctccttggcagtgagaacgtatcgtcgacatcgttccagctcatggattacaacaacatcccaacgctcaacaaggccatgttctggggtactctcgtgggcgagtttatccctaccgccacgggaatttgggaatttggcctcagtgtctttggcactgccgacctttatattgataatgagctcgtgattgaaaatacaacacatcagacgcgtggtaccgcctttttcggaaagggaacgacggaaaaagtcgctaccaggaggatggtggccggcagcacctacaagctgcgtctcgagtttgggtctgccaacacgaccaagatggagacgaccggtgttgtcaactttggcggcggtgccgtacacctgggtgcctgtctcaaggtcgacccacaggagatgattgcgcgggccgtcaaggccgcagccgatgccgactacaccatcatctgcacgggactcagcggcgagtgggagtctgagggttttgaccggcctcacatggacctgccccctggtgtggacaccatgatctcgcaagttcttgacgccgctcccaatgctgtagtcgtcaaccagtcaggcaccccagtgacaatgagctgggctcataaagcaaaggccattgtgcaggcttggtatggtggtaacgagacaggccacggaatctccgatgtgctctttggcaacgtcaacccgtcggggaaactctccctatcgtggccagtcgatgtgaagcacaacccagcatatctcaactacgccagcgttggtggacgggtcttgtatggcgaggatgtttacgttggctacaagttctacgacaaaacggagagggaggttctgtttccttttgggcatggcctgtcttacgctaccttcaagctcccagattctaccgtgaggacggtccccgaaaccttccacccggaccagcccacagtagccattgtcaagatcaagaacacgagcagtgtcccgggcgcccaggtcctgcagctatacatttcggccccaaactcgcctacacatcgcccggtcaaggagctgcacggattcgaaaaggtgtatcttgaagctggcgaggagaaggaggtacaaatacccattgaccagtacgctactagcttctgggacgagattgagagcatgtggaagagcgagaggggcatttatgatgtgcttgtaggattctcgagtcaggaaatctcgggcaaggggaagctgattgtgcctgaaacgcgattctggatggggctgtag

SEQ ID NO: 1161 - protein, 700 aa, Hypocrea jecorina
MILGCESTGVISAVKHFVANDQEHERRAVDCLITQRALREVYLRPFQIVARDARPGALMTSYNKVNGKHVADSAEFLQGILRTEWNWDPLIVSDWYGTYTTIDAIKAGLDLEMPGVSRYRGKYIESALQARLLKQSTIDERARRVLRFAQKASHLKVSEVEQGRDFPEDRVLNRQICGSSIVLLKNENSILPLPKSVKKVALVGSHVRLPAISGGGSASLVPYYAISLYDAVSEVLAGATITHEVGAYAHQMLPVIDAMISNAVIHFYNDPIDVKDRKLLGSENVSSTSFQLMDYNNIPTLNKAMFWGTLVGEFIPTATGIWEFGLSVFGTADLYIDNELVIENTTHQTRGTAFFGKGTTEKVATRRMVAGSTYKLRLEFGSANTTKMETTGVVNFGGGAVHLGACLKVDPQEMIARAVKAAADADYTIICTGLSGEWESEGFDRPHMDLPPGVDTMISQVLDAAPNAVVVNQSGTPVTMSWAHKAKAIVQAWYGGNETGHGISDVLFGNVNPSGKLSLSWPVDVKHNPAYLNYASVGGRVLYGEDVYVGYKFYDKTEREVLFPFGHGLSYATFKLPDSTVRTVPETFHPDQPTVAIVKIKNTSSVPGAQVLQLYISAPNSPTHRPVKELHGFEKVYLEAGEEKEVQIPIDQYATSFWDEIESMWKSERGIYDVLVGFSSQEISGKGKLIVPETRFWMGL

SEQ ID NO: 1162 - DNA, 920 bp, PENICILLIUM OCCITANIS
ggtggccgtaactgggaaggtttcgcgccggaccctgtgttgactggtcagatgatggcaagcactatccaaggcatgcaggataccggtgtgattgcttgcgcaaagcactatattggaaacgaacaagagcacttccgtcagggctctcaggagaacttcaccgttgctgatgctatcagctcgaacattgatgacgttactttgcacgaattgtacttgtggccgtttgccgatgcggttagggcaggtgtcggttccgtcatgtgttcttacaatcaaataaataacagctactcctgcggcaacagctacaccctgaaccacatcctcaagggtgaactcgacttccaaggatttgtaatgaccgattggagtgctcaacactctggtgtcggcgatgctcttgccggagctgacatggatatgcctggtgatgtggctttcgacagtggaactgctttctggggtaccaacttgacaattgccgtgctcaatggcactgttcccgaatggcgtattgacgacatggctgttcgtatcatgtctgctttctacaaggttggtcgtgatcgtacccaggttcccatcaacttcgctagctggaccttgatacctatggcaacgaatactactacgccggcgagggctacaaggaaactcaaccagcacgttgatgtgcgtggtgaccacgccaaagtcgtccgtgaaatcggcagtgctagcattgttctcctcaagaacgttgatggtgctcttccattgactggctcggagaagtttgtcgcagtatttggagaggacgcaggctccaaccccgatggtgtcaatggctgctctgaccgtggctgtgataacggtaccttggccatgggatggggtagtggtactgccaacttcccttacttggtcacccctga

SEQ ID NO: 1163 - protein, 306 aa, PENICILLIUM OCCITANIS
GGRNWEGFAPDPVLTGQMMASTIQGMQDTGVIACAKHYIGNEQEHFRQGSQENFTVADAISSNIDDVTLHELYLWPFADAVRAGVGSVMCSYNQINNSYSCGNSYTLNHILKGELDFQGFVMTDWSAQHSGVGDALAGADMDMPGDVAFDSGTAFWGTNLTIAVLNGTVPEWRIDDMAVRIMSAFYKVGRDRTQVPINFASWTLIPMATNTTTPARATRKLNQHVDVRGDHAKVVREIGSASIVLLKNVDGALPLTGSEKFVAVFGEDAGSNPDGVNGCSDRGCDNGTLAMGWGSGTANFPYLVTP

SEQ ID NO: 1164 - DNA, 3101 bp, CHAETOMIUM THERMOPHILUM
gtcagtatgaaactcgctgttggtctcgcctgtttagttggtagccatctggctgctacaggctccctgaaatctaaggctaaggtatgaaaatggaggcttcgaaatctctctccaaagctttcccccgaactcttcccctttgccttttggtgttcctctcttccgggaagggccaagaacgtccagacgttgcgcacagcggggacttgaatttacttggtatcactcagggacttttatcaaacataataaacctttctcctcatccaccgtgccaataacctcatgctcgttttcttccctgaaaactggacttccgtcacagagaatgcgctttgctcatacaacacaattgcttcattatctgggcataggccacccatcagctaacaacttccacaagctagaaaaacgtgcctgggcaacctcggagccttcctacccatcaccatggatgaatccgaacgccgctggctgggagcaggcttaccaatgggctaaggactttgtctctcaaatgaccttgctggaaaaggttaacctcacgacaggtgttgggtaagtctgaaagaaaagcatcgaggacccgatgcccaagctttttatgtcttttccaggttggctaacgtcgtagacagctgggagggagaacagtgtgttggccaaacaggggccatccctcggctgggtctccgaagcctgtgtctacacgactcaccgcttggtattcgtgggacggactacaactcggccttcccttcaggacagacgacagctgctacgtgggaccggactcttttctataagcgtggatatgcaatgggaaaggaagccagagggaagggtatcaacgttctcctgggccccgtagctggcccacttggcaggatgcccgctggtggtcggaattgggaaggcttctcccccgatccggttctcacaggtattgctatggctgagactgtcaaggggattcaggatgccggtgttattgcctgtgctaagcatcttattggcgacgagcaaggtcagtttatatccattcactcgtgctcccagcagagtacatactgaaccatccacagaacacttcagacaggttggcgatggcttcgacatcgatgagagtctatcctcaaacatcgatgacaggacaatgcacgagctctacctctggccatttgccgacgcagttcgtgccggagttggttccgtcatgtgcgcctacaaccaggtcaacaactcgtactcctgccacaactccaaactattgaacggccttctcaagaacgaacttggcttccagggtttcgttatgagcgactggcaggcgcagcacactggtgttgcaagtgctgtggcaggcttggacatgaccatgccaggagatactgtgttcaattcgggtctcagtttttggggagcaaacctcactgttgctgtcctcaatggtacgcttcctgcatatcggctggatgatatggcgatgcgaattatggccgccttcttcaaggttcgcgggacccaggacgttgaccttgaccctatcaacttctcgttctggaccctggacacttacgggccgattcattggggcgcgaaggaaggtcaccaacagatcaacttccacgttgatgttcgggaagatcacagtcgtctgatccgcgagattgctgcgaaaggaacggtgctgttgaagaacgagggtgccttgcccctggacaaacccaagttcttggctgtcattggcgaggatgctggtccaaatcataatggacccaactcctgtgatgaccgtggttgtgttggggggactcttgctatgggatggggctctggtactgccaatttcccatacctggttacaccggatgcagcactccaagcccaggccattaaggatggctcccggtacgaaagcgtgctgtcgaaccatgctatggagacgatcaggaaggttgtctctcaggacaatgtgacggcagttgtgtttgtcaatgccaactcaggagaagggtacatcaccgttgatggcaataggggagaccgcaacaacctgaccttgtggaacggtggggatgaactaatcaagaacgtggccagctggtgctccaacactatcgttgtcattcattcagttggtcccgttctgcttactgactggtacgaccatccgaacatcactgcaattctatgggccggtcttcctgggcaggagtctggcaatgccatcactgatgtcctgtacggcaaagtgaaccctgctggccgctcgccatttacttggggtgctacacgtgagggttatggagctgatgtcctgtacgatcccgatgatgcaagagtgccgcagcaaaacttcacggagggtgttttcatcgactatcgctactttgacaaacacaatactcgtgtcatctacgaattcggccacggactgagttacacaacctttgagtataggaatctgcaaattcagaagcacaatgtgtccgcatacataccaactaccgggcttacggaaccagcaccgacgttcggtgaacactcgacgaattactctgattatctctacccagaaggcttccaccgtgccaatcgttacatctacccctacgtgaacagcaccgatcttgagctcgcctccggagacccttactacggccagacagcagaccagttcctgccccctaacgcgacctcttccgacccgcagccactgttgcgctcttcaggaaagaactcgccgggtggtaaccctcagctgtatgatgtgctctacacagtcacggcagatattaccaacacaggcgccctcgagggtgatgaagtcgtgcagctgtacgtatcgctcggcgggcctgatgacccaaaggtaatgcttagggacttcgcccggttgcacatcaagcctggtgagacagtcaagtttgaagggaagctgacaaggagagacttaagtacctgggatgttacgctgcaggattgggtgattagggaccatacaaagatggtgtttcttgggaagagcagtcggaagttggtgttaggggctttgctgaattgaagagaatgaaaagagtattagggggatgatc

SEQ ID NO: 1165 - protein, 867 aa, CHAETOMIUM THERMOPHILUM
MKLAVGLACLVGSHLAATGSLKSKAKLEKRAWATSEPSYPSPWMNPNAAGWEQAYQWAKDFVSQMTLLEKVNLTTGVGWEGEQCVGQTGAIPRLGLRSLCLHDSPLGIRGTDYNSAFPSGQTTAATWDRTLFYKRGYAMGKEARGKGINVLLGPVAGPLGRMPAGGRNWEGFSPDPVLTGIAMAETVKGIQDAGVIACAKHLIGDEQEHFRQVGDGFDIDESLSSNIDDRTMHELYLWPFADAVRAGVGSVMCAYNQVNNSYSCHNSKLLNGLLKNELGFQGFVMSDWQAQHTGVASAVAGLDMTMPGDTVFNSGLSFWGANLTVAVLNGTLPAYRLDDMAMRIMAAFFKVRGTQDVDLDPINFSFWTLDTYGPIHWGAKEGHQQINFHVDVREDHSRLIREIAAKGTVLLKNEGALPLDKPKFLAVIGEDAGPNHNGPNSCDDRGCVGGTLAMGWGSGTANFPYLVTPDAALQAQAIKDGSRYESVLSNHAMETIRKVVSQDNVTAVVFVNANSGEGYITVDGNRGDRNNLTLWNGGDELIKNVASWCSNTIVVIHSVGPVLLTDWYDHPNITAILWAGLPGQESGNAITDVLYGKVNPAGRSPFTWGATREGYGADVLYDPDDARVPQQNFTEGVFIDYRYFDKHNTRVIYEFGHGLSYTTFEYRNLQIQKHNVSAYIPTTGLTEPAPTFGEHSTNYSDYLYPEGFHRANRYIYPYVNSTDLELASGDPYYGQTADQFLPPNATSSDPQPLLRSSGKNSPGGNPQLYDVLYTVTADITNTGALEGDEVVQLYVSLGGPDDPKVMLRDFARLHIKPGETVKFEGKLTRRDLSTWDVTLQDWVIRDHTKMVFLGKSSRKLVLGALLN

SEQ ID NO: 1166 - DNA, 2990 bp, PENICILLIUM BRASILIANUM
  misc_feature (2953)..(2953): n is a, c, g, or t
tgaaaatgcagggttctacaatctttctggctttcgcctcatgggcgagccaggttgctgccattgcgcagcccatacagaagcacgaggtttgttttatcttgctcatggacgtgctttgacttgactaattgttttacatacagcccggatttctgcacgggccccaagccatagaatcgttctcagaaccgttctacccgtcgccctggatgaatcctcacgccgagggctgggaggccgcatatcagaaagctcaagattttgtctcgcaactcactatcttggagaaaataaatctgaccaccggtgttgggtaagtctctccgactgcttctgggtcacggtgcgacgagccactgactttttgaagctgggaaaatgggccgtgtgtaggaaacactggatcaattcctcgtctcggattcaaaggattttgtacccaggattcaccacagggtgttcggttcgcagattattcctccgctttcacatctagccaaatggccgccgcaacatttgaccgctcaattctttatcaacgaggccaagccatggcacaggaacacaaggctaagggtatcacaattcaattgggccctgttgccggccctctcggtcgcatccccgagggcggccgcaactgggaaggattctcccctgatcctgtcttgactggtatagccatggctgagacaattaagggcatgcaggatactggagtgattgcttgcgctaaacattatattggaaacgagcaggagcacttccgtcaagtgggtgaagctgcgggtcacggatacactatttccgatactatttcatctaatattgacgaccgtgctatgcatgagctatacttgtggccatttgctgatgccgttcgcgctggtgtgggttctttcatgtgctcatactctcagatcaacaactcctacggatgccaaaacagtcagaccctcaacaagctcctcaagagcgaattgggcttccaaggctttgtcatgagcgattggggtgcccatcactctggagtgtcatcggcgctagctggacttgatatgagcatgccgggtgataccgaatttgattctggcttgagcttctggggctctaacctcaccattgcaattctgaacggcacggttcccgaatggcgcctggatgacatggcgatgcgaattatggctgcatacttcaaagttggccttactattgaggatcaaccagatgtcaacttcaatgcctggacccatgacacctacggatataaatacgcttatagcaaggaagattacgagcaggtcaactggcatgtcgatgttcgcagcgaccacaataagctcattcgcgagactgccgcgaagggtacagttctgctgaagaacaactttcatgctctccctctgaagcagcccaggttcgtggccgtcgttggtcaggatgccgggccaaaccccaagggccctaacggctgcgcagaccgaggatgcgaccaaggcactctcgcaatgggatggggctcagggtctaccgaattcccttacctggtcactcctgacactgctattcagtcaaaggtcctcgaatacgggggtcgatacgagagtatttttgataactatgacgacaatgctatcttgtcgcttgtctcacagcctgatgcaacctgtatcgtttttgcaaatgccgattccggtgaaggctacatcactgtcgacaacaactggggtgaccgcaacaatctgaccctctggcaaaatgccgatcaagtgattagcactgtcagctcgcgatgcaacaacacaatcgttgttctccactctgtcggaccagtgttgctaaatggtatatatgagcacccgaacatcacagctattgtctgggcagggatgccaggcgaagaatctggcaatgctctcgtggatattctttggggcaatgttaaccctgccggtcgcactccgttcacctgggccaaaagtcgagaggactatggcactgatataatgtacgagcccaacaacggccagcgtgcgcctcagcaggatttcaccgagagcatctacctcgactaccgccatttcgacaaagctggtatcgagccaatttacgagtttggattcggcctctcctataccaccttcgaatactctgacctccgtgttgtgaagaagtatgttcaaccatacagtcccacgaccggcaccggtgctcaagcaccttccatcggacagccacctagccagaacctggatacctacaagttccctgctacatacaagtacatcaaaaccttcatttatccctacctgaacagcactgtctccctccgcgctgcttccaaggatcccgaatacggtcgtacagactttatcccaccccacgcgcgtgatggctcccctcaacctctcaaccccgctggagacccagtggccagtggtggaaacaacatgctctacgacgaactttacgaggtcactgcacagatcaaaaacactggcgacgtggccggcgacgaagtcgtccagctttacgtagatctcgggggtgacaacccgcctcgtcagttgagaaactttgacaggttttatctgctgcccggtcagagctcaacattccgggctacattgacgcgccgtgatttgagcaactgggatattgaggcgcagaactggcgagttacggaatcgcctaagagagtgtatgttggacggtcgagtcgggatttgccgctgagctcacaattggagtaatgatcatgtctaccaatagatgttgaatgtctggtgtggatattacgaggagactgtcatgataatagagaatcgtatattgcctaagaggcatgaatatccagagttttcattcttgattcaaactgtgctcttcaagcatgtaatttgtaattggtattcttgacataaaactgctaccctgggccgttccatgnaattagtcttagcttcgatcttttccttttttgctcc

SEQ ID NO: 1167 - protein, 878 aa, PENICILLIUM BRASILIANUM
MQGSTIFLAFASWASQVAAIAQPIQKHEPGFLHGPQAIESFSEPFYPSPWMNPHAEGWEAAYQKAQDFVSQLTILEKINLTTGVGWENGPCVGNTGSIPRLGFKGFCTQDSPQGVRFADYSSAFTSSQMAAATFDRSILYQRGQAMAQEHKAKGITIQLGPVAGPLGRIPEGGRNWEGFSPDPVLTGIAMAETIKGMQDTGVIACAKHYIGNEQEHFRQVGEAAGHGYTISDTISSNIDDRAMHELYLWPFADAVRAGVGSFMCSYSQINNSYGCQNSQTLNKLLKSELGFQGFVMSDWGAHHSGVSSALAGLDMSMPGDTEFDSGLSFWGSNLTIAILNGTVPEWRLDDMAMRIMAAYFKVGLTIEDQPDVNFNAWTHDTYGYKYAYSKEDYEQVNWHVDVRSDHNKLIRETAAKGTVLLKNNFHALPLKQPRFVAVVGQDAGPNPKGPNGCADRGCDQGTLAMGWGSGSTEFPYLVTPDTAIQSKVLEYGGRYESIFDNYDDNAILSLVSQPDATCIVFANADSGEGYITVDNNWGDRNNLTLWQNADQVISTVSSRCNNTIVVLHSVGPVLLNGIYEHPNITAIVWAGMPGEESGNALVDILWGNVNPAGRTPFTWAKSREDYGTDIMYEPNNGQRAPQQDFTESIYLDYRHFDKAGIEPIYEFGFGLSYTTFEYSDLRVVKKYVQPYSPTTGTGAQAPSIGQPPSQNLDTYKFPATYKYIKTFIYPYLNSTVSLRAASKDPEYGRTDFIPPHARDGSPQPLNPAGDPVASGGNNMLYDELYEVTAQIKNTGDVAGDEVVQLYVDLGGDNPPRQLRNFDRFYLLPGQSSTFRATLTRRDLSNWDIEAQNWRVTESPKRVYVGRSSRDLPLSSQLE

SEQ ID NO: 1168 - DNA, 2828 bp, Thermoascus aurantiacus
cgacctcgtcctctgcttcatcagctgcttgactccgtacctcagcaaccatgaggcttgggtggctggagctggccgtcgcggcggccgcgaccgtcgccagcgccaaggatgacttggcctactcgccgcctttctacccgtcgccgtggatggacggaaacggagagtgggcggaggcctaccgcagggctgtcgacttcgtctcgcagctgaccctcgcggagaaggtcaacctgacgaccggtgtcggctggatgcaggagaaatgtgtcggtgaaacgggcagcattccgagactggggttccgtggactgtgcctccaagactcgccccttggtgtcagatttgctgactacgtttctgccttccccgccggtgtcaacgtcgctgcaacgtgggataagaacctcgcctaccttcgtgggaaggcgatgggtgaggaacaccgtggtaagggcgtcgacgtccagctgggacctgtcgccggccctcttggcagacaccccgacggtggcagaaactgggagggtttctctcctgaccccgtcctgaccggtgtgcttatggcggagacgatcaagggtatccaggacgccggtgtgattgcttgcgccaagcacttcattggtaacgagatggagcacttccggcaagccagtgaggctgttggttatggtttcgatattaccgagagtgtcagctcaaatatcgacgacaagacgcttcacgagctgtacctttggccctttgcggatgctgttcgcgctggcgttggttcgttcatgtgctcctacaaccaggttaacaacagctacagctgctcgaacagctacctcctaaacaagttgctcaaatcggagcttgattttcagggcttcgtgatgagtgactggggagcgcaccacagcggcgttggagctgccctggctggccttgacatgtcgatgccaggagacaccgcctttggtaccggcaaatccttctggggaaccaacctgaccatcgccgttctcaacggcactgttccggaatggcgtgtggatgacatggctgttcgcatcatggcggccttttacaaggttggtcgcgaccgttaccaggtgccggtcaacttcgactcgtggacgaaggatgaatacggttacgagcacgcactggttggccagaactatgtcaaggtcaatgacaaggtggatgttcgtgccgaccatgcggacatcatccgtcaaattgggtctgctagtgttgtccttcttaagaacgatggaggactcccattgaccggctatgaaaagttcaccggagtttttggagaggatgccggatcgaaccgttggggcgctgacggctgctctgatcgtggttgcgacaacggcacgttggcaatgggttggggcagtggcactgctgacttcccctaccttgtcactcccgagcaggcaatccagaatgaaatcctttccaaggggaaggggttagtgagtgctgtcaccgacaatggtgccctggaccagatggaacaggttgcgtctcaggccagcgtttctatcgttttcgtcaacgccgactctggtgaaggctacatcaacgttgatggcaacgaaggtgatcggaagaacctcaccctctggaagggaggcgaggaggtgatcaagactgttgcagccaactgcaacaacaccattgttgtgatgcacactgtgggacctgtcttgatcgatgagtggtatgacaaccccaacgtcaccgccatcgtctgggccggtcttccaggccaggagagcggcaacagtctcgtcgatgtgctctacggccgtgtcagccccggaggaaagacgccgtttacgtggggaaagactcgcgagtcgtacggcgctcctctgctcaccaaacccaacaacggcaagggtgccccccaggacgacttcaccgagggcgtcttcatcgactacagaaggttcgacaagtacaacgagacgcccatctatgagttcgggtttggtctgagttataccacttttgaatactcggacatctacgtccagccccttaacgcacgaccttacaccccagcctccggcagcaccaaggcggctcctacctttgggaacatcagcacggactatgcagattacttgtaccctgaggatatacacaaggtcccattatacatctatccttggcttaacacgacggacccgaagaagtcctccggcgatcccgactacggaatgaaggccgaggactacatcccatctggcgcgactgatggatctcctcagcccatccttccggcaggcggtgctcctggtggcaacccgggtctctatgatgagatgtacagggtatctgcaatcatcaccaacaccggtaacgttgttggtgatgaggttcctcagctgtatgtctctcttggtggtccagatgaccccaaggtcgtgctccgcaactttgaccgcatcacgctccaccccggccagcagacaatgtggaccacgacattgacgcgacgcgatatctcgaactgggaccctgcctcccagaattgggttgtgaccaaatatcccaagacagtctacatcggcagctcttcgcggaaactgcacctgcaggcaccgcttcccccttactgaggttttatccggaaggaggaagtaaaaacacaatgttttagttgtacaggcgtctttcgtttgtgattatccataggcatatcaagaccacgttgggtcatatatatatagatatatatatatattagcggccgacgaaaggcaatgggtaacatggttcaagaggaggaaccgtcttgaaactaaagtcga

SEQ ID NO: 1169 - protein, 861 aa, Thermoascus aurantiacus; identical to SEQ ID NO: 1153

SEQ ID NO: 1170 - DNA, 2583 bp, Aspergillus niger
atgaggttcacttcgatcgaggcggtggctctgactgccgtctcgctggccagcgctgatgaattggcctactccccgccgtattacccctccccttgggccaatggccagggtgactgggcggaagcataccagcgcgctgttgatatcgtctcgcagatgacattggctgagaaggtcaatttgactacgggaactggatgggaattggaattatgtgttggtcagactggaggtgttccccgattgggaattccgggaatgtgtgcacaggatagccctctgggtgttcgtgactccgactacaactctgcgttccctgccggtgtcaacgtggccgcaacctgggacaagaatctggcttaccttcgtggccaggctatgggtcaggagtttagtgacaagggtgctgatatccaattgggtccagctgccggccctctcggtagaagtcccgacggcggtcgtaactgggagggcttctcccccgacccggccctcagtggtgtgctctttgcagagacaatcaagggtattcaggatgctggtgtggttgcaacggctaagcactacatcgcctacgagcaggagcatttccgtcaggcgcctgaagctcaaggctacggattcaatattaccgagagtggaagcgcgaacctcgacgataagactatgcatgagctgtacctctggcccttcgcggatgccatccgtgcaggtgccggtgctgtgatgtgctcgtacaaccagatcaacaacagctatggctgccaaaacagctacactctgaacaagctgctcaaggctgagctgggtttccagggctttgtcatgagtgattgggcggctcaccatgccggtgtgagtggtgctttggcgggattggacatgtctatgccgggagacgtcgattacgacagtggcacgtcttactggggtaccaacttgaccatcagtgtgctcaacgggacggtgccccaatggcgtgttgatgacatggctgtccgcatcatggccgcctactacaaggtcggccgtgaccgtctgtggactcctcccaacttcagctcatggaccagagatgaatacggcttcaagtactactatgtctcggagggaccgtatgagaaggtcaaccagttcgtgaacgtgcaacgcaaccatagcgagttgatccgccgtattggagcagacagcacggtgctcctcaagaacgatggcgctcttcccttgactggaaaggagcgcttggtcgcccttatcggagaagatgcgggttccaatccttatggtgccaacggctgcagtgaccgtgggtgcgacaatggaacattggcgatgggctggggaagtggcactgccaactttccctacttggtgacccccgagcaggccatctcgaacgaggtgctcaagaacaagaatggcgtattcactgcgaccgataactgggctattgatcagattgaggcgcttgctaagaccgccagtgtctctcttgtctttgtcaacgccgactctggtgagggttatatcaatgtcgacggaaacctgggtgaccgcaggaacctgaccctgtggaggaacggcgacaatgtgatcaaggctgctgctagcaactgcaacaacacgatcgttattattcactctgtcggcccagtcttggttaacgagtggtacgacaaccccaatgttaccgctattctctggggtggtcttcccggtcaggagtctggcaactccctcgccgacgtgctctacggccgtgtcaaccccggtgccaagtcgcccttcacctggggcaagactcgtgaggcctaccaagattacttgtacaccgagcccaacaacggcaacggagcgccccaggaagacttcgtcgagggcgtcttcattgactaccgcggatttgacaagcgcaacgagactcctatctatgagttcggctatggtctgagctacaccaccttcaactactcgaaccttcaggtggaggttctgagcgcccctgcgtacgagcctgcttcgggcgagactgaggcagcgccgactttcggagaggtcggaaatgcgtcggattacctctaccccgatggactgcagagaatcaccaagttcatctacccctggctcaacagtaccgatcttgaggcgtcttctggggatgctagctatgggcaggatgcctcagactatcttcccgagggagccaccgatggctctgcgcaaccgatcctgcctgccggtggtggtgctggcggcaaccctcgcctgtacgacgagctcatccgcgtgtcggtgactatcaagaacaccggcaaggttgcgggtgatgaagttcctcaactgtatgtttctcttggcggccctaacgaacccaagatcgtgctgcgtcaattcgagcgtatcacgctgcagccgtcgaaagagacgcagtggagcacaactctgacgcgccgtgaccttgcgaactggaatgttgagacgcaggactgggagattacgtcgtatcccaagatggtgtttgccggaagctcctcgcggaagctgccgctccgggcgtctctgcctactgttcactaa

SEQ ID NO: 1171 - protein, 860 aa, Aspergillus niger
MRFTSIEAVALTAVSLASADELAYSPPYYPSPWANGQGDWAEAYQRAVDIVSQMTLAEKVNLTTGTGWELELCVGQTGGVPRLGIPGMCAQDSPLGVRDSDYNSAFPAGVNVAATWDKNLAYLRGQAMGQEFSDKGADIQLGPAAGPLGRSPDGGRNWEGFSPDPALSGVLFAETIKGIQDAGVVATAKHYIAYEQEHFRQAPEAQGYGFNITESGSANLDDKTMHELYLWPFADAIRAGAGAVMCSYNQINNSYGCQNSYTLNKLLKAELGFQGFVMSDWAAHHAGVSGALAGLDMSMPGDVDYDSGTSYWGTNLTISVLNGTVPQWRVDDMAVRIMAAYYKVGRDRLWTPPNFSSWTRDEYGFKYYYVSEGPYEKVNQFVNVQRNHSELIRRIGADSTVLLKNDGALPLTGKERLVALIGEDAGSNPYGANGCSDRGCDNGTLAMGWGSGTANFPYLVTPEQAISNEVLKNKNGVFTATDNWAIDQIEALAKTASVSLVFVNADSGEGYINVDGNLGDRRNLTLWRNGDNVIKAAASNCNNTIVIIHSVGPVLVNEWYDNPNVTAILWGGLPGQESGNSLADVLYGRVNPGAKSPFTWGKTREAYQDYLYTEPNNGNGAPQEDFVEGVFIDYRGFDKRNETPIYEFGYGLSYTTFNYSNLQVEVLSAPAYEPASGETEAAPTFGEVGNASDYLYPDGLQRITKFIYPWLNSTDLEASSGDASYGQDASDYLPEGATDGSAQPILPAGGGAGGNPRLYDELIRVSVTIKNTGKVAGDEVPQLYVSLGGPNEPKIVLRQFERITLQPSKETQWSTTLTRRDLANWNVETQDWEITSYPKMVFAGSSSRKLPLRASLPTVH

SEQ ID NO: 1172 - DNA, 2517 bp, Aspergillus clavatus
atggttcaattcgacgtcgaaaagactctcgaggagctcacgctaggtgagaaggtggctctcacagctggaactgatttctggcacacggctgccgttcctcgcctcaacatccccagccttcgcatgtccgatgggcccaatggagtgcgcggaacgcgcttcttcaatggtacccgtgccgcatgctttccttgctctactgcgctgggcgcaacctgggacacggagctgctgtacgaagtcggccgcctgatggcagaagaatccatcgccaagggttctcacatcattctgggaccgaccatcaacactcagcgctccccgctcggcgggcgaggatttgagtcgttcgccgaggatggcgtgctttcgggtcttctggctggtaattactgcaagggcttgcaggataagggtgttgcggccactctgaagcacttcgtctgcaacgaccaggagcatgagcgcctggctgttgatagtattgtgacgatgcgcgctatgcgcgaaatctacttgatgcccttccatctggcgatgaggctttgcaagactgcctgtgtcatgaccgcgtataacaagatcaatggcacacacgtcagtgagaacaagcagatcatcaccgatattctgcgcaaggagtggggatgggatggtctggtcatgagcgactggttcggaacatacagtacctctgatgccatcaacgctggcttggatctggaaatgccgggcccaacccgctggcgtggaactgccctggcgcatgccgtttcatccaacaaggcttttgagtacgtcttggatgaacgtgtccgcaatgtgttgaacctgcacaactttgtcgagccactcggcatcccagagaacgcccccgaagaggcccttaaccggccagaagatcaggctttgctcagacgggctgcagcggagtcagtggtcctcatgaagaatgaggataacatccttcccttgaaaaaggagaagtccattctggtgattggacccaatgcgaagactgccgcatactgtggtggaggttctgcctccctggacgcatactataccgtggcaccctttgacggtgtcaaggccaagagcgagggcgaggtcagcttttcccagggtgtctattcatataacgaacttcccgtgctgggacctctactgaagacagaggaaggcgagaaagggttcaagttccgcgtgtataatgagccctcgtccaaccccaaccgcgagctcctcgatgaattgcgcctggagaactcgcttggcttcctcatggattacaagcaccccaaggtcacatccttcctcttctacgcggatatggagggttacttcacccctgaggaagacggcatctacgactttggtgtgaccgtacaaggaacaggcaaactctacatcgatggtgaactcgttgttgacaacagcaagaatcagcgccagggaaccgccttcttcggtaacgccaccgtcgaagagaagggctccaaggagctgaaggctggtcagacatacaaggtggtcgtcgaatttggcagcgcaccgacctctgatctggacatgcgcggtgtggtcgtcttcggccctggcggtttccgcttcggcgccgctcgtcgtgtcggccaggaggagctcatctccaaagcggccgagttggcctcccaggcggaccaggtggtcatcttcgccggtctgaccagcgagtgggagacggagggccacgaccgggaccacatggacctgcccgcgggcagcgacgagatgatcagccgcgtgctggatgccaaccccaacgcagtcgtggtcatccagagcggcacgcccgtcacgatgccctgggcgcacaagaccaaggccctgctgcaggcctggttcggcggcaacgagtgcggtaacggcatcgcagacgtgctgtacggcgacgtcaacccctccgcgaagctgcctctcagcttccctgtccgcctgcaggacaacccgtcgtacctgaacttccgctccgagcgcggccgggtcctgtacggcgaggacgtctacgtcggctaccgctactacgagaaggtcgacctggccccgctcttccccttcggccacggcctgtcgtacaccacattctcccgctccgacctctcgctggccaccgtccctgaaaagcgccagctcgaggacggcgagcccatcaccgccaccgtcactgtaaccaacacgggcgacgtcgcgggcgccgaggtcgtgcagctgtggattgtcccgccgccgacgggcgtcaatcggcccgtgcgcgagctcaagggctttgccaaggtgttcctgaaccccggtgagtcgaagacggtcgaaattgtggtggagaagaagctggcgacgagctggtgggacgagcagcgcgagaagtgggcgtcggagaagggcacgtacaaggtcctggtgacgggcacgggcgacgaggtgctcaagtcgtcgtttgaggtggagaagactagattctggctgggcttgtag

SEQ ID NO: 1173 - protein, 838 aa, Aspergillus clavatus
MVQFDVEKTLEELTLGEKVALTAGTDFWHTAAVPRLNIPSLRMSDGPNGVRGTRFFNGTRAACFPCSTALGATWDTELLYEVGRLMAEESIAKGSHIILGPTINTQRSPLGGRGFESFAEDGVLSGLLAGNYCKGLQDKGVAATLKHFVCNDQEHERLAVDSIVTMRAMREIYLMPFHLAMRLCKTACVMTAYNKINGTHVSENKQIITDILRKEWGWDGLVMSDWFGTYSTSDAINAGLDLEMPGPTRWRGTALAHAVSSNKAFEYVLDERVRNVLNLHNFVEPLGIPENAPEEALNRPEDQALLRRAAAESVVLMKNEDNILPLKKEKSILVIGPNAKTAAYCGGGSASLDAYYTVAPFDGVKAKSEGEVSFSQGVYSYNELPVLGPLLKTEEGEKGFKFRVYNEPSSNPNRELLDELRLENSLGFLMDYKHPKVTSFLFYADMEGYFTPEEDGIYDFGVTVQGTGKLYIDGELVVDNSKNQRQGTAFFGNATVEEKGSKELKAGQTYKVVVEFGSAPTSDLDMRGVVVFGPGGFRFGAARRVGQEELISKAAELASQADQVVIFAGLTSEWETEGHDRDHMDLPAGSDEMISRVLDANPNAVVVIQSGTPVTMPWAHKTKALLQAWFGGNECGNGIADVLYGDVNPSAKLPLSFPVRLQDNPSYLNFRSERGRVLYGEDVYVGYRYYEKVDLAPLFPFGHGLSYTTFSRSDLSLATVPEKRQLEDGEPITATVTVTNTGDVAGAEVVQLWIVPPPTGVNRPVRELKGFAKVFLNPGESKTVEIVVEKKLATSWWDEQREKWASEKGTYKVLVTGTGDEVLKSSFEVEKTRFWLGL

SEQ ID NO: 1174 - DNA, 2350 bp, Aspergillus niger
gaccatctactggtcacaaaccgctcgagattctgattttcgaatcccgacttcaacttttttctatatttgtacaagagacccgctttaaggttacctcgctgctggggctcagttgccctaccggcgggaaaaccatgttttatcagagtgggcaagcgtcggcatcttaagcgtgcctatcagttttttcaattgccgatatggcggatccttcacgtgtctgctttataacttacatgcagaatatcgtgtttggtctttacattccgaccttggctcccgcaaaggcataggtacatagtgtcgttaaaacgggtaatacgactcactataggagagaattccgggaatgtgtgcacaggatagccctgtgggtgttcgtgactgtaagcaactcggtcttttaggctttgatgctcttgctgacacagcgtacccgactacaactcgcgttctctgccggtgtcaacgtgcccgcaacctgggacaagaatctggcttacctgcgtgccaggctatgggtcaggagtttagtgacaagggtgatgatatccaattgggtccagctcccggccctctcggtagaagtcccgacgacggtcgtaactgggagggcttctcctccgatccggccctcagtggtgtgctctttgcagagacaatcaagggtattcaggatgctggtgtggtcgcaacgggctaagcactacatcgcctacgagcaggagcatttccgtcaggcgcctgaagctcaaggttacggattcaatattacctagaggcaagcgcgagcctcgacgataagtactacgccgaatttgaccctctgcccttcgccggtatcatgcgtgcaggtgccggtgctgtgatgtgctcgtacaaccagatcaacaacagctatggctgccagaacagctacactctgaacaagctgctcaaggctgagctgggtttccagggctttgtcatgagtgattgggcggctcaccatgccggtgtgagtggtgctttggcgggattggacatgtctatgccgggagacgtcgattacgacagtggcacgtcttactggggtaccaacttgaccatcagtgtgctcaacgggacggtgccccaatggcgtgttgatgacatggctgtccgcatcatggccgcctactacaaggtcggccgtgaccgtctgtggactcctcccaacttcagctcatggaccagagatgaatacggcttcaagtactactatgtctcggagggaccgtatgagaaggtcaaccagttcgtgaatgtgcaacgcaaccatagcgagttgatccgccgtattggagcagacagcacggtgctcctcaagaacgatggcgctcttcccttgactggaaaggagcgcttggtcgcccttatcggagaagatgcgggttccaatccttatggtgccaacggctgcagtgaccgtgggtgcgacaatggaacattggcgatgggctggggaagtggaacttgccaactttccctacttggtgaccccgagcaggccatcttgaacgaggtgctcaagaacaagaatggcgtattcactgcgaccgataactgggctattgatcagattgaggcgcttgctaagaccgccaggtaagaagatctcgggctctttctttttccttattgtgcaatgaatgctgacaacatggtagtgtctctcttgtctttgtcaacgccgactctggtgagggttatatcaatgtcgacggaaacctgggtgaccgcaggaacctgaccctgtggaggaacggcgacaatgtgatcaaggctgctgctagcaactgcaacaacacgatcgttattattcactctgtcggcccagtcttggttaacgagtggtacgacaaccccaatgttaccgctattctctggggtggtcttcccggtcaggagtctggcaactccctcgccgacgtgctctacggccgtgtcaaccccggtgccaagtcgcccttcacctggggcaagactcgtgaggcctaccaagattacttgtacaccgagcccaacaacggcaacggagcgccccaggaagacttcgtcgagggcgtcttcattgactaccgcggatttgacaagcgcaacgagactcctatctatgagttcggcgcacctgcacggatcaccactttcaactactcggagctagcagggctcgtttccagcgcgccctaagctgggctcgtatctgacgagcctgacgcagctccactttctgagaggtctggaaatgcgccgtattacctctcccccgaaggactgcagtataatcaccaagtccatctacctctggcgcaaccgttcccagatc

SEQ ID NO: 1175 - DNA, 2348 bp, Aspergillus oryzae
tcccacgtaggcatgggaatagaccttccgaaccggagagtcgaggggagtcaccatgcccgtttgatataactggaagagaagcccatatcaaatcgaccgaatgggccggcacccatactcatgtttactgcgctactagatcgagagaggtatgtgattgttgatggttggtttggttgagagatgatgaagttgatggctgctgctgcttcagggacgaggacggatccctctctatatgcccgatcagatctgggatcgacactgcccgaaagcagtggcgagtctggactttgttccaaatttgtgtttggttaaggtcatctgttggttgcgtccggtggtcaaaaccagcttgtgagcactccttacttaaaccaggtgatttccattccaactgacgctacatctcacacagcaaacaatctctcaactctcaactccagcctcctcctatttagttcctaaagatcgacatcagacatcaacaacaacaaagttcaagaaaagatgtttattaaacttttaaacaaagcgcttctagtgcttggtctgctgtcagctggcacgcaagctgcaactatgtcagtataaccgtgatgttaccccttttgctctgcatagtcccttactgttggagcagtcgcttggaccctcgcgcaagttcgttcgattacaatggcgaaaaggtccgcggtgtcaacctgggtggatggcttgtgcttgagccttggattacaccttcaattttcgatgccgctggtgccgaggccgtcgacgagtggtcattgactaagattctgggcaaggaagaggctgaagcccgcttgtccgctcactggaagtctttcgtctctgcgggcgatttccagcgaatggctgatgccggactgaaccacgtccgaatccccattggctactgggctcttggacccctcgaaggagacccttacgtcgatggtcagctagaataccttgacaaggcggtagaatgggctggagcggcgggcctcaaagttctgatcgaccttcacggtggtaagtgtcctttgggctgaacatccaaacatgggagtctaagcatggctaacaatctggccagcaccgggatctcagaatggattcgacaacagcggtcggagaggagccatccaatggcaacaaggggacactgttgagcagacccttgatgccttcgacctgctggccgagcggtaccttggctccgacaccgtggctgccatcgaagctatcaacgagcccaacattcctggtggagtagaccagggcaagctgcaagagtactacggttccgtctatggcatcgtcaacaagtacaacgctggcacatctgtggtatacggagatggttttctgcccgtagagagctggaacggcttcaagaccgagggcagcaaggtcgtgatggacactcaccattaccatatgtttgacaacggactcattgccatggatatcgacagccacatcgatgccgtctgccagttcgctcaccagcacctggaagcatctgacaagcctgttattgtgggtgagtggaccggtgccgtgactgactgtgccaaatacctcaatggcaagggcaacggcgctcgctatgacggttcctacgccgctgataaggctattggtgactgctccagcctggctactggttttgtgtccaaactctctgacgaagagcgatcggacatgcgccgcttcattgaggctcagctagacgcctttgaactcaagagcggctgggtgttctggacctggaagactgagggtgcccctggctgggacatgagtgatttgctcgaagctggtgtcttccctacttctcctgatgaccgggagttccctaagcagtgctaagcacacagtcgctaagctttttttttttcttatcctttagccactattctttttctctcttcctttcttttcaccctttgtcgctcccttcttgctcaacatctttatgggcagtggagtatctaatcttgttcatttcgggagtattatttgatattggcctcgcatggtttaagctaatgaatatatcttgatattgtttcacatgacttccgtataacaaagcgccgcgctccaaatcggggtattgagaaatatacacaaaaaagggtaccaaccggaaaattagtctagcctatacttgatttcgccatgagtcccatcctgtcccggtccctgtccctggagctgaacctagtaattgtgcccactgtgcttctaatgattccatgccggtagtaatcatgtcgacgagtggtcatggctaagattctgggcaaggaagagctgaagcccgttgtccg

SEQ ID NO: 1176 - protein, 405 aa, Aspergillus oryzae
MLPLLLCIVPYCWSSRLDPRASSFDYNGEKVRGVNLGGWLVLEPWITPSIFDAAGAEAVDEWSLTKILGKEEAEARLSAHWKSFVSAGDFQRMADAGLNHVRIPIGYWALGPLEGDPYVDGQLEYLDKAVEWAGAAGLKVLIDLHGAPGSQNGFDNSGRRGAIQWQQGDTVEQTLDAFDLLAERYLGSDTVAAIEAINEPNIPGGVDQGKLQEYYGSVYGIVNKYNAGTSVVYGDGFLPVESWNGFKTEGSKVVMDTHHYHMFDNGLIAMDIDSHIDAVCQFAHQHLEASDKPVIVGEWTGAVTDCAKYLNGKGNGARYDGSYAADKAIGDCSSLATGFVSKLSDEERSDMRRFIEAQLDAFELKSGWVFWTWKTEGAPGWDMSDLLEAGVFPTSPDDREFPKQC

SEQ ID NO: 1177 - DNA, 3885 bp, Aspergillus niger
tccattcgcccatgcttagcgtgtcttttctttgaacactgcatgcgggactgtgaattgcatgagtgggtagctttgcggagacagctgcactggcatacatcatcgttgggttcctcaattcgcatgccgtggcggacggtcactttgtggcgctcaaactatttaatatggcccagctcccctttctctcgctgttttcgtttctgtcctccctaaacctccagtctctccattggacaggtgttgcacggttgctcacctggtttgttttgctccccctttgggcgaccttgccatcatgaggttcactttgatcgaggcggtggctctgactgccgtctcgctggccagcgctgtacgtgccgttactttgtcctgagaattgcaattgtgcttaattagattcatttgtttgtttcatcatcgctgacaatggtcttttcataggatgaattggcctactccccaccgtattacccatccccttgggccaatggccagggcgactgggcgcaggcataccagcgcgctgttgatattgtctcgcaaatgacattggatgagaaggtcaatctgaccacaggaactgggtagggcttacatggcgcaatctgtatgctccggctaacaacttctacatgggaattggaactatgtgttggtcagactggcggtgttccccggtaggtttgaaaatattgtcgagacaggggacattattgattaacggtgacagattgggagttccgggaatgtgtttacaggatagccctctgggcgttcgcgactgtaagccatctgctgttgttaggcttcgatgctcttactgacacggcgcagccgactacaactctgctttccctgccggcatgaacgtggctgcaacctgggacaagaatctggcataccttcgcggcaaggctatgggtcaggaatttagtgacaagggtgccgatatccaattgggtccagctgccggccctctcggtagaagtcccgacggtggtcgtaactgggagggcttctccccagaccctgccctaagtggtgtgctctttgccgagaccatcaagggtatccaagatgctggtgtggttgcgacggctaagcactacattgcttacgagcaagagcatttccgtcaggcgcctgaagcccaaggttttggatttaatatttccgagagtggaagtgcgaacctcgatgataagactatgcacgagctgtacctctggcccttcgcggatgccatccgtgcaggtgctggcgctgtgatgtgctcctacaaccagatcaacaacagttatggctgccagaacagctacactctgaacaagctgctcaaggccgagctgggcttccagggctttgtcatgagtgattgggctgctcaccatgctggtgtgagtggtgctttggcaggattggatatgtctatgccaggagacgtcgactacgacagtggtacgtcttactggggtacaaacttgaccattagcgtgctcaacggaacggtgccccaatggcgtgttgatgacatggctgtccgcatcatggccgcctactacaaggtcggccgtgaccgtctgtggactcctcccaacttcagctcatggaccagagatgaatacggctacaagtactactacgtgtcggagggaccgtacgagaaggtcaaccagtacgtgaatgtgcaacgcaaccacagcgaactgattcgccgcattggagcggacagcacggtgctcctcaagaacgacggcgctctgcctttgactggtaaggagcgcctggtcgcgcttatcggagaagatgcgggctccaacccttatggtgccaacggctgcagtgaccgtggatgcgacaatggaacattggcgatgggctggggaagtggtactgccaacttcccatacctggtgacccccgagcaggccatctcaaacgaggtgcttaagcacaagaatggtgtattcaccgccaccgataactgggctatcgatcagattgaggcgcttgctaagaccgccaggtaagaagatccccgattcttttccttcttgtgcaatggatgctgacaacatgctagtgtctctcttgtctttgtcaacgccgactctggtgagggttacatcaatgtggacggaaacctgggtgaccgcaggaacctgaccctgtggaggaacggcgataatgtgatcaaggctgctgctagcaactgcaacaacacaatcgttgtcattcactctgtcggaccagtcttggttaacgagtggtacgacaaccccaatgttaccgctatcctctggggtggtttgcccggtcaggagtctggcaactctcttgccgacgtcctctatggccgtgtcaaccccggtgccaagtcgccctttacctggggcaagactcgtgaggcctaccaagactacttggtcaccgagcccaacaacggcaacggagcccctcaggaagactttgtcgagggcgtcttcattgactaccgtggatttgacaagcgcaacgagaccccgatctacgagttcggctatggtctgagctacaccactttcaactactcgaaccttgaggtgcaggtgctgagcgcccctgcatacgagcctgcttcgggtgagaccgaggcagcgccaaccttcggagaggttggaaatgcgtcggattacctctaccccagcggattgcagagaattaccaagttcatctacccctggctcaacggtaccgatctcgaggcatcttccggggatgctagctacgggcaggactcctccgactatcttcccgagggagccaccgatggctctgcgcaaccgatcctgcctgccggtggcggtcctggcggcaaccctcgcctgtacgacgagctcatccgcgtgtcagtgaccatcaagaacaccggcaaggttgctggtgatgaagttccccaactggtaagtaaacatgaggtccgaacgaggttgaacaaagctaatcagtcgcagtatgtttcccttggcggtcccaatgagcccaagatcgtgctgcgtcaattcgagcgcatcacgctgcagccgtcggaggagacgaagtggagcacgactctgacgcgccgtgaccttgcaaactggaatgttgagaagcaggactgggagattacgtcgtatcccaagatggtgtttgtcggaagctcctcgcggaagctgccgctccgggcgtctctgcctactgttcactaaatagctctcaaatggtataccatgatggccgtggtatatgaattaatgatttatgccaacagcaagaccactgtagatgtagatgtagaatgagtattgcgtagtagcgtgtagatgatgatacaagcgatccgacacatggtaggaagagtggcgctagttggggcggaaaccaagcgacgtcatccgctgccgacttcgccagtctttcttcttttcctcttcagccttcttcctccgcttaatccagcaaccattgccaattgcctctacaacaactaattgccataatactctactcctattcaatatatacaccacaatctcgacataatcacacaagcctgaacacacgagcaaccatgccctctcccgatcctccagccccagcgatacgacccttccaaccacccataacagcgctcctcatctacccagcgaccctaatcgtgggatcactcttctccgtcctctctcccaccgcacaaggcacacgcgacgacggctccagcaccctccacccacacgtcgagcccctagccccgtccatcgcgtcagacctcaacctctcctttcctccgccgcgccccgtcaactacttcgctcgcaaagacaacatcttcaatctatattcgtcaaagtcggctgg

SEQ ID NO: 1178 - protein, 860 aa, Aspergillus niger
MRFTLIEAVALTAVSLASADELAYSPPYYPSPWANGQGDWAQAYQRAVDIVSQMTLDEKVNLTTGTGWELELCVGQTGGVPRLGVPGMCLQDSPLGVRDSDYNSAFPAGMNVAATWDKNLAYLRGKAMGQEFSDKGADIQLGPAAGPLGRSPDGGRNWEGFSPDPALSGVLFAETIKGIQDAGVVATAKHYIAYEQEHFRQAPEAQGFGFNISESGSANLDDKTMHELYLWPFADAIRAGAGAVMCSYNQINNSYGCQNSYTLNKLLKAELGFQGFVMSDWAAHHAGVSGALAGLDMSMPGDVDYDSGTSYWGTNLTISVLNGTVPQWRVDDMAVRIMAAYYKVGRDRLWTPPNFSSWTRDEYGYKYYYVSEGPYEKVNQYVNVQRNHSELIRRIGADSTVLLKNDGALPLTGKERLVALIGEDAGSNPYGANGCSDRGCDNGTLAMGWGSGTANFPYLVTPEQAISNEVLKHKNGVFTATDNWAIDQIEALAKTASVSLVFVNADSGEGYINVDGNLGDRRNLTLWRNGDNVIKAAASNCNNTIVVIHSVGPVLVNEWYDNPNVTAILWGGLPGQESGNSLADVLYGRVNPGAKSPFTWGKTREAYQDYLVTEPNNGNGAPQEDFVEGVFIDYRGFDKRNETPIYEFGYGLSYTTFNYSNLEVQVLSAPAYEPASGETEAAPTFGEVGNASDYLYPSGLQRITKFIYPWLNGTDLEASSGDASYGQDSSDYLPEGATDGSAQPILPAGGGPGGNPRLYDELIRVSVTIKNTGKVAGDEVPQLYVSLGGPNEPKIVLRQFERITLQPSEETKWSTTLTRRDLANWNVEKQDWEITSYPKMVFVGSSSRKLPLRASLPTVH

SEQ ID NO: 1179 - DNA, 2435 bp, Orpinomyces sp. PC-2
aaataattaaattaagatatatataataaataaataaaatgaagactcttactgttttctctgctttattagctgttactgctgctaagaagtgcattgttaagagcgatgctgctgttgcttctgaagctgaagaagtcactgctgaacttactgctccagaagattctggtgttgaatctggtgaagatgatgaattattagatttatctaccattgactacggagatgatgttgacatgtctactgttaagaagcttccagctgacttcaaatggggtgctgctactgctgcttaccaagttgaaggtgcctgggatgaagaaggtcgtggtgaatctgtctgggatcacttcactcatctttacccaaagaatgtcgaatctggtgacagatccaaggacttctccactaatggtaacattgcttgtgattcttaccacaagttcgacgaagatgttaaaatgttaaagctcatgaatgctaaatactaccgtttctctatttcatggccacgtcttttcccagatggtcaagccagaaaggttgacggtaaatggaacgtcaatgaaaagggtgctgaatactacgatatggttatcaatactcttcttaaaaacgatattgttccattcgttactctttaccactgggatcttccatacgctctccacgaaaagtatggtggttggttagattaccactcccaagatgatttcgccaaatacgccgaattctgtttcgaacgttttggtgaccgtgtcaagaactggattactattaacgaaccatgggttaactgtgtttctggttaccgtcttggtccaggtaaggctccatacagatgtactggtgaagctccacgtaagctccaaaactccaccgatcttgacttagaaggaggttgttcctacgaaattggtccaactcaatactctaagaactctgaacctcttccagctaaccgtgttccacaaaagttagaagatgtctggtgttcccacaatattcttcttggtcacgctaaggctgttaaggtctaccgtgaaaaattccaaaagaagcaaaagggtcttattggtattaccgttgatggtgaagctcaaattccatgggttgaaccaggtatgaccaagaaggaatacgaaaacaacttaaagtacgccaacttagctgctgaattccgtattggttggtactctgacccaccaatggttggtgactatccaaagtccgttaaggaaagaatgggtaaggacttaccagaattcactgaagaagaaaagaagatcttaaagggatcttcctctgacttcttaggttggaacacctacactgctcactgggctgctcaagctaagaacgaagatggttcttacattcaaccaccaactgccgaagaagctaacttcgacaactccaagaaggatatgtgggatgataactgtaagggacgtggtgatggttggacttgtattccaccaactcttggttcccaagctggttcttcctggaacactaagttcgctccaactatccgtgttggtcttaactggttctccaagcgttacgaaggtttaattaagaacggtatcgttattactgaaaacggttgtgcccaaccaaactacaaggttgctcgtgctaatgatgaagttactaagaagtacttcgaatctattggtcaaccaaagtatgctgatacttacaaggaagaagatattgaaagagaagacaacttagaaggtactcttatgcacgatacctaccgtattgactggtacgaccaataccttaagaaccttcgtcttgcctacgccgtcgataacatcgatgtccgtggttacatggcctggtctttacttgataactttgaatgggaaaacggttacgaaactcgttttggtatgacttacattgacttctacaatgacaaggaaatgaagcgtgttccaaaggattcccttgaacatcttggtcaatggtacctcgaaaatgttgaacaaaactaaatttcttaaaaatttataataatattttattacaattataaataaatatattaataatggaattattttattcacttcttttgctataagtagtgaaataaattaattttataattatataaatttatagaataaatcttttttgaatcattaaaattaaaataaataatatacaaattttaatgaataataatgattattattaaatattctaaagaagatttataatttttaagaataaatataaagcaagaaaacaaatataattaaaaaaaataaaaattaaatataaaataaaaataaaataataaagctttgtgtttaaaataaaatagagtagtaaaagctattcgctattcttaataaatataaaaatataaaataaagttaaaaatttaaataaaataaaaaatattaataaaa

SEQ ID NO: 1180 - protein, 657 aa, Orpinomyces sp. PC-2
MKTLTVFSALLAVTAAKKCIVKSDAAVASEAEEVTAELTAPEDSGVESGEDDELLDLSTIDYGDDVDMSTVKKLPADFKWGAATAAYQVEGAWDEEGRGESVWDHFTHLYPKNVESGDRSKDFSTNGNIACDSYHKFDEDVKMLKLMNAKYYRFSISWPRLFPDGQARKVDGKWNVNEKGAEYYDMVINTLLKNDIVPFVTLYHWDLPYALHEKYGGWLDYHSQDDFAKYAEFCFERFGDRVKNWITINEPWVNCVSGYRLGPGKAPYRCTGEAPRKLQNSTDLDLEGGCSYEIGPTQYSKNSEPLPANRVPQKLEDVWCSHNILLGHAKAVKVYREKFQKKQKGLIGITVDGEAQIPWVEPGMTKKEYENNLKYANLAAEFRIGWYSDPPMVGDYPKSVKERMGKDLPEFTEEEKKILKGSSSDFLGWNTYTAHWAAQAKNEDGSYIQPPTAEEANFDNSKKDMWDDNCKGRGDGWTCIPPTLGSQAGSSWNTKFAPTIRVGLNWFSKRYEGLIKNGIVITENGCAQPNYKVARANDEVTKKYFESIGQPKYADTYKEEDIEREDNLEGTLMHDTYRIDWYDQYLKNLRLAYAVDNIDVRGYMAWSLLDNFEWENGYETRFGMTYIDFYNDKEMKRVPKDSLEHLGQWYLENVEQN

SEQ ID NO: 1181 - DNA, 3033 bp, Hypocrea jecorina
tggccacagagggagagttcgcgctaccgcttggtcgaggaaatgatcgcccacggcctcaaatcgtaaatctcggtgtgggtaggagtgcaacgatgggatttggccgcaatgctgccgagcccgagtgtttctgcaacgttatccaggagatttgcgcttgcccaagagggagttgacggggagagtcccaactggttccttcagtaacgccaccctggcagactatataacttgtggacaagactctgctttgttgagttcttcctaccagtcttgaccaagaccattctgttgagcccaatcagaaatgcgttaccgaacagcagctgcgctggcacttgccactgggccctttgctagggcagacagtcagtatagctggtccatactgggatgtgatatgtatcctggagacaccatgctgactcttgaatcaaggtagctcaacatcgggggcctcggctgaggcagttgtacctcctgcagggactccatggggaaccgcgtacgacaaggcgaaggccgcattggcaaagctcaatctccaagataaggtcggcatcgtgagcggtgtcggctggaacggcggtccttgcgttggaaacacatctccggcctccaagatcagctatccatcgctatgccttcaagacggacccctcggtgttcgatactcgacaggcagcacagcctttacgccgggcgttcaagcggcctcgacgtgggatgtcaatttgatccgcgaacgtggacagttcatcggtgaggaggtgaaggcctcggggattcatgtcatacttggtcctgtggctgggccgctgggaaagactccgcagggcggtcgcaactgggagggcttcggtgtcgatccatatctcacgggcattgccatgggtcaaaccatcaacggcatccagtcggtaggcgtgcaggcgacagcgaagcactatatcctcaacgagcaggagctcaatcgagaaaccatttcgagcaacccagatgaccgaactctccatgagctgtatacttggccatttgccgacgcggttcaggccaatgtcgcttctgtcatgtgctcgtacaacaaggtcaataccacctgggcctgcgaggatcagtacacgctgcagactgtgctgaaagaccagctggggttcccaggctatgtcatgacggactggaacgcacagcacacgactgtccaaagcgcgaattctgggcttgacatgtcaatgcctggcacagacttcaacggtaacaatcggctctggggtccagctctcaccaatgcggtaaatagcaatcaggtccccacgagcagagtcgacgatatggtgactcgtatcctcgccgcatggtacttgacaggccaggaccaggcaggctatccgtcgttcaacatcagcagaaatgttcaaggaaaccacaagaccaatgtcagggcaattgccagggacggcatcgttctgctcaagaatgacgccaacatcctgccgctcaagaagcccgctagcattgccgtcgttggatctgccgcaatcattggtaaccacgccagaaactcgccctcgtgcaacgacaaaggctgcgacgacggggccttgggcatgggttggggttccggcgccgtcaactatccgtacttcgtcgcgccctacgatgccatcaataccagagcgtcttcgcagggcacccaggttaccttgagcaacaccgacaacacgtcctcaggcgcatctgcagcaagaggaaaggacgtcgccatcgtcttcatcaccgccgactcgggtgaaggctacatcaccgtggagggcaacgcgggcgatcgcaacaacctggatccgtggcacaacggcaatgccctggtccaggcggtggccggtgccaacagcaacgtcattgttgttgtccactccgttggcgccatcattctggagcagattcttgctcttccgcaggtcaaggccgttgtctgggcgggtcttccttctcaggagagcggcaatgcgctcgtcgacgtgctgtggggagatgtcagcccttctggcaagctggtgtacaccattgcgaagagccccaatgactataacactcgcatcgtttccggcggcagtgacagcttcagcgagggactgttcatcgactataagcacttcgacgacgccaatatcacgccgcggtacgagttcggctatggactgtgtaagtttgctaacctgaacaatctattagacaggttgactgacggatgactgtggaatgatagcttacaccaagttcaactactcacgcctctccgtcttgtcgaccgccaagtctggtcctgcgactggggccgttgtgccgggaggcccgagtgatctgttccagaatgtcgcgacagtcaccgttgacatcgcaaactctggccaagtgactggtgccgaggtagcccagctgtacatcacctacccatcttcagcacccaggacccctccgaagcagctgcgaggctttgccaagctgaacctcacgcctggtcagagcggaacagcaacgttcaacatccgacgacgagatctcagctactgggacacggcttcgcagaaatgggtggtgccgtcggggtcgtttggcatcagcgtgggagcgagcagccgggatatcaggctgacgagcactctgtcggtagcgtagcgcgaggagggtgaaggcggttgacctgtgactgtgagtgaggaccgaaggtgggatggcgtgaatactgcaggaatacaatcttcaggataggcatcagagcagtaacatgaatgatgaagacggccgaagcagaagtgaattgaggaggtagtgatgatgaaatgtgagggaagagagatgttcaatcaccttgttcgagggaagctgcaaattgggcctcacgtcatctcgcagagagaaggaactcttgcagcaggagttctgctcactgagaagaaggcccgggttagcgtcgcgcctcttccgcgacatcctccgctccggcactgtgctgtcaaactggcaccaaca

SEQ ID NO: 1182 - DNA, 2852 bp, Thermoascus aurantiacus
tccttttccttcgttccttcgtttttattctgaccatgttcgttgcaatctgataatctgcttgtcggtcgtttcttggtgatcattcaaccatggcttgtgcaatcgccctcactgcagtctctctctttctttcctccgtcttctcttctcccattgacacctctgggaacgtccggcgcgactctgtgccaaccggctatgaatccccgccttactatcccgctccgccgggaggatgggtctcagattgggcccccgcgtacgcaaaggcttatgaggttgtgagcaacatgaccctggccgaaaaggtcaacatgaccaccggaactggcatcttcatggggccctgcgtgggtcagaccggcagcgctctccgttttggcattcccaacctctgtctcatggactcccctctggggatccgcaataccgaccataatacggcctttcctgcgggtatcacggtcggtgcgacgttcgacaaggagctcatgtatgctcgaggagtcgcgctgggcgaagaagcccgtggcaagggcgtcaacgtgctgatgggaccgatggtcggtcccatcggtcgtaagccgcggggaggtcgcaactgggagggcttcggggcggatcctacgctgcaggcaatcgggggagcgcagaccatcaaggggatgcagagcacgggggtcatcgcgacgctgaagcacttcatcggcaacgagcaggagatgtaccgaatgaccagcgtcattcaacgcggatactcgtcaaacatcgatgataggaccttgcacgagctctatctgtggccgtttgcagaaggtgttagggcaggagttggttccgtaatgatggcttataatgatgtaaatgggtctgcgtgcagccagaatagcaagttgatcaacggcattctgaaagatgaactcggctttcaggggtttgtcatgacagattggctgacgcagattggtggcgtctcttccgcgctggcaggcctcgacatggccatgcccggtgacgggcctatcccattgtttggagacagctactgggggtcagagctatcgagagctgtgctcaacgggaccgtaccggtggaccggctgaatgacatggtcactcggatcgtggcgacatggtacaagttcggccaagacaaggacttcccattacccaacttttcatccaacaccgacgctgctaccggtttgctatatcctggagctgttttctcgcccatcggcgtcgttaaccagtttgttgacgttcagggtgaccataaggtcgttgcgagagctattgcaagggatgccatcacgcttctcaagaacgaagataacgcgctaccattgaagcgtaacgattccttgaagattttcggcaccgatgctggtactaaccccgatggcatcaattcatgcgctgataaaggctgcgacaagggagtcttgactatgggatggggaagtggaacatctaaactcccgtacctcaatacgccacaagaagctattgccaatgcatcctcaaacgcagagttcttcgtcacggacagctttccgtcaaacgtcaacgccaacccggaagacatcgcgatcgtgtttataaatgctgattcgggcgaaaattacatcactgttgaaggcaattatggcgaccgttcagctgcagggctctatgcatggcacaacggagacgacctggttaaggcagccgcggcaaagttctcgaaagttgtggtcgtcgtacacactgtcggtccgattatcctggagaattggattgatctcccctcagttaaaagcgtggtcttcgcccatctgccaggtcaggaagcgggggactcccttgttgatgtcctctttggcgactacagccctagcggacatcttccctatacgattccccgtagtgaagaccaatacccttccagtgtcagcctcatcaaccagccctttggtcagatccaggacacctttaccgaaggcctatacatcgactatcgccatttcctgcatgcaaacctcacaccccgatatccatttggccatggactgtcctacaccactttcaacatcaccgaagcgaccatctcagtagtcatccccctgcagagcgagtatccgcccacccgcccgcctaagggcccaacacccacttacaacaacgtcataccgccagcgtccgaagtggcctggccagagaactttgatcgcatatggcgctatatctacccatatctcgataaccctgccgcggcgacgtccacagcgccttacccctacccgacgggctacacgacggtcccgcagccagctccgcgcgcaggtggcgcggagggcgggaaccctgccctttgggacgtcgctttctcggtccgcgtcaaggtcagcaacaccggatctcgcccgggccgtgctgtggcgcagctttacgtcgagcttccctcgtcactgggacttgacacgccgcgcctgcagctgcgacagttcgagaagacaaaaaccttggcgccaggcgagagcgaggtgttgaccatggagctgacccgcaaggacctgagcgtgtgggacgtggtggtgcaggactggaaggcgccgctcaacggacagggtgtcaaggtatggatcggagagagcgtggctgatttgagagtcgtgtgtgaagtcggtcgggagtgtaggaatatttagtgtatactgtatactatattgtgttgtgattcctgagagttaggataccgtgctgggacgatatagttaccttgggtacttatatataatatttagtagtagtatattaacaatatgaataatggtttggaggtccttattagaccttgttttccgtcg

SEQ ID NO: 1183 - protein, 866 aa, Thermoascus aurantiacus
MACAIALTAVSLFLSSVFSSPIDTSGNVRRDSVPTGYESPPYYPAPPGGWVSDWAPAYAKAYEVVSNMTLAEKVNMTTGTGIFMGPCVGQTGSALRFGIPNLCLMDSPLGIRNTDHNTAFPAGITVGATFDKELMYARGVALGEEARGKGVNVLMGPMVGPIGRKPRGGRNWEGFGADPTLQAIGGAQTIKGMQSTGVIATLKHFIGNEQEMYRMTSVIQRGYSSNIDDRTLHELYLWPFAEGVRAGVGSVMMAYNDVNGSACSQNSKLINGILKDELGFQGFVMTDWLTQIGGVSSALAGLDMAMPGDGPIPLFGDSYWGSELSRAVLNGTVPVDRLNDMVTRIVATWYKFGQDKDFPLPNFSSNTDAATGLLYPGAVFSPIGVVNQFVDVQGDHKVVARAIARDAITLLKNEDNALPLKRNDSLKIFGTDAGTNPDGINSCADKGCDKGVLTMGWGSGTSKLPYLNTPQEAIANASSNAEFFVTDSFPSNVNANPEDIAIVFINADSGENYITVEGNYGDRSAAGLYAWHNGDDLVKAAAAKFSKVVVVVHTVGPIILENWIDLPSVKSVVFAHLPGQEAGDSLVDVLFGDYSPSGHLPYTIPRSEDQYPSSVSLINQPFGQIQDTFTEGLYIDYRHFLHANLTPRYPFGHGLSYTTFNITEATISVVIPLQSEYPPTRPPKGPTPTYNNVIPPASEVAWPENFDRIWRYIYPYLDNPAAATSTAPYPYPTGYTTVPQPAPRAGGAEGGNPALWDVAFSVRVKVSNTGSRPGRAVAQLYVELPSSLGLDTPRLQLRQFEKTKTLAPGESEVLTMELTRKDLSVWDVVVQDWKAPLNGQGVKVWIGESVADLRVVCEVGRECRNI

SEQ ID NO: 1184 - DNA, 3125 bp, Thermoascus aurantiacus
gcatgctctgcttcattcttccttccttccttgcttctacccctcttctttccctccagggcatgacaccctcggccttggcttatctgtccttccttttccttcgttccttcgtttttattctgaccatgttcgttgcaatctgataatctgcttgtcggtcgtttcttggtgatcattcaaccatggcttgtgcaatcgccctcactgcagtctctctctttctttcctccgtcttctcttctcccattgacacctctgggaacgtccggcgcgactctgtgccaaccggctatgaatccccgccttactatcccgctccgccgggaggatgggtctcagattgggcccccgcgtacgcaaaggcttatgaggttgtgagcaacatgaccctggccgaaaaggtcaacatgaccaccggaactggcatcttcatggggccctgcgtgggtcagaccggcagcgctctccgttttggcattcccaacctctgtctcatggactcccctctggggatccgcaataccgaccataatacggcctttcctgcgggtatcacggtcggtgcgacgttcgacaaggagctcatgtatgctcgaggagtcgcgctgggcgaagaagcccgtggcaagggcgtcaacgtgctgatgggaccgatggtcggtcccatcggtcgtaagccgcggggaggtcgcaactgggagggcttcggggcggatcctacgctgcaggcaatcgggggagcgcagaccatcaaggggatgcagagcacgggggtcatcgcgacgctgaagcacttcatcggcaacgagcaggagatgtaccgaatgaccagcgtcattcaacgcggatactcgtcaaacatcgatgataggaccttgcacgagctctatctgtggccgtttgcagaaggtgttagggcaggagttggttccgtaatgatggcttataatgatgtatgtatcctactacggggcattttcttgtcgggctgacattccccaggtaaatgggtctgcgtgcagccagaatagcaagttgatcaacggcattctgaaagatgaactcggctttcaggggtttgtcatgacagattggctgacgcagattggtggcgtctcttccgcgctggcaggcctcgacatggccatgcccggtgacgggcctatcccattgtttggagacagctactgggggtcagagctatcgagagctgtgctcaacgggaccgtaccggtggaccggctgaatgacatggtatgcatatgccccagcagcgtatttattccgactatgatgttcttcgttccctgtcattggggacacatgagagctgcctttcattgtgttgcatgcacagcagtctattagcgtattgaagcgctgattgacatacgcaggtcactcggatcgtggcgacatggtacaagttcggccaagacaaggacttcccattacccaacttttcatccaacaccgacgctgctaccggtttgctatatcctggagctgttttctcgcccatcggcgtcgttaaccagtttgttgacgttcagggtgaccataaggtcgttgcgagagctattgcaagggatgccatcacgcttctcaagaacgaagataacgcgctaccattgaagcgtaacgattccttgaagattttcggcaccgatgctggtactaaccccgatggcatcaattcatgcgctgataaaggctgcgacaagggagtcttgactatgggatggggaagtggaacatctaaactcccgtacctcaatacgccacaagaagctattgccaatgcatcctcaaacgcagagttcttcgtcacggacagctttccgtcaaacgtcaacgccaacccggaagacatcgcgatcgtgtttataaatgctgattcgggcgaaaattacatcactgttgaaggcaattatggcgaccgttcagctgcagggctctatgcatggcacaacggagacgacctggttaaggcagccgcggcaaagttctcgaaagttgtggtcgtcgtacacactgtcggtccgattatcctggagaattggattgatctcccctcagttaaaagcgtggtcttcgcccatctgccaggtcaggaagcgggggactcccttgttgatgtcctctttggcgactacagccctagcggacatcttccctatacgattccccgtagtgaagaccaatacccttccagtgtcagcctcatcaaccagccctttggtcagatccaggacacctttaccgaaggcctatacatcgactatcgccatttcctgcatgcaaacctcacaccccgatatccatttggccatggactgtcctacaccactttcaacatcaccgaagcgaccatctcagtagtcatccccctgcagagcgagtatccgcccacccgcccgcctaagggcccaacacccacttacaacaacgtcataccgccagcgtccgaagtggcctggccagagaactttgatcgcatatggcgctatatctacccatatctcgataaccctgccgcggcgacgtccacagcgccttacccctacccgacgggctacacgacggtcccgcagccagctccgcgcgcaggtggcgcggagggcgggaaccctgccctttgggacgtcgctttctcggtccgcgtcaaggtcagcaacaccggatctcgcccgggccgtgctgtggcgcagctttacgtcgagcttccctcgtcactgggacttgacacgccgcgcctgcagctgcgacagttcgagaagacaaaaaccttggcgccaggcgagagcgaggtgttgaccatggagctgacccgcaaggacctgagcgtgtgggacgtggtggtgcaggactggaaggcgccgctcaacggacagggtgtcaaggtatggatcggagagagcgtggctgatttgagagtcgtgtgtgaagtcggtcgggagtgtaggaatatttagtgtatactgtatactatattgtgttgtgattcctgagagttaggataccgtgctgggacgatatagttaccttgggtacttatatataatatttagtagtagtatattaacaatatgaataatggtttggaggtcctattagacctc

SEQ ID NO: 1185 - protein, 866 aa, Thermoascus aurantiacus; identical to SEQ ID NO: 1183

SEQ ID NO: 1186 - DNA, 2812 bp, HYPOCREA JECORINA/TRICHODERMA REESEI
gatcacacccctcccacccttctcttttcaaggttgtccccttctcccacggctttatgtacttcccactctmtaattcgctctttccattccaagccaagcaacatctgtgagcagctcatccttcccaatatgggcgaatggcaggagcagatgatgggttttgacgtggaggatgttctgtctcagctgagccaaaatgagaagattgctctcttgtccggcattgatttctggcatacttatcccataccaaagtacaacgtcccttcagtccgcctaacggacggtcctaacggcatacgaggcacaaagttttttgctggcattcctgctgcctgcctgccatgtgggacggccctggcctctacctgggataagcagctgctgaagaaggctgggaagctgctcggtgatgagtgcatcgcaaaaggcgcccactgctggctgggcccaacaatcaatactccccgatctcctctgggggggcgcggcttcgagtcattttcggaagatccgtacctgtccggcatccttgctgcatctatgattctcggctgtgaaagcacaggtgtcatctctgccgtcaaacactttgtcgccaacgaccaggagcacgagcggcgagcggtcgactgtctcatcacccagcgggctctccgggaggtctatctgcgacccttccagatcgtagcccgagatgcaaggcccggcgcattgatgacatcctacaacaaggtcaatggcaagcacgtcgctgacagcgccgagttccttcagggcattctccggactgagtggaattgggatcctctcattgtcagcgactggtacggcacctacaccactattgatgccatcaaagccggccttgatctcgagatgccgggcgtttcacgatatcgcggcaaatacatcgagtctgctctgcaggcccgtttgctgaagcagtccactatcgatgagcgcgctcgccgcgtgctcaggttcgcccagaaggccagccatctcaaggtctccgaggtagagcaaggccgtgacttcccagaggatcgcgtcctcaaccgtcagatctgcggcagcagcattgtcctactgaagaatgagaactccatcttacctctccccaagtccgtcaagaaggtcgcccttgttggatcccacgtgcgtctaccggctatctcgggaggaggcagcgcctctcttgtcccttactatgccatatctctatacgatgccgtctctgaggtactagccggtgccacgatcacgcacgaggtcggtgcctatgcccaccaaatgctgcccgtcatcgacgcaatgatcagcaacgccgtaatccacttctacaacgaccccatcgatgtcaaagacagaaagctccttggcagtgagaacgtatcgtcgacatcgttccagctcatggattacaacaacatcccaacgctcaacaaggccatgttctggggtactctcgtgggcgagtttatccctaccgccacgggaatttgggaatttggcctcagtgtctttggcactgccgacctttatattgataatgagctcgtgattgaaaatacaacacatcagacgcgtggtaccgcctttttcggaaagggaacgacggaaaaagtcgctaccaggaggatggtggccggcagcacctacaagctgcgtctcgagtttgggtctgccaacacgaccaagatggagacgaccggtgttgtcaactttggcggcggtgccgtacacctgggtgcctgtctcaaggtcgacccacaggagatgattgcgcgggccgtcaaggccgcagccgatgccgactacaccatcatctgcacgggactcagcggcgagtgggagtctgagggttttgaccggcctcacatggacctgccccctggtgtggacaccatgatctcgcaagttcttgacgccgctcccaatgctgtagtcgtcaaccagtcaggcaccccagtgacaatgagctgggctcataaagcaaaggccattgtgcaggcttggtatggtggtaacgagacaggccacggaatctccgatgtgctctttggcaacgtcaacccgtcggggaaactctccctatcgtggccagtcgatgtgaagcacaacccagcatatctcaactacgccagcgttggtggacgggtcttgtatggcgaggatgtttacgttggctacaagttctacgacaaaacggagagggaggttctgtttccttttgggcatggcctgtcttacgctaccttcaagctcccagattctaccgtgaggacggtccccgaaaccttccacccggaccagcccacagtagccattgtcaagatcaagaacacgagcagtgtcccgggcgcccaggtcctgcagctatacatttcggccccaaactcgcctacacatcgcccggtcaaggagctgcacggattcgaaaaggtgtatcttgaagctggcgaggagaaggaggtacaaatacccattgaccagtacgctactagcttctgggacgagattgagagcatgtggaagagcgagaggggcatttatgatgtgcttgtaggattctcgagtcaggaaatctcgggcaaggggaagctgattgtgcctgaaacgcgattctggatggggctgtagattcaacacgtgagcaaaagcgattgcggaaagtaccagaaaagccaagggagtcaaaggatgggaacttgtgtcaatagaagatatgcatgatgggcatttgggatggtgtttggcattatgcaaagaagcaaagatggagtgataaaaaaaaaaaaaaaaa

SEQ ID NO: 1187 - DNA, 2517 bp, HYPOCREA JECORINA/TRICHODERMA REESEI
atgggcgaatggcaggagcagatgatgggttttgacgtggaggatgttctgtctcagctgagccaaaatgagaagattgctctcttgtccggcattgatttctggcatacttatcccataccaaagtacaacgtcccttcagtccgcctaacggacggtcctaacggcatacgaggcacaaagttttttgctggcattcctgctgcctgcctgccatgtgggacggccctggcctctacctgggataagcagctgctgaagaaggctgggaagctgctcggtgatgagtgcatcgcaaaaggcgcccactgctggctgggcccaacaatcaatactccccgatctcctctgggggggcgcggcttcgagtcattttcggaagatccgtacctgtccggcatccttgctgcatctatgattctcggctgtgaaagcacaggtgtcatctctgccgtcaaacactttgtcgccaacgaccaggagcacgagcggcgagcggtcgactgtctcatcacccagcgggctctccgggaggtctatctgcgacccttccagatcgtagcccgagatgcaaggcccggcgcattgatgacatcctacaacaaggtcaatggcaagcacgtcgctgacagcgccgagttccttcagggcattctccggactgagtggaattgggatcctctcattgtcagcgactggtacggcacctacaccactattgatgccatcaaagccggccttgatctcgagatgccgggcgtttcacgatatcgcggcaaatacatcgagtctgctctgcaggcccgtttgctgaagcagtccactatcgatgagcgcgctcgccgcgtgctcaggttcgcccagaaggccagccatctcaaggtctccgaggtagagcaaggccgtgacttcccagaggatcgcgtcctcaaccgtcagatctgcggcagcagcattgtcctactgaagaatgagaactccatcttacctctccccaagtccgtcaagaaggtcgcccttgttggatcccacgtgcgtctaccggctatctcgggaggaggcagcgcctctcttgtcccttactatgccatatctctatacgatgccgtctctgaggtactagccggtgccacgatcacgcacgaggtcggtgcctatgcccaccaaatgctgcccgtcatcgacgcaatgatcagcaacgccgtaatccacttctacaacgaccccatcgatgtcaaagacagaaagctccttggcagtgagaacgtatcgtcgacatcgttccagctcatggattacaacaacatcccaacgctcaacaaggccatgttctggggtactctcgtgggcgagtttatccctaccgccacgggaatttgggaatttggcctcagtgtctttggcactgccgacctttatattgataatgagctcgtgattgaaaatacaacacatcagacgcgtggtaccgcctttttcggaaagggaacgacggaaaaagtcgctaccaggaggatggtggccggcagcacctacaagctgcgtctcgagtttgggtctgccaacacgaccaagatggagacgaccggtgttgtcaactttggcggcggtgccgtacacctgggtgcctgtctcaaggtcgacccacaggagatgattgcgcgggccgtcaaggccgcagccgatgccgactacaccatcatctgcacgggactcagcggcgagtgggagtctgagggttttgaccggcctcacatggacctgccccctggtgtggacaccatgatctcgcaagttcttgacgccgctcccaatgctgtagtcgtcaaccagtcaggcaccccagtgacaatgagctgggctcataaagcaaaggccattgtgcaggcttggtatggtggtaacgagacaggccacggaatctccgatgtgctctttggcaacgtcaacccgtcggggaaactctccctatcgtggccagtcgatgtgaagcacaacccagcatatctcaactacgccagcgttggtggacgggtcttgtatggcgaggatgtttacgttggctacaagttctacgacaaaacggagagggaggttctgtttccttttgggcatggcctgtcttacgctaccttcaagctcccagattctaccgtgaggacggtccccgaaaccttccacccggaccagcccacagtagccattgtcaagatcaagaacacgagcagtgtcccgggcgcccaggtcctgcagctatacatttcggccccaaactcgcctacacatcgcccggtcaaggagctgcacggattcgaaaaggtgtatcttgaagctggcgaggagaaggaggtacaaatacccattgaccagtacgctactagcttctgggacgagattgagagcatgtggaagagcgagaggggcatttatgatgtgcttgtaggattctcgagtcaggaaatctcgggcaaggggaagctgattgtgcctgaaacgcgattctggatggggctgtag

SEQ ID NO: 1188 - DNA, 1872 bp, CHAETOMIUM THERMOPHILUM
ggtttccagggctttgtcatgagcgactggcaggcgcagcacactggtgttgcaagtgctgtggcaggcttggacatgaccatgccaggagatactgtgttcaattcgggtctcagtttttggggagcaaacctcactgttgctgtcctcaatggtacgcttcctgcatatcggctggatgatatggcgatgcgaattatggccgccttcttcaaggttcgcgggacccaggacgttgaccttgaccctatcaacttctcgttctggaccctggacacttacgggccgattcattggggcgcgaaggaaggtcaccaacagatcaacttccacgttgatgttcgggaagatcacagtcgtctgatccgcgagattgctgcgaaaggaacggtgctgttgaagaacgagggtgccttgcccctggacaaacccaagttcttggctgtcattggcgaggatgctggtccaaatcctaatggacccaactcctgtgatgaccgtggttgtgttggggggactcttgctatgggatggggctctggtactgccaatttcccatacctggttacaccggatgcagcactccaagcccaggccattaaggatggctcccggtacgaaagcgtgctgtcgaaccatgctatggagacgatcaggaaggttgtctctcaggacaatgtgacggcagttgtgtttgtcaatgccaactcaggagaagggtacatcaccgttgatggcaataggggagaccgcaacaacctgaccttgtggaacggtggggatgaactaatcaagaacgtggccagctggtgctccaacactatcgttgtcattcattcagttggtcccgttctgcttactgactggtacgaccatccgaacatcactgcaattctatgggccggtcttcctgggcaggagtctggcaatgccatcactgatgtcctgtacggcaaagtgaaccctgctggccgctcgccatttacttggggtgctacacgtgagggttatggagctgatgtcctgtacgatcccgatgatgcaagagtgccgcagcaaaacttcacggagggtgttttcatcgactatcgctactttgacaaacacaatactcgtgtcatctacgaattcggccacggactgagttacacaacctttgagtataggaatctgcaaattcagaagcacaatgtgtccgcatacataccaactaccgggcttacggaaccagcaccgacgttcggtgaacactcgacgaattactctgattatctctacccagaaggcttccaccgtgtcaatcgttacatctacccctacgtgaacagcaccgatcttgagctcgcctccggagacccttactacggccagacagcagaccagttcctgccccctaacgcgacctcttccgacccgcagccactgttgcgctcttcaggaaagaactcgccgggtggtaaccctcagctgtatgatgtgctctacacagtcacggcagatattaccaacacaggcgccctcgagggtgatgaagtcgtgcagctgtacgtatcgctcggcgggcctgatgacccaaaggttatgcttagggacttcgcccggttgcacatcaagcctggtgagacagtcaagtttgaagggaagctgacaaggagagacttaagtacctgggatgttacgctgcaggattgggtgattagggaccatacaaagatggtgtttcttgggaagagcagtcggaagttggtgttgggggctttgctgaattgaagagaatgaaaagagtattagggggatgatcatgggaactgaagggcatagccgcttattagaagaatttgatcttccttataaccgaaaaaaaaaaaaaaa

SEQ ID NO: 1189 - protein, 589 aa, CHAETOMIUM THERMOPHILUM
GFQGFVMSDWQAQHTGVASAVAGLDMTMPGDTVFNSGLSFWGANLTVAVLNGTLPAYRLDDMAMRIMAAFFKVRGTQDVDLDPINFSFWTLDTYGPIHWGAKEGHQQINFHVDVREDHSRLIREIAAKGTVLLKNEGALPLDKPKFLAVIGEDAGPNPNGPNSCDDRGCVGGTLAMGWGSGTANFPYLVTPDAALQAQAIKDGSRYESVLSNHAMETIRKVVSQDNVTAVVFVNANSGEGYITVDGNRGDRNNLTLWNGGDELIKNVASWCSNTIVVIHSVGPVLLTDWYDHPNITAILWAGLPGQESGNAITDVLYGKVNPAGRSPFTWGATREGYGADVLYDPDDARVPQQNFTEGVFIDYRYFDKHNTRVIYEFGHGLSYTTFEYRNLQIQKHNVSAYIPTTGLTEPAPTFGEHSTNYSDYLYPEGFHRVNRYIYPYVNSTDLELASGDPYYGQTADQFLPPNATSSDPQPLLRSSGKNSPGGNPQLYDVLYTVTADITNTGALEGDEVVQLYVSLGGPDDPKVMLRDFARLHIKPGETVKFEGKLTRRDLSTWDVTLQDWVIRDHTKMVFLGKSSRKLVLGALLN

SEQ ID NO: 1190 - DNA, 2583 bp, Aspergillus niger
atgaggttcactttgatcgaggcggtggctctgactgccgtctcgctggccagcgctgatgaattggcctactcccctccgtattacccctccccttgggccaatggccagggtgactgggcggaagcataccagcgcgctgttgatatcgtctcgcagatgacattggctgagaaggtcaatttgactacgggaactggatgggaattggaattatgtgttggtcagactggaggtgttccccgattgggagttccgggaatgtgtgcacaggatagccctctgggtgttcgtgactccgactacaactctgcgttccccgccggtgtcaacgtggccgcaacctgggacaagaatctggcttacctgcgtggccaggctatgggtcaggagtttagtgacaagggtgctgatatccaattgggtccagctgccggccctctcggtagaagtcccgacggcggtcgtaactgggagggcttctcccccgacccggccctcagtggtgtgctctttgcagagacaatcaagggtattcaggatgctggtgtggttgcaacggctaagcactacatcgcctacgagcaggagcatttccgtcaggcgcctgaagctcaaggctacggattcaatattaccgagagtggaagcgcgaacctcgacgataagactatgcatgagctgtacctctggcccttcgcggatgccatccgtgcaggtgccggtgctgtgatgtgctcgtacaaccagatcaacaacagctatggctgccagaacagctacactctgaacaagctgctcaaggctgagctgggtttccagggctttgtcatgagtgattgggcggctcaccatgccggtgtgagtggtgctttggcgggattggacatgtctatgccgggagacgtcgattacgacagtggcacgtcttactggggtaccaacttgaccatcagtgtgctcaacgggacggtgccccaatggcgtgttgatgacatggctgtccgcatcatggccgcctactacaaggtcggccgtgaccgtctgtggactcctcccaacttcagctcatggaccagagatgaatacggcttcaagtactactatgtctcggggggaccgtatgagaaggtcaaccagttcgtgaatgtgcaacgcaaccatagcgagttgatccgccgtattggagcagacagcacggtgctcctcaagaacgatggcgctcttcccttgactggaaaggagcgcttggtcgcccttatcggagaagatgcgggttccaatccttatggtgccaacggctgcagtgaccgtgggtgcgacaatggaacattggcgatgggctggggaagtggcactgccaactttccctacttggtgacccccgagcaggccatctcgaacgaggtgctcaagaacaagaatggcgtattcactgcgaccgataactgggctattgatcagattgaggcgcttgctaagaccgccagtgtctctcttgtctttgtcaacgccgactctggtgagggttatatcaatgtcgacggaaacctgggtgaccgcaggaacctgaccctgtggaggaacggcgacaatgtgatcaaggctgctgctagcaactgcaacaacacgatcgttattattcactctgtcggcccagtcttggttaacgagtggtacgacaaccccaatgttaccgctattctctggggtggtcttcccggtcaggagtctggcaactccctcgccgacgtgctctacggccgtgtcaaccccggtgccaagtcgcccttcacctggggcaagactcgtgaggcctaccaagattacttgtacaccgagcccaacaacggcaacggagcgccccaggaagacttcgtcgagggcgtcttcattgactaccgcggatttgacaagcgcaacgagactcctatctatgagttcggctatggtctgagctacactaccttcaactactcgaaccttcaggtggaggttctgagcgcccctgcgtacgagcctgcttcgggcgagactgaggcagcgccgactttcggagaggtcggaaatgcgtcggattacctctaccccgatggactgcagagaatcaccaagttcatctacccctggctcaacagtaccgatcttgaggcgtcttctggggatgctagctatgggcaggatgcctcagactatcttcccgagggagccaccgatggctctgcgcaaccgatcctgcctgccggtggtggtgctggcggcaaccctcgcctgtacgacgagctcatccgcgtgacggtgactatcaagaacaccggcaaggttgcgggtgataaagttcctcaactgtatgtttctcttggcggccctaacgaacccaagatcgtgctgcgtcaattcgagcgtatcacgctgcagccgtcggaagagacgcagtggagcacgactctgacgcgccgtgaccttgcgaactggaatgttgagacgcaggactgggagattacgtcgtatcccaagatggtgtttgtcggaagctcctcgcggaagctgccgctccgggcgtctctgcctactgttcactaa

SEQ ID NO: 1191 - protein, 860 aa, Aspergillus niger
MRFTLIEAVALTAVSLASADELAYSPPYYPSPWANGQGDWAEAYQRAVDIVSQMTLAEKVNLTTGTGWELELCVGQTGGVPRLGVPGMCAQDSPLGVRDSDYNSAFPAGVNVAATWDKNLAYLRGQAMGQEFSDKGADIQLGPAAGPLGRSPDGGRNWEGFSPDPALSGVLFAETIKGIQDAGVVATAKHYIAYEQEHFRQAPEAQGYGFNITESGSANLDDKTMHELYLWPFADAIRAGAGAVMCSYNQINNSYGCQNSYTLNKLLKAELGFQGFVMSDWAAHHAGVSGALAGLDMSMPGDVDYDSGTSYWGTNLTISVLNGTVPQWRVDDMAVRIMAAYYKVGRDRLWTPPNFSSWTRDEYGFKYYYVSGGPYEKVNQFVNVQRNHSELIRRIGADSTVLLKNDGALPLTGKERLVALIGEDAGSNPYGANGCSDRGCDNGTLAMGWGSGTANFPYLVTPEQAISNEVLKNKNGVFTATDNWAIDQIEALAKTASVSLVFVNADSGEGYINVDGNLGDRRNLTLWRNGDNVIKAAASNCNNTIVIIHSVGPVLVNEWYDNPNVTAILWGGLPGQESGNSLADVLYGRVNPGAKSPFTWGKTREAYQDYLYTEPNNGNGAPQEDFVEGVFIDYRGFDKRNETPIYEFGYGLSYTTFNYSNLQVEVLSAPAYEPASGETEAAPTFGEVGNASDYLYPDGLQRITKFIYPWLNSTDLEASSGDASYGQDASDYLPEGATDGSAQPILPAGGGAGGNPRLYDELIRVTVTIKNTGKVAGDKVPQLYVSLGGPNEPKIVLRQFERITLQPSEETQWSTTLTRRDLANWNVETQDWEITSYPKMVFVGSSSRKLPLRASLPTVH

SEQ ID NO: 1192 - DNA, 179 bp, PICHIA ANOMALA/CANDIDA BEVERWIJKIAE
tccaactggtcaacttccattcactattgctaaagatgttaatgattatatcccagttattgaaaaagttgatgttccagatccagttgacaaatttactgaatctatttgtgttgattacagatattttgataaatacaataaaccagtcagatatgaatttggttatggtttatcta

SEQ ID NO: 1193 - protein, 59 aa, PICHIA ANOMALA/CANDIDA BEVERWIJKIAE
PTGQLPFTIAKDVNDYIPVIEKVDVPDPVDKFTESICVDYRYFDKYNKPVRYEFGYGLS

SEQ ID NO: 1194 - DNA, 179 bp, Hanseniaspora uvarum
tccatctggtcagcttccattcacttggccaaagagaaacgaagataacccagccttcttgaactttgaatcccacatgggtagagttgtttacggtgaagatatctacgttggttacaagtactacgaaaagaagcaaatgcaagttttgattccatttggttatggtttatcctata

SEQ ID NO: 1195 - protein, 59 aa, Hanseniaspora uvarum
PSGQLPFTWPKRNEDNPAFLNFESHMGRVVYGEDIYVGYKYYEKKQMQVLIPFGYGLSY

SEQ ID NO: 1196 - DNA, 2625 bp, HYPOCREA JECORINA/TRICHODERMA REESEI
atgaagacgttgtcagtgtttgctgccgcccttttggcggccgtagctgaggccaatccctacccgcctcctcactccaaccaggcgtactcgcctcctttctacccttcgccatggatggaccccagtgctccaggctgggagcaagcctatgcccaagctaaggagttcgtctcgggcttgactctcttggagaaggtcaacctcaccaccggtgttggctggatgggtgagaagtgcgttggaaacgttggtaccgtgcctcgcttgggcatgcgaagtctttgcatgcaggacggccccctgggtctccgattcaacacgtacaacagcgctttcagcgttggcttgacggccgccgccagctggagccgacacctttgggttgaccgcggtaccgctctgggctccgaggcaaagggcaagggtgtcgatgttcttctcggacccgtggctggccctctcggtcgcaaccccaacggaggccgtaacgtcgagggtttcggctcggatccctatctggcgggtttggctctggccgataccgtgaccggaatccagaacgcgggcaccatcgcctgtgccaagcacttcctcctcaacgagcaggagcatttccgccaggtcggcgaagctaacggttacggataccccatcaccgaggctctgtcttccaacgttgatgacaagacgattcacgaggtgtacggctggcccttccaggatgctgtcaaggctggtgtcgggtccttcatgtgctcgtacaaccaggtcaacaactcgtacgcttgccaaaactccaagctcatcaacggcttgctcaaggaggagtacggtttccaaggctttgtcatgagcgactggcaggcccagcacacgggtgtcgcgtctgctgttgccggtctcgatatgaccatgcctggtgacaccgccttcaacaccggcgcatcctactttggaagcaacctgacgcttgctgttctcaacggcaccgtccccgagtggcgcattgacgacatggtgatgcgtatcatggctcccttcttcaaggtgggcaagacggttgacagcctcattgacaccaactttgattcttggaccaatggcgagtacggctacgttcaggccgccgtcaatgagaactgggagaaggtcaactacggcgtcgatgtccgcgccaaccatgcgaaccacatccgcgaggttggcgccaagggaactgtcatcttcaagaacaacggcatcctgccccttaagaagcccaagttcctgaccgtcattggtgaggatgctggcggcaaccctgccggccccaacggctgcggtgaccgcggctgtgacgacggcactcttgccatggagtggggatctggtactaccaacttcccctacctcgtcacccccgacgcggccctgcagagccaggctctccaggacggcacccgctacgagagcatcctgtccaactacgccatctcgcagacccaggcgctcgtcagccagcccgatgccattgccattgtctttgccaactcggatagcggcgagggctacatcaacgtcgatggcaacgagggcgaccgcaagaacctgacgctgtggaagaacggcgacgatctgatcaagactgttgctgctgtcaaccccaagacgattgtcgtcatccactcgaccggccccgtgattctcaaggactacgccaaccaccccaacatctctgccattctgtgggccggtgctcctggccaggagtctggcaactcgctggtcgacattctgtacggcaagcagagcccgggccgcactcccttcacctggggcccgtcgctggagagctacggagttagtgttatgaccacgcccaacaacggcaacggcgctccccaggataacttcaacgagggcgccttcatcgactaccgctactttgacaaggtggctcccggcaagcctcgcagctcggacaaggctcccacgtacgagtttggcttcggactgtcgtggtcgacgttcaagttctccaacctccacatccagaagaacaatgtcggccccatgagcccgcccaacggcaagacgattgcggctccctctctgggcagcttcagcaagaaccttaaggactatggcttccccaagaacgttcgccgcatcaaggagtttatctacccctacctgagcaccactacctctggcaaggaggcgtcgggtgacgctcactacggccagactgcgaaggagttcctccccgccggtgccctggacggcagccctcagcctcgctctgcggcctctggcgaacccggcggcaaccgccagctgtacgacattctctacaccgtgacggccaccattaccaacacgggctcggtcatggacgacgccgttccccagctgtacctgagccacggcggtcccaacgagccgcccaaggtgctgcgtggcttcgaccgcatcgagcgcattgctcccggccagagcgtcacgttcaaggcagacctgacgcgccgtgacctgtccaactgggacacgaagaagcagcagtgggtcattaccgactaccccaagactgtgtacgtgggcagctcctcgcgcgacctgccgctgagcgcccgcctgccatga

SEQ ID NO: 1197 - DNA, 2785 bp, HYPOCREA JECORINA/TRICHODERMA REESEI
ccacgcgtccgactagttctagatcccgagtaccttggtcgcggcccgttcatcatgaagacgttgtcagtgtttgctgccgcccttttggcggccgtagctgaggccaatccctacccgcctcctcactccaaccaggcgtactcgcctcctttctacccttcgccatggatggaccccagtgctccaggctgggagcaagcctatgcccaagctaaggagttcgtctcgggcttgactctcttggagaaggtcaacctcaccaccggtgttggctggatgggtgagaagtgcgttggaaacgttggtaccgtgcctcgcttgggcatgcgaagtctttgcatgcaggacggccccctgggtctccgattcaacacgtacaacagcgctttcagcgttggcttgacggccgccgccagctggagccgacacctttgggttgaccgcggtaccgctctgggctccgaggcaaagggcaagggtgtcgatgttcttctcggacccgtggctggccctctcggtcgcaaccccaacggaggccgtaacgtcgagggtttcggctcggatccctatctggcgggtttggctctggccgataccgtgaccggaatccagaacgcgggcaccatcgcctgtgccaagcacttcctcctcaacgagcaggagcatttccgccaggtcggcgaagctaacggttacggataccccatcaccgaggctctgtcttccaacgttgatgacaagacgattcacgaggtgtacggctggcccttccaggatgctgtcaaggctggtgtcgggtccttcatgtgctcgtacaaccaggtcaacaactcgtacgcttgccaaaactccaagctcatcaacggcttgctcaaggaggagtacggtttccaaggctttgtcatgagcgactggcaggcccagcacacgggtgtcgcgtctgctgttgccggtctcgatatgaccatgcctggtgacaccgccttcaacaccggcgcatcctactttggaagcaacctgacgcttgctgttctcaacggcaccgtccccgagtggcgcattgacgacatggtgatgcgtatcatggctcccttcttcaaggtgggcaagacggttgacagcctcattgacaccaactttgattcttggaccaatggcgagtacggctacgttcaggccgccgtcaatgagaactgggagaaggtcaactacggcgtcgatgtccgcgccaaccatgcgaaccacatccgcgaggttggcgccaagggaactgtcatcttcaagaacaacggcatcctgccccttaagaagcccaagttcctgaccgtcattggtgaggatgctggcggcaaccctgccggccccaacggctgcggtgaccgcggctgtgacgacggcactcttgccatggagtggggatctggtactaccaacttcccctacctcgtcacccccgacgcggccctgcagagccaggctctccaggacggcacccgctacgagagcatcctgtccaactacgccatctcgcagacccaggcgctcgtcagccagcccgatgccattgccattgtctttgccaactcggatagcggcgagggctacatcaacgtcgatggcaacgagggcgaccgcaagaacctgacgctgtggaagaacggcgacgatctgatcaagactgttgctgctgtcaaccccaagacgattgtcgtcatccactcgaccggccccgtgattctcaaggactacgccaaccaccccaacatctctgccattctgtgggccggtgctcctggccaggagtctggcaactcgctggtcgacattctgtacggcaagcagagcccgggccgcactcccttcacctggggcccgtcgctggagagctacggagttagtgttatgaccacgcccaacaacggcaacggcgctccccaggataacttcaacgagggcgccttcatcgactaccgctactttgacaaggtggctcccggcaagcctcgcagctcggacaaggctcccacgtacgagtttggcttcggactgtcgtggtcgacgttcaagttctccaacctccacatccagaagaacaatgtcggccccatgagcccgcccaacggcaagacgattgcggctccctctctgggcagcttcagcaagaaccttaaggactatggcttccccaagaacgttcgccgcatcaaggagtttatctacccctacctgagcaccactacctctggcaaggaggcgtcgggtgacgctcactacggccagactgcgaaggagttcctccccgccggtgccctggacggcagccctcagcctcgctctgcggcctctggcgaacccggcggcaaccgccagctgtacgacattctctacaccgtgacggccaccattaccaacacgggctcggtcatggacgacgccgttccccagctgtacctgagccacggcggtcccaacgagccgcccaaggtgctgcgtggcttcgaccgcatcgagcgcattgctcccggccagagcgtcacgttcaaggcagacctgacgcgccgtgacctgtccaactgggacacgaagaagcagcagtgggtcattaccgactaccccaagactgtgtacgtgggcagctcctcgcgcgacctgccgctgagcgcccgcctgccatgagggagacaagatgtgacgcgaatgtttagtgtatagataagtattagtattaatcagattaatgaagctyttgaagaaaaaaaaaaaaaaaaaaaaaaaaaaaaaa

SEQ ID NO: 1198 - DNA, 2502 bp, HYPOCREA JECORINA/TRICHODERMA REESEI
atggctgatattgatgttgaggccatcttgaagaagctcaccctggccgagaaggtcgatctgctggctggtatcgacttctggcacacaaaggctctccccaagcatggagtcccctctctccgctttacagatggccccaacggcgtaagagggaccaagttcttcaatggcgtccctgcggcctgcttcccttgcggcacgtcgctcggttccacattcaaccaaactctgctcgaagaggcaggtaagatgatgggcaaagaggccatcgctaagagtgcgcatgtgatcctcggcccgactatcaacatgcaacgctcccctctcggtggacgtggcttcgagtcgattggtgaggatccgttcctggcgggcttgggagctgcggctctcatccgcggcattcagagcactggagtgcaggctacgatcaagcactttttgtgcaatgatcaggaggacaggcgcatgatggtgcagagcatcgtcacggagcgggctctccgtgaaatctacgcactcccgttccagattgctgtgcgagactcccagccgggtgcgttcatgacggcgtacaatggcatcaatggcgtgtcgtgcagcgagaaccctaaatatcttgatgggatgcttcgaaaggaatggggttgggatggcctaatcatgagcgactggtacggcacatacagtaccacagaagccgttgtggcaggcctcgacctcgagatgcccggacctccacgcttccgaggagaaacactcaagttcaacgtctccaacggaaagccctttatccacgtcattgaccagagggctagggaagttcttcagttcgtcaagaagtgtgctgcctccggagtgacggagaacggccccgagacgactgtcaacaacacccccgaaacggcagctctcctccggaaggttggcaacgagggcatcgtgctgctgaagaacgagaacaacgttctgcccttgagcaagaagaagaagacgctgattgtcggccccaacgccaagcaggccacataccacggcggaggctctgccgcactcagggcctactacgcagtcactccctttgacggcctcagcaagcagctcgagacgccgccatcgtacaccgtcggcgcctacaccaccgttcctcccattctaggcgagcagtgcctcacgcccgacggcgctccgggcatgcgctggagggtcttcaacgagccccctggtacccctaaccgccagcacattgacgagctcttcttcaccaagacggacatgcacctggtggactactaccaccccaaggcggcagacacgtggtacgccgacatggagggcacgtacaccgccgacgaggactgcacctacgagctcggcctcgtcgtctgcggcacggcaaaggcgtacgtagacgaccagctcgtcgtcgacaacgccaccaagcaggtccccggcgatgccttcttcggctccgccacccgcgaggagacgggccgcatcaatctcgtcaagggcaacacgtacaagttcaagatcgagttcggctccgcacccacctacaccctcaagggcgacaccatcgtccccggccacggctccctccgcgtcggcggctgcaaggtcattgacgaccaggccgaaatcgaaaagtccgtcgccctcgccaaggagcacgaccaggtcatcatctgcgcgggccttaacgccgactgggagaccgagggcgccgaccgcgcgagcatgaagctccccggcgtgctggaccagctcattgccgacgtggccgccgcgaacccaaacaccgtcgtcgtcatgcagacgggcacccccgaggagatgccctggctcgacgccacgcccgccgtcatccaggcctggtacggcggcaacgagacgggcaactccattgccgacgtcgtctttggcgactacaacccctcgggcaagctgtccctcagcttccccaagcgcctgcaggacaaccccgcgtttctcaacttccgcaccgaggccgggcgcacgctgtacggcgaggacgtctacgtcgggtacaggtactacgagtttgccgacaaggacgtcaatttcccctttggccacggcctgtcctacaccacttttgccttttccaatctctccgtgtctcacaaggacggcaagctgagcgtgtccctctccgtgaagaacaccggctccgtgcccggcgcacaggtggcccagctctacgtcaagcccctccaagcggccaagattaaccgccccgtcaaggagctcaagggcttcgcaaaggtcgaactgcagcccggcgagacgaaggcggtgacaatcgaggagcaggagaagtacgtcgctgcgtattttgatgaggagcgggatcagtggtgtgtcgaaaagggtgactatgaggttatcgtgagcgacagcagcgcagcgaaggatggggttgcgctcaggggtaagtttacggtgggagagacgtattggtggtctggcgtgtaa

SEQ ID NO: 1199 - DNA, 2976 bp, HYPOCREA JECORINA/TRICHODERMA REESEI
ttatagtcgctttgttaaattggcctcgaggtcgacccacgcgtccggctgcttgtcccgttcctgtgcctgatgtctatctgccgttggcctcctcatcctcatctccctgttgtctgtctcctcttagtgcttcagtgacgctaggttcggtcactttgtccccccttcgttgctctggtgtgtccaaggtctaccctgcagtggttttgaacccttgatatcctgcttgagcatccgcgtcgccatatagagcagcatattcttctatctccaaagatcccctcaccgagagttctattcacccgacccttgccttgtcatccagtccttccatcatggctgatattgatgttgaggccatcttgaagaagctcaccctggccgagaaggtcgatctgctggctggtatcgacttctggcacacaaaggctctccccaagcatggagtcccctctctccgctttacagatggccccaacggcgtaagagggaccaagttcttcaatggcgtccctgcggcctgcttcccttgcggcacgtcgctcggttccacattcaaccaaactctgctcgaagaggcaggtaagatgatgggcaaagaggccatcgctaagagtgcgcatgtgatcctcggcccgactatcaacatgcaacgctcccctctcggtggacgtggcttcgagtcgattggtgaggatccgttcctggcgggcttgggagctgcggctctcatccgcggcattcagagcactggagtgcaggctacgatcaagcactttttgtgcaatgatcaggaggacaggcgcatgatggtgcagagcatcgtcacggagcgggctctccgtgaaatctacgcactcccgttccagattgctgtgcgagactcccagccgggtgcgttcatgacggcgtacaatggcatcaatggcgtgtcgtgcagcgagaaccctaaatatcttgatgggatgcttcgaaaggaatggggttgggatggcctaatcatgagcgactggtacggcacatacagtaccacagaagccgttgtggcaggcctcgacctcgagatgcccggacctccacgcttccgaggagaaacactcaagttcaacgtctccaacggaaagccctttatccacgtcattgaccagagggctagggaagttcttcagttcgtcaagaagtgtgctgcctccggagtgacggagaacggccccgagacgactgtcaacaacacccccgaaacggcagctctcctccggaaggttggcaacgagggcatcgtgctgctgaagaacgagaacaacgttctgcccttgagcaagaagaagaagacgctgattgtcggccccaacgccaagcaggccacataccacggcggaggctctgccgcactcagggcctactacgcagtcactccctttgacggcctcagcaagcagctcgagacgccgccatcgtacaccgtcggcgcctacaccaccgttcctcccattctaggcgagcagtgcctcacgcccgacggcgctccgggcatgcgctggagggtcttcaacgagccccctggtacccctaaccgccagcacattgacgagctcttcttcaccaagacggacatgcacctggtggactactaccaccccaaggcggcagacacgtggtacgccgacatggagggcacgtacaccgccgacgaggactgcacctacgagctcggcctcgtcgtctgcggcacggcaaaggcgtacgtagacgaccagctcgtcgtcgacaacgccaccaagcaggtccccggcgatgccttcttcggctccgccacccgcgaggagacgggccgcatcaatctcgtcaagggcaacacgtacaagttcaagatcgagttcggctccgcacccacctacaccctcaagggcgacaccatcgtccccggccacggctccctccgcgtcggcggctgcaaggtcattgacgaccaggccgaaatcgaaaagtccgtcgccctcgccaaggagcacgaccaggtcatcatctgcgcgggccttaacgccgactgggagaccgagggcgccgaccgcgcgagcatgaagctccccggcgtgctggaccagctcattgccgacgtggccgccgcgaacccaaacaccgtcgtcgtcatgcagacgggcacccccgaggagatgccctggctcgacgccacgcccgccgtcatccaggcctggtacggcggcaacgagacgggcaactccattgccgacgtcgtctttggcgactacaacccctcgggcaagctgtccctcagcttccccaagcgcctgcaggacaaccccgcgtttctcaacttccgcaccgaggccgggcgcacgctgtacggcgaggacgtctacgtcgggtacaggtactacgagtttgccgacaaggacgtcaatttcccctttggccacggcctgtcctacaccacttttgccttttccaatctctccgtgtctcacaaggacggcaagctgagcgtgtccctctccgtgaagaacaccggctccgtgcccggcgcacaggtggcccagctctacgtcaagcccctccaagcggccaagattaaccgccccgtcaaggagctcaagggcttcgcaaaggtcgaactgcagcccggcgagacgaaggcggtgacaatcgaggagcaggagaagtacgtcgctgcgtattttgatgaggagcgggatcagtggtgtgtcgaaaagggtgactatgaggttatcgtgagcgacagcagcgcagcgaaggatggggttgcgctcaggggtaagtttacggtgggagagacgtattggtggtctggcgtgtaaagtcgtgcatcatctttggcagattgaatccagtcactttgcatatagcgccgatgaaatgagaaccaacgatcattgtgtaaaaaaaaaaaaaaaaaaaaaaaaaaaaaaaaaaaaaaaaaaaaaaaaaaaaaaa

SEQ ID NO: 1200 - DNA, 1455 bp, HYPOCREA JECORINA/TRICHODERMA REESEI
atgcccgagtcgctagctctgcccaacgactttgaatggggcttcgcaacggccgcctaccagatcgaaggcgccgtcaaagaaggtggccgcggcccgtccatctgggacacgtactgccacctggagccatcgcgcaccaacggcgccaacggcgatgtggcttgcgatcactaccaccgctacgatgaggactttgatctcttgaccaagtacggcgcaaaggcctaccgcttctccttgtcgtggtcgcggatcattcccctcggcggcaggctggatcccgtcaacgaggagggaattgagttttacagcaaactgattgacgccctgttgaggcggggtatcacgccttgggtgactttgtaccactgggatctgcctcaggcgcttcacgatcgctatggaggctggctcaacgtggaagaggtccagctggactttgagcggtatgcgaggttgtgctttgaacgttttggggaccgagtccagaactggatcaccatcaacgawccctggattcaggccatctatggatatgccaccggcagcaacgccccgggcaggagcagcattaacaagcactccaccgagggcaacactgccactgagccgtggctcgctggaaaggcccagatcatgagccatgcccgcgccgtggccgtctacagcagggactttcgcccctcgcaaaagggccagatcggcatctcgctcaacggcgactactatgagccctgggacagcaatgagcctcgggacaaggaggctgctgagcgacggatggaatttcacattggctggtttgccaatcccatcttcttgaagaaggactatccagagagcatgaagaagcagctgggcgagaggcttccagccctcactcccgcggactttgccatcctcaatgccggagagaccgacttctacggcatgaattactacacatcccagttcgcgcgccacctagacggtcccgtccccgagacggactatctcggcgccatccatgagcaccaggagaataaggacggcagccccgttggcgaggagagcggcctcgcctggctgcgctcctgcccggacatgttccggaagcatctcgcccgggtgtacggcctgtacggcaagcccatctacatcaccgagaacggatgcccgtgccctggagaggagaacatgacgtgcgaggaggccgtcaacgaccccttccgcatccgstactttgactcgcacttggactcgatttccaaggccattacccaggacggcgtcgtcgtcaaggggtactttgcgtgggcgttgctcgataacttggaatggtcagatggctacggacccagattcggcgtcacgttcacagactacaccaccctcaagcgcacgcccaagaagtctgccctggtcctcaaggacatgtttgcggcccggcagagggttaaagtggcggcataa

SEQ ID NO: 1201 - DNA, 1991 bp, HYPOCREA JECORINA/TRICHODERMA REESEI
agccaggtcgcaaccagcagcagcagcagcagtacagagaaatcaacccagatagctcaaaatgcccgagtcgctagctctgcccaacgactttgaatggggcttcgcaacggccgcctaccagatcgaaggcgccgtcaaagaaggtggccgcggcccgtccatctgggacacgtactgccacctggagccatcgcgcaccaacggcgccaacggcgatgtggcttgcgatcactaccaccgctacgatgaggactttgatctcttgaccaagtacggcgcaaaggcctaccgcttctccttgtcgtggtcgcggatcattcccctcggcggcaggctggatcccgtcaacgaggagggaattgagttttacagcaaactgattgacgccctgttgaggcggggtatcacgccttgggtgactttgtaccactgggatctgcctcaggcgcttcacgatcgctatggaggctggctcaacgtggaagaggtccagctggactttgagcggtatgcgaggttgtgctttgaacgttttggggaccgagtccagaactggatcaccatcaacgawccctggattcaggccatctatggatatgccaccggcagcaacgccccgggcaggagcagcattaacaagcactccaccgagggcaacactgccactgagccgtggctcgctggaaaggcccagatcatgagccatgcccgcgccgtggccgtctacagcagggactttcgcccctcgcaaaagggccagatcggcatctcgctcaacggcgactactatgagccctgggacagcaatgagcctcgggacaaggaggctgctgagcgacggatggaatttcacattggctggtttgccaatcccatcttcttgaagaaggactatccagagagcatgaagaagcagctgggcgagaggcttccagccctcactcccgcggactttgccatcctcaatgccggagagaccgacttctacggcatgaattactacacatcccagttcgcgcgccacctagacggtcccgtccccgagacggactatctcggcgccatccatgagcaccaggagaataaggacggcagccccgttggcgaggagagcggcctcgcctggctgcgctcctgcccggacatgttccggaagcatctcgcccgggtgtacggcctgtacggcaagcccatctacatcaccgagaacggatgcccgtgccctggagaggagaacatgacgtgcgaggaggccgtcaacgaccccttccgcatccgstactttgactcgcacttggactcgatttccaaggccattacccaggacggcgtcgtcgtcaaggggtactttgcgtgggcgttgctcgataacttggaatggtcagatggctacggacccagattcggcgtcacgttcacagactacaccaccctcaagcgcacgcccaagaagtctgccctggtcctcaaggacatgtttgcggcccggcagagggttaaagtggcggcataaagaaagggaaatttcttcttgcattcagcctctatgcatcttcctctctctttttccctccctccccttgtccctctctctctacctctcatattccctctataccccccgcttcttctcatgaccccatgctccttgcccttggcccctctctgtcgaattctgcctcttatcacgtcttatgcgtctgtttacttgccttttttttttttgtctctttctgtctgtctgtctgcctgtctatgtgtacctatctggcccttcgctcattggcaacagatactagcacaagttcaagcaagcaagcacgcaagcaagcaagcaagccagccatcaacggcatcaaagccccatgtttagcctcatgttcacattgctatgttatctacatcagccattcactaccaggcgaagaggccacagagagtctcatcgtcttacctgtatatacgcttttttaaaaaaaaaaaaaaaa

SEQ ID NO: 1202 - DNA, 3060 bp, Aspergillus fumigatus
atgagattcggttggctcgaggtggccgctctgacggccgcttctgtagccaatgcccaggtttgtgatgctttcccgtcattgtttcggatatagttgacaatagtcatggaaataatcaggaattggctttctctccaccattctacccttcgccttgggctgatggccagggagagtgggcagatgcccatcgacgcgccgtcgagatcgtttctcagatgacactggcggagaaggttaaccttacaacgggtactgggtgggttgcgacttttttgttgacagtgagctttcttcactgaccatctacacagatgggaaatggaccgatgcgtcggtcaaaccggcagcgttcccaggtaagcttgcaattctgcaacaacgtgcaagtgtagttgctaaaacgcggtggtgcagacttggtatcaactggggtctttgtggccaggattcccctttgggtatccgtttctgtgagctatacccgcggagtctttcagtccttgtattatgtgctgatgattgtctctgtatagctgacctcaactccgccttccctgctggtactaatgtcgccgcgacatgggacaagacactcgcctaccttcgtggcaaggccatgggtgaggaattcaacgacaagggcgtggacattttgctggggcctgctgctggtcctctcggcaaatacccggacggcggcagaatctgggaaggcttctctcctgatccggttctcactggtgtacttttcgccgaaactatcaagggtatccaagacgcgggtgtgattgctactgccaagcattacattctgaatgaacaggagcatttccgacaggttggcgaggcccagggatatggttacaacatcacggagacgatcagctccaacgtggatgacaagaccatgcacgagttgtacctttggtgagtagttgacactgcaaatgaggaccttgattgatttgactgacctggaatgcaggccctttgcagatgctgtgcgcggtaagattttccgtagacttgacctcgcgacgaagaaatcgctgacgaaccatcgtagctggcgttggcgctgtcatgtgttcctacaatcaaatcaacaacagctacggttgtcaaaacagtcaaactctcaacaagctcctcaaggctgagctgggcttccaaggcttcgtcatgagtgactggagcgctcaccacagcggtgtcggcgctgccctcgctgggttggatatgtcgatgcctggagacatttccttcgacgacggactctccttctggggcacgaacctaactgtcagtgttcttaacggcaccgttccagcctggcgtgtcgatgacatggctgttcgtatcatgaccgcgtactacaaggttggtcgtgaccgtcttcgtattccccctaacttcagctcctggacccgggatgagtacggctgggagcattctgctgtctccgagggagcctggaccaaggtgaacgacttcgtcaatgtgcagcgcagtcactctcagatcatccgtgagattggtgccgctagtacagtgctcttgaagaacacgggtgctcttcctttgaccggcaaggaggttaaagtgggtgttctcggtgaagacgctggttccaacccgtggggtgctaacggctgccccgaccgcggctgtgataacggcactcttgctatggcctggggtagtggtactgccaacttcccttaccttgtcacccccgagcaggctatccagcgagaggtcatcagcaacggcggcaatgtctttgctgtgactgataacggggctctcagccagatggcagatgttgcatctcaatccaggtgagtgcgggctcttagaaaaagaacgttctctgaatgaagttttttaaccattgcgaacagcgtgtctttggtgtttgtcaacgccgactctggagagggtttcatcagtgtcgacggcaacgagggtgaccgcaaaaatctcactctgtggaagaacggcgaggccgtcattgacactgttgtcagccactgcaacaacacgattgtggttattcacagtgttgggcccgtcttgatcgaccggtggtatgataaccccaacgtcactgccatcatctgggccggcttgcccggtcaggagagtggcaactccctggtcgacgtgctctatggccgcgtcaaccccagcgccaagaccccgttcacctggggcaagactcgggagtcttacggggctcccttgctcaccgagcctaacaatggcaatggtgctccccaggatgatttcaacgagggcgtcttcattgactaccgtcactttgacaagcgcaatgagacccccatttatgagtttggccatggcttgagctacaccacctttggttactctcaccttcgggttcaggccctcaatagttcgagttcggcatatgtcccgactagcggagagaccaagcctgcgccaacctatggtgagatcggtagtgccgccgactacctgtatcccgagggtctcaaaagaattaccaagtttatttacccttggctcaactcgaccgacctcgaggattcttctgacgacccgaactacggctgggaggactcggagtacattcccgaaggcgctagggatgggtctcctcaacccctcctgaaggctggcggcgctcctggtggtaaccctaccctttatcaggatcttgttagggtgtcggccaccataaccaacactggtaacgtcgccggttatgaagtccctcaattggtgagtgacccgcatgttccttgcgttgcaatttggctaactcgcttctagtatgtttcactgggcggaccgaacgagcctcgggtcgttctgcgcaagttcgaccgaatcttcctggctcctggggagcaaaaggtttggaccacgactcttaaccgtcgtgatctcgccaattgggatgtggaggctcaggactgggtcatcacaaagtaccccaagaaagtgcacgtcggcagctcctcgcgtaagctgcctctgagagcgcctctgccccgtgtctactag

SEQ ID NO: 1203 - DNA, 2306 bp, Piromyces sp. E2; identical to SEQ ID NO: 1134

SEQ ID NO: 1204 - protein, 664 aa, Piromyces sp. E2; identical to SEQ ID NO: 1135

SEQ ID NO: 1205 - DNA, 2577 bp, Aspergillus avenaceus
atgaagctttccattttggaggcagcagctttgacagctgcctccgtagtcagcgcacaggacgatctcgcatactccccgccgtactacccttctccctgggccgatggccacggtgagtggtcgaacgcgtacaagcgcgctgtagatatcgtctctcagatgacattgacggagaaggtcaatctcaccaccggtactggatgggagttggagaggtgtgtcggtcagacgggcagtgtccctagactgggaatcccaagcctctgtctgcaggatagccctctgggtattcgcatgtcggactataactcggccttccctgcgggtattaacgttgcggccacctgggacaagaagcttgcctaccaacgcggcaaggcaatgggcgaggaattcagtgacaagggtattgatgttcagttgggccctgctgccggtcctcttggcaggtcccccgatggaggccgaaactgggagggcttctctcctgatccctgcctgactggtgtgtgttcgccgagacgatcaagggtatccaggaccgccggagttattgctaccggaagcactacattcctcaatgagcaagagcatttccgccaggtcgccgaagcccagggctatggcttcaacatcaccgaaaccgtgagctcaaatgtggatgacaagaccatgcacgagctgtatctctggcccttcgccgatgcggtgcgcgcgggcgtgggcgctgtgatgtgctcctacaaccagatcaacaacagctatggatgccaaaacagtctaaccctgaacaagctcttgaaagccgaactcggatttcagggatttgtcatgagtgactggagtgctcaccacagcggtgttggcgccgccttggctggtttggacatgtccatgccgggagatatcagtttcgacagcggcacttccttctatggcacgaacctgactgttggcgtcctcaacggcaccattccccagtggcgtgtggatgacatggccgtccggatcatggctgcctactacaaggttggccgcgaccgtctctggtctcctcccaatttcagctcgtggactcgcgatgaatatggcttcgcgcacttcttcccttccgaaggcgcttatgaacgtgtcaatgaattcgtcaacgtgcagcgtgaccatgcccaggtgatccgtcggattggcgcggatagtgtcgtgctcttgaagaacaacggtgcccttcccttgacgggccaggagaagactgttggcattctgggcgaagacgccgggtcgaatccgaagggagcaaatggttgcagtgaccgtggctgtgacaagggtactctggccatggcttggggtagtggtactgccaacttcccttaccttgtgactcccgaacaggccattcagaacgaggttctgaagggccgtggaaatgtctttgccgtgacggacaactatgatacacagcagattgccgccgttgcctctcaatccacggtttcattggttttcgtgaacgcagacgccggtgaaggtttccttaatgtggacggaaacatgggtgatcgcaagaacctcaccctctggcagaacggagaggaagtgatcaagactgtcacggagcactgcaacaacaccgttgttatccattcggtgggacctgttctcgtcgatgagtggtatgcgcaccccaatgtcaccggcattctgtgggctggtctcccgggccaggagtctggcaacgccattgcggacgtgctgtacggccgcgtcaaccctggcggcaagaccccctttacctggggtaagacgcgcgcgtcctacggcgactacctcctcaccgagcccaacaacggcaacggtgctcctcaagacaacttcaacgagggcgtgtttattgactaccgtcgcttcgacaagtacaatgagacgcccatctacgagttcggtcatggtatgagctacacgacttttgagctgtctggcctccaggtccagcttatcaacggatccagctatgttcccactacgggtcagacggccgccgcccaggcatttggtaaagtcgaggacgcgtctagctacctgtacccggagggactgaagaggatttccaagttcatctatccctggctgaactctaccgatcttaaagcgtctaccggcgatccttacggagagcccaacttcgagtatattcctgaaggtgctaccgatggctctcctcagccccgtctgcctgccagcgggggtcctggcggcaaccccggtctctacgaggacctgttccaggtttctgtgaccatcaccaacaccggcaaggttgccggtgatgctgtccctcagctgtatgtttcgctgggtggccccaacgagccgaagcgggtgctgcgcaagttcgagcgcctgcacatcgcccctggtcagcaaaaggtctggacgactaccctgaaccgccgtgacctagccaactgggatgtcgtggcccaggactggaagactccctatgctaagaccatctttgttggcacctcttcgcgcaagctgcctctcgctggtcgcttgccacgggtgcagtaa

SEQ ID NO: 1206 - protein, 858 aa, Aspergillus avenaceus
MKLSILEAAALTAASVVSAQDDLAYSPPYYPSPWADGHGEWSNAYKRAVDIVSQMTLTEKVNLTTGTGWELERCVGQTGSVPRLGIPSLCLQDSPLGIRMSDYNSAFPAGINVAATWDKKLAYQRGKAMGEEFSDKGIDVQLGPAAGPLGRSPDGGRNWEGFSPDPCLTGVCSPRRSRVSRTAGVIATGSTTFLNEQEHFRQVAEAQGYGFNITETVSSNVDDKTMHELYLWPFADAVRAGVGAVMCSYNQINNSYGCQNSLTLNKLLKAELGFQGFVMSDWSAHHSGVGAALAGLDMSMPGDISFDSGTSFYGTNLTVGVLNGTIPQWRVDDMAVRIMAAYYKVGRDRLWSPPNFSSWTRDEYGFAHFFPSEGAYERVNEFVNVQRDHAQVIRRIGADSVVLLKNNGALPLTGQEKTVGILGEDAGSNPKGANGCSDRGCDKGTLAMAWGSGTANFPYLVTPEQAIQNEVLKGRGNVFAVTDNYDTQQIAAVASQSTVSLVFVNADAGEGFLNVDGNMGDRKNLTLWQNGEEVIKTVTEHCNNTVVIHSVGPVLVDEWYAHPNVTGILWAGLPGQESGNAIADVLYGRVNPGGKTPFTWGKTRASYGDYLLTEPNNGNGAPQDNFNEGVFIDYRRFDKYNETPIYEFGHGMSYTTFELSGLQVQLINGSSYVPTTGQTAAAQAFGKVEDASSYLYPEGLKRISKFIYPWLNSTDLKASTGDPYGEPNFEYIPEGATDGSPQPRLPASGGPGGNPGLYEDLFQVSVTITNTGKVAGDAVPQLYVSLGGPNEPKRVLRKFERLHIAPGQQKVWTTTLNRRDLANWDVVAQDWKTPYAKTIFVGTSSRKLPLAGRLPRVQ

SEQ ID NO: 1207 - DNA, 3018 bp, Phaeosphaeria avenaria
atggcgctagcttcaaccctggtcgcattctttgtgacgcaagttcttgggcaacaggtcagtaacatttctattccacgtcgagtcgctgcgaaaagcgcaccaaagctgcagacatgttgccggacctggcgaactttgtcgttgcgctgttcccattcttacgcgctgtaaaatcccacgtgtaggctttgtttgcgtagcccgagctgactgtaaacagtatcctaccagcaacacatcgtctcccgcggccaactcgtcgagtcctttggacaacgcggtcagcccgccattttaccccagcccgtaagtaacactcgcttcgagaattgacagctttgttgcgggaacgtgtggagtggtacgcttctgcaaatgcggagaccccacactcgcctgcgcatgtcaaacggacgtccccacagccgtcccaagcaacatcaactcgacttgctctcttcgaagcacgactaacgcccgccagatggatcgaaggtcttggtgactgggaagcggcgtaccagaaggcgcaggctttcgtcagccaactcactcttctcgagaaggtcaacctcacaaccggcacaggatggcagagcgaccactgtgtcggcaacactggaggtgtgccacgtttaaacttcacaggcatctgtaaccaggatgctcctctgggcgttcgcttcgccgattacgtctctgccttcccatctgggggcaccatcgccgcagcatgggaccgtggcgagtggtatcttcgaggataccagatgggctcagagcaccgtagcaagggtgtagacgttcagcttggcccagtcgtcggccctctcggccgcaaccccaagggcggagtaagcaataaaatcttaagagacgtcatctaggctaacattcacgcagcgcaactgggagggcttctctcctgacccctacctgtccggtattgcttctgccgaatcagtccgcggaattcaggatgctggagtcattgcctgcacgaagcactacatcatgaacgaacaggagcatttccgccagcccggcaacttcgaggaccagggctttgttgatgccctcagctccaacctcgacgacaagactctgcacgagctctacctctggcctttcgccgatgccgtccgcgccggcactggatccatcatgtgcagctacaacaaggtcaacaactcgcaggcttgccagaactcttacctgcagaactacattctcaagggcgagcttggcttccagggtttcatcatgtcagattgggatgcgcagcactctggtgttgcgtccacctttgctggactcgacatgaccatgcccggtgacactgacttcaactctggcaagactttctggggtaccaacttcacaacctccattctcaacggaaccgtgccacaatggcgtctcgacgatgctgtcacgcgtatcatggccgccttctattatgtcggccgtgacaaggctcgcattcctgtcaacttcgacagctggtcgcgcgatacctacggtttcgaccattactatggcaaggcaggctacagccagatcaattcgcatgtcgatgttcgtgccgaccacttccgcagcattcgccgcaccgccgccatgtcgaccgtgctcttgaagaacgagggcgccctgcctcttacgggtagcgagaagtggactgcagtatttggtgacgacgctggcgatggtcagttgggacctaacggcttccccgaccatggcggtaacaacggcaccttggccatgggctggggctccggaacatctgactacccttacctcgtgacgccattggagtccattaaagccactgtcgcccagaacggcggcgttgtcacctctgtcaccgacaactgggcatacactcagatccagaccctggctaagcaggctagcgtagccatcgtcttcgtcaacgccgattccggagagggctacattactgtcgacggcaatgctggtgaccgcaacaacctgaccctctggcaggatggcgacaccttgatcaaaaacgtttcctcgctctgcaacaacaccatcgtggtcatccactcagtgggccctgtcctcgtcaactccttctacgacagcgagaacgtcaccgccatcctttgggcgggtttgcctgggcaagagtctggtaacgccattgctgacatcctttacggtcgccacaaccccggtggcaagctgcccttcaccattggtagcgacgcagccgagtatggaccggacctcatctacgagcccaccaacaacagcagcagcccacaagacaacttcgaggagggtgtcttcatcgactaccgtgcctttgacaagcagaacgtcactcccatttacgagtttggcttcggtctgtcatacaccaagttctcgtactcgaacctcacagtcaagaaggccaacgctggcgcatacactcctgcaactggccagtccaaggctgccccgaccctgggcaacttcagcacggatgcttcgcaataccagtggcccagcgacttcacctacgttgacacgttcatctacccctacctgaactctacggacctgaagacggcctcccaggatcccgaatacggccttgactacacttggcccgcgggtgcaaccgatggtaccccacaggcccgcattccagccggtggcgcgcctggaggcaaccctcagctttgggatgttctcttctccgttgaggctaccatcaccaacaatggtacactgcctggtgacgaggtcgtgcagctgtacgtcagcctgggtaacccagacgaccccaagatcgtcctccgtggctttgaccgtctctccatccagcccggcaagacggccactttccacgccgacatcactcgccgtgatgtgtccaactgggacgtcgccagccagaactgggtcatcacctcggcacccaagacggtatacgtcggtgcctcttcgaggaagctgccgctcacggcgactcttgacactagcgacttccagtag

SEQ ID NO: 1208 - protein, 874 aa, Phaeosphaeria avenaria
MALASTLVAFFVTQVLGQQYPTSNTSSPAANSSSPLDNAVSPPFYPSPWIEGLGDWEAAYQKAQAFVSQLTLLEKVNLTTGTGWQSDHCVGNTGGVPRLNFTGICNQDAPLGVRFADYVSAFPSGGTIAAAWDRGEWYLRGYQMGSEHRSKGVDVQLGPVVGPLGRNPKGGRNWEGFSPDPYLSGIASAESVRGIQDAGVIACTKHYIMNEQEHFRQPGNFEDQGFVDALSSNLDDKTLHELYLWPFADAVRAGTGSIMCSYNKVNNSQACQNSYLQNYILKGELGFQGFIMSDWDAQHSGVASTFAGLDMTMPGDTDFNSGKTFWGTNFTTSILNGTVPQWRLDDAVTRIMAAFYYVGRDKARIPVNFDSWSRDTYGFDHYYGKAGYSQINSHVDVRADHFRSIRRTAAMSTVLLKNEGALPLTGSEKWTAVFGDDAGDGQLGPNGFPDHGGNNGTLAMGWGSGTSDYPYLVTPLESIKATVAQNGGVVTSVTDNWAYTQIQTLAKQASVAIVFVNADSGEGYITVDGNAGDRNNLTLWQDGDTLIKNVSSLCNNTIVVIHSVGPVLVNSFYDSENVTAILWAGLPGQESGNAIADILYGRHNPGGKLPFTIGSDAAEYGPDLIYEPTNNSSSPQDNFEEGVFIDYRAFDKQNVTPIYEFGFGLSYTKFSYSNLTVKKANAGAYTPATGQSKAAPTLGNFSTDASQYQWPSDFTYVDTFIYPYLNSTDLKTASQDPEYGLDYTWPAGATDGTPQARIPAGGAPGGNPQLWDVLFSVEATITNNGTLPGDEVVQLYVSLGNPDDPKIVLRGFDRLSIQPGKTATFHADITRRDVSNWDVASQNWVITSAPKTVYVGASSRKLPLTATLDTSDFQ

SEQ ID NO: 1209 - DNA, 3019 bp, Phaeosphaeria nodorum
atggcgctagcttcatccctggtcgcattcttcgcgacgcaggttcttgcgcaacaggtcagtaacatttttattccacgtcgagtcgccacgaaaagcgtatcaaagctgcagacatgttaccggagctggcgaactttgtcgtcgcgctgtttccattcttacgcgctgtataatcccacgtgcatgctttgtttgtgtagcctgagctgaccgtaaacagtatcctaccagcaacacatccactcccgcggccaactcgtcgagtcctttggacaacgcggttagtccgccgttttaccccagcccgtaagtaaactccgctttgacatttgacagctttggtttgggagaggctggagtggtacgcttctgcaaatgcggagaccccacactcgcctgcgcatgtcaaacagacgtccccacaaccgtccccagcaacaccaactcgacttgtcctctttccagtggagctaacatcggccagatggatcgaaggtctcggcgactgggaagcggcgtaccaaaaggcgcaggcttttgttagccaactcactcttctcgagaaggtcaacctcacaaccggcacaggatggcagagcgaccactgcgtcggcaacactggaggcgtgccacgattgaacttcacaggcatctgtaaccaagacgctcctctgggcgttcgcttcgccgactacgtctctgccttcccatctggtggcaccatcgccgcagcatgggaccgtggcgagtggtaccttcgaggataccagatgggctcagagcaccgtgacaagggtgtagacgtccagcttggccctgtcgtcggtcctcttggccgcaaccccaagggcggagtcagtaaaacccccacaaaagttaaatcgttaggctaacatcgatgcagcgtaactgggaaggtttctctcccgacccctacctgtccggaattgccgtcgccgaatcggtccgcggtattcaggatgctggtgttattgcctgcacaaagcactacatcatgaacgagcaggagcatttccgccagcccggcaacttcgaggaccagggctttgttgatgctctcagctccaacctcgacgacaagactttgcacgagctctacctctggcctttcgccgacgctgtccgcgccggcactggttctatcatgtgcagctacaacaaggtcaacaactcgcaggcttgccagaactcgtacttgcagaactacattctcaagggcgagcttggcttccagggttttatcatgtcggattgggatgcccagcactctggtgttgcgtccacctttgctggactcgatatgaccatgcctggtgatactgacttcaactctggcaaaactttctggggtaccaactttacaacttctatcttgaacggaaccgtgccccagtggcgtctcgacgatgctgtcacgcgtatcatggctgccttctactatgtcggccgcgacaaggcccgcactcctgtcaacttcgacagctggtcgcgcgatacctacggtttcgatcatttctatggcaaggcaggttacagtcagattaaccagcacgtcgatgtccgtgccgaccacttccgcagcattcgccgcaccgctgccatgtccaccgtgctcttgaagaacgagggcgccctgcctcttacgggtagtgagaagtggactgccgtctttggtgacgatgctggcgagggccagctgggacctaacggcttccccgaccacggcggtaacaacggcaccttggccatgggctggggttcaggaacatctgactacccttacctcgtgaccccattggagtccatcaaagctactgtcggccagaacggaggcgttgtcacctctgtaaccgacaactgggcgtacactcagatccagaccttggctaagcaggctagcgtagccatcgtcttcgtcaatgccgattctggagagggctacatcactgtcgacggcaatgctggtgaccgcaacaacctgaccctctggcaggatggcgacaccttgatcaagaacgtgtcctcggtctgcaacaacactatcgtggttattcactcagttggacctgtcctcgtcaactccttttacgacagcgaaaacgtcaccgctatcctttgggctggtctgcctggccaagagtctggtaacgctattgctgacatcctttacggtcgccacaaccccggtggcaagctgcccttcaccattggcagcgacgcagccgagtacggaccggacctcatctacgagcccactaacaacagcagcagcccacaagacaacttcgaggagggcgtcttcatcgactaccgtgcctttgacaaacagaacgtcactcccatctacgagtttggcttcggtctgtcatacaccaagttctcgtactcgaacctcacagtgaagaaggccaacgctggcgcatacactccaaccactggccagagcaaggctgccccgaccctaggcaatttcagcaccgatgcttcgcagtaccaatggccaagcgacttcacctacgtgaacacgttcatctacccctacttgaactctactgatctgaagacggcctcccaggatcccgaatacggtctaaactacacttggcccgcgggtgcaaccgatggcaccccacaagcccgcattccagccggtggtgcgcctggaggtaaccctcagctttgggacgttctgttcagcgttgaggctaccatcaccaacaatggtaccctgcctggtgacgaggtcgtgcagctgtacgtcagcctgggtaacccagacgaccccaagatcgtcctacgtggctttgaccgtctctctattcagcccggcaagacggccactttccacgctgacatcactcgccgtgatgtgtccaactgggatgtcgccagccagaactgggtcatcacctcagcacccaagacggtatacgtcggtgcatcctcgaggaagctgccgctcacggcgactcttgacaccagcgacttccagtag

SEQ ID NO: 1210 - protein, 874 aa, Phaeosphaeria nodorum
MALASSLVAFFATQVLAQQYPTSNTSTPAANSSSPLDNAVSPPFYPSPWIEGLGDWEAAYQKAQAFVSQLTLLEKVNLTTGTGWQSDHCVGNTGGVPRLNFTGICNQDAPLGVRFADYVSAFPSGGTIAAAWDRGEWYLRGYQMGSEHRDKGVDVQLGPVVGPLGRNPKGGRNWEGFSPDPYLSGIAVAESVRGIQDAGVIACTKHYIMNEQEHFRQPGNFEDQGFVDALSSNLDDKTLHELYLWPFADAVRAGTGSIMCSYNKVNNSQACQNSYLQNYILKGELGFQGFIMSDWDAQHSGVASTFAGLDMTMPGDTDFNSGKTFWGTNFTTSILNGTVPQWRLDDAVTRIMAAFYYVGRDKARTPVNFDSWSRDTYGFDHFYGKAGYSQINQHVDVRADHFRSIRRTAAMSTVLLKNEGALPLTGSEKWTAVFGDDAGEGQLGPNGFPDHGGNNGTLAMGWGSGTSDYPYLVTPLESIKATVGQNGGVVTSVTDNWAYTQIQTLAKQASVAIVFVNADSGEGYITVDGNAGDRNNLTLWQDGDTLIKNVSSVCNNTIVVIHSVGPVLVNSFYDSENVTAILWAGLPGQESGNAIADILYGRHNPGGKLPFTIGSDAAEYGPDLIYEPTNNSSSPQDNFEEGVFIDYRAFDKQNVTPIYEFGFGLSYTKFSYSNLTVKKANAGAYTPTTGQSKAAPTLGNFSTDASQYQWPSDFTYVNTFIYPYLNSTDLKTASQDPEYGLNYTWPAGATDGTPQARIPAGGAPGGNPQLWDVLFSVEATITNNGTLPGDEVVQLYVSLGNPDDPKIVLRGFDRLSIQPGKTATFHADITRRDVSNWDVASQNWVITSAPKTVYVGASSRKLPLTATLDTSDFQ

SEQ ID NO: 1211 - DNA, 2409 bp, Phanerochaete chrysosporium
cagtccggcctgtatcaacaatgtggcggtatcggatggactggtgcgactacttgcgtcagcggcgcgacctgcacagtgctgaacccatactactcgcaatgtctccctggcgccgccaccacgagtgtttcgtctagtcattcgtcaagtagcagcgtcagcagccactccagcagtgcaagcagcagcagcataagttccactagcaccagccccccggcgccctcccagaccgtggcgaacgtgtcgccagaatgggccgccgcttacgtcaaggcacaagctgctgtagcaaagctatcggtgactgatatggtcaacctcgcgacaggtgtacagtgggagaaaggtccatgtgtcggcaacacccctgctatctcgtctatacccggcttcactggactttgcctccaagacagtcccgttggtgtccgttatgctgacggcacctccgtcttcccacctgaaatcaatgtcgctgctacatggaaccgtacgcttatgcgccaacgcggagctgcaatgggcgcggagttcaagggaaaaggcgtacacgtcgccctcggacccatgatgaacctcatgcgtgtccccgctgctggccgaaactgggaaggtggcggaggcgatccgttcctttctggtgagcttgctttcgagaccatcactggcattcagtcctccggtgcccaggcttgtgcgaagcacttcatcaacaatgagcaagagcattttcgggactccagttcgtccaacgtcgatgacaggacggagcatgaactctacggacaccctttcctccgcagtgtccaggcaaacgtcgcatccgtgatgtgcagctacaaccaaatcaacggaactttctcttgcgagaacgagaagaccttgtccggacttctcaagggagagtacgggttccaaggctacgttatgtctgactggtgggccacccactctggcgcacccgctgtgaacgcaggcctcgatatgactatgccgggtgacgagaccaccaactccggaacaacctacttcggacagaaccttgttaacgcagtgaacagcggccaagtttcgcaggccaggattaaggacatggcgactcgcatccttgcggcgtggtacctccttggccaagaccaaaacttccccgcggtcaacttcaactcgtggaactctggtcagggccagcatgtgaacgtctccggcaaccacgcgagcctcatccgcaccatcggcgcggcctcgcaaatcctactcaagaatgtgaacggtgcgctgccgctcaagaagcccaagaccattggcatcattggcaacggtgctggatcaaatcctagcggtcccaacgctttctctgaccgcgccggagacgtcggtgtcctcgcgcttgggtggggcagtggcactgcgaacttcccgtacttggtcgcacccgtcgacgcgattactgctcgtgcgtcgcaagatgggacgaccgtgtcgtcatcactaagtgacaccgacctgacgggcgctgctaacaccgcgaccgggaaggacgtcgcgatggtgttcatcacggccgacagcggtgaaggataccttactgtcgagggcaatgcaggcgaccgtaacgacctccaggcatggcacggaggtgatgcgctggttcagcaggtcgcgagccacaacaagaacacgatcgtcgtgatcaacagtgtcggacctatcaatatggaagcctgggtcaaccacccgaacgtcaccgctattgtttggagtggcctccctggtcaggaagcaggcaacgcggtcactgacgttctatttggcgcggtcaaccctggcggcaagctgcccttcaccatcggcaagtcgatcagcgactactccgcgcagatcatcaccaccggctcgggcatcgtgcccatcccgtacaacgagggcctcttcatcgactaccggcactttgaccaggcgggcatcgcaccgcgattcgagttcgggttcggcctctcgtacacgacgttcgactactcgaacctcgtcatcacgggctcgacagccgggggcacgcgtcagcccccggggcccggctcgtcgctcgacccatggctgcacgactcggtcgtcaccgtgtccttcacgctgacgaacaacggcacggtcgacgggacggaggtgccgcagctgtacctgagcccgcccacgagcgcgaaaagtgcgccacagaacctgaagggcttcgacagcgggttcctccccgcaggcgcgtcgacgacggtctccttcgagctctcgcggtactcgttctccgtgtgggacgtcgtctcccagagctggcagatccctgctggtgtcaccggcatctccgtgggcgcgagcagcagagatttgcgcctcaagggctcaatcacgaactga

SEQ ID NO: 1212 - protein, 802 aa, Phanerochaete chrysosporium
QSGLYQQCGGIGWTGATTCVSGATCTVLNPYYSQCLPGAATTSVSSSHSSSSSVSSHSSSASSSSISSTSTSPPAPSQTVANVSPEWAAAYVKAQAAVAKLSVTDMVNLATGVQWEKGPCVGNTPAISSIPGFTGLCLQDSPVGVRYADGTSVFPPEINVAATWNRTLMRQRGAAMGAEFKGKGVHVALGPMMNLMRVPAAGRNWEGGGGDPFLSGELAFETITGIQSSGAQACAKHFINNEQEHFRDSSSSNVDDRTEHELYGHPFLRSVQANVASVMCSYNQINGTFSCENEKTLSGLLKGEYGFQGYVMSDWWATHSGAPAVNAGLDMTMPGDETTNSGTTYFGQNLVNAVNSGQVSQARIKDMATRILAAWYLLGQDQNFPAVNFNSWNSGQGQHVNVSGNHASLIRTIGAASQILLKNVNGALPLKKPKTIGIIGNGAGSNPSGPNAFSDRAGDVGVLALGWGSGTANFPYLVAPVDAITARASQDGTTVSSSLSDTDLTGAANTATGKDVAMVFITADSGEGYLTVEGNAGDRNDLQAWHGGDALVQQVASHNKNTIVVINSVGPINMEAWVNHPNVTAIVWSGLPGQEAGNAVTDVLFGAVNPGGKLPFTIGKSISDYSAQIITTGSGIVPIPYNEGLFIDYRHFDQAGIAPRFEFGFGLSYTTFDYSNLVITGSTAGGTRQPPGPGSSLDPWLHDSVVTVSFTLTNNGTVDGTEVPQLYLSPPTSAKSAPQNLKGFDSGFLPAGASTTVSFELSRYSFSVWDVVSQSWQIPAGVTGISVGASSRDLRLKGSITN

SEQ ID NO: 1213 - DNA, 1263 bp, Candida albicans
ttatcaatgagattttcacaagctactgttttagcctttgcagctttatcgttagctgctccagcttttgaagctgacaataaaaacatcaaaagagaagattgtgacaaaacttcttttcatggtcaccacaaacataagagagctgttgcttacgactacgcttatgttaccgttactgttgatgggaacggtaatcctgtcactactgtcagtccagttctttctattgaaacaattgctaaatccgaagaaacttcatctacttcaacttcaatttcttcaactaccaccatcgttcaaaatgattcattgacttctgatgaaccaaaaaccctttcccttccatctggtactattaaaccatcctcatctgccaccgaatctcaatctcaatctcaatcatcttcaactggtggttctggttctggttctaccaatggtattgaaggtgatttggcagcttttgaagatccaactgaagaattccaagacggcgttttatcttgtagtgatttcccttcaggtcaaggtgtcattcctttagatcacttaggttttggtggttggtccggtattgaaaactccgatggttctaccggtggtaattgtaaagagggttcttactgttcttatgcttgccaaagtggtatgtccaagactcaatggccagaagatcaaccaagtaacggtgtttccattggtggattattgtgtaagaatggtaaattatacaaatccagtaccagatccaattacttatgtgaatggggtgtcaagaaagctaatgttgtcaacaaattgagtgaaactgttgccatttgtagaactgattacccaggtactgaaaatatggttattccaaccgttgttggaggtggtagtacttctgtcattaccgttgttgatcaaagtacttattacacttggagaggtggtgctacttctgctcaatattacgtcaacaatgccggtgtttcttgggaagatggttgtgtttggggtactccaggttccggtgttggtaactgggctccattgaattttggtgctggttatgctaatggtattgcttacttgtccttgattccaaatccaaacaaccgtgattcattgaatttcaaagtcaaaattgttggtgaatcaggctctaccgttagtggatcatgttcttatgcaaacggtaaattcaacggtaatagtgatgacggttgtaccgttggtgttacttctggtgaagctgactttgtcttgtataattag

SEQ ID NO: 1214 - DNA, 1677 bp, Piromyces sp. E2
  misc_feature (904)..(904): n is a, c, g, or t
gaattcacagtttacgttggtaagagtgctggtgatcttccacttaagaaagctattaagaatactcaaggtacgaacgaatctagctcttcagttggtgatgaaaacaacaataatccaaacaacaacgctgactgcagtgtaaatggatacaagtgctgttctaactctaatgctgaagttgtttacactgatggtgatggtaattggggtgttgaaaatggtaattggtgtattattaaggaacaacaacaacaacaaacttgtttcagtattaaattaggttatccatgttgtaaaggtaatgaagtagcttacactgataatgatggtcaatggggctttgaaaatggtcaatggtgtggtattgcaactgcaacttctggtgctggtggttgcccatacacttcaaagaatggttacccagtctgtcaaacaactactaaagttgaatacgttgactcagataaatggggtgttgaaaatggtaactggtgtattatgtgcaactaaatagaataaataattgacatattttttataataaagtaaataaaattgtatacataattttgtaaatgtataaaagtgatgtaataaaataaaataaaatatatttattattaaaaaaaaaaaagaataaataataaaaaaaaaatataaaaataaaagtaaaatatattaaaataaatttaaagaaataataattaaaaaaatagtaaaataaaggagaattaaaaataaatttaaagaaataataattaataagaaaaaatgagaaggataaaaaaaaaataataatataataaaaaaaaaaaaaaaaagtcacatcaaaaataaaaaaaaaattaaagaattaaaatttaaatattaaataatatgaaattttttattttaatttaangcattcttttttttttttttttttttttttatattctcacgaaacttaaatgcttagggattcgcggtaaaagttataagtttcattgaaaacttatatcttacctcgaaagcttgtatcaaaaaggaaaacttatattctgactcgtttaaagtaatgaaaggtgttcggcaaggttgtcctttatctccaattctttttaatctctttattaatgatgtttttaaagattgcgaaaaatttggagttaatattgaaggtgaaaattgttgtggtggtctttttgctgatgatattgttttatgtgcacctacaatgtataatttaaaaaagttattaaaacgtgtcaatagatgggctattgaaaacaatatgactttcggtatcaataagtgtgcaactatggtggttcgtcctgataagcgcgatgaacaaggtagaagagatcctacattttatcttggtaataaagaaattccaaaaacaaattgttatacgtacctaggtattccttttgataacactctttctcttaaacctgttatcaactctatgaataacaaagtaagaaaagcattatttaaggttagaggttttcttaaaaatccattaattcctattccctttaaaagatcagttatttcttcagttgtgcttggtattgttgcttattatgctcctttacttggatccaataaatcaagaacaaatggaactcaacaattggttaacaaaggtctctactggattagtggatctaaaaataggaattc

SEQ ID NO: 1215 - protein, 170 aa, Piromyces sp. E2
EFTVYVGKSAGDLPLKKAIKNTQGTNESSSSVGDENNNNPNNNADCSVNGYKCCSNSNAEVVYTDGDGNWGVENGNWCIIKEQQQQQTCFSIKLGYPCCKGNEVAYTDNDGQWGFENGQWCGIATATSGAGGCPYTSKNGYPVCQTTTKVEYVDSDKWGVENGNWCIMCN

SEQ ID NO: 1216 - DNA, 1590 bp, Trichoderma viride
aggagttgcgtgtttgtctttttcaaagagcttggtcattgacacgctttgtttttatctcgaacttgcttacggtccgaagcacgaacaacaacaagacggagaacaaagagaagaggaagaagaagaagaagaaggaagaagaaggaaaagaagaaagaaagaaggaaaaaaacagagagacggcaagcatgttgcccaaggactttcagtgggggttcgccacggctgcctaccagatcgagggcgccgtcgaccaggacggccgcggccccagcatctgggacacgttctgcgcgcagcccggcaagatcgccgacggctcgtcgggcgtgacggcgtgcgactcgtacaaccgcacggccgaggacattgcgctgctcaagtcgctcggggccaagagctaccgcttctccatctcgtggtcgcgcatcatccccgagggcggccgcggcgatgccgtcaaccaggcgggcatcgaccactacgtcaagttcgtcaacgacctgctcgacgccggcatcacgcccttcatcaccctcttccactgggacctgcccgagggcctgcatcagcggtacggggggctgctgaaccgcaccgagttcccgctcgactttgaaaactacgcccgcgtcatgttcagggcgctgcccaaggtgcgcaactggatcaccttcaacgagccgctgtgctcggccatcccgggctacggctccggcaccttcgcccccggccggcagagcacctcggagccgtggaccgtcggccacaacatcctcgtcgcccacggccgcgccgtcaaggcgtaccgcgacgacttcaagcccgccagcggcgacggccagatcggcatcgtcctcaacggcgacttcacctacccctgggacgccgccgacccggccgacaaggaggcggccgagcggcgcctcgagttcttcacggcctggttcgcggatcccatctacttgggcgactacccggcgtcgatgcgcaagcagctgggcgaccggctgccgacctttacgcccgaggagcgcgccctcgtccacggctccaacgacttttacggcatgaaccactacacgtccaactacatccgccaccgcagctcgcccgcctcgacgacaccgtcggcaacgtcgacgtgctcttcaccaacaagcagggcaactgcatcggccccgagacgcagtccccccttggcccctgtgcgccctgccgcgacttcctggtgtggatcagcaagaggtacctacccgcccatctacgtgacggagaacggcacgagcatcaagggcgagagcgacttgcccaaggagaagattctcgaagatgacttcagggtcaagtactataacgagtacatccgtgccatggttaccgccgtggagctggacggggtcaacgtcaaggggtactttgcctggtcgctcatggacaactttgagtgggcggacggctacgtgacgaggtttggggttacgtatgtggattatgagaatgggcagaagcgttccccaagaagagcgcaaagagcttgaagccgctgtttgacgagctgattgcggcggcgtgaggaaaaagttt

SEQ ID NO: 1217 - protein, 450 aa, Trichoderma viride
MLPKDFQWGFATAAYQIEGAVDQDGRGPSIWDTFCAQPGKIADGSSGVTACDSYNRTAEDIALLKSLGAKSYRFSISWSRIIPEGGRGDAVNQAGIDHYVKFVNDLLDAGITPFITLFHWDLPEGLHQRYGGLLNRTEFPLDFENYARVMFRALPKVRNWITFNEPLCSAIPGYGSGTFAPGRQSTSEPWTVGHNILVAHGRAVKAYRDDFKPASGDGQIGIVLNGDFTYPWDAADPADKEAAERRLEFFTAWFADPIYLGDYPASMRKQLGDRLPTFTPEERALVHGSNDFYGMNHYTSNYIRHRSSPASTTPSATSTCSSPTSRATASAPRRSPPLAPVRPAATSWCGSARGTYPPIYVTENGTSIKGESDLPKEKILEDDFRVKYYNEYIRAMVTAVELDGVNVKGYFAWSLMDNFEWADGYVTRFGVTYVDYENGQKRSPRRAQRA

SEQ ID NO: 1218 - DNA, 4157 bp, TALAROMYCES EMERSONII
tggcaactgattggattacttggctgattgaacctggtggcaaggccctggaagcgcgacttagacggccggagtaagccgtctccggaatgtacggtagcattccattcagtgcaatgcgggggtgtcggccgacccatggaagagagaacttggaagaatgtgctcctttgctactgttacacctgtcagcgaggcttgccccgctgccactgactcgggcgtgatgcaggaattaattattaggatttaggacgcgtcttccgtaattattaattactattttcccgatggaggcacttgccacaagtttcgcctgcgattcctccgtctcccgttctggcagctacggccaagaaaggtgatttgagtgagccttgcgccgtacctgctggttttgtcagccctagcgccggccgccttccccaggcaacgctttacgcttccccctgcaagtcgcggggaagctgcgaaccagaggtcccgtcgtgcctgcccatggaagtttctgctggagagcaatttcagagcaattttcatctcctcaccggacatccagccaatgacacggcgtgttcttgcagctcccagtccacccggtggatgcgtgttattctggacagcttgacacacacgcatgctccatcgtcaagaggaacttgcccagtagccgccttccgagtcccagcgtctccaccgcgttcccacggccgatcggccatatgatctcagtcccgtcaggatgtgttgtaaatgtaataatcctggtcgatcgtcctccgaccatgggctgccgttctcgatctgttcgggcagacgccattcgggacccaagcctcctgctaccggccctactagtggctcagggccactggggaccgaccctctttcccgtgtgtcggagcttgctgcccttgttggcctgcccgtttctttttataaagagcccgctgtccctccctgcgtctggaagaagacgtcagctctcctctgtgcctgacttcttgttaccttgttccctcgccgctggaagagcacgatgaggaacgggttgctcaaggtcgccgcccttgcggccgcgtccgccgtcaatggcgaggtacgtgcactctacgcccatgcatggagaattcgtcttttctctaaccgtccacaatagaacctggcgtattcacctcccttctacccttcgccgtgggccaatggacagggcgactgggcagaggcctaccagaaggccgtccagtttgtgtcccaactcaccctggccgagaaggtcaacctgaccaccggaactgggtaccgttgactgatgaaacctttggatccacgccatgttcggactgctgacattgtcaaagttgggagcaggaccgatgtgtcggtcaagtgggtagcatcccaaggtatgttgattcagtcccgatccggtcgtgggatctgactggactgtcaattaggctgggtttccctggactttgcatgcaggactctccgctgggcgttcgagacagtatgcttgttcatccccgcagtatctcgagcatgtgctaatgcgtttccgcaacagctgactacaactcggccttccctgccggtgtcaatgtcgctgctacctgggaccggaatctcgcctaccgtcgcggcgtagcgatgggcgaggagcatcgcggcaaaggtgtcgacgtgcagctgggccctgtggccggcccgctgggcaggtctcccgatgcgggcagaaactgggaaggtttcgccccggatcccgtgctgaccggaaacatgatggcgtcaaccatccagggtattcaagatgctggcgtcattgcttgcgccaagcatttcatcctctacgagcaggagcacttccgtcaaggcgctcaggacggctatgatatctccgacagtatcagtgccaacgctgacgacaagacgatgcacgagttgtacttgtggcccttcgccgatgctgttcgcgcgggcgtcggttccgtcatgtgctcctacaaccaggtgaacaacagctatgcctgctccaacagctacaccatgaacaagctgctcaagagcgagctcggtttccaaggcttcgtcatgaccgactggggtggccaccacagtggtgtgggttccgccctcgctggtttggatatgtcgatgcccggagacattgccttcgacagtggcacttccttctggggcacgaacctgaccgtcgccgtgctcaatggcagtattcccgagtggcgtgttgatgacatggctgtccgtatcatgtcggcttactacaaagtcggccgcgaccgctacagcgtccccatcaactttgactcgtggaccctggatacctatggtcctgagcactatgcggtgggccagggccagaccaagattaacgagcacgttgatgtccgcggcaaccacgccgaaatcatccacgaaatcggtgctgccagcgccgtccttcttaagaacaagggtggccttcctttgacgggcaccgagcggtttgtcggtgttttcggaaaggatgccggatccaacccctggggtgtgaacggctgcagtgaccgaggctgcgacaatggtacattggccatgggctggggcagtggtactgctaacttcccctatctggtgacgccggagcaggcgatccagagagaagtcttgtcccgaaacggaaccttcaccggcatcacggacaatggcgctcttgctgagatggcggcagccgcttctcaggccgagtaagtatttccgctgtcctcgagctctctaaaggacgtgactgacccgttcatagtacttgtctggtcttcgccaacgccgactccggtgaaggttacatcaccgtcgacggcaatgagggtgaccggaagaatctgaccctgtggcaaggggcggatcaggtcatccacaacgtctctgccaactgcaacaacaccgtcgtggtgttgcacactgtcggccccgttttgatcgatgattggtatgaccaccccaacgtcacggccattctctgggctggtcttccgggccaggagagcggtaactcgctcgtcgatgtcctctacggccgggtcaaccctggtaagactccgttcacttggggacgcgcccgggacgattacggtgcgcctttgatcgtcaagccgaacaatggcaagggcgccccgcagcaggactttactgagggtatcttcatcgactaccgtcggtttgacaagtacaacatcacccccatctacgagttcggattcggtctgagctacactacctttgagttctctcagctcaatgtgcagccgatcaatgcgccgccgtacactcctgcctccggcttcaccaaggcagcgcagtctttcggccagccttccaacgcttcggacaacctgtaccccagcgacatcgagcgggtcccgttgtacatctacccatggctcaactccaccgatttgaaggcgtccgccaatgaccctgactatgggttgcctacggagaagtacgttcctcccaacgccacgaacggcgacccgcagcccattgacccggctggcggtgctcctggtggcaacccgagtctgtatgagcctgttgctcgggtcaccaccatcatcaccaacaccggtaaggttacgggtgacgaggttcctcaactggtaagtgtcccaacattggttgctggaggtcccttttactgacttcaactcaagtacgtctctcttggcggtcccgatgacgctcccaaggttcttcgtggcttcgaccgtatcacccttgcgcctggtcagcagtacttgtggacgaccaccctgacgaggcgcgacatctcgaactgggaccctgtcacccagaactgggtcgtgaccaactataccaagacgatttatgttggcaactcgtcccgcaacctgcctttgcaggcgccccttaagccataccctggaatttaaggtaactatgtaccgcgactggaagtttttgttgaacctatctcgccattccatctcttgacatgtgtgaaagatcatatacggcgatatacggcaaattttgggatctcctccttagagaggagtgtacatctttcagttttctttccttgtctaaattagctcttatatagcgtttaatatacggcttttaaggggtag

SEQ ID NO: 1219 - protein, 857 aa, TALAROMYCES EMERSONII
MRNGLLKVAALAAASAVNGENLAYSPPFYPSPWANGQGDWAEAYQKAVQFVSQLTLAEKVNLTTGTGWEQDRCVGQVGSIPRLGFPGLCMQDSPLGVRDTDYNSAFPAGVNVAATWDRNLAYRRGVAMGEEHRGKGVDVQLGPVAGPLGRSPDAGRNWEGFAPDPVLTGNMMASTIQGIQDAGVIACAKHFILYEQEHFRQGAQDGYDISDSISANADDKTMHELYLWPFADAVRAGVGSVMCSYNQVNNSYACSNSYTMNKLLKSELGFQGFVMTDWGGHHSGVGSALAGLDMSMPGDIAFDSGTSFWGTNLTVAVLNGSIPEWRVDDMAVRIMSAYYKVGRDRYSVPINFDSWTLDTYGPEHYAVGQGQTKINEHVDVRGNHAEIIHEIGAASAVLLKNKGGLPLTGTERFVGVFGKDAGSNPWGVNGCSDRGCDNGTLAMGWGSGTANFPYLVTPEQAIQREVLSRNGTFTGITDNGALAEMAAAASQADTCLVFANADSGEGYITVDGNEGDRKNLTLWQGADQVIHNVSANCNNTVVVLHTVGPVLIDDWYDHPNVTAILWAGLPGQESGNSLVDVLYGRVNPGKTPFTWGRARDDYGAPLIVKPNNGKGAPQQDFTEGIFIDYRRFDKYNITPIYEFGFGLSYTTFEFSQLNVQPINAPPYTPASGFTKAAQSFGQPSNASDNLYPSDIERVPLYIYPWLNSTDLKASANDPDYGLPTEKYVPPNATNGDPQPIDPAGGAPGGNPSLYEPVARVTTIITNTGKVTGDEVPQLYVSLGGPDDAPKVLRGFDRITLAPGQQYLWTTTLTRRDISNWDPVTQNWVVTNYTKTIYVGNSSRNLPLQAPLKPYPGI

SEQ ID NO: 1220 - DNA, 2514 bp, DEBARYOMYCES HANSENII/CANDIDA FAMATA
atgtccgaattcaatatcgagagcaccttagctcagttaacacttcaagaaaaaatcggtttacttgccggtatcgatttctggcacacatttgctgttgaaagattgaatattccaagcctcaggttcagtgatggacctaatggtttgagaggaacaaaattttttgatagtgttccatctgcttgttttccatgtggaacggcattggctgctacttttgacaaggaattattatttgaagctggtcgtttaatgggagacgaagccaaacacaagggcgcacaagttgttttgggtccaacaattaatatccaaagaggtcctttaggtggtagaggttttgagtcgtttagtgaagatgcacatttaacagggcaaagtgcagcttcgattataaatggtattcaagacaagggaatcgttgctacaatcaagcattttgtttgtaatgacttggaggatcaacgtaattctagtgattctattcttactgaaagagctttgagagagatttatttagagccattcagacttgccatcaagcactcaaaccctgtggcattaatgaccagttataataaggtaaacggagagcatgcttcacaatcagaaagattgattcaagatattttacgtaaagagtggggttgggatggtactaccatgtctgactggtacggtacctataccagtaaggatgcaatcgaaaatggattagatattgaaatgcctggtccttcaatctttagaaatcaatccgaagtggctgctatggtgactaccaaggaattacacattaagaagattgatgaaagagtcacaaatgttcttaagttaattaagtatgcactcaaatcaggtattcctgaaaatgcaccggagacttcgaatggtaatacaccagagactgctgctcttttaagaaaacttgctcatgattctgttgtcttacttaaaaatgataacgaaatcttacctttaagtaaggatgataaaatagccgttattggacctaatgcaaagtttgccgcctactgtggtggaggatccgcatccttgagagcttattatacaactaccccgtttgattctatttcaaaaaaattaaataaagatccagaatacactattggtgcttatggacacaggttattaccagcattaggacctcaattggtcaatccaaaaaccggaaaagctggttacaatttgaaatattaccttgagccaaaatctacttcggaaagaacattaatagatgaaagggatttagatttatcacacattttcttggtggactactacaacaaagaaataaaggatgacttattctatattgacttcgacggtcagtttacgcccgaagaaacagctgattatgaatttggtattgctgttcttggtacagcccaattgtttgttgacggtaaattggttgttgacaacaagacggtccaacaaagaggtaactccttcttcaatagtgggtctaatgaagttagaaattctatttacttagagaaaggtaagacttactccattaaaattgagtttggctccggtcctacatttaccgtgccttctcacgattctgtcagttttggtggtggtggtggtatcaacttgggagttgctaaggtaattaatccagaagatgaaatagcgaaggctgcagaacttgctaaaaaagtagacaaggtggtcttaaatattgggttaaatcaagaatgggaatcagaagggtttgatcgtccagacatgaaattaattggccacatcaacaaattagttgatgcagtattagatgccaatccaaataccgttgttgtcaaccaatctggtactccagttgagttcccatggatcaaaaaagcgaatgcattagttcaagcatggtatggtggtaatgaattaggcaatggtatagctgatgtcttattcggtgatgttaacccaagtggtaagttatctctctcgttccctgtcaagaatgttgataatccagcttatcttaacttcaaaactgagaagggtagagttttatatggtgaagacattttcgttggttacaaatactatgagaaacttgaaagagaagtggccttcccatttggttttggtttgtcctacaccaagtttgatatttctgattcgaaggtctccgttgatgaaaaagatgatagtttaacagtatctgtgaacgttaaaaacacaggtaaaattgatggttcagaagttgttcaagtctatatatcgaaagatgaaagtgatgtaatcagacccgtaaaagaattaaagggattcgaaaaggtaaatttgaaggccggtgctgattccaccgtttcattgaaattgtctttgaaggattcgatttctttctttgacgagtaccaagatgaatggtcagttgaaaagggtgactacaaggttcatgttggtaacagtagtgataatattacttcaattttgccttttaagattgaaaagggcttcttatggtcaggcatgtaa

SEQ ID NO: 1221 - DNA, 2514 bp, DEBARYOMYCES HANSENII/CANDIDA FAMATA; identical to SEQ ID NO: 1220

SEQ ID NO: 1222 - DNA, 2577 bp, Acremonium chrysogenum
atgatcacaatgcggaacagtttattgatttcgcttgctgcggcagcacttgccgagggcaaggcatactctcctcccgcataccctgctccctgggccagcggcgccggggaatgggctcaagctcatcaaagagctgtcgagttcgtctcgcaattgaccttggccgaaaaaataaacttgacgaccggtgttggctgggagggagggcaatgtgtcggcaacactggaagcattccccgtttgggcttccgcagcctctgcatgcaggattcaccactcggtgtgagagacactgattataatactgccttccctgctggagtcaatgtcgccgctacttgggatctcgatcttgcctaccggcgcggtatagccatggccgaagaacaccgtggcaaaggtgtggacgtgcaacttggtcccgttgctggtccgctaggaagagtaccagagggtggccgtaactgggaaggtttcgcgccggaccctgtgttgactggtcagatgatggcaagcactatccaaggcatgcaggataccggtgtgattgcttgcgcaaagcactatattggaaacgaacaagagcacttccgtcagggctctcaggagaacttcaccgttgctgatgctatcagctcgaacattgatgacgttactttgcacgaattgtacctgtggccgtttgccgatgcggttagggcaggtgtcggttccgtcatgtgttcttacaatcaaataaataacagctactcctgcggcaacagctacaccctgaaccacatcctcaagggtgaactcgacttccaaggatttgtaatgaccgattggagtgctcaacactctggtgtcggcgatgctcttgccggagctgacatggatatgcctggtgatgtggctttcgacagtggaactgctttctggggtaccaacttgacaattgccgtgctcaatggcactgttcccgaatggcgtattgacgacatggctgttcgtatcatgtctgctttctacaaggttggtcgtgatcgtacccaggtccccatcaacttcgctagctggaccttggatacctatggcaacgaatactactacgccggcgagggctacaaggaaatcaaccagcacgttgatgtgcgtggtgaccacgccaaagtcgtccgtgaaatcggcagtgccagcattgttctcctcaagaacgttgatggtgctcttccattgactggctcggagaagtttgtcgcagtatttggagaggacgtaggctccaaccccgatggtgtcaatggctgctctgaccgtggctgtgataacggtaccttggccatgggatggggtagtggtactgccaacttcccttacttggtcacccctgaacaagctatccaggccgaagtcgtgaagaacggcggtatgtttactgctattaccgacagcggcgccaccgatacagccaagaccgtggctgctcaagcttcggcttgcctagtgtttgccaatgcagactccggagaaggatacatcaccgttgacggcaatgtgggagatcgtaagaacttgacattgtggcagaacggtgaagctatgatctcggccgtcgcaggtaactgcaacaacaccattgtcgttcttcatactgttggacccgttcttgtcgaggactgggtgcaccaccctaacatcactgctgttttgtgggctggtctgcctggagagcagagcggtaactccttggttgatgttctctacggcagtgtcaacccgggaggcaagactcctttcacctggggcaagcaacgttctgattggggagttgatgtcatctacgaacccaacaatggagacggcgctcctcagcaggacttcactgagggtatcttcattgattaccgacactttgacaaatacaacattacccccacctacgaattcggttatggtctcagctacagcaccttctcattctcagacctcaaggtgactcctatcgctgcttctccttaccgaccagccaagggtcagagcggtccggcacctgtgctaggcaaggttttgaacgccacggcctatctgttccctgactacatcaaacgcattgaagcgttcatttacccatggctcaactccactgatcttaagacttcctctggtgatccaaactacggctggccaacttccaagtacgtgcctgacggcgctcaagacgggtctccacaacctgtcaaccccgccggtggtgctcctggtggtaaccctgctctgtatgaccctgttgccgaagtcactgtcaccgtcaagaacactggaaaggtcgctggtgtcgaagtgccccaactctatgtttcgctcggtggtccctccgatgcacccaaggttcttcgtggctttggccgtctttctctcggcgctggcgaggagactcaatggactgccactttgacccgacgtgacgtatctaactgggacactatcagacagaactgggttgtcacaaactacaccaagactgtttacgttggcaactcttctcgcaacttgccgctccagcagactttggctctcaacattggacactaa

SEQ ID NO: 1223 - DNA, 2171 bp, HYPOCREA JECORINA/TRICHODERMA REESEI
agtacttgcatcttagtctcttcaaaggttgcaaacagccaccctccccatgcaacttgtcccttgggtaaaatggtcatggccagctggctaaatgcgcaggtacatactaataatctgcacacagttgagccatccgggaaaatgcagggtctatcgcaatcagcagcccatcattgtatgtatttctccatgttaattttccgaaagttgggggtggtggtgagggggcgttgtctataatgtgtgtaccttatatatatatatccggggaccaacgaacacgctattctcttgtctgtgtctgtcctctgatttaggaagaggattctgcatgcctgagttggagttgattatctgagtgaggagttgcgtgtttgtctttttcaaagagcttggtcattgacacgctttgtttttatctcgaacttgcttacggtccgaagcacgaacaacaacaagacggagaacaaagagaagaggaagaagaagaagaagaaggaagaagaaggaaaagaagaaagaaagaaggaaaaaaaccgagagacggcaagcatgttgcccaaggactttcagtgggggttcgccacggctgcgtacgttgttgcatcatgctcccttcaaacgccccccccctgatagtccatctcacttacacccgtccgacagctaccagatcgagggcgccgtcgaccaggacggccgcggccccagcatctgggacacgttctgcgcgcagcccggcaagatcgccgacggctcgtcgggcgtgacggcgtgcgactcgtacaaccgcacggccgaggacattgcgctgctcaagtcgctcggggccaagagctaccgcttctccatctcgtggtcgcgcatcatccccgagggcggccgcggcgatgccgtcaaccaggcgggcatcgaccactacgtcaagttcgtcgacgacctgctcgacgccggcatcacgcccttcatcaccctcttccactgggacctgcccgagggcctgcatcagcggtacggggggctgctgaaccgcaccgagttcccgctcgactttgaaaactacgcccgcgtcatgttcagggcgctgcccaaggtgcgcaactggatcaccttcaacgagccgctgtgctcggccatcccgggctacggctccggcaccttcgcccccggccggcagagcacctcggagccgtggaccgtcggccacaacatcctcgtcgcccacggccgcgccgtcaaggcgtaccgcgacgacttcaagcccgccagcggcgacggccagatcggcatcgtcctcaacggcgacttcacctacccctgggacgccgccgacccggccgacaaggaggcggccgagcggcgcctcgagttcttcacggcctggttcgcggatcccatctacttgggcgactacccggcgtcgatgcgcaagcagctgggcgaccggctgccgacctttacgcccgaggagcgcgccctcgtccacggctccaacgacttttacggcatgaaccactacacgtccaactacatccgccaccgcagctcgcccgcctccgccgacgacaccgtcggcaacgtcgacgtgctcttcaccaacaagcagggcaactgcatcggccccgagacgcagtccccctggctgcgcccctgtgccgccggcttccgcgacttcctggtgtggatcagcaagaggtacggctacccgcccatctacgtgacggagaacggcacgagcatcaagggcgagagcgacttgcccaaggagaagattctcgaagatgacttcagggtcaagtactataacgagtacatccgtgccatggttaccgccgtggagctggacggggtcaacgtcaaggggtactttgcctggtcgctcatggacaactttgagtgggcggacggctacgtgacgaggtttggggttacgtatgtggattatgagaatgggcagaagcggttccccaagaagagcgcaaagagcttgaagccgctgtttgacgagctgattgcggcggcgtgatggaaaaagtttttgagttgatgatacctgcaaagggatgctgaagatgatgatgatgtatgaacacgaaagggatagtattatagcaagctaggataacctgatgcttcttcaaaggggaaattgatatataaacatgcat

SEQ ID NO: 1224 - protein, 466 aa, HYPOCREA JECORINA/TRICHODERMA REESEI
MLPKDFQWGFATAAYQIEGAVDQDGRGPSIWDTFCAQPGKIADGSSGVTACDSYNRTAEDIALLKSLGAKSYRFSISWSRIIPEGGRGDAVNQAGIDHYVKFVDDLLDAGITPFITLFHWDLPEGLHQRYGGLLNRTEFPLDFENYARVMFRALPKVRNWITFNEPLCSAIPGYGSGTFAPGRQSTSEPWTVGHNILVAHGRAVKAYRDDFKPASGDGQIGIVLNGDFTYPWDAADPADKEAAERRLEFFTAWFADPIYLGDYPASMRKQLGDRLPTFTPEERALVHGSNDFYGMNHYTSNYIRHRSSPASADDTVGNVDVLFTNKQGNCIGPETQSPWLRPCAAGFRDFLVWISKRYGYPPIYVTENGTSIKGESDLPKEKILEDDFRVKYYNEYIRAMVTAVELDGVNVKGYFAWSLMDNFEWADGYVTRFGVTYVDYENGQKRFPKKSAKSLKPLFDELIAAA

SEQ ID NO: 1225 - DNA, 1900 bp, HUMICOLA GRISEA VAR. THERMOIDEA
gtcgacggtccgaaacacgcgggagaatggggtgcggaagaagcccggaagcaacatggctgctgctcgcctggcttggtggtagcatgttggatcttgttgtgtgtttacatcacgggtataaagtaggggctgccttcctcctccaagggaccctttcttgaatcttttggttgtgtctggaggccaaagactctgagagatcatcagtctcccccaagatccatcctacagtcatcagtatactttgtgaaatcactcgacctcagtcttccccgttagcccatcatgtctcttcctccggacttcaagtggggctttgccaccgctgcgtacgttttatttaccctatgcctcttcaaaacagaaatctcaggggggtgaatgagaactcgagaacagtgatgaactgaccccggcctctttcaactcacagctaccagatcgagggctccgtcaacgaggatggccgtgggccgtccatctgggacaccttctgcgccatccccggcaagatcgccgacggcagctcgggcgccgtggcctgcgactcgtacaagcgcaccaaggaggacattgccctcctcaaggagctcggcgccaactcgtaccgcttctccatctcgtggtcgcgcatcatccccctgggcggccgcaatgaccccatcaaccagaagggcatcgaccactacgtcaagtttgtcgacgacctgatcgaggccggcatcacccccttcatcaccctcttccactgggacctgcccgacgccctcgacaagcgctacggcggcttcctcaacaaggaggagttcgccgccgactttgagaactacgcccgcatcatgttcaaggccatccccaagtgcaagcactggatcaccttcaacgagccctggtgctccgccatcctcggctacaacacgggctacttcgcccccggccacacctcggaccgcagcaagtcccccgtcggcgacagcgcccgcgagccctggattgtcggccacaacatcctcatcgcccacgcccgcgccgtcaaggcctaccgcgaggacttcaagcccacccagggcggcgagatcggcatcaccctgaacggcgacgccaccctgccctgggaccccgaggacccggccgacattgaggcctgcgaccgcaagatcgagttcgccatctcgtggttcgccgaccccatctacttcggcaagtaccccgactcgatgcgcaagcagctgggcgaccgcctgcccgagttcactcccgaagaggtcgccctggtcaagggctccaacgacttctacggcatgaaccactacacggccaactacatcaagcacaagacgggcgtgccgcccgaggacgacttcctcggcaacctcgagacgctcttttacaacaagtacggcgactgcatcggcccggagacccagtccttctggctgcgcccgcacgcccagggcttccgcgacctgctcaactggctcagcaagcgctacggctaccccaagatctacgtgaccgaaaacggcacctcgctcaagggcgagaacgacatgcccctcgagcaggtcctcgaggacgacttccgcgtcaagtacttcaacgactacgtgcgcgccatggcggccgccgtcgccgaggacggctgcaacgtccgcggttacctggcctggtcgctgctcgacaactttgagtgggccgagggctacgagacgaggtttggcgtgacctatgtggactatgccaacgaccagaagaggtatcccaagaagtcggccaagagcctcaagccgttgtttgatagcttgattcgcaaggagtaaggggtttcggggatagatagtggttctatctggagtgggattttgtttgttctctgtacatagtttgaaaggagtgg

SEQ ID NO: 1226 - protein, 476 aa, HUMICOLA GRISEA VAR. THERMOIDEA
MSLPPDFKWGFATAAYQIEGSVNEDGRGPSIWDTFCAIPGKIADGSSGAVACDSYKRTKEDIALLKELGANSYRFSISWSRIIPLGGRNDPINQKGIDHYVKFVDDLIEAGITPFITLFHWDLPDALDKRYGGFLNKEEFAADFENYARIMFKAIPKCKHWITFNEPWCSAILGYNTGYFAPGHTSDRSKSPVGDSAREPWIVGHNILIAHARAVKAYREDFKPTQGGEIGITLNGDATLPWDPEDPADIEACDRKIEFAISWFADPIYFGKYPDSMRKQLGDRLPEFTPEEVALVKGSNDFYGMNHYTANYIKHKTGVPPEDDFLGNLETLFYNKYGDCIGPETQSFWLRPHAQGFRDLLNWLSKRYGYPKIYVTENGTSLKGENDMPLEQVLEDDFRVKYFNDYVRAMAAAVAEDGCNVRGYLAWSLLDNFEWAEGYETRFGVTYVDYANDQKRYPKKSAKSLKPLFDSLIRKE

SEQ ID NO: 1227 - DNA, 1614 bp, COCCIDIOIDES POSADASII
atgaagggcgttgctttgttgaccgctgcggcgggtctcgtgggttctgccttggctggcggagcccgtcaccatcgccatggccatgccgtcctccaccgccgcaaccctcagacctgcggctgcactgtcaggaccatcaccatgaccggagagccaaccttggttccggaacccgtcactgagaagaccaccaccatccgctccaccagctacaccaccgtgaccgtgtccgtcactcctaccgaggcagtccagactcccaccgaggcgctcccaactcccattgtcaccgtctacccaacccctggcacctacaccgttgagccaaccaccatcatcgtgaccaaggagaccaccgtctgcgccgccacgaccaccggtctctcgccaggcgaacacacctatggaggcgtcaccaccgttgttgactcgccaaccactctcaccgtgccgatcgccaccgtcaagcccgagggaagcaccttcaccagcgtcatcgagaagaccacctatgtctgcccaactgagggaacctacaccatcgccccctctaccacctccgtctccaagagcaccgtcatcgtgtacccaactccggccatcatcacttctggaacttacacccagcctggagccaccgtcaccgtcaccgagaccgactatgtctatgtctgccccaccccaaccggcatcgaactcccaaaggtcgaccctcccaaggttgagatccccgatgttgagccacccaaggctgaaccacccaagaccgagcagccaacaccaccaaagcaggacaagcctgagccgccaaagacacctcagatcggtggtggtgagaaatggggcatgacctactctccttacaccgacgacggccagtgcaagggtgccggtgacgtcaaggctgacattgccatcatcaagcaaaagggtttcaagaccgtccgcgtctactcctctgactgtgacggcctcaagaacatcggcaacgcttgcaaggagtacggtctcagaatgatcatcggtgtcttcatctccaacaccggcatcgagggcgcccagaagcaggtcaccgatatcgtcgagtggggccagtggaacatagttgacctcgtcgtcgtcggcaacgaagccatcttccagggccacgctgatgccacctcccttgcttctttcatcggttcctgcaaggccaccttcaagaaggctggctacaacggcccagtcaccaccactgagcccctcaacatctggcaggccaatgcttccaagctttgcggtgtcatcgacattctcggcgccaatatccacccgttcttcaactccgatgtctcccccgctgatgctggtaaattcgtcaagggccaaatggacatcctccacggcctctgcaacaagaaggtcatcaacctcgagactggctggcccaacggtggtggtaacaacggaaaggccatctctggtcagtcagagcaggttaccgccatcaaatccatcgtcaaggctgttggcagcgactctgtcttcttctccttccgtgatgaccgctggaaggaacccggcccactcggtgtcgagcaaaactggggctgcattaacgttttcggctga

SEQ ID NO: 1228 - protein, 537 aa, COCCIDIOIDES POSADASII
MKGVALLTAAAGLVGSALAGGARHHRHGHAVLHRRNPQTCGCTVRTITMTGEPTLVPEPVTEKTTTIRSTSYTTVTVSVTPTEAVQTPTEALPTPIVTVYPTPGTYTVEPTTIIVTKETTVCAATTTGLSPGEHTYGGVTTVVDSPTTLTVPIATVKPEGSTFTSVIEKTTYVCPTEGTYTIAPSTTSVSKSTVIVYPTPAIITSGTYTQPGATVTVTETDYVYVCPTPTGIELPKVDPPKVEIPDVEPPKAEPPKTEQPTPPKQDKPEPPKTPQIGGGEKWGMTYSPYTDDGQCKGAGDVKADIAIIKQKGFKTVRVYSSDCDGLKNIGNACKEYGLRMIIGVFISNTGIEGAQKQVTDIVEWGQWNIVDLVVVGNEAIFQGHADATSLASFIGSCKATFKKAGYNGPVTTTEPLNIWQANASKLCGVIDILGANIHPFFNSDVSPADAGKFVKGQMDILHGLCNKKVINLETGWPNGGGNNGKAISGQSEQVTAIKSIVKAVGSDSVFFSFRDDRWKEPGPLGVEQNWGCINVFG

SEQ ID NO: 1229 - DNA, 526 bp, COCCIDIOIDES POSADASII
tggtatgtgaaactacattcaaggcagtgcagcacaaagctccttgggtcatctggggcgttgttccgcttaacaaatttgaattaggtcccgctacatctgtaggttttccatctttatgcctacaagatggacccttaggcttgcgattcgcggacaatattactgcatttcctgccggcataacaatcggtgctacctgggatcggagtctgatgcgcaagagaggaaaactccttgggcttgaagcacggctcaagggagttaatgtgcttctaggtccgtcaatgggacctttgggcacattgccggctggaggccgaaattgggaaggttttggatctgacccggttctccaagccgtcgcttcagcagagaccatccgaggtatccaggaaaacggtgtaattgcaactgcgaaacactacgttttgaacgaacaggaacactacagacagcctcttgaatggggcatatcgaatgccatgtcctccaatatcgacgaccgaaccttgcgcgaagtata

SEQ ID NO: 1230 - protein, 174 aa, COCCIDIOIDES POSADASII
VCETTFKAVQHKAPWVIWGVVPLNKFELGPATSVGFPSLCLQDGPLGLRFADNITAFPAGITIGATWDRSLMRKRGKLLGLEARLKGVNVLLGPSMGPLGTLPAGGRNWEGFGSDPVLQAVASAETIRGIQENGVIATAKHYVLNEQEHYRQPLEWGISNAMSSNIDDRTLREV

SEQ ID NO: 1231 - DNA, 1695 bp, TALAROMYCES EMERSONII
tcaacatcgttcgttgcttgtaacctcttaagggaattcgcaaaaaaggctaagttcattattgttctcgaaaaggaaactctatcaaccacgtgtctgtcagaaaatgactacgaccgagactcctaccactacgactacatccactcttcctcccgacttcctctggggtttcgcaactgccagctaccagatcgaaggggccttcgacgaggatggccgtctgccttcgatatgggacactttcagcaagacgcccggcaaggtcgaggacgggaccaatggcgatgtcgcctgcgactcgtaccaccgtaccggtgaggacattgagatattgaagaaatacggtgccaagatctatcgcttctcgttgtcctggccacgtatcatccctctcggcgggcgaaacgaccccatcaatgaaaagggcctgcagttctactccaagttccttgatgacttacacgccgcgggcatcgagcccttcgtcacgctcttccactgggatctgcccgacgagctgatgaagcggtacgggggcatgctcaacaaggaggagtttgtggccgactacgccaactatgcccgtgtcgtcttcaacgcgctcggctcgaaggtcaagcactggatcactttcaacgagccctggtgcagttccgtgctcggccacaacaccggcaagcacgcccccgggcggacgagcgatcggacgaaaagtcccgagggagacggcactcgcgaaccttggatcgtgggtcacaaccttctcgtggctcatggtaccgttgtggacatctatcggagagagttcaaagagaaacaaggcggggaaatcggaatcaccctcaacggcgactgggccgaaccatgggatcccgaaaacccagcagacgtcgaagcctgcgaccgaaagatcgaattcgccatctcgtggttcgcggacccgatctaccacgggaaatacccggacagcatggtgaaacagttgggcgaccgtctgccgaagttcacgccggaagaaatcgccttcgtgcacggcagcaacgatttttacggcatgaaccactactgcgaaaactacatccgcaaccggaccggcgaaccagacccggaggacattgctggcaacctggacatcctgatggaggacaagaacggcaaccccatcggccccgagacccaatgcgagtggctgcggccgttcccgctggggttcaggaagctgctgaagtggcttgcagaccggtacaacaaccccaagatctacgtgaccgagaacgggacgagcgtcaagggcgagagcgacaagccgctcgaggaggtgctcaacgatgagttccgcgtgcagtactaccgggactatatcggcgcgatggtggatgctgttgcacaggatggggtcaacgtcaaggcttacatggcttggagtttgttagacaacttcgaatggtccgaaggctaccggtccagattcggagtgacctacgtcgactacaagaacgggcagaagaggattccgaagaagagtgctcttgtcatcggggagctgttcaacaagtatatcaggaaggagtagatattgtctgtctgcaaggaatgcgtcttttcccttttccttttctggtagtagtctgacagaaggccaccttaataacgaattgagttatttgaaattggacaaaaaaaaaaaaaaaa

SEQ ID NO: 1232 - protein, 489 aa, TALAROMYCES EMERSONII; identical to SEQ ID NO: 1137

SEQ ID NO: 1233 - DNA, 2100 bp, COCCIDIOIDES POSADASII
agaaaagagcaagagaagacttgtatctggtgcaatgatggaagaaggtcgtggtccagaattaagggtacgaggaggtggccgacatggacaaaagtggagagcggacgacagatatggcggaggcggaggaggcgggggcggaagaggagggaaatggttcagcaactggagtaagaaaaagaagattttggttatcgttgggattcttgcattactattgatcatcatcatcccggtcggcgtcgtggtttcaaagaagaaagatgatgaaggtggctcagctgggcatggggatggggatgccccttccaacgataacctcaaggaaatcgaccgcgatagcattccgcaaagcgccagaggaacgtatctcgacccttttacgtggtatgacactgcagattttaacgtgacatacacggatgagactgtgggtgggctgccggtgatgggcctgaattctgcctgggacgactctgcgcaggcgaatgaacacgtcccacctctgaataagaggttcccgtacgggaagcaacctattcgcggagtgagcgtggggggatggctttcactcgaaccgtttatcactccatcgtttttcaagaaatactctgtgcatgacaatgtcgttgatgagtacaccctcacccagcgcctcgcctcctctgcgaaacctaccttggagaagcattatgctacctttatcacagagcgatctttcagagagatacgggatgctgggctggaccacgttcggataccgtactcttattgggcggtgaaaaagttcgacgatgaaccgtatgtggaacaggtttcgttcagatatctcctacgagcgatcgagtattgtaggaaatatggactgcgagttagcttggacctgcacggattgcccgggagccaaaatggttggaaccatagcggccgtcacggagccatcggctggctgaatgggcccgatggggataaaaatgctcagcggtctttggatattcacgatcagctctccaagtttttcgcgcagccacgctataagaatgtcgtcacgctatatggccttgcgaatgaaccgttgatgctgaagctacccattgagcctgtgatagattggaccaagaaagcagcagagatcgttgagaaaaatggcatgaagcaacacattgttttcggagatgggtttctgaaactgtccaagtggaagaccatactacaggatactgggcacagtctcctcttggatacgcatcaatacacgatcttcaataccgaactaattggcttggaacacaagaagaagctcgagttcgtctgtgacgggtgggtggaattgctaagtgacagcaactcaaagggaactggttgggggccgaccatctgcggtgaatggtcccaagccgacacggactgcgccaggtatcttaacaacgtcggcgttggcacccgctggactggtaccatggatagccccagcgccaaagatcaagtttctgaacctctttgccctgctgccaagtctggtaacgggaaagcatgtagctgtgatggcgctaatgctgacccttctgaatactcggatgcgtataagaaattcctcctgacgtatgcggaggcgcagatgtctgccttcgaaaagggttgggggtggttttattggacatgggagaccgagtcagcggtgcaatggagctggagaagaggattggaggctggcattttgccaaagaaggcgtacgagccgtcgtttaagtgtggagatactctccccgagttgggtgatctgccggagtactattagtgctctatggtgtgttggaacttgtaatatttattgttggaacatggtctggagagctgggaatgtcttgcattgcctgtgatatattggagttgtgattttgtttcattctgcgggtcgggtattagctagggatggtttggtttgggtataatctgtctgacgccatatttggctctgaattttgttcgatgtttcctacaatacccaatgctctcctatcggagaagtggcgatgcttgtattgttttgatcaagccaggaataattcacttttttacacctggaaaaaaaaaaaa

SEQ ID NO: 1234 - protein, 449 aa, COCCIDIOIDES POSADASII
MGLNSAWDDSAQANEHVPPLNKRFPYGKQPIRGVSVGGWLSLEPFITPSFFKKYSVHDNVVDEYTLTQRLASSAKPTLEKHYATFITERSFREIRDAGLDHVRIPYSYWAVKKFDDEPYVEQVSFRYLLRAIEYCRKYGLRVSLDLHGLPGSQNGWNHSGRHGAIGWLNGPDGDKNAQRSLDIHDQLSKFFAQPRYKNVVTLYGLANEPLMLKLPIEPVIDWTKKAAEIVEKNGMKQHIVFGDGFLKLSKWKTILQDTGHSLLLDTHQYTIFNTELIGLEHKKKLEFVCDGWVELLSDSNSKGTGWGPTICGEWSQADTDCARYLNNVGVGTRWTGTMDSPSAKDQVSEPLCPAAKSGNGKACSCDGANADPSEYSDAYKKFLLTYAEAQMSAFEKGWGWFYWTWETESAVQWSWRRGLEAGILPKKAYEPSFKCGDTLPELGDLPEYY

SEQ ID NO: 1235 - DNA, 1375 bp, COCCIDIOIDES POSADASII
ggggggggggggggggcattcctgtccttcgttttcgccatctagtctttattccatctcttccttctcccatcccctttctgtcgctgatttctttcattcacttctttcattaagaccggtttcctcccagcttcgtctcggttcctttccctgcaccttgtatatcgtacatccgtggaattcgtcattcgctgggaaagttgataatgcgtttgtcgactctccttcctctcgccctggcggccgtacccgctgtctctgcggccggcaagcttggctttgctctcggtgttaagaatgccgatggttcctgcaaatcccaggcagactttgagaaggatttcgatgttttgaaggcccactcaaatatcgtccggacatacgccgcggccgattgcaacaatgctgaggccattgttccggctgctaagaagaagggatttaatcttgtcttgggtgtctggcctgatgtcccggagtccttcgacgcagacaccaaagctttgcagaaagtaatcccaggaaatgaagatgtgatcaccgctataaccgtcggctctgagactttgtaccgtggcaacttcaccggccaagagcttttgcagaagatcaaccaggttcagaagatgttccccaaggttaaggtcggcactgcagacagttggaacaagtatgccgatggtactgctgatccaatcatcgcgggtggtgtcaagtatctactcgtcaacgctttcgcattctggcaaggacaggacgtttccaatgccaccgacacatacatcgatgacatgatgcaggccatggttcacatccagaaagtcgctggagcgaatgctaagcaaattcacattgctactggagagaccggttggccaagtgacggtggaagcgacttcggtgctgccaaagctggaactaaaaatgctaagaccttctttgagaaaggcgtgtgtgcaatgctttcctggggcgtcgacgtcttctacttcgaggctttcgatgagccatggaagccaaagagcattggcgacaatggcaaggctgctgacgagactcactggggcttgtacaccgctgatcgccggtccaagtacacgcctgtgtgcaaacatattcgatcttgatataaccaccacctgaggctgctgtgctggtctccgagaaaatggatgggtctaacagtttgggaacgacccgatgcctaagggctttcgcatggttgaggccgctccttaattttgttttcgcgatcatctaaggtaggcgatagaaatatggctattgcaggcaaagttggcgcattgtagctactctctttagactaattgaaaatgcgattgttttatcaatgtgtcaaaaaaaaaaaaaa

SEQ ID NO: 1236 - protein, 306 aa, COCCIDIOIDES POSADASII
MRLSTLLPLALAAVPAVSAAGKLGFALGVKNADGSCKSQADFEKDFDVLKAHSNIVRTYAAADCNNAEAIVPAAKKKGFNLVLGVWPDVPESFDADTKALQKVIPGNEDVITAITVGSETLYRGNFTGQELLQKINQVQKMFPKVKVGTADSWNKYADGTADPIIAGGVKYLLVNAFAFWQGQDVSNATDTYIDDMMQAMVHIQKVAGANAKQIHIATGETGWPSDGGSDFGAAKAGTKNAKTFFEKGVCAMLSWGVDVFYFEAFDEPWKPKSIGDNGKAADETHWGLYTADRRSKYTPVCKHIRS

SEQ ID NO: 1237 - DNA, 2380 bp, COCCIDIOIDES POSADASII
ggacgaaactgggaaggttttggatctgacccggttcttcaagccgtcgcttcagcagagaccatccgaggtatccaggaaaacggtgtaattgcaactgcgaaacactacgttttgaacgaacaggaacactacggacagcctcttgaatggggcatatcgaatgccatggcctccaatatcgacgaccgaaccttgcgcgaagtatacatctggccgtttgcagaaagtgtgagagccggggttgggagcgtcatgtgcgcctaccagatggtcaacaactcgtattcatgcgggaatagcttgcttttgaacggtattctcaaggatgagttaggatttcaaggctttgtgcagtcggattggtgggcccaacaggccggcgtgtcgaccgctctcgctggactagacatgacgatgcccggccctggtccgcggcctagcccgggggtctcttactggggaagcaatcttgccatagctgcgctgaacacgtccgtgccaatggagcggctgaacgacatggcgaccaggatagtcgcggcgtggtatcagctaggacaggactcctggccgaagcctcccccagacggtgatggcgggccaaacttctcgtcctggacaagagaaaagattggtcgtcttcatcacggaagtaatgacgacgatgccacgggtgtggtgaacaaattcatcaatgctcaaagcgaaggagacgacgcgcatttgcatgtggcgcgtcgaatcgccgctgaaggcactatattattgaaaaacgaaggtggaatattacctctttcaagaaacggaaggagccgaaacgccggtctatatcgagttgggatatacggagaagatgccggcccgggaaaaggccccaatttttgtcgggatcgcgcttgtaaccaggggactctagcgtctggatggggcagcggtgccgttgaatttccataccttataccaccgggagaggccctggatagagagttcaacaatgacacggttgagctgtcactctattataagaatgaggttgccgaccgcgatctaaaagacaaggatctctgtatcgtctttgcaaattcaaatggcggagagggttttgtggccgatggtgatatacgcggagatcgaaatgaccttttcctgcaaaaggacggcgatagattggtcgaacatgtggcaagcaaatgtggggacggatctggcgaaacgatcgttgttattcacgccgttgggcccgtgatcgttgagtcttgggttgattatcccggtattaaagccattgtgcttgccaatctccccgggcaagagagtggggacgctctcgctgactttttgttcggcgacgtggacgcatgcggtcggcttccttataccatgggtaaaagtctcgatgattatggaccaggggccagggtgctgtgtgaaagccagaggcccgttccacagaaggatttttcacacggcctttacaccgattatcgttactttgacaagcataatataacccctcgttacgagtttggctatggcctttcatatacaacatttaggttgtccaacctcattgtcaagccgttgcaggacagaactccgttaccggctccgcgacctgagccaagggtgtcaccaccgtcatacaatgatgaaatcccgccgcccaaagatgcgctattccctaaagggttcaggaggctgtccgactacatctatccttatatatcctcagtgaaggaggtgacacaaggaccatatgaatacccacagggatataatataacccaggagccatcgcaagcgggtggaggtgagggcggtaacccgtctctgttcgaaccttttgtcaacgtatccgtggtgctggccaacaccggtccgcgcactgggaaggaagtcgtccaggtatacgtctcttttccggagaacgtaactgatagccagccactagccgacggtgaaaaaagcaattccacaggaaatcatacggaaccgtataatcccttggtcaccattgaatttcctgttcgagtgcttcgaaatttcgagaaagttgagttggcatctggggaatggactaccgtaaacatgtccctcacgcggaaggatttgagttactggagcacaagacagcaaaattggatgatgccaacggcgggagctttcaagatatgggttggtaggagttctagggatcttccgcttgttggcaagttttgagttttgggagtgctagtgatttaaaactgggcaaggtcaacgtatggaacggcgcattgcagattggatagatatatacacgcatatattataacaattttagattcaggcttgacaatgaatagaatccattgaaaaaaaaaaaaaaaaaaaaaaa

SEQ ID NO: 1238 - protein, 740 aa, COCCIDIOIDES POSADASII
GRNWEGFGSDPVLQAVASAETIRGIQENGVIATAKHYVLNEQEHYGQPLEWGISNAMASNIDDRTLREVYIWPFAESVRAGVGSVMCAYQMVNNSYSCGNSLLLNGILKDELGFQGFVQSDWWAQQAGVSTALAGLDMTMPGPGPRPSPGVSYWGSNLAIAALNTSVPMERLNDMATRIVAAWYQLGQDSWPKPPPDGDGGPNFSSWTREKIGRLHHGSNDDDATGVVNKFINAQSEGDDAHLHVARRIAAEGTILLKNEGGILPLSRNGRSRNAGLYRVGIYGEDAGPGKGPNFCRDRACNQGTLASGWGSGAVEFPYLIPPGEALDREFNNDTVELSLYYKNEVADRDLKDKDLCIVFANSNGGEGFVADGDIRGDRNDLFLQKDGDRLVEHVASKCGDGSGETIVVIHAVGPVIVESWVDYPGIKAIVLANLPGQESGDALADFLFGDVDACGRLPYTMGKSLDDYGPGARVLCESQRPVPQKDFSHGLYTDYRYFDKHNITPRYEFGYGLSYTTFRLSNLIVKPLQDRTPLPAPRPEPRVSPPSYNDEIPPPKDALFPKGFRRLSDYIYPYISSVKEVTQGPYEYPQGYNITQEPSQAGGGEGGNPSLFEPFVNVSVVLANTGPRTGKEVVQVYVSFPENVTDSQPLADGEKSNSTGNHTEPYNPLVTIEFPVRVLRNFEKVELASGEWTTVNMSLTRKDLSYWSTRQQNWMMPTAGAFKIWVGRSSRDLPLVGKF

SEQ ID NO: 1239 - DNA, 4865 bp, COCCIDIOIDES POSADASII
tctagatagcgaaacggactgaagactgtgtggggtaatgaaatatggcaaagcgtgtccgcccatcgacgtgtgttttgctctcacctcgtctcacttcgcctgtccttgggccgaaagcctgtgttcggtgtggtgcagcaagttcccgcatggtccgcatggtctccacacacattgttccggaagacatgcggagggcctacggagcctacggattacccggcagccacagctgccccgtgactgtccggttcttcagtttgtggagagacatgtgttcatcttagaccacttcagtggcatctcactgatctccaagacctctattgacagtcgtccactctaaatattatctatacaaagagtactacggataacgaatgtgtgcctatgtgtactgtgcgaacgtccagtgaccatcccgtgcgtcccccttggagtctgtccaagcgtgcattccctgcaaccgggttgctaagctctggctcaatgaaggcgccacatgatcttcgctgcagatccttgcattggctttgagacagagcaagccacccaataggaagcttgtcacttcatcaaaccactctggacgaacggagctggctggagatagtgacataggcctgcctgcgaactgcaactattggcgccatgctgatagtgagttcatccaccaaactggaaaaagtctcctgtgttgtgtgttgtgtttgttcttctgtgccacaacgaacgttgcgatcgaccctgtatacggagtgcgtgacggtgagttttctttcctacttcagttttttaccaagcatcttagaggacggtatggctttcgttgttgggctaagtctcgctgcgatgagccttgacttctcggcgaggggagggtttccggaaattgctttctcggggcatcatctgatgctttgctgcccgccttgatccctgccgattgctgcacaggagggagtaatttgcccggttgtgtggttgtgatggggaagctacacaagctgtggtgcagctgatgctcattgttgccggcacaccagtagaccgacaggtctttatttacatatgtttataaaccttacatgcatacgtcgtacgtatgtacatggaggtacttcagggtaccaatgagctccgcggtcgcgccatccaaaccaggcaaactgggaggtacatctttgtactttcccaatatctccacctggatcggcgaggttgatgaatgcatgataaatcctccaagaaagattggggaccaaccgtcatccctgatccctccagctgcttctccttaaaagaccactacccttcatcgaactaaccagtgggaatgcttcatagagggcgtacttcagtgttgcattattgttatttgtttctttttctctaaacacagattggagttcgtcgcactgttatatcttttgataccgggatacggttctttaatcgttggattattctcgacgcgccagatctctccgatgcctatctccaacctggcgatcaccgctcttgagaattaactgcttccggagaaattccattattatctcacaatgtggttaggttggctgccggctgtatttgtacttgttgccggcggggctgcggagaaggtaaaaccgataaaagctgatttgcagatggcatttcttcctgattaactgatgcgcatacgcgctaggttctattactaacgtgtattggtactgacaggaatgggccttctcacctccatactatccttcaccttgggcttcgggccagggagaatggagcgaggcatataacaaagcgcgcgaattcgtctctcaattaacactcacagagaaagtgaacctcacgaccggcgttgggtagatcctcgcgtgccttatttcctatcaacaaagcagttcgctgatttctcacaggtggatgcaagaagcttgtgttggcaatgtaggatcaattcctcgactaggatttcgttcattatgcatgcaggacggacctcttggtattcgtttcggtatgaatttatttcgcctctgatcgccagacaatatgagctgtgctaacgcagagtagcggaccatgtcagtgcttttccggcgggtatcaacgtaggagcgacgtggagcaaaagtttggcatacttgcgtggaaaggcgatgggagaagaacaccgtgacaaaggagttgatgtgcaattgggacctgctgtcggaccgttgggcaggtctcccgatggaggtcgtaactgggaaggctttagtcctgacccggtgctgtcgggatatctggtcgctgaaacgataaaaggaatccaggatgctggagtgatcgcctgtgtcaagcattttatagtgaacgaacaggagcgttttcgtcaagcgcctgaagctcaagggtatggtttcaacatctcagagagctccagctccaacgtggacgacgtcactatgcacgagctgtatctctggtgagttcacgtccgcatatgacagcattgatatcatccatttcttatcaggagtaggccgttcgccgatgcggtgcgagccggagtgggctctgtgatgtgttcatataaccaaatcaacaacagctatgggtgctccaacagctacactcagaataagctccttaaaggcgaactcggattccaaggtttcatcatgagcgattggcaagcgcatcacagcggcgtcggagatgacttggctggtttggacatgtcaatgcccggggacactcttttcctcaccggaaaatcatactggggaccgaatttgactatcgctgtcaccaatgggactattccccagtggaggctggatgatatggctgttcgcatcatggcagcttactacaaagtccggcgtgaccaaacccaagtcccgatcaacttcaattcctggacgcgtgatgaatttggatatctgcatgctggtggccaggaaggttatggcagggtgaaccaaatggtcaacgtacgcggcagacatgccgttattgctcgaaaagttgcaagcgccagcacagtgcttcttaagaacagaggggtccttccactaaaaggcaaagagaagctcactgcagttatcggggaagatgctggaccgaatctatggggaccaaatggttgccctgatcgaggttgtgctaacgggactctagcaatgggttggggcagcggtacggcggattttccgtaccttgtgacaccagcgcaggcgattgagaatgaagtaataacgaaaggagttggagaagcaatgtcagtgtttgacaactacgcaacgtctcagatagaatcggttgtttctcaagctactgtctcgcttgtatttgtgaacgcaggcgctggagaaggttttatcagtgttgacgggaatgagggcgatcgaaagaacttgactctttggaagaacggggatgagttaattaaaacagtcgcctccatgtgtaacaatactgtcgtggtcatgcacactgctgggcccgtcttggttaacaagtggtacgaccatcctaatgtcactgctatcttgtgggcagggctacccgggcaagaaagcggtaacgccctgggggacgtgatctatggtcgagtcaatccaggggccaaatctcctttcacatgggccgcgacctcggaggactatggtgtcagcatcctcaaagagcccaatgcggcgaccaaggctccgcagattgattttgaggaaggtatctttattgattaccgcgccttcgacaagtcaaacacaaagccaatctatgaattcggatttggcttgagctacacgactttcaccttctctgacctcgaagtccagccactgcgggccaacccgtatgttcccacaagcggtttcacggattctgccccggtttttggtaactcgaccgatcatctccagtttcctgccggatttgaccctgtccacctctacatctacccgtggttgaattcgaccgatcttaaggagtcttctatggaccgcgattatgggctaccgaccgaaaagtatgtcccaccaggagcaacggatggaggcccacaggcgcttctcccagcaggaggtgggccaggagggaacccgggcctatatgaggagctttacagagtatcagtcaccatcacaaatacggggagcgtgacaggagatgaagtgccacagctggtaaggatccctacataatacctcagctgttaggtcagctacgttgtggccatttgctaatcaactaaacctctgacaacaaacagtacctatcacttggtggcccgaacgacgctaagatagttttgcgtgggttcgatcgtgtcactctccgacctggcgagaacacggtctggcagacaaccctgactcgacgtgatatctccaactgggatcctgtgacacagaactgggtggtgacgagccatcccaagatgatctacgtgggaaattcatccaggaatcagcctctatccgctcctctagccccgtcttcgtaggccaagctctcgagcgcatcgatccgccaggggtatgagattgtagatacgaggtttgcatccgtgattccgtgcctccaaggtacgcggtggcatgcgtcatagctacatattatttgacagatgttcaaaaggaaatcgggtgcgaaataacgctcaatgccattattctgtttttgatgaagccatggagagagaagctgttgatcaatcgtgttgctcccctttccctttcccccggtctggcggcccgaggaagcgctgcacgacccggtaacccgcatagcagtgtgtatgacgatatagcccactaggggaagattaacgaatcaaaaaagtacaaggtaccaaaagctctaga

SEQ ID NO: 1240 - protein, 858 aa, COCCIDIOIDES POSADASII
MWLGWLPAVFVLVAGGAAEKEWAFSPPYYPSPWASGQGEWSEAYNKAREFVSQLTLTEKVNLTTGVGWMQEACVGNVGSIPRLGFRSLCMQDGPLGIRFADHVSAFPAGINVGATWSKSLAYLRGKAMGEEHRDKGVDVQLGPAVGPLGRSPDGGRNWEGFSPDPVLSGYLVAETIKGIQDAGVIACVKHFIVNEQERFRQAPEAQGYGFNISESSSSNVDDVTMHELYLWPFADAVRAGVGSVMCSYNQINNSYGCSNSYTQNKLLKGELGFQGFIMSDWQAHHSGVGDDLAGLDMSMPGDTLFLTGKSYWGPNLTIAVTNGTIPQWRLDDMAVRIMAAYYKVRRDQTQVPINFNSWTRDEFGYLHAGGQEGYGRVNQMVNVRGRHAVIARKVASASTVLLKNRGVLPLKGKEKLTAVIGEDAGPNLWGPNGCPDRGCANGTLAMGWGSGTADFPYLVTPAQAIENEVITKGVGEAMSVFDNYATSQIESVVSQATVSLVFVNAGAGEGFISVDGNEGDRKNLTLWKNGDELIKTVASMCNNTVVVMHTAGPVLVNKWYDHPNVTAILWAGLPGQESGNALGDVIYGRVNPGAKSPFTWAATSEDYGVSILKEPNAATKAPQIDFEEGIFIDYRAFDKSNTKPIYEFGFGLSYTTFTFSDLEVQPLRANPYVPTSGFTDSAPVFGNSTDHLQFPAGFDPVHLYIYPWLNSTDLKESSMDRDYGLPTEKYVPPGATDGGPQALLPAGGGPGGNPGLYEELYRVSVTITNTGSVTGDEVPQLYLSLGGPNDAKIVLRGFDRVTLRPGENTVWQTTLTRRDISNWDPVTQNWVVTSHPKMIYVGNSSRNQPLSAPLAPSS

SEQ ID NO: 1241 - DNA, 2348 bp, Aspergillus oryzae; identical to SEQ ID NO: 1175

SEQ ID NO: 1242 - protein, 405 aa, Aspergillus oryzae; identical to SEQ ID NO: 1176

SEQ ID NO: 1243 - DNA, 1988 bp, Aspergillus niger
agtacttgcatcttagtctcttcaaaggttgcaaacagccaccctccccatgcaacttgtatggtcatggccagctggctaaatgcgcaggtacatactaataatctgcacacagttgagccatccgggaaaatgcagggtctatcgcaatcagcagcccatcattgtatgtatttctccatgttaattttccgaaagttgggggtggtgtgtctataatgtgtgtaccttatatatatatatccggggaccaacgaacacgctattctcttgtctgtgtctgtcctctgatttaagaggattctgcatgcctgagttggagttgattatagtgaggagttgcgtgtttgtctttttcaaagagcttggtcattgacacgctttgtttttgtccgaagcacgaacaacaacaagacggagaacaaagagaagaggaagaagaagaagaagaaggaagaagaaggaaaagaagaaagaaagcgagagacggcaagcatgttgcccaaggacttacagtgggggttcgccaaggctgcgtacgttgttgcatcatgctcccttcaaacgcccatctcacttacacccgtccgacagctaccagatcgagggcgccgtcgaccaggacggccgcggccccagcatctgggacacgttctgcgcgcagcccggcaagatcgccgacggctcgtcgggcgtgacggcgtgcgactcgtacaaccgcacggccgaggacattgcgctgctcaagtcgctcggggccaagagctaccgcttctccatctcgtcgcgcatccccgagggcggccgcggcgatgccgtcaaccaggcgggcatcgaccactacgtcaagttcgtcgacgacctgctcgacgccggcatcacgcccttcatcaccctcttccactgggacctgctgcatcagcggtacggggggctgctgaaccgcaccgagttcccgctcgactttgaaaactacgcccgcgtcatgttcagggcgctgcccaaggtgcgcaactggaacgagccgctgtgctcggccatcccgggctacggctccggcagcttcgcccccggccggcagagcacctcggagccgtggaccgtcggccacaacatcctcgtcgcccacggccgcgccgtcaaggcgtaccgcgacgacttcaagcccgccagcggcgacggccagatcggcatcgtcctcaacggcgacttcacctacccctgggacgccgccgacccggccgacaaggagcgcctcgagttcttcacggcctggttcgcggatcccatctacttgggcgactacccggcgtcgatgcgcaagcagctgggcgaccggctgccgacctttacgcccgaggagcgcgccctcgtccacggctccaacgacttttacggcatgaaccactacacgtccaactacatccgccaccgcagctcgcccgcctccgccgacgacaccgtcggcaacgtcgacgtgctcttcaccaacaagcagggcaactgcatcggccccgagacgcagtccccctggctgcgcccctgtgccgccggcttccgcgacttcctggtgtggaccagcaagaggtacggctccccgcccatctacgtgacggagaacggcacgagcatcaagggcgagagcgacttgcccaacgagaagattctcgaagatgacttcagggtcaagtactataacgagtacatccgtgccatggttaccgccgtggagctggacggggtcaacgtgaggtttggggttacgtatgtggattatgagaatgggcagaagcggttccccaagaagagcgcaaagagcttgaagccgctgtttgacgagctgattgcggcggcgtgatggaaaaagtttttgagttgatgatacctgcaaagggatgctgatgatgatgtatgaacacgaaagggatagtattatagcaagctaggataacctgcttcaaaggggaaattgatatataaacatgcat

SEQ ID NO: 1244 - protein, 434 aa, Aspergillus niger
MLPKDLQWGFAKAAYQIEGAVDQDGRGPSIWDTFCAQPGKIADGSSGVTACDSYNRTAEDIALLKSLGAKSYRFSISSRIPEGGRGDAVNQAGIDHYVKFVDDLLDAGITPFITLFHWDLLHQRYGGLLNRTEFPLDFENYARVMFRALPKVRNWNEPLCSAIPGYGSGSFAPGRQSTSEPWTVGHNILVAHGRAVKAYRDDFKPASGDGQIGIVLNGDFTYPWDAADPADKERLEFFTAWFADPIYLGDYPASMRKQLGDRLPTFTPEERALVHGSNDFYGMNHYTSNYIRHRSSPASADDTVGNVDVLFTNKQGNCIGPETQSPWLRPCAAGFRDFLVWTSKRYGSPPIYVTENGTSIKGESDLPNEKILEDDFRVKYYNEYIRAMVTAVELDGVNVRFGVTYVDYENGQKRFPKKSAKSLKPLFDELIAAA

SEQ ID NO: 1245 - DNA, 1625 bp, Candida wickerhamii
  misc_feature (429)..(429): n is a, c, g, or t
  misc_feature (432)..(432): n is a, c, g, or t
  misc_feature (436)..(436): n is a, c, g, or t
taaatactaatatatatacatatagaatgttattatctaagagtacagttatggctatcgccacaacgatgatgattcgttccacaatggctatcccagcagctggtgaataccacaaacatcatcaacacaagcgtgctgtcgcctatgaatacgtttacgtgacaatcaccgtggacggtaacggtaacaccatcgagcaatctgctacgctgactacaactatgcctccagtgtcaactccagagacttcatcagatgaagatacaactacttatttctccactacgcaattgactcaaacttcatcaatcccaactgagaccccaattactacttcctcagaggaagaagaaccaaccacatcatcttatgaagctccagagacaacggaagccactacatcatctacatcatctccatcatctncancagnagccactaccacgacagcttccttgtcagattttggtatttcaggtgatttaagcgctttggaagatccaagtgaaacttgggaagatggtgttatctcatgttcagatttcccagtaggacaaggtgttatcccattgaacaatttaggtttcggtggttggtcaggtatttaccacagtgacacttctactggaggttcatgtactgaaggttcatactgttcatacgcttgtcaacccggtatgtccaagacacaatggccatccgatcaaccagctaacggtgtcagtgttggtggattactttgtaaaggtggaaaactttataagagttcatcatcagattatttatgtgaatggggtgttgacgctgcacgtgttgtcagtgaaatatccgacgttgtctccatttgtagaactgattacccaggtaccgagaatatggttatcccaaccgctgttgaaggtggtgatgaggctatcttaactgtagttaatggtgaaacttactatcaatgggaaggtatgacaacatctgcacaatattatgttaataacgcgggtgtctcatatgaagacggatgtatttggggagattctaatggtgatattggaaattgggctccattaaattttggtgctggttacgatggtggtatttcatacctttcattaatcccaaatccaaacaataaaaatgcactgaattttaatgttaaaattattgcttatgatgataaatcaaatgttaatggtgaatgtgtttatgaaaatggtagttataatggtgatggtaccgatggttgtaccgtggctgttactagtggtaaggctaaatacgttttatactaattttttatatatatatattttcttatcttctttaatttatgatgtaatctttttttactccttaatctattaccttatcaatcagggattaattatattaaagttcaatctaatttacaaatactgtctttaattctatgtgttgcggatgtattacattgcgacataactaagaactaaatttatcttataacacttacccgagatcaaaagtgattgaatatttcagaataattctcacacaacacaaatgatcttaaaaagcaatgaaatgggaatcaattgtggatagacaattgaaccatcctgtgtacttagtccctgggttaatatttt

SEQ ID NO: 1246 - protein, 420 aa, Candida wickerhamii
  misc_feature (135)..(137): Xaa can be any naturally occurring amino acid
MLLSKSTVMAIATTMMIRSTMAIPAAGEYHKHHQHKRAVAYEYVYVTITVDGNGNTIEQSATLTTTMPPVSTPETSSDEDTTTYFSTTQLTQTSSIPTETPITTSSEEEEPTTSSYEAPETTEATTSSTSSPSSXXXATTTTASLSDFGISGDLSALEDPSETWEDGVISCSDFPVGQGVIPLNNLGFGGWSGIYHSDTSTGGSCTEGSYCSYACQPGMSKTQWPSDQPANGVSVGGLLCKGGKLYKSSSSDYLCEWGVDAARVVSEISDVVSICRTDYPGTENMVIPTAVEGGDEAILTVVNGETYYQWEGMTTSAQYYVNNAGVSYEDGCIWGDSNGDIGNWAPLNFGAGYDGGISYLSLIPNPNNKNALNFNVKIIAYDDKSNVNGECVYENGSYNGDGTDGCTVAVTSGKAKYVLY

SEQ ID NO: 1247 - DNA, 2158 bp, Candida wickerhamii
gaattcaattgaagtcatgatgtttgcattttgccaatttgtcagtttacttagaatttcattatttaaatgatactttttgcctttgtggaagtatttgaaattttatcaattaaaaactgttaagaaaagatgttctcacaaaagtatcttttatcattagctgcaataattgcaatcgctaaagcagctccagctgatgacgcttctaaaccaggtattgggaaatttgcaccaggtcaattaggtttccgttattatatcgacaccaccaccgagtacgcaactcctgccactgctactgctcctgcaagttccactacgtacgctgcaccatatgctgaattgtcatccttggttggaaacttgtccacgacgacatggggtaattggtatcctgacgctaccgaggctgccacggatactgatgacccatatggacaatacgcatggtctcaattatgggaagctaccactttcccaaattttactcgtggtatttacagtaccacggtggatccaacaccgatcccaaccgagagtttagttgtgccaccagatgacccagtcaagagggcattccaagatttgggaatcaaattccctctgggtttcattcaaggtgttgccggttccgctgctcaaattgaaggtgccgtcgccgatgaaggtagatcaccaactaatttagaagttagttccgctagtagacatttacctgaagatttcgtcactaatgaaaattattatctttacaaacaagatatcaccagattagcagctatcggcgttgaatactattcgttcactatcccatggactagaatcttaccattcgcctatcccggttctcctgtgaatcaacaaggtttagatcattatgacgacttgatcaacactgtcttagcatatggaatgaaaccaattgtcacattgatccatttcgattcaccattacaacttgtcgacttcaatgccacattggaattgggactgccaggtggatacgaaggtgaagatttcgtcgaggcatttgtcaattacggtaaaatcgtcatgacccatttcgctgatcgtgtcccattatggatcatctttaatgaacctgtccaattcgccactaatggactcggtgtcaaacatgtcgtccaagccacggctcaattatacgatttctaccataacgagatcaacgggtccggtaagattggtatgaagttcagtcacatcttcgggttccctgaggatccaactaacccagaacatgttgctgccgcagacagatcaaatgaattgcaattaggtctctttgctgatccattgttcttaggtgaagactacccagacagtttcaagaccacattattgaaaacgcagccagcactggcttggacactggatgaattagccgctgttaagggtaaatgtgatttcttcggtgttgatccatacacttataacactatcaagccattggataacggtactgcatcatgtgaagccaacgtcaccgacacttactggccaacgtgtgtcaatgtcaccgttactgaagctgataactggagtatcggttaccgttcccaatcctatgtctacatcacaccaagacaattaagagtctcgttgaactacatctggcaacactggcacgttcctatcttcatcacggaatttggtttccctgaatggagagaaggtgagaaactcttagttgaccaagtccaagatttggacagatccatttactacagatctttcttgactgcagcattagaggcatctcagtacgacggtgtcgagataatgggtgccttggcttggagttttgccgataattgggaattcggtgattataaccaacaattcggtttacaagtcgttaatagaactactcaggagagattctataagaagagtttctttgattttgtcggttttattaatgataatagagcttgagatccctaatccatttatgattatattttttaaaaaactttctatgatgactattatttctttaatgacattactacactaaatgtcaatttctttacttacgcttcttttattttataacccagaaaagttgatatacaatttacttgtcttttaccaatttaaataaaaaattaaataaataaaattcaagctt

SEQ ID NO: 1248 - protein, 609 aa, Candida wickerhamii
MFSQKYLLSLAAIIAIAKAAPADDASKPGIGKFAPGQLGFRYYIDTTTEYATPATATAPASSTTYAAPYAELSSLVGNLSTTTWGNWYPDATEAATDTDDPYGQYAWSQLWEATTFPNFTRGIYSTTVDPTPIPTESLVVPPDDPVKRAFQDLGIKFPLGFIQGVAGSAAQIEGAVADEGRSPTNLEVSSASRHLPEDFVTNENYYLYKQDITRLAAIGVEYYSFTIPWTRILPFAYPGSPVNQQGLDHYDDLINTVLAYGMKPIVTLIHFDSPLQLVDFNATLELGLPGGYEGEDFVEAFVNYGKIVMTHFADRVPLWIIFNEPVQFATNGLGVKHVVQATAQLYDFYHNEINGSGKIGMKFSHIFGFPEDPTNPEHVAAADRSNELQLGLFADPLFLGEDYPDSFKTTLLKTQPALAWTLDELAAVKGKCDFFGVDPYTYNTIKPLDNGTASCEANVTDTYWPTCVNVTVTEADNWSIGYRSQSYVYITPRQLRVSLNYIWQHWHVPIFITEFGFPEWREGEKLLVDQVQDLDRSIYYRSFLTAALEASQYDGVEIMGALAWSFADNWEFGDYNQQFGLQVVNRTTQERFYKKSFFDFVGFINDNRA

SEQ ID NO: 1249 - DNA, 2591 bp, Phanerochaete chrysosporium
caaaatgggactgacactggtcgtcttattacatcttgctctagggttgctgactggggtccaagctcagtccggcctgtatcagcaatgtggcggtatcggatggactggtgcaactacttgcgtcagcggcgcgacctgcacagtgctgaacccatactactcacaatgtctccctggcgccgccaccacgagtgtttcgtctagtcattcgtcaagcagcagcgtcagcagccactccagcagtgaaagcagcagcagcataagttccactagcaccagcccccccgcgccctcccagactgtggcgaacgtgtcgccagaatgggctgctgcctacgtcaaggcacaagctgctgtagcgaagttatcggtgactgatatggtcaacctcgcaacaggtgtgcagtggcagaaaggtccatgtgtcggcaacacccctgctatctcttctatacccggttttactggactttgcctgcaagacagtcccgttggtgtccgctacgctgatggaacgtctgtattcccacctgaaatcaacgttgctgctacatggaaccgtacgcttatgcgccaacgtggagctgctatgggagcggaattcaaagggaaaggcgtgcacgtcgctctcggtcccatgatgaacctcatgcgtgtccccgccgctggccggaactgggaaggtggcggtggtgatcctttcctgtctggcgaagtggcattcgagaccatcagtggcattcagtcctccggtgcccaggcttgtgcgaagcatttcatcaacaacgagcaagaacactttagagactccagttcatctaacgtcgacgataggacggagcatgaactctacggacaccctttccttcgtagcgtccaggcaaacgtagcttccgtaatgtgcagctacaatcaaatcaacggaactttctcttgcgaaaatgagaagaccttgtcaggactcctcaagggagagtacggcttccaaggctacgtcatgtctgactggtgggccactcactctggtgcacccgctgtgaacgccggccttgacatgaccatgccgggtgacgagacactcagctctggaacgacctacttcggacagaacctcgtcaacgctgtgaacagcggccaagtctcgcaggccagggtcaaggacatggcgactcgcatccttgcagcgtggtacctccttggccaagaccaaaacttccccgcggtcaacttcaactcgtggaactctggtcagggccagcatgtgaacgtctccggcaaccacgcgagcctcatccgcaccatcggcgcggcctcgcagatcctgctcaagaacgcgaacggtgcgcttccgctcaagaagcccaagactattggcatcattggcaacggtgctggatcaaaccctaacggtcccaacgctttctctgaccgcgccggagacgtcggtgtcctcgcgcttgggtggggcagtggcactgcgaacttcccttacctggtcgcacccgtcgatgcgattactgctcgtgcgtcgcaagacgggacgaccgtgtcgtcgtcactgagtgacaccgacctgacgggcgctgctaacaccgcgaccgggaaggacgtcgcgatggtgttcatcacggccgacagcggtgaaggataccttactgtcgagggcaatgcaggtgaccgtaacgaccttcaggcatggcacggaggtgatgcgctggtccagcaggtcgcgagccacaacaagaacacgatcgtcgtgatcaacagtgtcggacctatcaatatggaagcctgggtcaaccacccgaacgtcaccgctattgtttggagtggcctccctggtcaggaagcaggcaacgcggtcactgacgttctatttggcgcggtcaaccctggcggcaagctgcccttcaccatcggcaagtcgatcagcgactactccgcgcaaatcatcaccaccggctcgggcatcgtgcccatcccgtacaacgagggcctcttcatcgactaccggcactttgaccaggcgggcatcgcaccgcgattcgagttcgggttcggcctctcgtacacgacgttcgactactcgaacctcgtcatcacgggctcgacggccggcggcacgcgtcagcccccggggcccggctcgtcgctcgacccatggctgcacgactcggtcgtcaccgtgtccttcacgctgacgaacaacggcacggtcgacgggacggaggtgccgcagctgtacctgagcccgcccgcgagcgcgaagagcgcgccgcagaacctgaagggcttcgacagcgtattcctccccgcgggcgcgtcgacgacggtctcttttgagctctcgcgctactcgttctccgtctgggacgtcgtctcccagagctggcagatccctgctggtgtcaccggcatctccgtgggcgcgagcagcagagatttgcgcctcaagggctcaatcacgaactgagggcgcgaggaacgtgccgtggttaaaatgtattcgtagtgcactgtacaccgtctttcctggcttgacatatgtaaacacttcccatttcaaaaaaaaaaaaaaaaaaaaaaaa

SEQ ID NO: 1250 - protein, 823 aa, Phanerochaete chrysosporium
MGLTLVVLLHLALGLLTGVQAQSGLYQQCGGIGWTGATTCVSGATCTVLNPYYSQCLPGAATTSVSSSHSSSSSVSSHSSSESSSSISSTSTSPPAPSQTVANVSPEWAAAYVKAQAAVAKLSVTDMVNLATGVQWQKGPCVGNTPAISSIPGFTGLCLQDSPVGVRYADGTSVFPPEINVAATWNRTLMRQRGAAMGAEFKGKGVHVALGPMMNLMRVPAAGRNWEGGGGDPFLSGEVAFETISGIQSSGAQACAKHFINNEQEHFRDSSSSNVDDRTEHELYGHPFLRSVQANVASVMCSYNQINGTFSCENEKTLSGLLKGEYGFQGYVMSDWWATHSGAPAVNAGLDMTMPGDETLSSGTTYFGQNLVNAVNSGQVSQARVKDMATRILAAWYLLGQDQNFPAVNFNSWNSGQGQHVNVSGNHASLIRTIGAASQILLKNANGALPLKKPKTIGIIGNGAGSNPNGPNAFSDRAGDVGVLALGWGSGTANFPYLVAPVDAITARASQDGTTVSSSLSDTDLTGAANTATGKDVAMVFITADSGEGYLTVEGNAGDRNDLQAWHGGDALVQQVASHNKNTIVVINSVGPINMEAWVNHPNVTAIVWSGLPGQEAGNAVTDVLFGAVNPGGKLPFTIGKSISDYSAQIITTGSGIVPIPYNEGLFIDYRHFDQAGIAPRFEFGFGLSYTTFDYSNLVITGSTAGGTRQPPGPGSSLDPWLHDSVVTVSFTLTNNGTVDGTEVPQLYLSPPASAKSAPQNLKGFDSVFLPAGASTTVSFELSRYSFSVWDVVSQSWQIPAGVTGISVGASSRDLRLKGSITN

SEQ ID NO: 1251 - DNA, 4555 bp, Phanerochaete chrysosporium
tcgaagttgccgctgtttgtccgcgccttatccgctcgacgcggctgctgttgggcaacgacgtggccaagaccatttccgatctacatatcgacttcttcaaacatgttcgagaagtataagtgctttgaccatgcgtacgctgtctacgcaaggcagccccctctccctacgctgacaaaatgggactgacactggtcgtcttattacatcttgctctagggttgctgactggggtccaagctcagtccggcctgtatcagcaatgtggcggtatcggatggttagctggcttgtctctcctgcgtccggagtggatgctcatatgttcctcgcatgcaggactggtgcaactacttgcgtcagcggcgcgacctgcacagtgctgaacccatgtacgtcgccacacagtacatgtcacagcagccgagctcatgacacgtagactactcgcaatgtctccctggcgccgccaccacgagtgtttcgtctagtcattcgtcaagtagcagcgtcagcagccactccagcagtgcaagcagcagcagcataagttctactagcaccagccccccggcgccctcccagaccgtggcgaacgtgtctccagaatgggccgccgcttacgtcaaggttggaacgacgtcttcagatgtatatgttgatgtcactgaaacacgcgcaggcacaagctgctgtagcaaagctatcggtgactgatatggtcaacctcgcaacaggtgagatgactcgtgattaatactctatcttctaacaacttctggcaggtgtgcagtggcagaaaggtccatgtgtcggcaacacccctgctatctcgtctatacccggttttactggactttgcctgcaaggtatgcgttcaacgtccctacgatgtgtgcaggtcgacttattccatggtccacagacagtcccgttggtgtccgctacgctgatggaacgtctgtcttcccaccgtacgtgctgagcgatagctgtgaatctacttccctggctgaaacagttacctacagtgaaatcaacgttgctgctacatggaaccgtacgcttatgcgccaacgcggagctgctatgggagcggaatttaaggggaaaggcgtgcacgtcgctctcggtcccatgatgaacctcatgcgtgtccccgccgctggccgaaactgggaagggtgagtttctttggagtgtttgacacgcttgtcgcggcagtacttaatttctccgtcttggattgtagtggcggtggtgatcctttcctctctggcgaagtggcgttcgagaccatcactggcattcagtcctccggtgcccaggcttgtgccaagcatttcatcaacaagtgcgtgtcttcatctccttgcagttcgcgcttactgacgtatttatgcagcgagcaagaacactttagggactccagttcatctaacgtcgacgataggtgagttttaccgtgttgcgacagtcgggaaagtagctgacctgctctcataggacggtgagataatcgtagtttatatgtgacatgtttctcattcaagtgttaggagcatgaactctacggacaccctgtaatggttcctctatcattcgccgtcaccgactctgacgcatcaatagttccttcgtagcgtccaggcaaacgtagcttccgtaatgtgcagctacagtaagttgtgatctcagcctcgtgcagacgcaaactaaatcgtctgatgtttactacagatcaaagtacgaatgcatcacgaatgattccagcagacgctaatctatatcctactcagtcaacggaaccttctcttgcgaaaatgagaagaccttgtcaggactcctcaagggagagtacggcttccaaggctgtgagtgcctctttttacggggcaggcaatcaaattaactctcagtatcgtagacgtcatgtctggtaggttttacagtgtgccatgtcaagctcgcggctgagctaagctgtcagactggtgggccactcactctggtgcacccgctgtgaacgccggccttgacgtatgtctccgcgccttcccatggccgctactgctaactgcttttagatgaccatgccgggcgacgagacactcagctctggaacgacgtacgcagctcctgccgtaagctgtcttgcggcattctgacgtgcgcattgccagctacttcggacagaacctcgtcaacgctgtgaacagcggccaagtctcgcaggccagggttaaggtacgcagaatcgaccatatatctactaataggacttgaatgttgtcttgcacaggacatggcgactcgcatccttgcggcgtggtacctccttggccaagaccaaaacttccccgcggtcaacttcaactcgtggaactctggtcagggccagcatgtgaacgtctccggcaaccatgcgaggtactgtaaaccgggtatccactactcggcgcgcaccgctgacacgtctgtagcctcatccgcaccatcggcgcggcctcgcaaatcctgctcaagaacgtgaacagtgcgcttccgctcaaaaagcccaagactattggcatcattgggaacggtgctggatcaaaccctaacggtcccaacgcgtacggacacaatccagctttacgttcccaaagcttgctgaagtttcgtttacgccagtttctccgaccgcgccggagacgtcggtgtcctcgcgcttgggtggggcagtgggtaagtcggcgcccgacgttggggttgctacaagctcacggtgccacaaaatatagcactgcgaacttcccgtacttggtcgcagtaggtctatgcttctgctgcgtttccgctgtaactgacgcgccttagcccgtcgacgcgattactgctcgtgcgtcgcaggatgggacgaccgtgtcgtcgtcactgagtgacaccgacctgacgggcgctgctaacaccgcgaccgggaaggacgtcgcgatggtgttcatcacggccgacagcgggtgcgtgtgtctggccctgttcttatggcgcacgctgatatttttacagtgaaggataccttactgtcgagggcaatgcaggtgaccgtaacgacctccaggcatggcacggaggtgtaagtgcgcctaacatcgtgactacatgcccgcttatacacagacgcctctaggatgcgctggttcagcaggtcgcgagccacaacaagaacacgattgtcgtgatcaacagtgtcggacctatcaatatggaagcctgggtcaaccacccgaacgtcaccgctattgtgagtgaccgtgtgcattggagagccctgctgctgacgccgctcggttaactaggtttggagtggcctccctggtcaggaagcaggtatgcatatacgcgcaagattcgctgtgcgaaacactcaccctgtgcccgataggcaacgcggtcactgacgttctatttggcgcggtcaaccctgggtacgtggtcgaccatgtcgttaggcgtagggacggtatgctgacaccgaccacagcggcaagctgcccttcaccatcggcaagtcgatcagcgactactccgcgcagatcatcaccaccggctcgggcatcgtgcccatcccgtacaacgagggcctcttcatcgactaccggcactttgaccaggtgtgtaccggggtgcgtgcgcagcgcgcagcgtgctgacgggggcgtgcttaggcgggcatcgcaccgcgcttcgagttcgggttcggcctctcgtacacgacgttcgactactcgaacctcgtcatcacgggctcgacggccggcggcacgcgtcagcccccggggcccggctcgtcgctcgacccatggtgcgccatttccctttcgtaaagtcacctcgctgacgcaggtcgctgcgcccgcgcaggctgcacgactcggtcgtcaccgtgtccttcacgctgacgaacaacggcacggtcgacgggacggaggtgccgcagctgtacctgagcccgcccgcgagcgcgaagagcgcgccgcagaacctgaagggcttcgacagcgtattcctccccgcaggcgcgtcgacgacggtctctttcgagctctcgcgctactcgttctccgtctgggacgtcgtctcccagagctggcagatccctgctggtgtcaccggcatctccgtgggcgcgagcagcagagatttgcgcctcaagggctcaatcacgaactgagggcgaggaacgtgccgtggtaaaaatgtattcgtagtgcactgtgcactatctttcctggcttgacatatgtaaacacttcccatttcgccgacatagcgcgaggtacactgactgactttcacatggaggcacgtttgcccatataagctagcttccccttgcgtgcgaacaggtaaccacgacgggtaaaaatgtttctgcagcccaaccatgtacaaaactacagattaggggggatcacgtcagtgcgaagagtcatgttgctagaagtgaatatgcgggtagtacaatgatatatccagactcggggagttacgtcgccagtgacgcttttga

SEQ ID NO: 1252 - protein, 823 aa, Phanerochaete chrysosporium
MGLTLVVLLHLALGLLTGVQAQSGLYQQCGGIGWTGATTCVSGATCTVLNPYYSQCLPGAATTSVSSSHSSSSSVSSHSSSASSSSISSTSTSPPAPSQTVANVSPEWAAAYVKAQAAVAKLSVTDMVNLATGVQWQKGPCVGNTPAISSIPGFTGLCLQDSPVGVRYADGTSVFPPEINVAATWNRTLMRQRGAAMGAEFKGKGVHVALGPMMNLMRVPAAGRNWEGGGGDPFLSGEVAFETITGIQSSGAQACAKHFINNEQEHFRDSSSSNVDDRTEHELYGHPFLRSVQANVASVMCSYNQINGTFSCENEKTLSGLLKGEYGFQGYVMSDWWATHSGAPAVNAGLDMTMPGDETLSSGTTYFGQNLVNAVNSGQVSQARVKDMATRILAAWYLLGQDQNFPAVNFNSWNSGQGQHVNVSGNHASLIRTIGAASQILLKNVNSALPLKKPKTIGIIGNGAGSNPNGPNAFSDRAGDVGVLALGWGSGTANFPYLVAPVDAITARASQDGTTVSSSLSDTDLTGAANTATGKDVAMVFITADSGEGYLTVEGNAGDRNDLQAWHGGDALVQQVASHNKNTIVVINSVGPINMEAWVNHPNVTAIVWSGLPGQEAGNAVTDVLFGAVNPGGKLPFTIGKSISDYSAQIITTGSGIVPIPYNEGLFIDYRHFDQAGIAPRFEFGFGLSYTTFDYSNLVITGSTAGGTRQPPGPGSSLDPWLHDSVVTVSFTLTNNGTVDGTEVPQLYLSPPASAKSAPQNLKGFDSVFLPAGASTTVSFELSRYSFSVWDVVSQSWQIPAGVTGISVGASSRDLRLKGSITN

SEQ ID NO: 1253 - DNA, 4193 bp, Kluyveromyces marxianus
attgaataatggggctgcaaaaattaagggtgctaaaatatataccagtactacctaaagcagtatgcattcccattattacttggaggaagggccttcgaaagcgtttgaaacaggagtaggagtaggagtattacggagaaatgggcattgaatagaggtagcaaaggaaaagccgtgacaatgcggcaatgtacccaacctatgagtctgtgtgtgtaaagtgtgtgtgtctttttttttttaattttaatttttttttttaattattgaaaaaccaggactacgtcaggttaggagaatggatattgaaaatattaatgtaccagtagttttgcatgtataattattattaccaatagacgaagtggaggtattagagcgatttgggggaattgtgattgtatatatagtgtgtatgttttacggtactgaaagatcgtgttgtaaggaaaaataaggcacaggaaaaattcagattttttaagggtttattactaggagcagtagtagtagtagagtagtggtagcaaaagccgagatctaggtagagacagatctgtaatacatagctagttgaagttgaagaagtgcaaacgttaagaaaaaaaatgtctaaatttgatgttgaacagttattgagtgaattgaaccaggatgaaaagatttccttactttctgcagttgatttctggcatactaagaagattgaacggttgggaattccagcggtgagggtttctgatggtccaaatggtattagagggacgaagttctttgatggggttccttcaggatgtttccctaatggtaccgggttggcatctacttttgatcgcgatctgcttgagacagcaggtaagttgatggctaaggaatcgattgcgaagaatgctgctgtgattttgggtccaaccacaaacatgcaacgtggtcctttgggtggtcgtggttttgaatcattctctgaagatccatatcttgctggtatggctacttcttctgttgttaaaggtatgcaaggcgaaggtattgctgctaccgttaagcattttgtttgtaacgacttggaagaccaacgtttttcttcgaactcaattgtttctgaaagggctctgagagaaatttacttggagcccttcagattggcagttaaacatgccaatcctgtttgtataatgactgcttataacaaggtcaatggcgatcattgctcccaatccaagaagctattgatcgacattttgagagacgagtggaaatgggacggtatgttaatgtccgactggttcggtacatatacgactgccgcagctatcaagaatgggttggatatcgagttccctggaccaacaagatggagaacacgtgctttagtgtctcactctctcaactccagagaacaaatcactactgaagatgttgatgatcgtgttagacaagtgctaaaaatgattaagttcgttgttgacaatttagagaaaacaggtattgtggagaatggcccagaatctacttcaaacaacaccaaggaaacctcggacctgttgagagagattgctgctgactctattgttttattgaagaacaaaaacaattatcttacctctaaagaaagaagacaatatcatgtcattggcccaaatgctaaagcaaagactagttccggtggtggttcagcatctatgaactcctactatgttgtttctccgtatgaaggtatcgtcaataagctgggcaaagaggtcgattacaccgtaggggcctattcacacaaatcgattggaggtttggcagagagtagtttgatcgatgctgcaaaaccagcagatgctgaaaatgctggattaattgccaagttttactccaatccagtagaagagagatctgaagatgaagaaccattccacgttaccaaagtcaatagatccaatgttcacttatttgatttcaaacatgagaaagtggatccaaagaacccttacttttttgtaaccttaaccggacagtacgtgcctcaagaagatggtgattatatcttcagtcttcaagtttatggttctggtttgttctacttaaacgatgagttgattattgaccaaaagcacaaccaagaaaggggtagtttctgctttggagctggtaccaaagaaagaaccaaaaagttgactttgaagaagggccaagtttataatgtaagagttgagtacggttctggcccaacttcaggtttggttggggaattcggtgcaggtggattccaagctggtgtcattaaggcgatcgatgatgacgaggagattagaaacgcagcagaattagcagctaagcatgataaggctgtgttgataattggattaaatggtgaatgggaaaccgaaggttatgacagagaaaacatggatttgccaaaaagaacaaatgaattagttcgtgctgttttgaaagcaaatccaaatactgttatcgttaaccaatcaggtaccccagttgagttcccttggttagaagaggcaaatgcgctagttcaagcttggtacggtggtaatgaattgggtaatgctatcgcagatgtcttgtacggtgacgtggttccaaatggtaagttatcgctctcttggccatttaagttgcaagataatccagcctttttaaacttcaagaccgagttcggaagagttgtttacggtgaggatatctttgttggttataggtactacgaaaagcttcaaagaaaggtagccttccccttcggatatggtctatcgtatacaacattcgaactagatatttctgacttcaaggtaactgatgataagatagatatttcagttgatgtgaagaatactggtgataaatttgctggctccgaggtggtgcaagtctacttcagcgctctaaactctaaggtctcgagaccggttaaggagttgaagggattcgaaaaagttcatttggaaccaggtgagaagaagacagttaatattgaactagaattgaaagatgcaatttcctactttaacgaagagctcggtaaatggcacgttgaagcaggtgaatacttggtttcagttggtacttcttctgatgatatactttccgtcaaagagtttaaagtagaaaaagacttgtactggaaaggtttgtgaagaatgctaaaatggtttagtgtttccaatccaggtgcaagtttcattgtacagttataattatatatatgtgtaacgtgcaatgacccatcataacagagagttattcgctattaaacacaaaaaacaaacaaaccagtaactacatgaaatgaataggtattaaagtcttgaatttcccatgaaatacgaacctttacagtttgaacttaacaatatggcctttttaagccatatcaacctcatgaaattacggggaaggaaacgatgaaaggtcaaagcctattaagcatagtactgcatctaagggagagtggtaccctttacaaggttttttgttttccagagtagtttgcgaatactacaaatacgttgaatttttgaagttacatttcattacgtaacatttaaactaattagatagtaaataataaacatcgcaatacacattaaatcattgaattaacctatacagcttagattcgcagaatatattctaacagtaactgttagaataatccattaagagtctaaagcctgtggctttttaattgatgaattccacaagactttttgctgcaattaggagaagatcaagcagaataaaaaacaaattatgaagtacggaaacttcttgcacctaacaaaatatattgaaaagatggctttaaacagattctgcctctgaaagcttttcgacatgatcagcatcgctctttagaggctcttgctctttcaaattttgagcatttgcaactctaacgtcatttcgttggaccaaagttgccctgactgagccaagaatgcttgatcaacgatcctttcttgggtttggagcttcaaagacaacttctaattcttctaagcttctacccttagtttcaacgaagaagaagtagataacaataaattcgaaaatatcgaagaaaacgtagaacacatagaaccaatatttgatattcttcatgcctttggagtagcaaattgattaacaaattgggcaacaccagaaaccaacatgttgaggagttgggccttagatct

SEQ ID NO: 1254 - protein, 845 aa, Kluyveromyces marxianus
MSKFDVEQLLSELNQDEKISLLSAVDFWHTKKIERLGIPAVRVSDGPNGIRGTKFFDGVPSGCFPNGTGLASTFDRDLLETAGKLMAKESIAKNAAVILGPTTNMQRGPLGGRGFESFSEDPYLAGMATSSVVKGMQGEGIAATVKHFVCNDLEDQRFSSNSIVSERALREIYLEPFRLAVKHANPVCIMTAYNKVNGDHCSQSKKLLIDILRDEWKWDGMLMSDWFGTYTTAAAIKNGLDIEFPGPTRWRTRALVSHSLNSREQITTEDVDDRVRQVLKMIKFVVDNLEKTGIVENGPESTSNNTKETSDLLREIAADSIVLLKNKNNYLTSKERRQYHVIGPNAKAKTSSGGGSASMNSYYVVSPYEGIVNKLGKEVDYTVGAYSHKSIGGLAESSLIDAAKPADAENAGLIAKFYSNPVEERSEDEEPFHVTKVNRSNVHLFDFKHEKVDPKNPYFFVTLTGQYVPQEDGDYIFSLQVYGSGLFYLNDELIIDQKHNQERGSFCFGAGTKERTKKLTLKKGQVYNVRVEYGSGPTSGLVGEFGAGGFQAGVIKAIDDDEEIRNAAELAAKHDKAVLIIGLNGEWETEGYDRENMDLPKRTNELVRAVLKANPNTVIVNQSGTPVEFPWLEEANALVQAWYGGNELGNAIADVLYGDVVPNGKLSLSWPFKLQDNPAFLNFKTEFGRVVYGEDIFVGYRYYEKLQRKVAFPFGYGLSYTTFELDISDFKVTDDKIDISVDVKNTGDKFAGSEVVQVYFSALNSKVSRPVKELKGFEKVHLEPGEKKTVNIELELKDAISYFNEELGKWHVEAGEYLVSVGTSSDDILSVKEFKVEKDLYWKGL

SEQ ID NO: 1255 - DNA, 3096 bp, Pichia capsulata
agcagctgtaaaacgacatactgaatgccccacctggcattgatcctgttgttcgtgaattgagacaacccagcaacgacaaagctttgtgatcttgcgtcttactactgcggggttagtccgttcaccccccagtgaccttaccccttcattttttcgcttggcggacctgttgttgggcaggggaaaccctataaagagtgtacggttcaccacacaggtgggagctgggagggacaacgatgaaatcaacaattatcattctatccgttttagctgcagctacagcaaagaatatctccaaagcggagatggagaacctcgaacactggtggtcctatggaagatcagatccggtatatccatctccagagatctctggcctcggtgactggcaattcgcgtaccagagggccagagagattgtcgcgctcatgaccaacgaggagaagacgaacctcacgtttggaagctccggtgacaccggttgttcaggtatgatctccgacgtaccagatgttgacttcccaggtctgtgtttgcaagatgctggtaacggtgtcaggggcactgatatggtcaacgcttatgcttcgggtctgcacgttggtgcttcttggaacagacagcttgcctacgaccgcgctgtctacatgggtgccgaattcaggcacaagggggtcaacgtcttacttggtcccgtggttggtcccatcgggagagtcgccacaggcggacgtaactgggaaggtttcaccaacgacccttacctggccggtgccctcgtctacgagacaacaaagggtattcaggaaaacgtcattgcctgtaccaaacacttcattggaaacgaacaggagacaaacagaaatccttctggtacctacaaccagtctgtatccgccaacattgacgacaagactatgcacgagttgtacctctggcccttccaggactctgtccgggctggtctcgggtccatcatgggatcctacaaccgtgtcaacaacagttatgcttgtaagaacagcaaggttctcaatggtcttctcaagtccgagctcgggttccaaggttttgttgtttccgactggggtggccagcacactggtattgccagtgccaatgcaggtcttgacatggccatgccttcgtcgacatactgggaagaggggctcatcgaggctgtcaagaacggtacagttgaccaatcacgtctcgatgacatggctacacgtatcatagccgcttggtacaagtatgcgagacttgatgacccaggttttggtatgcctgtcagccttgccgaagaccatgagcttgtcgatgcccgtgacccagctgctgcttcaaccatcttccagggagctgtggagggccatgtactggtgaaaaatgaaaatgctctacctctgaagaagcccaagtacatctccctcttcggatatgacggggtttctacagatgtcaacacagtgggcggtggtttctcatttttctccttcgacgtgaaggcaatcgagaacaagactctcataagtggtggtggttctggaaccaacactccctcctacgtcgacgcacctttcaacgcctttgtcgccaaagcccgtgaggacaacacctttctgtcctgggacttcacctctgctgagccggttgccaatcccgcttcggatgcgtgcattgacttcatcaacgccgctgcgtcagagggctacgaccgaccaaaccttgctgacaagtattctgacaaacttgtcgaggctgttgcatctcagtgcagcaacaccatagtggtcatccacaacgcaggtatccgtcttgtggacaactggattgagcacgagaacgttaccggggtcatcctggcgcaccttcccggccaagacacgggaacctcgcttatcgaggttttgtatggcaaccaatcaccatctggacgtcttccatacaccgttgctaaaaaggcctctgactacggtggccttctgtggcccaccgagcctgagggagaccttgacctctacttcccccagtccaacttcactgagggagtttacatcgactacaagtacttcatccagaagaacatcactccacgttatgagtttgggtatggtctaacatacaccaccttcgactactccgagttggaggttgacgccatcaccaaccaaagctaccttccccccgactgtaccatcgaagagggaggtgccaagtctctctgggatatcgttgccacagtcaagttcaccgttaccaacaccggtgatgtcgccgctgcagaggtcccacagctctacgtcggtatccccaacgggccacccaaagtcctcagaggtttcgataagaagctcatccaccctggccagtctgaagagttcgtctttgaactgacccgtcgcgaccttagcacctgggatgttgttgcccagaattggggattgcaagccggtacctaccagttctacgtcggtaggagtgtctttgacgttccattaaccagcgctctggtcttcacaaactgatgttccagttttatttacctttcttcacctttctttaccgatattcttcactttctcgacttgtggtctgcttcttttctaagacaaaaattcaatcaaacagtgtttcccaaaacggaagatgcgccgtagccagaattcccgcgcaattgataagggtttggctgtcaaaaaccaacggctgtgataagggagagcagtgccgtgtaagatctgtagggcattgttgtgggaaataaaatggtatcattgattcaaagcgagagagaagtgaagcgttgttcagattatatggggtaacatctatttgtttactggtctttcaaaattaagcgccggcccaggggtaaacagcggctgcaaatggcggtaaagataaaaaaaagttgtaggattacgaggacaaaaccatagccttgtatgtgaatgctgattatcacgttgttgagagtctcgaacatcaagctttcaacgttttgttaatttaacttttctgtgaatgcaaaagggaaattggttttggcgccgagaaagtcttatctctgggccggagatccctggg

SEQ ID NO: 1256 - protein, 763 aa, Pichia capsulata
MKSTIIILSVLAAATAKNISKAEMENLEHWWSYGRSDPVYPSPEISGLGDWQFAYQRAREIVALMTNEEKTNLTFGSSGDTGCSGMISDVPDVDFPGLCLQDAGNGVRGTDMVNAYASGLHVGASWNRQLAYDRAVYMGAEFRHKGVNVLLGPVVGPIGRVATGGRNWEGFTNDPYLAGALVYETTKGIQENVIACTKHFIGNEQETNRNPSGTYNQSVSANIDDKTMHELYLWPFQDSVRAGLGSIMGSYNRVNNSYACKNSKVLNGLLKSELGFQGFVVSDWGGQHTGIASANAGLDMAMPSSTYWEEGLIEAVKNGTVDQSRLDDMATRIIAAWYKYARLDDPGFGMPVSLAEDHELVDARDPAAASTIFQGAVEGHVLVKNENALPLKKPKYISLFGYDGVSTDVNTVGGGFSFFSFDVKAIENKTLISGGGSGTNTPSYVDAPFNAFVAKAREDNTFLSWDFTSAEPVANPASDACIDFINAAASEGYDRPNLADKYSDKLVEAVASQCSNTIVVIHNAGIRLVDNWIEHENVTGVILAHLPGQDTGTSLIEVLYGNQSPSGRLPYTVAKKASDYGGLLWPTEPEGDLDLYFPQSNFTEGVYIDYKYFIQKNITPRYEFGYGLTYTTFDYSELEVDAITNQSYLPPDCTIEEGGAKSLWDIVATVKFTVTNTGDVAAAEVPQLYVGIPNGPPKVLRGFDKKLIHPGQSEEFVFELTRRDLSTWDVVAQNWGLQAGTYQFYVGRSVFDVPLTSALVFTN

SEQ ID NO: 1257 - DNA, 3371 bp, SACCHAROMUCOPSIS FIBULIGERA
cagctgcaagaatatccgagaccccagtttctccgcaaatacatgcagaggcgcatgacaaagccgcgtactgcatccgtcatacagatttaagcgcattaatatagtctatgaaaaatctataatagatctattttaatattgcacatcgcgagaagcataacacatccttgcaggactatactgaaataactacctttatgaatgtgcagtatgttcgtttttttaaccctttctatatgcagttaaatggcctagccataattactttgaaaagcacttttcacagcaaacattttgaagatatataaatagatttcatttctctgattttgtaaatatttcacttgaaagttttgcttcttcttcatcttcatcaccactaacagttttaataagctaaaggtgaaaaaaaattaatatgttgttgattttggaactcttagtacttattatagggcttggagttgctcttcctgttcaaactcataatctgactgataatcaaggctttgatgaagaaagctcccaatggattagcccgcattattatccaactccacaaggtggtaggctccaaggcgtctggcaggatgcttacaccaaagcaaaagccctcgttagccagatgactattgttgaaaaggtcaatttgaccaccggtaccggttggcaattaggtccatgtgttggtaacaccggttctgttccaagattcggcatcccaaacctttgcctacaagatggaccattgggtgttagacttactgatttctctacaggttatccatctggcatggccaccggtgcaacgttcaataaggatttgttccttcaaagaggtcaagctcttggccacgagttcaacagcaaaggtgtacatattgcattgggccctgctgttggcccacttggtgtcaaagccagaggtggccgaaatttcgaggcctttggttccgacccatatctccaaggtattgctgctgctgcaaccatcaaaggtctccaagagaataatgttatggcttgtgtcaagcactttattggtaacgaacaagatatctacagacagccaagtaatagtaaggtcgaccccgagtatgatccagctacaaaagagtctattagtgctaatattccagacagagccatgcatgagttgtacttgtggccatttgccgattctattcgagcaggtgttggttctgttatgtgctcttataacagagtcaacaacacatactcttgcgaaaactcttacatgattaatcatttgcttaaagaagaattgggttttcaaggctttgttgtttcggactgggctgcccaaatgagtggggcttatagtgctatctctgggttagatatgtccatgcctggtgagcttttaggtggctggaatactggtaaatcttactggggccagaacttgaccaaagccgtctataatgagactgtcccgattgaaagattagatgatatggcaaccagaatcttggctgctttatacgctaccaatagtttccctacgaaagatcgccttccaaacttttcctcttttacaacaaaggagtatggtaatgagtttttcgttgacaaaacttctccagtagttaaagtgaatcactttgttgatccttcaaatgattttactgaggatactgctttgaaggttgctgaggaatctattgtacttttaaaaaacgaaaagaacaccttgccaatctctccaaataaagttagaaaactattgttgtcaggaattgccgctgggcctgatccaaaaggttacgaatgctcagatcagtcatgtgttgatggggcattatttgaaggttgggggtctggtagtgttggctatcctaaatatcaagttaccccatttgaagagatttcagcaaatgccagaaagaacaaaatgcagtttgattatatcagagagtcatttgatttaacacaggtatcaacagttgcttctgatgcacatatgagtattgttgttgtttctgcggttagcggggaaggttaccttattattgatggcaacagaggtgacaaaaataatgtgacattgtggcacaacagtgataatttgattaaggccgttgcagaaaattgtgcaaatactgttgttgttattacgtctacaggccaagttgatgtggaaagctttgcggatcacccaaatgtcacggctatcgtttgggcaggtccattgggcgatagatctggaacagctattgccaacatcctttttggcaacgcaaacccatcaggtcatcttccgttcactgttgctaaaagtaatgatgattatatcccaattgtgacttacaatccacctaatggcgagcctgaggacaatactttggcagagcatgacttgcttgttgactatagatattttgaagagaagaatattgagccaagatacgcatttggttatggcttgtcttacaatgagtataaagttagcaatgcaaaggtctcggcagccaaaaaagttgacgaagagttgccacaacctaaattgtatttagctgagtacagctacaacaaaactgaggaaataaataatcctgaagacgctttctttccaagcaacgctagaagaattcaagagttcctctacccatatttagatagcaatgttaccttgaaagacggaaactatgagtatcctgatggctacagcacagagcaaagaacaacgcctatccaacctgggggcggcttgggaggcaacgatgctttgtgggaggtcgcttataaagttgaagtggacgttcaaaacttgggtaactccactgataagtttgttccacagttgtatttgaaacaccctgaagatggcaagtttgaaaccccggttcaattgagagggttcgaaaaggttgagttgtccccgggtgagaagaagacagttgagtttgagcttttgagaagagatcttagtgtgtgggataccaccagacaatcctggatcgttgaatctggtacttatgaggccttaattggtgttgctgttaatgatatcaagacatctgtcctgtttactatttgatttttgagcattttactcttataattttactctttctatgtcgttctaaattattttaaaaaaaaaatctttttctgttctgattttttccaattaaaaagtttttggttttgcttttcactgtttcagtgctttaacaagatacatatgtcaataccaatttgtctaattttcttatataatcacatttcaactatgttatttctgctggctgaataaataccatgatttttgcttattccaattcatcgctttatcggttcatttctatagatttactatgacgttgattttttcatcactgcag

SEQ ID NO: 1258 - protein, 880 aa, SACCHAROMUCOPSIS FIBULIGERA
MLLILELLVLIIGLGVALPVQTHNLTDNQGFDEESSQWISPHYYPTPQGGRLQGVWQDAYTKAKALVSQMTIVEKVNLTTGTGWQLGPCVGNTGSVPRFGIPNLCLQDGPLGVRLTDFSTGYPSGMATGATFNKDLFLQRGQALGHEFNSKGVHIALGPAVGPLGVKARGGRNFEAFGSDPYLQGIAAAATIKGLQENNVMACVKHFIGNEQDIYRQPSNSKVDPEYDPATKESISANIPDRAMHELYLWPFADSIRAGVGSVMCSYNRVNNTYSCENSYMINHLLKEELGFQGFVVSDWAAQMSGAYSAISGLDMSMPGELLGGWNTGKSYWGQNLTKAVYNETVPIERLDDMATRILAALYATNSFPTKDRLPNFSSFTTKEYGNEFFVDKTSPVVKVNHFVDPSNDFTEDTALKVAEESIVLLKNEKNTLPISPNKVRKLLLSGIAAGPDPKGYECSDQSCVDGALFEGWGSGSVGYPKYQVTPFEEISANARKNKMQFDYIRESFDLTQVSTVASDAHMSIVVVSAVSGEGYLIIDGNRGDKNNVTLWHNSDNLIKAVAENCANTVVVITSTGQVDVESFADHPNVTAIVWAGPLGDRSGTAIANILFGNANPSGHLPFTVAKSNDDYIPIVTYNPPNGEPEDNTLAEHDLLVDYRYFEEKNIEPRYAFGYGLSYNEYKVSNAKVSAAKKVDEELPQPKLYLAEYSYNKTEEINNPEDAFFPSNARRIQEFLYPYLDSNVTLKDGNYEYPDGYSTEQRTTPIQPGGGLGGNDALWEVAYKVEVDVQNLGNSTDKFVPQLYLKHPEDGKFETPVQLRGFEKVELSPGEKKTVEFELLRRDLSVWDTTRQSWIVESGTYEALIGVAVNDIKTSVLFTI

SEQ ID NO: 1259 - DNA, 3215 bp, SACCHAROMUCOPSIS FIBULIGERA
ggtgaccaagcatggcatactgaggttctttaatatataaaccgaggtctgcgccaggttgcaagccacatatttgttttagtttcaacataaagaagaaaatcaaacaaaacaaaaaacaagtacaatctataaaataaaataaaacaaaatagagataaaaacaaaatagaaataaaaacaaaaataaaaaaattaaaataaattaataaaaaaatataaatctcttgacaaaaaaacttccatttacatagaagaaaaaatttgaaccccaaaatgttgatgatagtacagcttttggtctttgcactaggccttgctgttgctgtcccaattcaaaactatacccagtctccatcccagagagatgagagctcccaatgggtgagcccgcattattatccaactccacaaggtggtaggctccaagacgtctggcaagaagcatatgctagagcaaaagccatcgttggccagatgactattgttgaaaaggtcaatttgaccactggtaccggttggcaattagatccatgtgttggtaataccggttctgttccaagattcggcatcccaaacctttgcctacaagatgggccattgggtgttcgattcgctgactttgttactggctatccatccggtcttgctactggtgcaacgttcaataaggatttgtttcttcaaagaggtcaagctctcggtcatgagttcaacagcaaaggtgtacatattgcgttgggccctgctgttggcccacttggtgtcaaagccagaggtggcagaaatttcgaagcctttggttccgacccatatctccaaggtactgctgctgctgcaaccatcaaaggtctccaagagaataatgttatggcttgtgtcaagcactttattggtaacgaacaagaaaagtacagacagccagatgacataaaccctgccaccaaccaaactactaaagaagctattagtgccaacattccagacagagccatgcatgcgttgtacttgtggccatttgccgattcggttcgagcaggtgttggttctgttatgtgctcttataacagagtcaacaacacttacgcttgcgaaaactcttacatgatgaaccacttgcttaaagaagagttgggttttcaaggctttgttgtttcggactggggtgcacaattaagtggggtttatagcgctatctcgggcttagatatgtctatgcctggtgaagtgtatgggggatggaacaccggcacgtctttctggggtcaaaacttgacgaaagctatttacaatgagactgttccgattgaaagattagatgatatggcaaccaggatcttggctgctttgtatgctaccaatagtttcccaacagaagatcaccttccaaatttttcttcatggacaacgaaagaatatggcaataaatattatgctgacaacactaccgagattgtcaaagtcaactacaatgtggacccatcaaatgactttacggaggacacagctttgaaggttgctgaggaatctattgtgcttttaaaaaatgaaaacaacactttgccaatttctcccgaaaaggctaaaagattactattgtcgggtattgctgcaggccctgatccgataggttatcagtgtgaagatcaatcttgcacaaatggcgctttgtttcaaggttggggttctggcagtgttggttctccaaaatatcaagtcactccatttgaggaaatttcttatcttgcaagaaaaaacaagatgcaatttgattatattcgggagtcttacgacttagctcaagttactaaagtagcttccgatgctcatttgtctatagttgttgtctctgctgcaagcggtgagggttatataaccgttgacggtaaccaaggtgacagaaaaaatctcactttgtggaacaacggtgataaattgattgaaacagttgctgaaaactgtgccaatactgttgttgttgttacttctactggtcaaattaattttgaaggctttgctgatcacccaaatgttaccgcaattgtctgggccggcccattaggtgacagatccgggactgctatcgccaatattctttttggtaaagcgaacccatcaggtcatcttccattcactattgctaagactgacgatgattacattccaattgaaacctacagtccatcgagtggtgaacctgaagacaaccacttggttgaaaatgacttgcttgttgactatagatattttgaagagaagaatattgagccaagatacgcatttggttatggcttgtcttacaatgagtatgaagttagcaatgcaaaggtctcggcagccaaaaaagttgatgaggagttgcctgaaccagctacctacttatcggagtttagctatcaaaatgcaaaagacagcaaaaatccaagtgatgcttttgctccagcagatttaaacagagttaatgagtacctttatccatatttagatagcaatgttaccttaaaagacggaaactatgagtatcctgatggctacagcactgagcaaagaacaacacctaaccaacctgggggcggcttgggaggcaacgatgctttgtgggaggtcgcttataactccactgataagtttgttccacagggtaactccactgataagtttgttccacagttgtatttgaaacaccctgaggatggcaagtttgaaacccctattcaattgagagggtttgaaaaggttgagttgtccccgggtgagaagaagacagttgatttgaggcttttgagaagagatcttagtgtgtgggataccaccagacagtcttggatcgttgaatctggtacttatgaggccttaattggcgttgctgttaatgatatcaagacatctgtcctgtttactatttgatttttgagcattttactcttataattttactctttctatgtcgttctaaattttttttttaaaaaaaatcgttttctgttctgattttttccaattaaaaagtttttggttttacttttcactgtttcagtgctttaacaagatatatatatcaataccaatttgtctaattttcttatataatcgcatttcaactatgttagttctgctggctgaatgaataccatgatttttgcttattccaattcatcgctttatcggttcatttctatagatttactatgacgttgatttttccatcactgcag

SEQ ID NO: 1260 - protein, 876 aa, SACCHAROMUCOPSIS FIBULIGERA
MLMIVQLLVFALGLAVAVPIQNYTQSPSQRDESSQWVSPHYYPTPQGGRLQDVWQEAYARAKAIVGQMTIVEKVNLTTGTGWQLDPCVGNTGSVPRFGIPNLCLQDGPLGVRFADFVTGYPSGLATGATFNKDLFLQRGQALGHEFNSKGVHIALGPAVGPLGVKARGGRNFEAFGSDPYLQGTAAAATIKGLQENNVMACVKHFIGNEQEKYRQPDDINPATNQTTKEAISANIPDRAMHALYLWPFADSVRAGVGSVMCSYNRVNNTYACENSYMMNHLLKEELGFQGFVVSDWGAQLSGVYSAISGLDMSMPGEVYGGWNTGTSFWGQNLTKAIYNETVPIERLDDMATRILAALYATNSFPTEDHLPNFSSWTTKEYGNKYYADNTTEIVKVNYNVDPSNDFTEDTALKVAEESIVLLKNENNTLPISPEKAKRLLLSGIAAGPDPIGYQCEDQSCTNGALFQGWGSGSVGSPKYQVTPFEEISYLARKNKMQFDYIRESYDLAQVTKVASDAHLSIVVVSAASGEGYITVDGNQGDRKNLTLWNNGDKLIETVAENCANTVVVVTSTGQINFEGFADHPNVTAIVWAGPLGDRSGTAIANILFGKANPSGHLPFTIAKTDDDYIPIETYSPSSGEPEDNHLVENDLLVDYRYFEEKNIEPRYAFGYGLSYNEYEVSNAKVSAAKKVDEELPEPATYLSEFSYQNAKDSKNPSDAFAPADLNRVNEYLYPYLDSNVTLKDGNYEYPDGYSTEQRTTPNQPGGGLGGNDALWEVAYNSTDKFVPQGNSTDKFVPQLYLKHPEDGKFETPIQLRGFEKVELSPGEKKTVDLRLLRRDLSVWDTTRQSWIVESGTYEALIGVAVNDIKTSVLFTI

SEQ ID NO: 1261 - DNA, 576 bp, Schizophyllum commune
gaattcccgtacttgattacacctctcgacgcgattacagcacgcgcgcaggaggacggcacgaccgtcacgtcctcgctcagtgacagtgacaccgctcgcgccgcgcagattgctgccgctgccgacgtcgccattgtgttcatctcttcggactccggggagggatacctcactgtcgagggcaacgccggcgatcggaatgacttgcttgcctggcacgacggggatgcacttgtccaggctgttgcggatgccaacgagaacaccattgtcgctgtgaacacggtcggcgccatcatcactgaggcttggatcgagcacccgaacgtcaaggccgttgtctggagtggtcttcctgggcaggaggccggcaactccgttgctgacatcctctacggtgcatacaacccgagcggtcgtctcccttacaccattgccaaatccgcggacgactaccccgcgcaagtgctttacgaatcgagcgcgcaagtgccagacatcgactactccgagggcctccttgtcgactaccgccactttgatgccaatggcatcgagccccgattcgaattc

SEQ ID NO: 1262 - protein, 192 aa, Schizophyllum commune
EFPYLITPLDAITARAQEDGTTVTSSLSDSDTARAAQIAAAADVAIVFISSDSGEGYLTVEGNAGDRNDLLAWHDGDALVQAVADANENTIVAVNTVGAIITEAWIEHPNVKAVVWSGLPGQEAGNSVADILYGAYNPSGRLPYTIAKSADDYPAQVLYESSAQVPDIDYSEGLLVDYRHFDANGIEPRFEF

SEQ ID NO: 1263 - DNA, 1608 bp, Gibberella zeae
atgcatctgaaatcccttcttctcgcagcactgccattgctactagaagcaagcccaacaatcaagggcgaagacaccgcctcactggcgatcaacaccagctctggaatctttgctccatactttgacagacagcaaccaaatgtcgcgtccttcctcgacattccctacgcagaaacacccattgggaatctcagatttgcaccaccagtagaaaagaagaacgctggagatggtattgtccacacaacgaagctcccagcagggtgtattcaatatttgcctgctttgcttcggggaaccatcaacgatggacccatcacagctggcacttttcaacgcggagactacgcaaatacaactgaagattgtctcaaaatctcgctatttgctcctgagaaatctgttcgggccaaagaaggcaaaaaaacccaggctctgcctgtcatcgtctggatccacggagggggctattctgttggtggcaccaacgttccataccaacttgcacagaactgggtgcagcgcacacaaaagcatatagtcgtgcaagtacagtatcgcctcaatcttctaggctttcccaacgctgaaggtctggcatgtgaaggcaacaatctcaaccttggcctacttgatcagcgtctcgctgtcgaatgggtccgcaataacatcgctcgcttcggaggcgaccctgaccgtatcactctttggggcgagagcgccggaggttatgcggttgacggatacctttttgcctgggcccaagatcctatcatcaagggggtcatcgcagactctggcaacgcgttggctctagaaggagtggttggtgactcgaggaatcataccggcttttctcttgctgcaaagtctatgggctgtggtggattgcttccgaaagatgagctcgagtgcatgcgacacgtgcccgagcgcaacttgaaggagtatctccaagcagaggttggtcaaggagcggccgccgatggcggattgaccgtctctgtgatcgctgataacatcactgtcttttccaactatactgagagaatttccggaaactcagcaaagtatccagctaacattcctgtcctgatcggagccaacacaaacgagggagctgctgttgttccgtacaaattccccggctttgaaactgcgactgaactaccagaccagcttaagcctctagctgatggatttggactcaatttacaatgcactaccctcaaagaaacccgtctcagggctgaggcaggtgctacaacctaccagtatctctacgcaggcaatttcaccaacatctcgcctttgccctggttgggcgcatatcacacggcagaattacctttggtctttggaacatacgagacagaaggaccgtctaccaagtttgagcgtaggatgagcgaaagaatgcaggatctttatctcgaatttgccagtgatccgtcgcatggattagagaaatctggatggccgagagcagagtcgcagctggagagatcgaaacttgtcaagttggctgcggacaacaaggttgagcaagttgttagcgcgaagaagttggtagacgagtgtgttcagaatggatttgctgtgtag

SEQ ID NO: 1264 - protein, 535 aa, Gibberella zeae
MHLKSLLLAALPLLLEASPTIKGEDTASLAINTSSGIFAPYFDRQQPNVASFLDIPYAETPIGNLRFAPPVEKKNAGDGIVHTTKLPAGCIQYLPALLRGTINDGPITAGTFQRGDYANTTEDCLKISLFAPEKSVRAKEGKKTQALPVIVWIHGGGYSVGGTNVPYQLAQNWVQRTQKHIVVQVQYRLNLLGFPNAEGLACEGNNLNLGLLDQRLAVEWVRNNIARFGGDPDRITLWGESAGGYAVDGYLFAWAQDPIIKGVIADSGNALALEGVVGDSRNHTGFSLAAKSMGCGGLLPKDELECMRHVPERNLKEYLQAEVGQGAAADGGLTVSVIADNITVFSNYTERISGNSAKYPANIPVLIGANTNEGAAVVPYKFPGFETATELPDQLKPLADGFGLNLQCTTLKETRLRAEAGATTYQYLYAGNFTNISPLPWLGAYHTAELPLVFGTYETEGPSTKFERRMSERMQDLYLEFASDPSHGLEKSGWPRAESQLERSKLVKLAADNKVEQVVSAKKLVDECVQNGFAV

SEQ ID NO: 1265 - DNA, 1542 bp, Schizosaccharomyces pombe
atgactgcactatttaatttctggcgcattatgtatgcgaatatttcgtccatttggctactggtggtttcattttttgaatggttattttccgctacgtcgatatcgcagcagcgtggttccggccctcgaaagggaaaggtagttatgaacaaggattgtcgttcttgggaggattggaaagttttggctacgacgattgacaaggcgtcggggcgttggaaatggcgctttactcctgcctcggacaagtacgactatctattgattgatcgatgcacggtctccttaaaacgataccgccagaggaaatctgtctatcccatgttaatgttcttgcgctctagcttacttcgtaactttggcaacattggcaattcctctctgtataccgagaattactcgggtacaaaaattttgattgaagagtatgtacgtgaggtcaacaattgtttagagtttttatatcacactaaaaggctttcctacgacgttaagtgcgattttttttccgctgcccgaatttccttcggtactacctgtttgtatttcaacggcggcactgcgtttggtctatatcactttggggtagctaagaccctttggaaacgtaatttgcttcctcaaatccttgcaggatgcgcatcaggtgcgttgattgcatcgcttttgagtgtctatcgtgatgaagaattgaatggtttgtttgatactttccccagcgaactgtggaaaatatgtcagcaaacatctgactattctctttcaaaagttgtggagtatgggaatatgcttgacatttccatgatagcatcttttgtccgtcaaagactcggtactattacctttcaagaggcttttgagcgtactggacgtattgttaacatcgttgctccaccttcagctgtttctggatcccctcaggttcttaattatttcactgcccctaatgtgctgatctggagtgccgtatgttctagcaatagctgggctgccatttaccgctcttctcctcttttggctaaacttcccgatgggtctaccgaggtgtgtactcccaaaaattttatttggccgtatgctgggcttcctaataccggtcgctctaatccttatgcacgaatctctgagattttcaacgtgaatcattttgttattacccagtctcgcccttcgttgttccctacattttatgatgaacttcatcatcatcgtgtttcaggatactccttaaaaatgatacgcttagtaggattagaaatggcttaccgtttccgccaactggatattttgggtcttctacctccaagactacgtcgattttttgttgacgattatgttccaagtgcgtatatcacgcttactccaacattttctttctcggacataaagcatgcatttaccaagccctcattaagcgacatccagtattggattctagtaggtgaaagggccacatggcaagctataccacttttacaagttcgctgtaaaactgaaatttctttacgacatcgtatgtggaagccgattcttttttga

SEQ ID NO: 1266 - protein, 513 aa, Schizosaccharomyces pombe
MTALFNFWRIMYANISSIWLLVVSFFEWLFSATSISQQRGSGPRKGKVVMNKDCRSWEDWKVLATTIDKASGRWKWRFTPASDKYDYLLIDRCTVSLKRYRQRKSVYPMLMFLRSSLLRNFGNIGNSSLYTENYSGTKILIEEYVREVNNCLEFLYHTKRLSYDVKCDFFSAARISFGTTCLYFNGGTAFGLYHFGVAKTLWKRNLLPQILAGCASGALIASLLSVYRDEELNGLFDTFPSELWKICQQTSDYSLSKVVEYGNMLDISMIASFVRQRLGTITFQEAFERTGRIVNIVAPPSAVSGSPQVLNYFTAPNVLIWSAVCSSNSWAAIYRSSPLLAKLPDGSTEVCTPKNFIWPYAGLPNTGRSNPYARISEIFNVNHFVITQSRPSLFPTFYDELHHHRVSGYSLKMIRLVGLEMAYRFRQLDILGLLPPRLRRFFVDDYVPSAYITLTPTFSFSDIKHAFTKPSLSDIQYWILVGERATWQAIPLLQVRCKTEISLRHRMWKPILF

SEQ ID NO: 1267 - DNA, 1131 bp, Schizosaccharomyces pombe
atggggtttgcgacgattctttattctatttgggtagtactttcatcttttgtgattctttcagcataccagctggaagttcgcaaatttttggttaagttgttgtccaagatagtcatcggtgcatctgaatcaaatgttgcttctttttttgcttttgtttcagagaaaagcttagaagcggcaagcgttaagttcgttgctactataattgctgagcgtatgggtgcccaattttcttctttctacgacaaaatattttttgttgatatgcttggccttggatccttgtttgctttggccgctgttaatgtacttgccgcccgaaaactcgagtctgaattacccgcatctcttgaaccaagcatcggtaaccgcgatcagcaaaaaaatagctcacttgcaaaatgcttcagtaggttatttatcaatgatttacatgggacaaccgtcaaacgctacccatacatctcttatcttcctaactggcttttagccaaaaataatgctgagcgtctcgtttacaaaagtcaccttttattaaacgcttattcacctccaaaatctgcatccgcatcttctgttattgtttgggtttgtggtgctaagaaatccgaaagcattatcattccctacctttcatctttaggcttcttcgtagtggttcccaattacgcccagcctccaaaatttcccctttccgatgccgtcgaatttgtatctttgtgtgtagattggatagtagagaatgccatctattatgatgcagatccagaacgtatttttttcctaggtgaagatactggtgcgtctgtcgctcttgagagtctaaaacacattcgaccaaactctgtaaaaggcatttttgctctgtgtccccgttctattcaaaatttagtgtggacaaatcaatccactattcctatgatgacattacatgctggagatgtcaatccggttagcgacagtaatgatagagaatcatccgaaaaggcatcattgattaaaaattttgttgtacctggtgctgtcccttattattatgaatttacttctccaagaacaatctcaacggctacgttcatcgcacgttggttcttcttagtagaagataataagaaaacaatttaa

SEQ ID NO: 1268 - protein, 376 aa, Schizosaccharomyces pombe
MGFATILYSIWVVLSSFVILSAYQLEVRKFLVKLLSKIVIGASESNVASFFAFVSEKSLEAASVKFVATIIAERMGAQFSSFYDKIFFVDMLGLGSLFALAAVNVLAARKLESELPASLEPSIGNRDQQKNSSLAKCFSRLFINDLHGTTVKRYPYISYLPNWLLAKNNAERLVYKSHLLLNAYSPPKSASASSVIVWVCGAKKSESIIIPYLSSLGFFVVVPNYAQPPKFPLSDAVEFVSLCVDWIVENAIYYDADPERIFFLGEDTGASVALESLKHIRPNSVKGIFALCPRSIQNLVWTNQSTIPMMTLHAGDVNPVSDSNDRESSEKASLIKNFVVPGAVPYYYEFTSPRTISTATFIARWFFLVEDNKKTI

SEQ ID NO: 1269 - DNA, 1452 bp, Schizosaccharomyces pombe
atgtctaaaaatgaaattaaactacagatggaatatgcttcaagctatgaaacatggcttgaagctgcggaaaaattagatgtcatagaaggaaaatatcaatggagagagcaaaaggagtcagatgagtacgactatgttttagtcgagagtcggctgcatgaactgcgaagacatcgattgtctaaaaatacgagacttttgcttggacttttacgaaattcagttgcaagagactttgcaaatatggataatagtagattatataattatgcacattcagggacaaaaaaattgatagatgagttcattcaagaggttttgatgtgcttgacgtatttagaggaaacgcctgatctttcgttggatgaaaagattactgaattttctcgtttaaaacttacgactggcaatacagcattgatcttaagtggtggtggaacgtttggtatgacacatattggtgttttacagtctttgcatgaacaaggtttggtacctaaaattatctgtggttcatctgctggtgcaattgttgcgtgcgcggcagcagtccgaaataaagaagagcaggagattttgcttagacaatttcatacaggtgatctcagtgtctttactgatcccaatgcagcaccaccatcagttatacagtctgtcaaacagtatttcactagaggctgtgtcttggatatcagccatttggaaagggtaatgaagctgcttattggagatttcactttccaagaggcatatgatcgttcaggatatattttaaatgttactgtgtcttgtggaagcctgtttgagatgcccagtttacttaactacattactgctccaaatgttttagtgtggagtgcggttgtcgcaacgtgctctgttccctttttattcaaacgagctactttgtgggaaagagaccctttaacaagagaagtatcggcattttgtgtaacagatgctccgttatggatggacggatctgttgataatgacattccgcatgctaaactaacggagctgttccatgttaatcattttatcgtatcacaagtcaactttcacatcgttccgtttattatggatccaacatctcataattgggttgagcgctgttgtaagaaggcaattgatttggctgctcaggaagttagcttgacatttcgtttgtttgcagaactaggcattttttcggtattattcacgaagcttcaatctgtaatcacccagaaatattctggagatattacaattatccccagattgaattaccgtgaagtgaataaagtcattaaaaatccaactccttcatttcttttagatgcagcaacgaggggcaaacgtggaacatggacaaaagttccagttactcggaaccattgtgcaatagagattttaatcgcagctgcatatactcggttaataaaaaggtctaaaagtttaaaataa

SEQ ID NO: 1270 - protein, 483 aa, Schizosaccharomyces pombe
MSKNEIKLQMEYASSYETWLEAAEKLDVIEGKYQWREQKESDEYDYVLVESRLHELRRHRLSKNTRLLLGLLRNSVARDFANMDNSRLYNYAHSGTKKLIDEFIQEVLMCLTYLEETPDLSLDEKITEFSRLKLTTGNTALILSGGGTFGMTHIGVLQSLHEQGLVPKIICGSSAGAIVACAAAVRNKEEQEILLRQFHTGDLSVFTDPNAAPPSVIQSVKQYFTRGCVLDISHLERVMKLLIGDFTFQEAYDRSGYILNVTVSCGSLFEMPSLLNYITAPNVLVWSAVVATCSVPFLFKRATLWERDPLTREVSAFCVTDAPLWMDGSVDNDIPHAKLTELFHVNHFIVSQVNFHIVPFIMDPTSHNWVERCCKKAIDLAAQEVSLTFRLFAELGIFSVLFTKLQSVITQKYSGDITIIPRLNYREVNKVIKNPTPSFLLDAATRGKRGTWTKVPVTRNHCAIEILIAAAYTRLIKRSKSLK

SEQ ID NO: 1271 - DNA, 3982 bp, HYPOCREA LIXII
tgctgccttggtcgtcctcgcggccgcagccgggcttttgctttgctccatttctattcaataatgaccgaggattgaagtacagtcttccagcaagcacaagatggatgtcggggtacgtcggggtatgctggcgtttggacgtgcatgttctctgatgagatcgtgattatgcatccaactctgggggaattgcgggggatccgtgtcgaatcacgctatccccgcaatctgaccacggaactcggctacgaaatacgaaatattggctactttttgcgtactcgtattagcttccttgccccttagtcgatattagtcgccccgaccgagaaagcgaccgagaagcaatccgagacagtcggtgaaaaggaacaaaccatgaaaacaccaagccagctgacatgaaagcgtagaattattaccaaaattgcttccgctaagccattgtaccgcggttgcttctgactacactactaggtagtttactgcatttgcgatagccatgacccgaggcagatgagaatacatgtaagcaactccagagttgtcagcttctgagagttgccagcttctgttaaataggtagaggaggtccgactcagtcactgcttcttttctggggattatcgagtcagtttgattcatgttattgccgttcacatagcagccaccttattagtcggctccaccatgttcagcctcacaacattaacgggactccttcttgccgttgcctccaacgcacagctggctggtgcagatggtccaaccgtggccttgcgctattctacagttgttggttctagcagtaatggagtcgatagctttagaggcataccttacgcgcagccgccagtaggatcgctacgattgaagccaccacaacccataacttcttctttgggcgaggttcaggcaaccgctactccgaaagcatgccctcaattttcttcgcagtttactcccagtggcctaccaccagcattagtggatatcatcacgaatatatcgaatgtagtacaaaaccaagacgaggattgcctgacactgaatgtccagaggccctcggatgcttcaagcggttccaagctccctgtagtattcttcatttatggaggagcttttgaatctggcgcaacacagggagttgactccacaaatctcatccaagcctcaattgcttctggtacaccgatcatttttgtggcggcaaattatcgattagggggcttcggtttcctcgctggcaaagagctcctcaacgatggaagtaccaacctaggcctaagggaccagcgtttggcactgcagtgggtcgctgataatattgagcaattcggtggtgatcccgataaagtgacgctttgggggttctctgcaggctctatgagcgtctttgatcagacggcgctctttggaggcaataactcttatcacggaaagcccctttttagggcagcattgatggagagcggcagcatcctgcctgcggagcctgccaattctacaaaggctcaactcatctatgacaaggttgttgacagcgccggatgctcgacatccagcgatactctagcatgtttgaggtccgtagactttaacacctttctgttagcggcagaatctgttcccatctcaagcagttataactccatcgctttgtcatacctaccaaggccagatggaacagtcctccttgattcaccggaaatcttggcttcaagaggtcaatttgcaaaagtccccttgttgctaggcgatcaggaagatgaaggaactcttttctcggtttaccaattgaatcttactagcacacaagacgttgaagaatatcttggcagcctctatttccagcaagccactgcgtcccaggtccaagatctggtggccacctatccagacgatccctcggctggttcgcctttcagaacagggtcgttgaatagcctttatccagaatacaaacgactggccgctatacttggtgactttattttcacacttcagaggcgcagtcttcttgagacagtagaccagatagccccatcagtaccgacgtggtcttttctttcgtcttacttatacgggacggcttttttgggaactttccacacgacctcacaaatcgctgcttttgggctgattccaggctacgctgccgccgttacacaagaattttacatctcttttttcaacacgatgaacccgaacagcaatggctcagcactactccctacatggccatgctggggatcaggaaaacaggtgatgcaacttggtgcaacttcttcatctttgttaaatgacagcttccgatcggcgtcctttgattttatccgatcaaactcccaggcactacatatttagttcaaagtagtagatgaaaaactcttgtaaccttctgcaagaagagagatagtgctattataaaatccttattcttataaggaaatactatattcctacattccgataggcttattattttaccagaagctgtttctatcgaaataatagcctttaattttgcattttcccttgtaacataaaaacaataagctactgtattccctgctattgtttttagtataacgctggctaaaccagctaccctattggttaattcgatcaaaactgaatagaattctgcagagatctaacattgcgttttgagagggaatacagcattttatataaatgatcgcctagatgtatcatcaatttgcgaaggaaactgaaatgggtaagattaagcaatgcggatgaatggtaatcagtatttaccccagagtatgagtgaaagtttctgcgtatcatttcacctgagcccaggcccgtatagtcttcgtcaaccaaaccgtcgcaatacatgccggacgccatcatcaatgacatcaagtttgctttccgcatattccagcaatttgccactattttttgcttcatggaccctgagtggattaacttccttaaataaccgttcgtaaaattgcctcaaagccagtcttgtccccgcgttgagctgcgatgtaaacccgtattcctgagcggctgcttcaactttgggaaagttgcctagtggagtattgggatcgagggccaggaagtgtttcaacctccaaactgttgggcgcagttcacgttggttcagcgggaaggataaaaattcctgcaagcccgaaccaggacttatcctgccgcctaaatcgtatttgtggaagagcttcccaaggctaccgtttgcataggccaaccaaaattcgttgaatgaacacgtaggaatgtcgggataatcttctgttttagcccctaaattttggtcggtctctccttgatttatttcctccgataagatgagctgagtatagaggccccccaagtctaccttcatcgtattcgctacgacaaactgcgaagccaaaatcgtaccatatatcaaattcggcccaaattgggtttggatatgtgctgtccaagatcatagcataaaacaagaagcactttctttttgatggtggctctagctgttgaaggtccttgtcgcgatcttttaggtcgaggttaggcttcgcagcgtctatagctcgttggagtggattatcctttccatcgagctgaagaggcggggttgagttgtcaaggatgtgctggtttcgaaggaaccatgggaagtagctcccgcggttctgctcagacaacctggaaaatgcctctatgattttgctcacaaggatacctttctctcgccattcgtttagctggatagcctcaacatccaaatacacaagacctttataaaggccaaggagataagatttctctctctcgtcgcggcaccgggtgaacccataaatgctcacatgtctctgggtcttgcggaagccagtccccaataacatcactatagagtatgtcgggagttgttatcgagcgagcggaacacttggtgaggtgacgaaatgacattttatcctgaggg

SEQ ID NO: 1272 - protein, 558 aa, HYPOCREA LIXII
MFSLTTLTGLLLAVASNAQLAGADGPTVALRYSTVVGSSSNGVDSFRGIPYAQPPVGSLRLKPPQPITSSLGEVQATATPKACPQFSSQFTPSGLPPALVDIITNISNVVQNQDEDCLTLNVQRPSDASSGSKLPVVFFIYGGAFESGATQGVDSTNLIQASIASGTPIIFVAANYRLGGFGFLAGKELLNDGSTNLGLRDQRLALQWVADNIEQFGGDPDKVTLWGFSAGSMSVFDQTALFGGNNSYHGKPLFRAALMESGSILPAEPANSTKAQLIYDKVVDSAGCSTSSDTLACLRSVDFNTFLLAAESVPISSSYNSIALSYLPRPDGTVLLDSPEILASRGQFAKVPLLLGDQEDEGTLFSVYQLNLTSTQDVEEYLGSLYFQQATASQVQDLVATYPDDPSAGSPFRTGSLNSLYPEYKRLAAILGDFIFTLQRRSLLETVDQIAPSVPTWSFLSSYLYGTAFLGTFHTTSQIAAFGLIPGYAAAVTQEFYISFFNTMNPNSNGSALLPTWPCWGSGKQVMQLGATSSSLLNDSFRSASFDFIRSNSQALHI

SEQ ID NO: 1273 - DNA, 1224 bp, Thermomyces lanuginosus
agcgacgatatgaggagctcccttgtgctgttctttgtctctgcgtggacggccttggccagtcctattcgtcgaggtatgtggccacgcaatactctcatgcattgcctttcgacctgctgtactaagactgcacatacagaggtctcgcaggatctgtttaaccagttcaatctctttgcacagtattctgcagccgcatactgcggaaaaaacaatgatgccccagctggtacaaacattacgtgcacgggaaatgcctgccccgaggtagagaaggcggatgcaacgtttctctactcgtttgaagagtaagtgtcgacataagtgcaggcactcgccgtggaaatagcagactgaccgggaagtgcagctctggagtgggcgatgtcaccggcttccttgctctcgacaacacgaacaaattgatcgtcctctctttccgtggctctcgttccatagagaactggatcgggaatcttaacttcgacttgaaagaaataaatgacatttgctccggctgcaggggacatgacggcttcacttcgtcctggaggtctgtagccgatacgttaaggcagaaggtggaggatgctgtgagggagcatcccgactatcgcgtggtgtttaccggacatagcttgggtggtgcattggcaactgttgccggagcagacctgcgtggaaatgggtatgatatcgacgtggtatgtagtaaacgagatcatgcgggaaagtgcaggaagtctgatacacgcatattagttttcatatggcgccccccgagtcggaaacagggcttttgcagaattcctgaccgtacagaccggcggaacactctaccgcattacccacaccaatgatattgtccctagactcccgccgcgcgaattcggttacagccattctagcccagagtactggatcaaatctggaacccttgtccccgtcacccgaaacgatatcgtgaagatagaaggcatcgatgccaccggcggcaataaccagcctaacattccggatatccctgcgcacctatggtacttcgggttaattgggacatgtctttagtgcgcggcgcggctgggtccgcaatgacagtttgtataaagtttgaggttaggcaggatcatgatgttcgtcacttggggtcatttgacggtcaaatcaagatgacactctccaagcattgatgagttgaatcaaaatggatcagtggtacat

SEQ ID NO: 1274 - protein, 291 aa, Thermomyces lanuginosus
MRSSLVLFFVSAWTALASPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCL

SEQ ID NO: 1275 - DNA, 1044 bp, Aspergillus niger
atgttctctggacggtttggagtgcttttgacggcgctcgctgcgctgagtgctgcggcaccgacaccgcttgatgtgcggagtaggtatgcctgatttgaagtggctggatagcactgatgaaggttttgaataggtgtctcgacttccacgttggatgagctgcaattgttcgcgcaatggtctgccgcagcttattgctcgaacaatatcgactcggacgactccaacgtgacatgcacggccgacgcctgtccatcagtcgaggaagcgagcaccaagatgctgctggagtttgatttgtatgttgctccagtaacaagaatagaacacagctgattgaataggacaaataactttggaggcacagccggtttcctggccgcggacaacaccaacaagcggctcgtggtcgccttccgaggcagtagcaccatcaagaactggattgctgatctcggcttcatcctgcaagataacgatgacctctgtactggctgcaaggttcacactggattctggaaggcatgggaagccgctgcagacaatctgacgagcaagatcaagtccgcgatgagcacgtactcaggctataccctctacttcaccgggcacagcttgggcggcgcattggctacgctgggagcaacggtcttgcgaaatgacggttatagcgttgaactggtgagtgctccagagattgatcaagaaacagtcggttctgacagtcaatagtacacctatggatgtcctcgagtcggaaactatgcgctggccgagcacatcaccagccagggatcaggagcgaacttccgcgttacacacttgaacgacatcgtcccccggttgccacccatggactttggattcagccagccaagtccagaatactggatcaccagtggcaccggagccagtgtcacggcgtcggatattgaactcatcgagggaatcaattcgacggcggggaatgcaggcgaagcaacggtggacgttttggctcacttgtggtactttttcgcgatttccgagtgcctgctatag

SEQ ID NO: 1276 - protein, 297 aa, Aspergillus niger
MFSGRFGVLLTALAALSAAAPTPLDVRSVSTSTLDELQLFAQWSAAAYCSNNIDSDDSNVTCTADACPSVEEASTKMLLEFDLTNNFGGTAGFLAADNTNKRLVVAFRGSSTIKNWIADLGFILQDNDDLCTGCKVHTGFWKAWEAAADNLTSKIKSAMSTYSGYTLYFTGHSLGGALATLGATVLRNDGYSVELYTYGCPRVGNYALAEHITSQGSGANFRVTHLNDIVPRLPPMDFGFSQPSPEYWITSGTGASVTASDIELIEGINSTAGNAGEATVDVLAHLWYFFAISECLL

SEQ ID NO: 1277 - DNA, 1239 bp, ANTRODIA CINNAMOMEA
ccaaatccatcaacgccgggacacctgcatatggtcgccactgcttccctgccaattggacggcacttgcgccgtagcggtgccctggcgaagggctgcttaaaacgggccgtctattgttgtctcaccgcccaaaccccatactcaggagtttgatctgcgcgcaaccgctacggagtcgccatgggccctttcgtactaggtgctgctctctcagtggccgctctgtctgctgtacaggccctcccttcacggtacccgactctcaaggcgcgggcgtcgatcactgcgttgccgggcgcgcagatcacagactacacgccgtacacttactacgcgagcacggggtactgcaatgcttcagagactctatcatggagttgcggggcgaactgcgaagcaaaccccgacttcgagcccgtcgcgtccggtggcaatggcgactcgatacagtactggtttgtgggatacgaccctacgctagagaccgtgatcgtatcgcatcagggcacggatccttcggaaattctgcccctcattacggatgcggatattgagaagacgactctagactcgtctctattccctgggctgagctccgatatcgaggtgcacagtgggttcgccaacgagcaatcgaagactgccacagacgttctgtcggccgtgcagagcgcgatgtcaaagcacagtgccagcaaggtgaccgtagttggacattcgctcggggccgccattgccctccttgatgctgtctacctcccgctccacatctcggatgcgacattctccttcatcggatatggtctgccgcgggtgggcaatcaggcgttcgcgaattacgtcgacgcgcagccgacgtcggtgacacacattaataacgaggaagaccccattcccatctgcccgggtatgtctctcgggttcgtccacccgtccggcgaggtgcacatcgaggactccggcgaatgggcagcatgtccaggtcaggacaacccgagcacacagtgcatcgttggcgacgtgccgtccatctgggatggagacgagtcggaccacgatggtccttacaatggcattgagatgggttgctagctgagcgggcgcccgattctcctttttgtgttatttgtgggaacaattttgtattcatcattccgtatattgtcctgtagcaacttgtattcgctacttggaaaacatcttgccaaaaaaaaaaaaaaaaaaaaaaaaaaaaaa

SEQ ID NO: 1278 - protein, 303 aa, ANTRODIA CINNAMOMEA
MGPFVLGAALSVAALSAVQALPSRYPTLKARASITALPGAQITDYTPYTYYASTGYCNASETLSWSCGANCEANPDFEPVASGGNGDSIQYWFVGYDPTLETVIVSHQGTDPSEILPLITDADIEKTTLDSSLFPGLSSDIEVHSGFANEQSKTATDVLSAVQSAMSKHSASKVTVVGHSLGAAIALLDAVYLPLHISDATFSFIGYGLPRVGNQAFANYVDAQPTSVTHINNEEDPIPICPGMSLGFVHPSGEVHIEDSGEWAACPGQDNPSTQCIVGDVPSIWDGDESDHDGPYNGIEMGC

SEQ ID NO: 1279 - DNA, 1025 bp, Aspergillus oryzae
aagctttcacggagcccttccacttcagccaccatgcatcttgctatcaagtctctctttgtctctctcctcggagccagcgttctcgcaagccctcttcccagcaatgctctggttgagagaaacgctcccctgaatgagttcctcagcgctcttctgtcgcatctgcctgccatcgatggcaccatcgacgcggtgtcgggtgtgatcaccgattttgatcaattgctcgccgacctcactggtgctcgaaccacacaaaatggatatattggtgtctgcacggactacaccgttctcttcgcccgcggaaccagtgagcccggaaacgtaagcttcgttgccttagtgcttatttccattctaactttgtgcaggtcggtgtccttgttggacctcctctttctgaagcgtttgagcaagccgtcggtgcaaaagccttgagcttccagggcgtcaacggctataacgcagatgtcgcgggttatttggctggaggtgacgctgccggtagcaagtcaatgtacgtctcttctctattgtgtcgcaaccttctcgctctattccgatggacaatgaaaatcgcagctgacattattcgaacagggcatccctggccagcgaagttctctccaaatgtcctgacactaagctcgtcatgagcggctactctcagggttgccagattgttcacaacgccgttgagcagctccctgccgcagacgctagcaagatcagcagcgtcctcctcttcggagacccatgtacgttaaattccaaggccgtggggattattgatgtatgaaacatgctgattattttatagacgcgggcaaggccttccccaacgttgatgcttcccgtgtgcacactgtgtgccacgccggagatactatttgcaacaacagcgtcgttatcctgccccctcacctgacctacgctgttgatgtgactaacgcggttcaatttgctgttgcggctgcgaactaatttacgataagggctccatgttcactgtgaagctt

SEQ ID NO: 1280 - protein, 254 aa, Aspergillus oryzae
MHLAIKSLFVSLLGASVLASPLPSNALVERNAPLNEFLSALLSHLPAIDGTIDAVSGVITDFDQLLADLTGARTTQNGYIGVCTDYTVLFARGTSEPGNVGVLVGPPLSEAFEQAVGAKALSFQGVNGYNADVAGYLAGGDAAGSKSMASLASEVLSKCPDTKLVMSGYSQGCQIVHNAVEQLPAADASKISSVLLFGDPYAGKAFPNVDASRVHTVCHAGDTICNNSVVILPPHLTYAVDVTNAVQFAVAAAN

SEQ ID NO: 1281 - DNA, 1671 bp, Gibberella zeae
atgaagcttcttacgaacattggcacgttgctggctcttagcccagtccagcaggtttctgcaacaccacatactggagaacactacaacctcgtcaagctcgaaggatatggcagtgtctctggaacgacggtcaacagtaccctcaccaagaaggatctacctacgactgtggatgcatggatgggtattgactacgcgctccagcctacaggtcatcgacgcttcaaagccgccgaatggcccaagcctttcaagggcgtcaaacgcgccgacagctacggaaagacctgcatccaggaaattgcatccaagacacccctcgagtcacaaagcgaggcttgtctcaacttcaacgtgttccgaaccaaaggcgtgccgttgagcaagaagctccccgttctcgtgtggatccatggcggcgcattcttctctggaagctgggctagctttgacggcgctgcattcgcggcttcatcaaaagaacctattgtcgttgtaaactttcactaccgcgtcaactccctcggctttcttccatctaagctcttcaaagacgagggtctttcaaacctcggtattcgcgaccagcgactgctgtttgagtttgttcagaaacacattggagcttttggaggtgacaagaatgctgttactatcggcggtcgctctgctggtggacactcagttggaatccattacttccataactacggcaaggacaacaaagcgttattcgcccaagccatccatcaatctggatctgtcacgtcaagagccttccccaacgatacatatcccttgtacaagactcagtacgacgaatacactgcataccttggatgcgacaacaagaaaaccaacaaagctaccctcaaatgtctgcgagaagcagatatcgacagtatcagaaatattagcaccaagatcttttacgattacaatgacgtcttgacttggcctttccagccagtacagggaggaccattatttgagaagcccggctctcagtccggatacgatggaacattctatcacgttcccactattacttcaaacgtcaacgacgagggcaaattctatacgcctggcaatcttgagacagatagcgagttcttggattatctccacaacatctcgcctgctttaacaaagaaggacttatccgagctgagcgccttgtatcctgatccggcaaagtatgacaactcaccctttgcaaactcgccaaacagcactcagtacaaccgcatctcggccgcttggagtgactacgcttatatctgcccaggtcaagagacagcataccgtgcctccactgctggcgtgcctacatggaaagtccgcttcaataccaacaacagcttccctgcctggcagggaattccacacacagcagacactgcatacacatggaatggggagtctacccagtaccccgagattagccacatctaccacggatatctttctagctttgtcacggctggaaatcccaacagtcacaggtatcctggtagtcctgagtggccagcttatcacggagatgatgagtcaccactgcagattgttgttcagccaggggataccaaggtagagaaggacgagatcaggaaggaggcttgtctctggtggagagacccagagagagctcctagacttaacaagtaa

SEQ ID NO: 1282 - protein, 556 aa, Gibberella zeae
MKLLTNIGTLLALSPVQQVSATPHTGEHYNLVKLEGYGSVSGTTVNSTLTKKDLPTTVDAWMGIDYALQPTGHRRFKAAEWPKPFKGVKRADSYGKTCIQEIASKTPLESQSEACLNFNVFRTKGVPLSKKLPVLVWIHGGAFFSGSWASFDGAAFAASSKEPIVVVNFHYRVNSLGFLPSKLFKDEGLSNLGIRDQRLLFEFVQKHIGAFGGDKNAVTIGGRSAGGHSVGIHYFHNYGKDNKALFAQAIHQSGSVTSRAFPNDTYPLYKTQYDEYTAYLGCDNKKTNKATLKCLREADIDSIRNISTKIFYDYNDVLTWPFQPVQGGPLFEKPGSQSGYDGTFYHVPTITSNVNDEGKFYTPGNLETDSEFLDYLHNISPALTKKDLSELSALYPDPAKYDNSPFANSPNSTQYNRISAAWSDYAYICPGQETAYRASTAGVPTWKVRFNTNNSFPAWQGIPHTADTAYTWNGESTQYPEISHIYHGYLSSFVTAGNPNSHRYPGSPEWPAYHGDDESPLQIVVQPGDTKVEKDEIRKEACLWWRDPERAPRLNK

SEQ ID NO: 1283 - DNA, 1227 bp, Gibberella zeae
atgcggttcaaacttgcggattcattgagcctcatcaccgttcagctcatcttggctacctcgactctcgctctcagtaatcctggatcatcatcgcaaaaacacagccccaacccaagcgcaccgtcaccgaaaggcatttcagtacccttctttgcgactctcgaacgtctatcacgacttgtagacatcgcctactgcatcggcacaacaggcgtgagaaaaccattcaactgcgtgtcacgatgcaatgacttccccagtctgtctctcatcaacgcatggaacactggccctttgctaagcgacagctgcggatacatcgccgtagaccatggggtggcgcagcatggtgatagcggtgacttgaccgccggcgagcctgctatcgtagtagccttccgtggaacctacagcattgccaatacgattgttgacttgagcactgttcctcaggagtatgtgccatatccatccccagatcatggtggcagtgagcctcccaacgaacctgaacacacatgtacgaattgtactgtacacatgggctttctccagtcatggaagaatactcgacagttcgttcttccacagctgaggcagctaagattacaatacccctcttatccaatacagctcgtcgggcacagtctagggggctctgttgcttgtcttgctgctctggaattgaaggtgtcgctgggatgggaaaatgttatcgtcaccacgtttggtgagtcacgcgtcggaaacgaaggtctagcccgcttcgtggatgaagtattttatctaaatgatgacaataacccagaagggcgcgaattcaggcgggtaactcacaaagaagatcctgtacctcttctacctctaagtgaatggggctacaagtcacacgcgggcgaggtatacatcaccaagcaagaactgaccccttccgagtctgatatctacatgtgtatcggcgacaacgaccccaagtgcatagcaggagcagatgattcgttatggatgactacccgccggttgtttcacgctaggaacctttggacggcctcggacaagttggcggagccgaatggtttcccttcgagattcaagctgtggcagctcttgtttgcgcaccgggactatttctggagattgggcctttgtgtacctggaggagatcccgcagactggggtagaggacgatatcaaggcttgggcccagatactgaggaactgtga

SEQ ID NO: 1284 - protein, 408 aa, Gibberella zeae
MRFKLADSLSLITVQLILATSTLALSNPGSSSQKHSPNPSAPSPKGISVPFFATLERLSRLVDIAYCIGTTGVRKPFNCVSRCNDFPSLSLINAWNTGPLLSDSCGYIAVDHGVAQHGDSGDLTAGEPAIVVAFRGTYSIANTIVDLSTVPQEYVPYPSPDHGGSEPPNEPEHTCTNCTVHMGFLQSWKNTRQFVLPQLRQLRLQYPSYPIQLVGHSLGGSVACLAALELKVSLGWENVIVTTFGESRVGNEGLARFVDEVFYLNDDNNPEGREFRRVTHKEDPVPLLPLSEWGYKSHAGEVYITKQELTPSESDIYMCIGDNDPKCIAGADDSLWMTTRRLFHARNLWTASDKLAEPNGFPSRFKLWQLLFAHRDYFWRLGLCVPGGDPADWGRGRYQGLGPDTEEL

SEQ ID NO: 1285 - DNA, 1539 bp, Gibberella zeae
atttttagatattcttgtttatataccttttcgcatagtaatgccaagataatgatgtgcaagatatatatggatcacgaaattaacatgggtcgtttcacagcccgattgcaagctgaaaacatgcttacagaccactatttactacatcgcaaacatcaaaaactcctactgcatgaaactttctacttccaatccgctgggtagacaggccatcatcatctcgttacgttggagggtaacatctgttgcaacagcaaagtcgtgatagtggagtcgccgcaatgtcgcgtctgttttggcgaactctgaatgtaaatctaatctgacttgggaaatatattcgttggcgggcccggaccgcatagctagttgtttctttcagctggcgactaaactatcgaaaaagcaatgagctgatactgccgtgtgcatccaaagtcaggcatgtaaatgatgatgtttgcagatggtaagctgaatatggacaattatcgttcccaaagtgttataaaacctggatgaattccagtaaatatatctgttatccttcagtccatctcatacatctagtatagtcttatactccagtctgatacagaccttgtcaggatggctgtccttcgttttattaccgtagcacttgctgccatcaccaacgtcgccaatgccgttcctaccgacgcaaccaagcgacaagacagcaacttgcccttcccactggctcacttcaccaacacagtagcgtccgtccaaaacacctactgcggaccgactgccaacacacctggtgtcaagtttggtgatcaaaccttgcttcatgccattggcgacggcgatactgttcaacgtaccaacatttatcactctgagagcttgggcataatcgtcgcttcccagggcacaaatctgtcaagcattgtctctcaatcccacaacattcaagctattcccattatcccagatgcaagacttggtctgccctttggctcaatggtctttgcggggtggcaaaatgcttggtccaagggctggaccgatgtcagtgcagcactggccgacactatcaagcaattccccaatgaccaaatcatcgtcacgggacacagtcagggagctgccatctcactgctcactgcattggccattcagaaccagttcggcaatgtcagtactatccgggaaatcattgcttatggtccctcccgcgtgggaaccccagcgttcgccgacgcatttgatactatcttccctggaaagtacacgggcgttgttaatggtgacgattgggttccttctctcccatctcaacctatctaccgacacccctctggaatggtttggatcaaccctgccaactcgacatcgtggaagtactatccaggccaggagaaccccgacggacctgactcaagagtaatccagatgttttacccaggaacgctgcagttcaactggggagaccatcagggaatttacatgcacagctctatgggcacgactcaaggaccttgccctgctcaggttggtgggttctaa

SEQ ID NO: 1286 - protein, 317 aa, Gibberella zeae
MMFADDLVRMAVLRFITVALAAITNVANAVPTDATKRQDSNLPFPLAHFTNTVASVQNTYCGPTANTPGVKFGDQTLLHAIGDGDTVQRTNIYHSESLGIIVASQGTNLSSIVSQSHNIQAIPIIPDARLGLPFGSMVFAGWQNAWSKGWTDVSAALADTIKQFPNDQIIVTGHSQGAAISLLTALAIQNQFGNVSTIREIIAYGPSRVGTPAFADAFDTIFPGKYTGVVNGDDWVPSLPSQPIYRHPSGMVWINPANSTSWKYYPGQENPDGPDSRVIQMFYPGTLQFNWGDHQGIYMHSSMGTTQGPCPAQVGGF

SEQ ID NO: 1287 - DNA, 921 bp, Aspergillus tamarii
atgcgcttcctctccggcttcgtttctgttctgtcctcagtggccctgttgggttacgcttacccaacggcaattgatgttagagacatccctactacccagctcgaagacttcaagttctgggtgcaatatgcggctgccacctactgccccaataactacgttgccaaagacggcgaaaagctgaattgctctgtgggcaactgccctgatgtcgaggcggccggttctactgtcaagctcagcttctccgatgataccatcaccgacactgccggcttcgtggccgtagacaacaccaacaaggccatcgtcgtcgctttccgtggctcctactctatccgcaactgggtcaccgacgcaaccttcccccaaaccgacccaggactgtgcgacggctgcaaggccgaactgggcttctggaccgcctggaaggtcgtccgcgaccgcatcatcaagaccctggatgagctgaagcccgaacacagcgactacaagatcgttgtcgtgggccacagtctcggcgccgccatcgcctcgctcgcagctgcggacctgcgcacgaagaattacgacgcgatcctgtacgcctacgccgcgccgcgtgtggccaacaagcctctggccgagttcatcaccaaccagggcaacaactaccgcttcactcacaatgacgaccccgtgcccaagctgccgctcttgactatgggctacgtgcacatcagccctgaatactatatcaccgcgccggacaacactaccgtcaccgacaaccaagtcaccgttctcgatggatacgtgaacttcaagggaaacaccggcacgagcggcggactgcctgacctccttgcgttccactcgcatgtctggtactttatccacgccgatgcctgcaagggtcctggattgccattgcgctaa

SEQ ID NO: 1288 - protein, 306 aa, Aspergillus tamarii
MRFLSGFVSVLSSVALLGYAYPTAIDVRDIPTTQLEDFKFWVQYAAATYCPNNYVAKDGEKLNCSVGNCPDVEAAGSTVKLSFSDDTITDTAGFVAVDNTNKAIVVAFRGSYSIRNWVTDATFPQTDPGLCDGCKAELGFWTAWKVVRDRIIKTLDELKPEHSDYKIVVVGHSLGAAIASLAAADLRTKNYDAILYAYAAPRVANKPLAEFITNQGNNYRFTHNDDPVPKLPLLTMGYVHISPEYYITAPDNTTVTDNQVTVLDGYVNFKGNTGTSGGLPDLLAFHSHVWYFIHADACKGPGLPLR

SEQ ID NO: 1289 - DNA, 1300 bp, Aureobasidium pullulans
atgacatggatcatcacacctaatatgcgcttccttctgttatctctcctgagtgtgttatcggtcgtcacgactgctcttccagcccagcaagctcctcttcttcgacatgctgcagacaatcgcactgtttcccccgagctattctctgacctcgaagagctcgcgcgcgtcgtcgacatatcttattgtgtaggtctcaccggcataggcatatcaaggccgttcaaatgtcttggtcgctgctctgagtttcctgatttcgagctcgtcaaggtaagagaatctgtttgtattgaccatatttgatcatgcgccgacatgtttctagacatggaacactggccagttgatgtccgactcttgcggatacatcgctctagctcactcgcagacgaatcctcgcatcatcgtcgcgttccgtggcacctactcaatcgcaaacactgttgtcgatctttccactgtccctcaagagtacatcccctatcctggtgatcccgactcaggagcttcgaaaactgatcatgcaaaatgcgacaactgtactgtgcatactggcttctatagttcttggaaagtcgcttcttctgccattttaccagacgtggaggctgccatcgctgcctaccccgactatgctctgactcttgtgggacattcgcttggtggtgctgttgccgctctggccgggctcgagtttgaatcgcgtggctggaatcccactatcaccacctttggagagccccgacttggaaacgcagcactgaatgaatacctcgaccagcggttcaatctactagactctacacgtgaagtctggacgaacactttcgatgagcggcaacttcgttatcgtcgtgtcactcacatcgacgatccagtacctctgctaccacttacagaatggggatatcgtatgcacgctggcgagatctatatctccaagtccgccttgaccccggacatcgaggatcttcagcactgtgtcggcgatgaagaccatcggtgcatcgcgggacaagatggcagtctaaaattagattccatgcagaccaaagccgatgacctcagagctcagatacagcgctcagtcgacgaccttgctgaggagcgtgcgctggagaagcgcggtgttggttcttgggtcgtgccatctcgctacaagttgtggcagttattcttttcccaccgtgactacttctggcgtctcggattgtgtgttcctggtggagatccttgggattggaatcgtaagccatatgcaccgcttgatggaagcgagcaagagcctgtctga

SEQ ID NO: 1290 - protein, 414 aa, Aureobasidium pullulans
MTWIITPNMRFLLLSLLSVLSVVTTALPAQQAPLLRHAADNRTVSPELFSDLEELARVVDISYCVGLTGIGISRPFKCLGRCSEFPDFELVKTWNTGQLMSDSCGYIALAHSQTNPRIIVAFRGTYSIANTVVDLSTVPQEYIPYPGDPDSGASKTDHAKCDNCTVHTGFYSSWKVASSAILPDVEAAIAAYPDYALTLVGHSLGGAVAALAGLEFESRGWNPTITTFGEPRLGNAALNEYLDQRFNLLDSTREVWTNTFDERQLRYRRVTHIDDPVPLLPLTEWGYRMHAGEIYISKSALTPDIEDLQHCVGDEDHRCIAGQDGSLKLDSMQTKADDLRAQIQRSVDDLAEERALEKRGVGSWVVPSRYKLWQLFFSHRDYFWRLGLCVPGGDPWDWNRKPYAPLDGSEQEPV

SEQ ID NO: 1291 - DNA, 1170 bp, Rhizopus microsporus
atggtttcattcatttccatttctcaaggcgtcagtctctgccttcttgtctcttctatgatgcttggttcatctgctgttcctgttgctggtcataaaggttcagtcaaggcaactaatggcactgacttccaactccctcctctcatctctagccgttgtactcctccttcccatcctgaaaccacaggtgatcccgatgccgaagcttactatattaacaagagcgttcaatggtaccaagctcacggtggcaactacactgctcttatcaagcgtgatactgaaaccgtcggtggtatgaccttggatttgcccgagaaccctcctcctattcctgccacgtccactgctcccagctctgattcaggtgaagttgtcacagccactgctgctcaaatcaaagagctcactaactacgctggtgttgctgctactgcttactgtcgtagtgtcgttccaggtaccaagtgggactgtaagcaatgtctcaagtatgttcctgatggtaagcttatcaagaccttcacttctcttctcactgataccaatggctttatcttgagaagtgatgctcaaaagaccatctatgttactttccgtggtactaattccttcagaagcgctattactgacatggtcttcacctttactgattattctcctgtcaagggcgccaaagttcacgctggtttcctttcctcatacaaccaagttgtcaaagactacttccccgtcgttcaagaccaattgaccgcttaccctgactataaggtcatcgtcaccggccactctctcggtggtgcccaagccttgctcgctggtatggatctctaccaacgtgaaaagagattatctcccaagaacttgagcatctatactgttggttgtcctcgtgtcggtaacaatgcattcgcttactacgtcgacagcaccggaattcccttccaccgtaccgttcacaagcgtgatatcgtccctcatgttcctcctcaagccttcggttatcttcaccccggtgtcgaatcttggatcaaggaagaccctgctgatgttcaaatctgtacttccaacattgaaaccaaacaatgcagtaactctatcgttcctttcacctctatcgctgatcacttaacctactttggtattaacgaaggaagctgtttgtaa

SEQ ID NO: 1292 - protein, 389 aa, Rhizopus microsporus
MVSFISISQGVSLCLLVSSMMLGSSAVPVAGHKGSVKATNGTDFQLPPLISSRCTPPSHPETTGDPDAEAYYINKSVQWYQAHGGNYTALIKRDTETVGGMTLDLPENPPPIPATSTAPSSDSGEVVTATAAQIKELTNYAGVAATAYCRSVVPGTKWDCKQCLKYVPDGKLIKTFTSLLTDTNGFILRSDAQKTIYVTFRGTNSFRSAITDMVFTFTDYSPVKGAKVHAGFLSSYNQVVKDYFPVVQDQLTAYPDYKVIVTGHSLGGAQALLAGMDLYQREKRLSPKNLSIYTVGCPRVGNNAFAYYVDSTGIPFHRTVHKRDIVPHVPPQAFGYLHPGVESWIKEDPADVQICTSNIETKQCSNSIVPFTSIADHLTYFGINEGSCL

SEQ ID NO: 1293 - DNA, 2841 bp, Fusarium oxysporum
actcgatatagctcaggcggtaaatcgtaacgttttatctggtagtttgtactataattggtttgctcatcactgtgacaccagaactgtgcactaattattggatatcaaccaaccactcttacgattcatacgaatcaccagactattctttttttttctctcctattttttctcaaagcccaaagccctacagtcccaacattttgacagtccccatcgtaatgtaacagagactaacaaaacccctgtagcccaccatcttgatcacgaccctcacgtggtccgaggtcgtcgttacctgtaagggaagctcatccgggcccaacgacaaacggaccaaggaaaaatgctgtcagagcccgatgaaggggaccttgtctgccgggatcatggagccaagaatgcggggtgggcagtgtagaacacaccatgaaggattagactgccgcgaagcttcatttccgctgttcggccctggggcggcggttattacaccgacggcgtgagggtttgccaagatggatggggggagagctatgggtggatgtgtgaaatgtgatgggaaggggagagacgggatcagcgactgagggtgagcgggtattgtgatgggagctagctaaagaaaaaagatatataaatgtctggttcttctcacgatgtcgatctctcagtagatctgaaggacagcttcagcttcagcttcaaaggcatctctaggagttgtacctcgccggcctatcctcacttacacccataccttggaccctatcccttgtcacgatgcttcttctaccactcctctcagccatcaccctcgcggtagccagccctgtagctctcgatgactacgtcaactctctcgaggagcgaggtaaacataaccccatcccgattacttcataagctcacattcccagctgttggtgtcaccacaaccgactttggcaacttcaagttctacatccaacacggcgccgcagcttactgcaactctgaagccgcagctggttcaaagatcacctgctccaataatggctgtccaaccgttcagggcaacggagctaccatcgtgacatctttcgtgtaagtacaaggctgcacaaacacatcgcacccttacttacacatccagggctccaagacaggtatcggtggctacgtcgcgacagactctgcccgaaaggaaatcgtcgtctcgtttcgcggaagcatcaacattcgaaactggcttaccaacctcgacttcggccaggaagactgcagtctcgtctctggatgtggtgtacactctggcttccagcgagcctggaatgagatctcctctcaagcaacagctgccgtcgcctccgcacgcaaggcgaacccttctttcaaggtcatctctacaggccactcccttggaggtgctgtggccgttcttgctgccgcaaacctgagagtcggtggaacacccgtcgacatttacacctacggttctccccgtgtcggaaatgtacagctctcagccttcgtctcaaaccaggctggtggagagtaccgcgttacacacgccgatgaccctgtccctcgtctcccccctctgatcttcggatacagacacacaactcctgagttctggctgtctggtggtggcggcgacacggttgactacaccatcagcgatgtcaaggtctgtgagggtgctgccaaccttggatgcaacggtggaactcttggtttggatattgctgctcatctgcattacttccaggcgactgacgcctgtaacgctggcggattctcttggcgacgatacagaagcgccgagagcgtcgacaagagggccaccatgactgacgccgagcttgagaagaagctgaactcttatgtccagatggataaggagtatgtgaagaataaccaggcccgctcttaacgagggtatgaggtctaatgggaaatgacatgattcatgaacgaaaccatagtacatatgatgcaaataggatataaaaaacatatttcattcactagctttacacattaccgtgcgccatgcaatgccctgctactgactcaaaggccatgctcaaattgtttcataactccaaacaccaaccaccacgcgctgtatcagggattaatcatgagatccctcaaccaccatgccttgagcattaggaacaccaacaaggatgacaccacgaggtacgcggacctctttgaccttcatgcatccaaaaacgttgacctctcggatcttgggacaagatcggaagattgaccccaagatgaaatcagtcacctcttcacagaagctgatttccagctctttcaactctgggtaacgagcatcctcgtggaagacctcctcgaaagcctcgcgtgagatatgacggcaagcatgaatgttgaggtactgaagcttctcacccgaatgagccatcaaggctttgaaaccctcactgcagagcccaacgctatctgggttctcccgaggcttacttgcatcaatttgtcgacatttctggaggtccacaaagtgcgagggaggattggcccatttggtgaaaagatcaacaaaaccctggtcagtcataaactcactgtccgtgattcggaacttggaaagggagcgacaatgctcgtgaatagcctgcaacagcccatcgtcaacttcaggaacaatcttcagagacaaggtcttgagattggcaccgattttcgagacaacttcgatgtaagcgtcagattcagtcttgtgctgtaactgaagtccgagatgctctagagccgacaaacttgcgatcgttttgacaccgtcgttggttagcttttggttattctcaaccttga

SEQ ID NO: 1294 - protein, 345 aa, Fusarium oxysporum
MLLLPLLSAITLAVASPVALDDYVNSLEERAVGVTTTDFGNFKFYIQHGAAAYCNSEAAAGSKITCSNNGCPTVQGNGATIVTSFGSKTGIGGYVATDSARKEIVVSFRGSINIRNWLTNLDFGQEDCSLVSGCGVHSGFQRAWNEISSQATAAVASARKANPSFKVISTGHSLGGAVAVLAAANLRVGGTPVDIYTYGSPRVGNVQLSAFVSNQAGGEYRVTHADDPVPRLPPLIFGYRHTTPEFWLSGGGGDTVDYTISDVKVCEGAANLGCNGGTLGLDIAAHLHYFQATDACNAGGFSWRRYRSAESVDKRATMTDAELEKKLNSYVQMDKEYVKNNQARS

SEQ ID NO: 1295 - DNA, 1742 bp, Aspergillus tamarii
ccaagctttgcaaccaagcctgtcgccgtctgatcaacatccttcttgaacatgccgaggctgatttcgtggattttccgtcagcttaagcaagtggatccgcgtggatggtagtgtgaactgaaccaattcagctcgatccggccaagagcatcgatggtagactattgagatcgcgcatgccatgtctcactattttcagcggaaccacaaacaacccgattgtcggatcagggatatcgattttggcgaagtctgtatacagaatgtaactatttaatgggcgtcgtttccactgtctgctgtcttcatctgttcatgctcacaattgcctcgtctctatccattgagtagaccctgcgaagcacactggcaaagatgcgcttcctctccggcttcgtttctgttctgtcctcagtggccctgttgggttacgcttacccaacggcaattgatgttagaggtactgaatctgcttcatgatctgctggacggacactgactcattgttaagacatccctactacccagctcgaagacttcaagttctgggtgcaatatgcggctgccacctactgccccaataactacgttgccaaagacggcgaaaagctgaattgctctgtgggcaactgccctgatgtcgaggcggccggttctactgtcaagctcagcttctccgagtaagccacctgagttcccagtaccgtgacctccaactaacaaccctaacagtgataccatcaccgacactgccggcttcgtggccgtagacaacaccaacaaggccatcgtcgtcgctttccgtggctcctactctatccgcaactgggtcaccgacgcaaccttcccccaaaccgacccaggactgtgcgacggctgcaaggccgaactgggcttctggaccgcctggaaggtcgtccgcgaccgcatcatcaagaccctggatgagctgaagcccgaacacagcgactacaagatcgttgtcgtgggccacagtctcggcgccgccatcgcctcgctcgcagctgcggacctgcgcacgaagaattacgacgcgatcctgtacgcctacgccgcgccgcgtgtggccaacaagcctctggccgagttcatcaccaaccagggcaacaactaccgcttcactcacaatgacgaccccgtgcccaagctgccgctcttgactatgggctacgtgcacatcagccctgaatactatatcaccgcgccggacaacactaccgtcaccgacaaccaagtcaccgttctcgatggatacgtgaacttcaagggaaacaccggcacgagcggcggactgcctgacctccttgcgttccactcgcatgtctggtactttatccacgccgatgcctgcaagggtcctggattgccattgcgctaattcgttaccatttttttttttttttggtgaatttcttacatgatttggacggacgatgagatgagtctatgcttcgtactgtataaggtttgatgtggagttgaagcctacgtaaataatttaatatcccctaatctgaaacaaaatttaaatcgaaccaaatttcatcccagtcaaaccttaatcgccataaattcacgtctccacccacagagtaacttaggtacactattaccttcacaacaaaagatgagctaaagaaaactgaagaaacccctcctcagcctccaaaaaataaaagaattccaaatgtcgtcggccaagcacactacacctgcag

SEQ ID NO: 1296 - protein, 306 aa, Aspergillus tamarii; identical to SEQ ID NO: 1288

SEQ ID NO: 1297 - DNA, 1383 bp, Neosartorya fischeri
atgcttgggcctcttgcctatgcatcagaagatgttcccaaactcccatcgcgagatccattctacacaccaaaagcctctaactggaccgacgagaaagcaggcacggttctcgattctcgcaaggtgaccatcgatctgcccgtcttaccaggtggtgatatcgagttcgaggccttccaactgctctacgtaacgcaggatctccacgaagagaaggccacatctgtcacgacaatcatcgtcccgcagggagcaaacaccagccggatcctgtcctaccagattgcctacgatgcgcccgacatcaactgctcgccctcctacgggctgcagaaagatgctaataaggctgcggcggggtggtctcttaaccaaatgatctttgtagccgaggctctggctgacgccggatcgccggttctgaatatccccgactatgaaggatcgaacgccgcatttactgtggggccccaaagcgcctaccagaccctggattcaattcgcgctgcgacgcagtccggagagattacggggatcgacaaagacgcggagaccgtcttgtttggctactctggcggcgggtacgcgtcggaatgggctgttgagttccatcatgactacgcgtcggacgttaatataatcggagctgcgatcggtgggcctccaccgaatattatgaaaacgtacaaacatgtcaacgggaaactttcgacattgaatgtctgggccatgctcggtgtgatgaatgcaattcgtgatatcgacatatggatgcgtggggatctgaaagatgaacaccgagagaaattcctcggtgcccttcagcgttgcagtgagcctgaagataagcccccgaagatccctacttgggccaatatcaacaattggttcaaaaacggggacgaattcttgacgaagttcgagtcgaatcttacagagattggcgttatgggaaaccgtatcacggaaacaacagcgcccaagttccctctttatatctatcagggcgcattggacatcattacagctccgtataaagatacaaaagacctgaaggaaaagttttgtgaacatggaacgcctgtcttcctcgtcaagtgggcgggaatgggccatggtggtactctttttgctggcactacttgggccatgaaatggatcaaaaaggttttcaatcgcgatgagatccaaaacggttgtcacgaagaagagcgcgaagtggttttcggtgccggagatctagctggattattcggaggccaatatgatgacggcgagatttctaccagcagacggcttggttggggagacaacgagggtctgctttctatccagagtggagcacgcccagtggatgtattccagagggcagagctgtga

SEQ ID NO: 1298 - protein, 460 aa, Neosartorya fischeri
MLGPLAYASEDVPKLPSRDPFYTPKASNWTDEKAGTVLDSRKVTIDLPVLPGGDIEFEAFQLLYVTQDLHEEKATSVTTIIVPQGANTSRILSYQIAYDAPDINCSPSYGLQKDANKAAAGWSLNQMIFVAEALADAGSPVLNIPDYEGSNAAFTVGPQSAYQTLDSIRAATQSGEITGIDKDAETVLFGYSGGGYASEWAVEFHHDYASDVNIIGAAIGGPPPNIMKTYKHVNGKLSTLNVWAMLGVMNAIRDIDIWMRGDLKDEHREKFLGALQRCSEPEDKPPKIPTWANINNWFKNGDEFLTKFESNLTEIGVMGNRITETTAPKFPLYIYQGALDIITAPYKDTKDLKEKFCEHGTPVFLVKWAGMGHGGTLFAGTTWAMKWIKKVFNRDEIQNGCHEEEREVVFGAGDLAGLFGGQYDDGEISTSRRLGWGDNEGLLSIQSGARPVDVFQRAEL

SEQ ID NO: 1299 - DNA, 1368 bp, Neosartorya fischeri
atgggggtcattccgcgcttgcttgtcttaataggcggactgctcccggccattatcgcagcggttgagccacggataccgtttttcccatcgttagacccattctatacgccgaaggatgggtcttgggaggaactggaccctggaacaatcatagaccaccgccaagtgcatatcaattcactccgttacggcatcccatctaccgccacagcatatcaactgctatatgtcaccaaggacctgaacaacaacgcaaaccactcagtcacaacgatagtcatccccaaaaacgcaaagaaagaccgacttctatccgtgcagcccgcctatgactcgccagacatcaattgctctccatcatacgggctccaggtcggggcggtcggcccctccctatcctggaacatgatggatttatccttcgtacaaccgttcgtacgagacgacggtccagttctgaatattcctgactacgaggggtggaacgctgccttcaccgtgggcccgcagacagcctaccacgtactcgattcgatccgtgcggcattcaacttcaaggacaaaattggcctccagcctaatgccagaacggtactgtacgggttctccggtggcgcgtatgctaccgaatgggcttgcgagatgcagcccagttatgccccggatctgacccagattgtgggtgctgccatgggcggtcctcctcccaacattacgaacacctacatttactgtaatgggggagattgggcagagctgaacgtgtgggcagtgctgggcatgatgaacgctatccccgagataaaagaatacatcgataaggatctgctggacgagcaccgcgaggagttctatggtcctatgagacgctgtagtcgtcactttggcgtggaagaagttcccccgtctctggcgttcaggaacatctcctcctttttcaagcacggagaccacttcttgtataagttccgtgagacgctggaccggtttggcgttatggggaagactggggcccccaagttcccaatgtatatctaccaaggaacaaaggacgagatcgtgcacccgatcggagttacgaatcagcttgtgcgggacctctgcgagaagggtggcaatgtacgctacgtccaatacccttgcacagaccatatgaataccttgattaaagggggaactgctgtctggatctggattgggaatctcctatctggcctccctacgtggccgggatgtcagtatcgggacttgaatccgccgatcgatggatctgatgatggctgcccgaaagacggggaagaagtcctcgcgatggatgagtattatccacagttggaagctttcgcacgggacgagctgaagtga

SEQ ID NO: 1300 - protein, 455 aa, Neosartorya fischeri
MGVIPRLLVLIGGLLPAIIAAVEPRIPFFPSLDPFYTPKDGSWEELDPGTIIDHRQVHINSLRYGIPSTATAYQLLYVTKDLNNNANHSVTTIVIPKNAKKDRLLSVQPAYDSPDINCSPSYGLQVGAVGPSLSWNMMDLSFVQPFVRDDGPVLNIPDYEGWNAAFTVGPQTAYHVLDSIRAAFNFKDKIGLQPNARTVLYGFSGGAYATEWACEMQPSYAPDLTQIVGAAMGGPPPNITNTYIYCNGGDWAELNVWAVLGMMNAIPEIKEYIDKDLLDEHREEFYGPMRRCSRHFGVEEVPPSLAFRNISSFFKHGDHFLYKFRETLDRFGVMGKTGAPKFPMYIYQGTKDEIVHPIGVTNQLVRDLCEKGGNVRYVQYPCTDHMNTLIKGGTAVWIWIGNLLSGLPTWPGCQYRDLNPPIDGSDDGCPKDGEEVLAMDEYYPQLEAFARDELK

SEQ ID NO: 1301 - DNA, 1709 bp, Nectria haematococca
gcccttgtttgccaagtgccgtattgacgccgaaagcaccccggcttcccgcccccaaaagcctcaacaccatgatcacggctcctcgattcagataccataataggcatctcgagtaagctaagcatgcggttctcggctggatttggtaatgttctgcgaaccagtgctccttgtctaaccggagtttgccaagcgctgtaggagtccgttgaaccccgctccgcgaggacgacttttgcttcacacatcctcggatgagaaacacacgctgtgtgaacgacgttgtttgcttgtgataatattcctgatgaattgatagtaactgatctcaatacgagatgctccagcatgtgaataacggagtgagcgatctccaaattgtataaaaagacgcgttgttgtcgtgtaatcagaagacctcagtacacatcatcctcttcagattgacaatccaagtcaattgactctcttattgagacctctgtcatgatgctcatcctatctattctttccattattgcctttgcggcagctagtccagtgccctctattgatgagaacattcgggtacttgagcatcgaggtgagtgaattgacgactatgaggctccaacgaatatgcgctaacatatagcttagctgtgacagtcacgacacaggacctgtcaaacttcaggttttatctccagcatgctgatgctgcgtattgcaatttcaatacggcagttggcaaaccagtccactgtggtgccgggaactgccctgatgttgaaaaggactctgctatcgttgtcggatcggtagtgtaagtgaactgccccaagatcacaaacaacaatatgaggaccataactcacaaagctttccagtggtacgaagacgggcatcggtgcgtatgtggcaactgacaatgctcgtaaggagatcgttgtctctgtgcgtggcagcatcaacgtgcgaaactggatcacaaacttcaactttggccaaaagacctgcgatcttgttgctggctgtggggttcacaccggcttcttggaggcttgggaggaggttgcagccaatatcaaagctgctgtctccgcagcgaagactgcaaacccgactttcaagttcgtcgttaccggacactccctcggtggtgccgtcgctactgttgcggctgcgtacctgcgcaaagacggctttccttttgacctctacacctacggctctccaagagtaggaaacgacttcttcgccaacttcgtcacgcaacagacgggtgctgaatatcgcgtcacacacggtgatgaccccgtcccacgtcttcctcctatcgtctttggataccgtcatactagcccagaatactggcttgacggtggcccacttgataaggactacactgtgagcgagatcaaggtttgtgatggcattgcgaacgtaatgtgcaatggtggcacaatagggctggacattcttgcgcacatcacctatttccagagcatggccacttgtgcaccaatcgcgatcccatggaagagggatatgtcagatgaggagttggacaagaagttgactcaatatagcgagatggatcaggaatttgttaagcagatgacttagaccatagagagaatgagtttatggtcttgcttgctggcaaataattactaagttattaatatttcttttataataagagaaatttagtacttaatcta

SEQ ID NO: 1302 - protein, 333 aa, Nectria haematococca
MMLILSILSIIAFAAASPVPSIDENIRVLEHRAVTVTTQDLSNFRFYLQHADAAYCNFNTAVGKPVHCGAGNCPDVEKDSAIVVGSVVGTKTGIGAYVATDNARKEIVVSVRGSINVRNWITNFNFGQKTCDLVAGCGVHTGFLEAWEEVAANIKAAVSAAKTANPTFKFVVTGHSLGGAVATVAAAYLRKDGFPFDLYTYGSPRVGNDFFANFVTQQTGAEYRVTHGDDPVPRLPPIVFGYRHTSPEYWLDGGPLDKDYTVSEIKVCDGIANVMCNGGTIGLDILAHITYFQSMATCAPIAIPWKRDMSDEELDKKLTQYSEMDQEFVKQMT

SEQ ID NO: 1303 - DNA, 906 bp, Aspergillus terreus
atgcctcttatgatgttcagtattcgttatacatgtctggtgctggtcaccaccctcgtagccctaggtgtggctgcaccaatgagacatgttgccagagacgtctcgacggcggccctgacgcagctggacctgttcgccgagtactccgccgccgcatactgcaccggtaacctcaacaccaccggcacaaaggtcgtctgtcccgccggcaactgtccgcaggtggaggcggcggacacaacctccctgaaggagtttctcgccgacggccaatacggcgagctggccgggtacctcgccgccgactccacgaacaagctgatcgtcctgagttttcgcgggagccgctcgcccgcgaactggatcgccaacctcgacttcatctttgacgatgcggacgagctctgcgccgactgcaaggtgcacggcgggttctggaaagcctggcacacggtctccgacgcgctgaaggcggagatccagaaggcgcgcaccgcgcacccggactataaactggtgtttacggggcatagtctgggcgctgcgattgcgacgctgggcgcggccgagctgcgcaccacggagaagtgggctattgatgtgtattcgtatggctcgccgcgcgttggaaaccttgagctggccgagtacatcacctccctcggggcgatctaccgcgccactcataccaacgatattgtgccccgactgcccccggaggctgtcgggtaccgccatcccagcccagagtactggattaccagtgcgaatggcgtagagcccacgacggcggatgtcaaggtgattgagggggtgggatcgagaaaggggaatgcgggcgaggcgtcgccggatgcgtcagcgcattcgtggtactttggggatatttctgagtgtcagtga

SEQ ID NO: 1304 - protein, 301 aa, Aspergillus terreus
MPLMMFSIRYTCLVLVTTLVALGVAAPMRHVARDVSTAALTQLDLFAEYSAAAYCTGNLNTTGTKVVCPAGNCPQVEAADTTSLKEFLADGQYGELAGYLAADSTNKLIVLSFRGSRSPANWIANLDFIFDDADELCADCKVHGGFWKAWHTVSDALKAEIQKARTAHPDYKLVFTGHSLGAAIATLGAAELRTTEKWAIDVYSYGSPRVGNLELAEYITSLGAIYRATHTNDIVPRLPPEAVGYRHPSPEYWITSANGVEPTTADVKVIEGVGSRKGNAGEASPDASAHSWYFGDISECQ

SEQ ID NO: 1305 - DNA, 1692 bp, Galactomyces geotrichum
atggtttccaaaagcttttttttggctgctgcggtaaacgtggttggcgttttggctcaagctcctacggctgttctcaatgataacgaagtcattactggtgtgcttgagggtcaagttgatactttcaaaggaatcccatttgctgacccgccagttgctgacttgcggtttaagcatcctcaaagttttactggatcttaccagggtcttcaagcaaaggattttagctccgcttgtatgcaaattgatccctacaactctcttaccattcttgacaatgttctgaacttgggaaaaattattcctgaagacttcagaggccccatttatgacatggccaagggtaccgtgtcaatgagtgaggattgtctttaccttaacgttttccgtcccgctggtaccaagcctagtgataagttacctgttatggtttggatttatggtggtgctttcatctatggttcttctgctgcttaccctggtaacggctacgttaaggaaagtgtcaaaatgggccagcccgttgtgtttgtttctattaactaccgtactggtccctttggctttttgggtggtgatggcattactgctgaaggcaatacaaactctggtttgcacgaccagcgtaagggtcttgagtgggttagcgacaatattgccaactttggtggtgaccctgataaggttatgatctttggtgagtctgctggcgccatgagtgttggtcatcagcttattgcttatggtggtgacaacacttacaatggaaagccccttttccattctgctattcttcagtctggcggtcctctcccttactatgactctacctccgttggtcccgaaaaggcttacaacagatttgctgaatatgctggctgtgatactactgctagtgacgttgacattttgcaatgtctccgcagcaaatctagccaagttttgcacgatgcccaaaactcgtatgacttaaaggacctgtttggcctcctcccagaatttcttggatttggtcccagacccgatggcgacattctccccggttccgcctttgaactttaccgcagcggcagatatgccaaggttccctacattactggtaaccaggaagatgaggggactgttcttgcacctgttgctcttaacgcaaccacaactccccatgttaaaaagtggttgcaatacattttcaaccaagcttctgactcttctattgagcgcgttttggagctttacccgcaaaccctttcagagggttccccctttcgcactggtattcttaatgccttgacccctcagttcaagcgcgttgctgccatcttatccgatttgcttttccagtcaccccgccggattatgcttaacgctactaaagatgttaaccgctggacctatatttccactcatttgcacaatcttgtgccatttttgggtaccttccatggtaacgagcttgttatccaatttaatgttaacgttggccccgctgattcttatctacgctactttatttcctttgctaaccatcatgatcccaatgttggtaccaatcttctcacttggaacaaatacactgatgagggcaaggagatgcttgagattaagatgtttgataactcaatgagaactgatgattttagaattgagggaatctcaaactttgagtctgacgttaatctctacggttaa

SEQ ID NO: 1306 - protein, 563 aa, Galactomyces geotrichum
MVSKSFFLAAAVNVVGVLAQAPTAVLNDNEVITGVLEGQVDTFKGIPFADPPVADLRFKHPQSFTGSYQGLQAKDFSSACMQIDPYNSLTILDNVLNLGKIIPEDFRGPIYDMAKGTVSMSEDCLYLNVFRPAGTKPSDKLPVMVWIYGGAFIYGSSAAYPGNGYVKESVKMGQPVVFVSINYRTGPFGFLGGDGITAEGNTNSGLHDQRKGLEWVSDNIANFGGDPDKVMIFGESAGAMSVGHQLIAYGGDNTYNGKPLFHSAILQSGGPLPYYDSTSVGPEKAYNRFAEYAGCDTTASDVDILQCLRSKSSQVLHDAQNSYDLKDLFGLLPEFLGFGPRPDGDILPGSAFELYRSGRYAKVPYITGNQEDEGTVLAPVALNATTTPHVKKWLQYIFNQASDSSIERVLELYPQTLSEGSPFRTGILNALTPQFKRVAAILSDLLFQSPRRIMLNATKDVNRWTYISTHLHNLVPFLGTFHGNELVIQFNVNVGPADSYLRYFISFANHHDPNVGTNLLTWNKYTDEGKEMLEIKMFDNSMRTDDFRIEGISNFESDVNLYG

SEQ ID NO: 1307 - DNA, 1005 bp, Yarrowia lipolytica
atgaagctttccaccatccttttcacagcctgcgctaccctggctgccgccctcccttcccccatcactccttctgaggccgcagttctccagaagcgagtgtacacctctaccgagacctctcacattgaccaggagtcctacaacttctttgagaagtacgcccgactcgcaaacattggatattgtgttggtcccggcactaagatcttcaagcccttcaactgtggcctgcaatgtgcccacttccccaacgttgagctcatcgaggagttccacgacccccgtctcatctttgatgtttctggttacctcgctgttgatcatgcctccaagcagatctaccttgttattcgaggaacccactctctggaggacgtcataaccgacatccgaatcatgcaggctcctctgacgaactttgatcttgctgctaacatctcttctactgctacttgtgatgactgtcttgtccacaatggcttcatccagtcctacaacaacacctacaatcagatcggccccaagctcgactctgtgattgagcagtatcccgactaccagattgctgtcaccggtcactctctcggaggagctgcagcccttctgttcggaatcaacctcaaggttaacgaccacgatcccctcgttgttactcttggtcagcccattgtcggtaacgctggctttgctaactgggtcgataaactcttctttggccaggagaaccccgatgtctccaaggtgtccaaagaccgaaagctctaccgaatcacccaccgaggagatatcgtccctcaagtgcccttctgggacggttaccagcactgctctggtgaggtctttattgactggcccctgatccaccctcctctctccaacgttgtcatgtgccagggccagagcaataaacagtgctctgccggtaacactctgctccagcaggtcaatgtgattggaaaccatctgcagtacttcgtcaccgagggtgtctgtggtatctaa

SEQ ID NO: 1308 - protein, 334 aa, Yarrowia lipolytica
MKLSTILFTACATLAAALPSPITPSEAAVLQKRVYTSTETSHIDQESYNFFEKYARLANIGYCVGPGTKIFKPFNCGLQCAHFPNVELIEEFHDPRLIFDVSGYLAVDHASKQIYLVIRGTHSLEDVITDIRIMQAPLTNFDLAANISSTATCDDCLVHNGFIQSYNNTYNQIGPKLDSVIEQYPDYQIAVTGHSLGGAAALLFGINLKVNDHDPLVVTLGQPIVGNAGFANWVDKLFFGQENPDVSKVSKDRKLYRITHRGDIVPQVPFWDGYQHCSGEVFIDWPLIHPPLSNVVMCQGQSNKQCSAGNTLLQQVNVIGNHLQYFVTEGVCGI

SEQ ID NO: 1309 - DNA, 2589 bp, Magnaporthe grisea
gagcttgatgtcactacttcctttccatgtcaactgatcctgccctccaaagcaaagaattctattttaccacgagtaccagtctacagctgagtttgtcaaccgtagcgaggttagatttaataccgcacagctttcgcgtggccagcaatcgtgccctttttacgcggtagtatagtgcgcaaagtgggatctacaacatgtcaacaaggtcaaggtcttttggaaagctagatgcaataccgcataggagagtaaactccactgccgaagattaaacgaacccactccgatgcgtctgtttaatgtaccccagcccaaccccctcaccactccgcacgaccaaaaaaaagtcccgggaccgtcaccataccgtatcgtcataggcaccaagatgaagttgcccatgctacctcgcgcagtatgagctgactcggaggaggtaggtagctagtcacaccggaaatatgacgaacgactcgcttggccaggatggcctcgagagctcaacaagtctggttgcatgctccccctcaataacgggtcgggtgggtgggcgcaaattcccttatttccgtatcagttccagtcctcttcttggtgctcgcctggcaagagactcataaatcttggggaagaccccgaatcggtgagcagggtcgactgtcgttcaccaccctctgtcttcaccttctttctccttcccacaagttcccgagacatctctcttcctttggcggaaccgctcgaaaagatggctcgtactttgtggaagctggcactccttggtgccttgccgggactgtcttctgcagctctctccaccgtggtaggggactcgtgcaaccagtatgcgggaactgccaacgcgacgactggagttaccagatggcttgggattcggtatgcctccccgcccgttggctctttgaggttcatgccgcctcaggatgcgccttgccagaatggtattcagaacgcgacacaggtaagcagcgctcatgtctggccctgagactttctccaagtagctcagcagtacatgcggtggctgacaagacatgcagcacgggccgatatgcatagggaccggagagtccgagagtgccactcgctcggaagactgtcttttcctcgacatctacgcgccgtccaatgccacttcatcctccaagctcccggttgtcatgttcatccagggcggcggcttcaacaaaaactccaactccaactacgacggcacagggctggtcaaggctggcgattacggcctgatcgccataactttcaactaccgcgtcgggccctatggcttcctcaccaacggcaacgaggtcgagcccaacaacgggctaaaggaccagcgcaaggcgctccagtggatcaagaagaacattgcgcagttcggtggcgacccggaccacgtcgtcctgatcggcggttcggccggaggggcgagcatctccctgcagctgatcgcgtacggcggcaaggacgagggcctgttccacggcgcagccgccacggcggtgtcttttgcgactgtgctgaccgtggaggagtcccagtaccagtacgacaactttgccatcctcgcaggctgtgcggtcgccgactcgctggcctgcctgcggtccaaaaacaccaccgagctgcaggccgccaacaagccgagcgcttacccgggggcctccgaggcgccgctgtacatgtggaaccccgtggttgacggcgacatgctgacggagctgacctataccgccttcgaggagggaaggttcctccgcgttccggtcatctttggcacgtcaaccaacgacgggcggtcctttgcccctcgaggaacgtcgacgctcggccagagcaacaccttcctgaaagaccagttcccgtacatgacgattgagcagatgggcaagatcaacgacatgtaccccaacgagaacaacacctgccccgacacaggctgctactttgggcaggccgccgcagcgtacggtgacgtgcgctacatgtgtcccggcatgtggatctcgtcgatatatgaaaagtttggacagggcagcaagtcctggaactaccgatatgacgtcgaggacccgaagcaggttgcttcaggagagggtgtgccacacacggtaggttgaaccatccgaaccatccgaaccccgcattgacaaccgagttttttcttcttctcttttttaaagctgaccatgacgttcatgttgaaacgcagtccgagaaccaagccatctttggccccgagtacaccaacggtggcgcaccggcaagcctctaccccggccagatcaacgcgcacgccgtcgatgtcactcagggatactggaccagcttcatcaggactctggatcccaacacgcacaaggtggccgacgcggtcaattgggatacgtggactgacgcgggtcacaagcgattgctcattgcgacaggtggcaagtccagcatggaggttgtggacgacaagacccgagagaggtgtgaatacatcacctcaattggcgtttccatcaagcagtaattataaagtatataataattattgaatagaagccataattctgc

SEQ ID NO: 1310 - protein, 536 aa, Magnaporthe grisea
MARTLWKLALLGALPGLSSAALSTVVGDSCNQYAGTANATTGVTRWLGIRYASPPVGSLRFMPPQDAPCQNGIQNATQHGPICIGTGESESATRSEDCLFLDIYAPSNATSSSKLPVVMFIQGGGFNKNSNSNYDGTGLVKAGDYGLIAITFNYRVGPYGFLTNGNEVEPNNGLKDQRKALQWIKKNIAQFGGDPDHVVLIGGSAGGASISLQLIAYGGKDEGLFHGAAATAVSFATVLTVEESQYQYDNFAILAGCAVADSLACLRSKNTTELQAANKPSAYPGASEAPLYMWNPVVDGDMLTELTYTAFEEGRFLRVPVIFGTSTNDGRSFAPRGTSTLGQSNTFLKDQFPYMTIEQMGKINDMYPNENNTCPDTGCYFGQAAAAYGDVRYMCPGMWISSIYEKFGQGSKSWNYRYDVEDPKQVASGEGVPHTSENQAIFGPEYTNGGAPASLYPGQINAHAVDVTQGYWTSFIRTLDPNTHKVADAVNWDTWTDAGHKRLLIATGGKSSMEVVDDKTRERCEYITSIGVSIKQ

SEQ ID NO: 1311 - DNA, 3398 bp, Magnaporthe grisea
gcaacaggtgatcacacattgcaccacacccttccaaatttgatcagatcggccttgacacgcaacatgggcaacatcacctcgacaaagctttatcaccgtgctttcggcggcaccaagcacctgatcgagcaatacgtcgtccaagtcgggatctcgatcaacaaggtcctgctgcctgattccgtttctgggatcgaagagcacgagtccaccaacggaagcacgggaggacatcgcggagcacctgcggaacttgccgtcacccccatcacttcccggcgcgtgcaaggcctgtggactctgcacgacaagaagacggccgccgccgacttccagcggtcctttgggcacacttgcctgatcctccaaggtggctccatctttggcatgtgccatctcggtgtcgtcaaggcgctgcacgaagatggactcctgccccgctgcatcgcgggcacggcgacgggagcgctcattgcggctttggtggctacgcataccgacgaggaactccccagggtcttttctggcgagctggttgatctcagcgcattcgagactcatgcccgaaagacaagctccggttctaggtgggcaaccctgttccggcgcctccaccgattcgcggagaagggctacatcctcgacttgaccgtgctcgagcagctcgtgcgagacaatgtgggtgatatgaccttccaggaggcttttgagcgtactggcagggctctcaacattacggtcgtctcctcgggtcagggtggagtgcccacggtccttaattatctaagtacaccaaatgtggtaagtataatagtgcagacgtggatacagcctaatctcttggcctaatccttctatatccgtcactggtatttactgacagtctcctgcaacagctcatctggacagcagcggcagcctctaatgcagacttgccctcgctctacggtcgtacaacgcagttactgcgtaaggggtatgatgggaggatcgaagcatggggacccccgaggacctttaggcacttttcccaggcgcaatatacggaacaaaactcaccaatccgcaaaatcggctcccagttcaacgtcaaccattacatagtaagccaggcgcgggcgtacatgcttcccttcctcaggccagacatgcacggccccgtatccagtttcagctggtacctcaacgacctggcctggtacgccggcctcgaggtccggcacaggctccggcagctcgacaggttcgggctgatcccggaccgcataaggcgtcttgtgatcgacgacgtcgttcccagtggcaggggcctgaccgtagtgcccgacgtcaagatggccgactttgcacgcctcctcgaggtgcccacgcagcagtcgctggcgcactggatcagggttggtgagaagagcgtctggcccgcgttggcggctctccgggtgcgctgccacgtcgagttggtgattcaaaacgcacaggatgtccttgacacgactaacgaggccgagtatgcagacctgggggtgccgaatactgaagtcaacggcggggttaaggcatgacctcgtctagggaccggggttggcagctgggacatgtctcgtcccggtctcttagttgggctttgggagaaacgaagttgatgtacaatagaatctgtaccagctcgacggttccacccgccaacatgcttgtatccttcattgcaatctcagtctacaattcgggatgttgttttggccagcggagacctgtacctgcactagcctgtcacttctcgaatgtggagaggtagggaaatagttttcccaatattgatcattgccgttgttaccgctgagaaggtttcccctttggaggctagtcggtagatgtctagtcatcttaacctttcaatgggaattaacgcttgtcatcactgtcacgtcggcttcctattagaggttcggggggattcggagacaacatatccacaaaacccgacagtgatagtaattacccggtataccatgcaagtgcaaggcaagtggaatctttttctttttcttctgtaaagctcccatttcaaggtaacgcgcaagaaatggtctcgtccgtgaaccgagatcgtactttgcgttgtacagagcacctgaatccacccgttgccgaggaagtttgggtgttgtcaaatgacacagcgtggtttatccctcacaatcatatgactgaccactaaaaacatacctaggtattagactagttctagtctagcttctactgttcagcatctccggaaccacgtgggaatgcaacccaaggtaagagcacagtcggtggtattcgctaattaccccgccgtcccctcagtaacaacacgtatggtaactgactcgagttttcaaccgggctcgaggccgtcctaccgttgcaacattatactggaaacgcccccatggtctgtctgtacatacatagtacatagtagctgatggccaagctttatggggagaatcggacagaagttgcaccgggcgccgtgttggggcgcaaaggccggacgaagattttttttctttctctatttctttctgatttctttggtttgagtggtccaacattgtattactatccccacgtcaaggaaaaccgacctgccatgttcggttttttttttgtcgagatttttccctttcgggcgagtttggcaggaatatggtaggactttcttgtggatattgggaaaacatgctacgaccaaagttcaatacttctcattatttaccacctgccacttgctgaatgcctctcttgcgacggccagcaaggttcgttgtgagaaaatggacatttctttaacacggaggtgatggtctgcggtttgatagactttacgaagcgtaacgcgtggatcttttcttttttgtggtaccaaaaattgacggtttggttcatcattggttcaagcgttagccctttaatatggatattgataccctacccttggtttcattcagctgcaacaactaccgtagggagaaatgcaggtacccgcaggccaagacgaatgccgagcatggagaagcttatgttggtatgatatccggggatgcacgctgcaaattacctaccttcctacggtaggtaggtacctactatggtaggcaccacaataaattacatgatcaaagtgtcgtacctgcctgtacccatgataagttataggtaggtacctccatagaatgtcttgaccagatactatacgatataactggatcatcaccgagtcagaatagagcctgatctatgcctacactttacaggtttgttcctaagtggttaatctcatctttgtcttgctcacacttgcggggatttgatgggactagccttggctgtcaaacttgttttccttg

SEQ ID NO: 1312 - protein, 534 aa, Magnaporthe grisea
MGNITSTKLYHRAFGGTKHLIEQYVVQVGISINKVLLPDSVSGIEEHESTNGSTGGHRGAPAELAVTPITSRRVQGLWTLHDKKTAAADFQRSFGHTCLILQGGSIFGMCHLGVVKALHEDGLLPRCIAGTATGALIAALVATHTDEELPRVFSGELVDLSAFETHARKTSSGSRWATLFRRLHRFAEKGYILDLTVLEQLVRDNVGDMTFQEAFERTGRALNITVVSSGQGGVPTVLNYLSTPNVLIWTAAAASNADLPSLYGRTTQLLRKGYDGRIEAWGPPRTFRHFSQAQYTEQNSPIRKIGSQFNVNHYIVSQARAYMLPFLRPDMHGPVSSFSWYLNDLAWYAGLEVRHRLRQLDRFGLIPDRIRRLVIDDVVPSGRGLTVVPDVKMADFARLLEVPTQQSLAHWIRVGEKSVWPALAALRVRCHVELVIQNAQDVLDTTNEADSTVPPANMLVSFIAISVYNSGCCFGQRRPVPALACHFSNVESISGTTWECNPSCNNYRREKCRYPQAKTNAEHGEAYVGLFLSG

SEQ ID NO: 1313 - DNA, 4002 bp, Magnaporthe grisea
gaaccaagccccaggcccaacttcacaaccccaacccgccagctggaccgagggtctccaacgagccgagccgttgcggctccaaataagccaagatgctcgatattcttcacctaacatcgaccaggtccaatgccaatagttcctctgccgcaaaacaacatcccgactccacacggccccaaaagccctccgcgtccgagccgacatcggcaaaaccacaacaaacgcactacgacaggcctcaacggtctagaccaaacaatgtcgttaccgtgctagacagagcagccaagctcgctctagattgtcgagatgttgtctgctcctctttacgaaccgagacggcggcgtttaagaagcggaggcgcgagttggaggctctgatgaacaatgtacgtcggatcgccatattacttgggggcccgtgatagatgccctcccctctgcatgtttgcgcatagtgctgatatagaatcttgcacccggcggtacaggctaattcctatgaggaatgggaaactgctgctcgagccctcgacaagttcatgggcaatgacctgtggaaagacaagcttggttctggtgaatactgcgttgtggagctcctcgagaacatgcagaggctagacgaggctacgaaaaagcgcaacttctgcgagctacttttcctgataagaacgacactttcgcgagacctcggaggcatggggagctctgccttgtataggcattctcatacgggtaccaagaccatcatccaacgatatgtccagtcggccaccagggcaatcgaaacaatggtggagctggcgggttctgccacatcgaggggaggcatgggattacccaaagtgctgcaggagctggagcatacgagaaggcatttcggccgtagtgccctgatgcttagcggcggcgccacctatggtatgacgcacattggcgtgatcaaggctctgtttgagcaaaatttgttgccgcgcatagtctcgggcgcatctgccggctctatcgtttgcgcggtgctgtgcacgcacaccgacgaggacctgccacggatcatcaaagagttcccgtacggagagctcgacgtgtttgaggagcaaggtcgtcaagtgagcatagccaagaggctttggaagctgttgacggaatggtactggtacgatgaaacgcacctcgtcagggtcatgcgcaacatgattggcgatgttacgttccgcgaggcatacaaccgtacgcgcaggatatgcaacattacggtatcaatagccaacaacatcgagcttcctcgactgttgaactaccgcacatcgcccgatgtcatgatctggtccgccgtcgccgtctcgtgttctgtcccgggtctcttcaaagcctcgagcctcatgatcaaagaccccaagacgggggagcagtctcgatggttcccatcgccgcagagatggatagatggctctatcgacaacgacctgcccacaactaggctggccgagatgttcgccgttaaccactttatagtctctcaagttaatccccatgtagttcccttccttgagcgggacgacgtcatacttgagcccgaggaacgagactcggctctttcaacaagcttcaagccctcattactcatcaagaatctattctcagagatcaccagcatggccacagaggagctattgtatagattgaccgtggttgcggaaaatactggacccatgtcgaatatcctgaccaaagtgtgcagcattctgagccaacaatactcgggagacataacaataatccccaagatagaatggagcgacatggctcatctggttactaaccctacgagcgattttatgctcaagtcctgtctcatcggcgaaagaggaacatggccgaagctgcgacgcatccgtgaccactgtgcaatcgagctgtgtctcgacagggcgataacggaattgatgacgctggccgcctttagccccagtcaagtcaacctgcgccgttctttgggccttcactctggcgatgttggacaaccgatcaaccgactgcaccaccgagagcgtcggccgtcggacagtaatatacatatgataatgagacagcgccaaaataatctggagctggagcagctgcttagcgaaaacgaatggcgcctcgagagcacgtcggaatccgatgacgaggacgaagacggcggtgtgatgctaaaggtggacgcccgcccacgacgtcgaaaaacctcatccggcgcgagcgcggctcaaaactccgaggaccgcccacgcaagcctgtgctgcggcgtgcggcccgcagccaccaggcgctccatttcaaggcgctggcacgactatcgacgccaatggccaaccctctgaccaaagatctggacgatctggacgatctggatgtggtcaccatgggcttgtcaacctcacgatctgggacccctggagacctgaactcgcccacgtcgacgacaagctcgcacagcccgcggtttatggaggcggtccgaaagacatctttggggaaatcagcatttgcccgaaccgaaatcccgtcttcgccagccgaggatacccttatcgactcggcatctgacgcagactcgctgccctcggaccatggtaatatcttggatccagcggctgagggcaagccgaaggatggttctgcgccaaaggtccttgagcaggctcgattgtgccaagagcccgagacgacgcgggaagcagacaacatgtttaccagttgactcgtggacgagggcctgagctcatcgggcagcgacacggagcgtgccgggcaccgattaccgaacagcactgcttctgagcaaggtcctcggggtacgagtcgtgagggtgaagtggagggagtgagtgaccatcggttactgtggatgggttggtagagtggtgtaaaggcacaaacggttggattacgagctattcttcacttgtatcgagaatcgcgattgtgcagatgacactgttgtatacagtatgacgcttgcgcaacggtttggcttttggtctccaatgactctattagactgcatttctaggtggcattttggaataaattagaacggagctttccgacatcatgtcaggtcttgaatgggatgttcgggacgaatttagacatatttagagacaaaatcaagaatatcgcccatatcaccattgaaattattagcccggggttccatcgatacttgttcgtagacaattgagcataggacagtacttcgccaatgccttgtatcagttgacatacaatttgatcaatagaacagaattacgaatactgctgtacctgtttctcattccacgcccaaaactcttgggcgatgccagaaccgccttccgattctggcttggtcgctttctcgaggtcatccctgattggctcaaaacggccccagggttgaacgaaaaacaaagttacgggtcagctgtaagcccgcccaaatagtgcaactcaaacacaaacaaaaaacagtgacttactccacgccccattcttctccaaaccaacctcaggactcaacccggcaagagctgcgtgtaggcgccgttgacggtcgggtgctagagcgtgtatttgaaaaaaaaacacctgttccatataggattggtgcctcgccaggtcggagctcaggttgcccgggttgagtgcgaggctgacgaatgcctttgttgccgaagcggcgggcgtactcggtcccctggaggtaattgcaggctttactgatgctgtacttgatgtgtggcgagatggcatctttggaagcgaggtcgtcaagcttgtcgagcaggacgccgcccggcggggccgcgagctcggcgaccgaagacgcgacccagacgactcggaccgagccaggtgcagactcggcggcggtagtggccaatagaacaggatgggaaggcaccattgattatcgaggaccttgcaggttgacaattgctgaggtcattgcagaacgccatcgt

SEQ ID NO: 1314 - protein, 998 aa, Magnaporthe grisea
MLDILHLTSTRSNANSSSAAKQHPDSTRPQKPSASEPTSAKPQQTHYDRPQRSRPNNVVTVLDRAAKLALDCRDVVCSSLRTETAAFKKRRRELEALMNNANSYEEWETAARALDKFMGNDLWKDKLGSGEYCVVELLENMQRLDEATKKRNFCELLFLIRTTLSRDLGGMGSSALYRHSHTGTKTIIQRYVQSATRAIETMVELAGSATSRGGMGLPKVLQELEHTRRHFGRSALMLSGGATYGMTHIGVIKALFEQNLLPRIVSGASAGSIVCAVLCTHTDEDLPRIIKEFPYGELDVFEEQGRQVSIAKRLWKLLTEWYWYDETHLVRVMRNMIGDVTFREAYNRTRRICNITVSIANNIELPRLLNYRTSPDVMIWSAVAVSCSVPGLFKASSLMIKDPKTGEQSRWFPSPQRWIDGSIDNDLPTTRLAEMFAVNHFIVSQVNPHVVPFLERDDVILEPEERDSALSTSFKPSLLIKNLFSEITSMATEELLYRLTVVAENTGPMSNILTKVCSILSQQYSGDITIIPKIEWSDMAHLVTNPTSDFMLKSCLIGERGTWPKLRRIRDHCAIELCLDRAITELMTLAAFSPSQVNLRRSLGLHSGDVGQPINRLHHRERRPSDSNIHMIMRQRQNNLELEQLLSENEWRLESTSESDDEDEDGGVMLKVDARPRRRKTSSGASAAQNSEDRPRKPVLRRAARSHQALHFKALARLSTPMANPLTKDLDDLDDLDVVTMGLSTSRSGTPGDLNSPTSTTSSHSPRFMEAVRKTSLGKSAFARTEIPSSPAEDTLIDSASDADSLPSDHGNILDPAAEGKPKDGSAPKVLEQARLCQEPETTREADNITELRILLYLFLIPRPKLLGDARTAFRFWLGRFLEVIPDWLKTAPGLNEKQSYGSADWCLARSELRLPGLSARLTNAFVAEAAGVLGPLEVIAGFTDAVLDVWRDGIFGSEVVKLVEQDAARRGRELGDRRRDPDDSDRARCRLGGGSGQ

SEQ ID NO: 1315 - DNA, 1579 bp, Magnaporthe grisea
gagccaggaacaaaaataaagaaacagtaattactttgaggcctgctattttaccttgggactatgctcggattacctgaaaatttctcagaaacatcatgatatctagcagataaaacatggttgttgggtcagcgctcatgttgcgccctgtgcctccgcttgttgccagcaaacccggctccggattctattggcagcgacgcctgttcaacttggcaggctctacgaatatcaccgtgtccgcttgcaagcctagtgcaaagcgatttatatcagagacgccgctccgtcttgagtcttcaggtcaagatgaccctagattgaaagaagtcctaggcaggactatcgcagacgattttgccaagttgcgttctgactatggtgagcaattccaaccaaaggggcaaacgaatgtatatgcatccattggaatcatcttatacgcgaagagaggcttacaggaactgtccagcatcgcccaaataccctgtggtgctcgcccatggcctgcttggtttctcgactctcgagctagcaggccatttgctcccacccattgaatactggcacggcgtcaggaccgccctggaagcgcgaggcgtgactgtcatcacacccgcggtgccaccctcggcaagcatcgcggtgcgggccgccaagctggcgacgcagatcgccgactcggtgcccagcggcacgcccgtcaacataatcgcgcactccatgggaggcctggacgccaggctcctcgtgtcgccagcgtttgcggaccagctctcttccgtgaccgcagaacgcctcaacgtggcgtcgctggtgaccatatcgacgccccaccgcggcagcacctacgccgagcatgttataaaccttctaggtcctcagcgggtagagggggcccggcgcatgcttcgaaccacaatggggtgggataacacggaagcgtttgagcagctgacacccaggtatatgaaggaggtgttcaatcccgctactccggaccacccggacacgcgttatttttcctatggtgccatgacggacgggcggccgcggctttttagcccctttcgcgcgtcgcacaagattattcaggctgccgagggccccaacgatggtctcgtgtctgtcgaaagcagtaaatggggtacatacgaaggaactgtggtcggtgtttcacacctggccctgatcaactggtgagtagtttgaccccaaaaagttgagagcattcaaggtttgacgtgactgagccgcgtaggacgaatagacttggttggactgttagaaagtggttgggccaagaagagacgtgagtacaatctcgaccaagatgtggactaaagtctttttagaggccaactcaactaacccggactcagcttcaacgcaattgcgttttaccttgatattgcagatatgttggcgaaaaggggattgtaggatagatgagcggtggatggggtgccaacagcctgaaagacagccaagtcaatgctggcgtcaggatatgtatcattaataagatcaattgttgttcacattaattttcaacattttattcctttggcacaaa

SEQ ID NO: 1316 - protein, 367 aa, Magnaporthe grisea
MVVGSALMLRPVPPLVASKPGSGFYWQRRLFNLAGSTNITVSACKPSAKRFISETPLRLESSGQDDPRLKEVLGRTIADDFAKLRSDYASPKYPVVLAHGLLGFSTLELAGHLLPPIEYWHGVRTALEARGVTVITPAVPPSASIAVRAAKLATQIADSVPSGTPVNIIAHSMGGLDARLLVSPAFADQLSSVTAERLNVASLVTISTPHRGSTYAEHVINLLGPQRVEGARRMLRTTMGWDNTEAFEQLTPRYMKEVFNPATPDHPDTRYFSYGAMTDGRPRLFSPFRASHKIIQAAEGPNDGLVSVESSKWGTYEGTVVGVSHLALINWTNRLGWTVRKWLGQEETFNAIAFYLDIADMLAKRGL

SEQ ID NO: 1317 - DNA, 2968 bp, Magnaporthe grisea
accacacggtcttgttcagaagttcagaaagaaaccgcgggttgtgtgggcggagttgccgctttcaggggcccgtgacgtgacggcagcatggtcgccaacaccgacgtcatcgcgcccgagggtagcacaaatcagcaacacaatcacggtggagagtctgaaaaaccaccatctgcgcgtgcaatctcggacggcaggctcccagatggcgccagcgaatttgcaaaacagtcagagaagctctcgcttcaaaagtctggcggcagtgtaaaagacgacaatcctgccgtagaggcccgcttcgtttctccacaggataccgtccttgtcacctccaacggcgataggttacccggtgtgccactggaggaggctcacagattgaacgaactcaaccaaggattgaatggggggaagaaggccgatgccagcggttcggtcgccgacaattctgctggagagaaggcggcatcaggagcagggccagatgcgtcccctaacgagaagggagaggtggctgtaccccttgatgagcggagcgccaacacgaaaaacgccaagtcgatacaggagtcgactcaaggcaacctgaccaagtcaatgccgccatcgcacacgaacccgctgttcccgccgttgccgctctatggtcctccgagtctgatgcgtaacttgcaatgcacgacattccgcgtttcgtcctttttcctctcgcttggcttcctaggcgtcattgttctgggctccctgttcaccagcataccgccgttttgcagccgcgccttcaagtacatgttactcaagaacccggacgcagaacgcccattctacgaggaagagaagcgccgtgcgtccgtacggaaggagctcgagcgtaggtggaggcggcgcgggtcccctgacaggacgcctcaggacgccgagaatcgggacggtgatggctacatccccacagagggtggtccggatcccatcaagtgcgatgttggctactacgcccgtcgtgtcgggctcgatgtagaagagtttgaggttcagaccgaggacggcttcatcattgacctttggcatgtctacgatccgcgggagtatgaagaactcgaacccaagcaacggaaagaacgaggccccgaagttttcaccggcgccaagagaaagctgaggaaccccgacggaccgaagaggttcccggtgcttttgatgcacggcctactacaaagcgccggtgcttattgtgtgaatgatgatgattctttggcctttgtaagtactatatgagccctatccacgccttatcgtcctactcacccttggcgtagatgaagggctcctcggctgaccagcatctcctatacagtacctgtgcaaatccggctacgacgtctggcttgggaacaaccgctgcggcttcaaaccaaaacacaccctcctcaaatactccgaccctcggatgtggtgctggaatatccgacagatgggcgtatttgacctcactgcactcacgtctagggtacagttcgagactggtttcgaaaagatcggtctggtatgccactcccaaggcaccacgcagacttttgtcgccctggccaaagagcaacgacccgacctcggtgagaaactgagcgtcttctgtgccctggcgccggcggcttatgctggcccgttgatcggcaagatgtacttcaagttcatgcgcatcatcaccccgtccatgttccgcctgatgtttggcatccacgccttcatccccttcatgatgaccatgcacagcgtcatcaacccgcgaatctacggcaagctgggctacaaggtcttttcgttcctgttcaactggaccgacacgcgttgggatcgcggcctccgagaccgcttcttccagttcgcccccgtctacgtctcagccgaatcgatgcggtggtggctcggacgcgagtgtttcgcaaaccataagtgcatcctggcgaccaaggaggagtggaaagccgaggaggaggaggacaaacacaacgaagagacggatgcccaacagcaacaggcatccacgggtccgggcgaagatcctccgcagcgctggcccagcaacctccttctcgacccggagaatgtcgatccgaaaaacatccacagcccgagcccgagccctagccccgacccggaggccggcaccgacgagcaccaccagaccatgcagcagcgccgacgcccgcttggcgccacggcgtggtacaacaagcaggccccaccattcgcgttctgggtctgcggccgggacgacctcgtcgacgggcgcaagctcctccgccgcttcgagcgtggccgtgagccgcacgtgaacgttgtccacagcagggtcctcgacgagtacgagcacctggacgtcatctgggccatggacgcccccgatagggtcttcagcgaggtcagggaggtgctctggaagacttgcaacgtgcgtgaccggtgcagggtccccaaggggtgtgaggaagtcgcgccgtggtcgcccgctggcgaggccaggggcgtggaccagcccagctatggaggtggtcagggtgaggataacgagttttccggcagtagcagcgaagatctgtccgcgtgagacggtcgttcatgaaaggtgtatcaattagcgctattctttctcacacttacggcgtcctggcttgctctttttccatgttgctttttgtttccatcttgtccttatcatttattttcattataattttaggctcaggtccgggggtgctttgcaggcgtctggtcagtttaggactcggggcagcacgcttatgcgtttttggttaaggcaagtataaaatagtaaaaaagaaatgtgtacggatagtactaatacaccgagtgatattacaactgtatcgcgccggtgataaatctcggaacctcagtttatccctttttttcctagcagaaatatcgaaaagaagctccgaat

SEQ ID NO: 1318 - protein, 808 aa, Magnaporthe grisea
MVANTDVIAPEGSTNQQHNHGGESEKPPSARAISDGRLPDGASEFAKQSEKLSLQKSGGSVKDDNPAVEARFVSPQDTVLVTSNGDRLPGVPLEEAHRLNELNQGLNGGKKADASGSVADNSAGEKAASGAGPDASPNEKGEVAVPLDERSANTKNAKSIQESTQGNLTKSMPPSHTNPLFPPLPLYGPPSLMRNLQCTTFRVSSFFLSLGFLGVIVLGSLFTSIPPFCSRAFKYMLLKNPDAERPFYEEEKRRASVRKELERRWRRRGSPDRTPQDAENRDGDGYIPTEGGPDPIKCDVGYYARRVGLDVEEFEVQTEDGFIIDLWHVYDPREYEELEPKQRKERGPEVFTGAKRKLRNPDGPKRFPVLLMHGLLQSAGAYCVNDDDSLAFYLCKSGYDVWLGNNRCGFKPKHTLLKYSDPRMWCWNIRQMGVFDLTALTSRVQFETGFEKIGLVCHSQGTTQTFVALAKEQRPDLGEKLSVFCALAPAAYAGPLIGKMYFKFMRIITPSMFRLMFGIHAFIPFMMTMHSVINPRIYGKLGYKVFSFLFNWTDTRWDRGLRDRFFQFAPVYVSAESMRWWLGRECFANHKCILATKEEWKAEEEEDKHNEETDAQQQQASTGPGEDPPQRWPSNLLLDPENVDPKNIHSPSPSPSPDPEAGTDEHHQTMQQRRRPLGATAWYNKQAPPFAFWVCGRDDLVDGRKLLRRFERGREPHVNVVHSRVLDEYEHLDVIWAMDAPDRVFSEVREVLWKTCNVRDRCRVPKGCEEVAPWSPAGEARGVDQPSYGGGQGEDNEFSGSSSEDLSA

SEQ ID NO: 1319 - DNA, 2815 bp, Magnaporthe grisea
ataaaaactgtttccctaccacacaaccacttacctacctacctacttaccttagctacctaggtaacctgccgggaacgaccttgtcaagctgcaagacagaagcaattgaagcaccaagccgcaatccctagcctcttggcaggccgatatctctatcgtaaccattttgtggcttttgttaagaatacctggagaccgcgccggagacgatcgccagcggggtttggcgcgcaaacaaccgcgataataatgccgttgcctttcctggggcgactgaatatgtatgcaggcgcagcgaggttactatcctgtttgctcggtccagtgagcttactgactttgtgacctcttcgttccagtcccgaatatgtcgcccttcttggttcattctttctcgtcgggctcgaggcctttattcgtgtaatcacattagcgctgcgtacgccaacgcctcatgcccctagtgctgaagaacttcaagacaatcgacgcagtcataagcaagatctaactatagtcctcgactacagcctcgacactaatatccctgttatatggcgtctcgagacgaatcttcaaccgatattccacacctaagcagaagatagccgtggaaaagcagaaacgtccgtatttgtacttatttacccctggagcggagtccggatcgtcctgactgacacttatttctcgattttgtcacaacagctgtgtctacttcgattcgagatgcatccgattttgtcgaactttgcgccctgaacggctaccaggctgaagaacatgttgtccagaccaaagatggctatctactcggcttgcatcgcctcgcctggaggaaaggggaggaagaccagagagtcaacagcggcccgaacagcgtccagaagcgtgtggtgtacttgcaccacggtttgctcatgaacagtgaggtctgggtctgccagacggacacaaaccgatcgctcgcgttcgtgctggtggatcaaggcttcgatgtctgggtgagttttgtttgctccacgagcgtgatcgtcctccccaatttccagcttgaggatctaaccagaggtatatatggcagcttggaaacaaccgcggcaacaagtactcgaagaagagtatcaaccattcacctgcttccacagccttttggaatttctccattgacgaatttgctttccacgacattccggatagtatcgcgtacatcctcgagactacggacgaaaagtcgttgtcgtacattggcttctcgcaaggaacagcccaggcctttgccagtttggccgtcaatccaagacttaaccagcaagtcaacgtgtttatcgccctcgcgccagccatgtcaccggcgggactttccaacagagtagtggatgctctgatcaaatcgtcgccttcggttctttttctgctctttggtcgccgggcgatcctcagctctgctaccatgtgggagaccatattgtatcctccgatctttatcaaggtcatagatgttgctgtgtctttcctatttggttggaaaaccagaaacatctcgacaagccagaagctggctgcttatccccacttgtactcgttcaccagcaccaagtcggtggtacattggttccaaatcatccgtaccaagagctttcagatgtacgatgatgatgtccagcaaccattgtcgctgagcacaagctccaggttcacgaaagtggctaagtatcctacgcgaaacatcaagacaccgatagttctagtctatggcggttccgattcactggtggatatcaaagtcatgcttcgccagctgccgcctcagaccgtcgccaccgagatcccgcgctacgaacatatcgactttttgtgggcgcgcgacgttgacgcacaagtattccgccacgtatttgacgcgctggactcattcactggtgcggaacataccaaggaagagtacaatcggtataggactgctcgctcgtccagcatcagtgccagcgtgaacttcaggcgacacgctcatcatgatagtgtcgacactcaggcagatgtgacagatgagaccaccgcgacaaccaccgaggcggaaagcgactcgggtgacaggactctcgtcaacggtcgaggcggatcgaggtctagacttcgacaccaggccacagagggcttacgcagcccttcaaggggctctgaggtctcggtaggcccggccagtggtggcttgaatacaaatggtacagtagcctccgatggtgaaagctcctcgggttcgcccgcaaggcgaagggcaggcattcaacgccataccagcggtgtgagcgtcgactctctacgtcaaggccgtggaattagggtgggtgccagtcgggccgtagggggtgtcactgctgcgatcgccggcggcaactctcccagtagcgggacggattaggaaacaccgcccttggctatggaagtgctggcttcacagaggcctggttagccggctgtcgcaacaaagttgtagagacagtcgagtccccttgcgaggagctgaagagagattctctggtccgtttgcctcgtatacaacctgcaaacagttttgtgattggagcaagtttgtgatcattccttagtgtctcactgaagtctccttgaaattttggtttatcctgtacatctctatatgtacagcgaatttggcgttgggggttggctttttaccgtttgggcgggaaaaaaaaacagattgcgtttcctttgtttttaaagcaggaacttgacctatagatatcagtcccttactatcatatatctatatacactgagcaggtcctgt

SEQ ID NO: 1320 - protein, 613 aa, Magnaporthe grisea
MPLPFLGRLNIPEYVALLGSFFLVGLEAFIRVITLALPSTLISLLYGVSRRIFNRYSTPKQKIAVEKQKPVSTSIRDASDFVELCALNGYQAEEHVVQTKDGYLLGLHRLAWRKGEEDQRVNSGPNSVQKRVVYLHHGLLMNSEVWVCQTDTNRSLAFVLVDQGFDVWLGNNRGNKYSKKSINHSPASTAFWNFSIDEFAFHDIPDSIAYILETTDEKSLSYIGFSQGTAQAFASLAVNPRLNQQVNVFIALAPAMSPAGLSNRVVDALIKSSPSVLFLLFGRRAILSSATMWETILYPPIFIKVIDVAVSFLFGWKTRNISTSQKLAAYPHLYSFTSTKSVVHWFQIIRTKSFQMYDDDVQQPLSLSTSSRFTKVAKYPTRNIKTPIVLVYGGSDSLVDIKVMLRQLPPQTVATEIPRYEHIDFLWARDVDAQVFRHVFDALDSFTGAEHTKEEYNRYRTARSSSISASVNFRRHAHHDSVDTQADVTDETTATTTEAESDSGDRTLVNGRGGSRSRLRHQATEGLRSPSRGSEVSVGPASGGLNTNGTVASDGESSSGSPARRRAGIQRHTSGVSVDSLRQGRGIRVGASRAVGGVTAAIAGGNSPSSGTD

SEQ ID NO: 1321 - DNA, 1002 bp, Magnaporthe grisea
atggcttcgcgagcacccatccgcagggtagaccctgagctagggcttatttgggagggagctccaaacatggatacactcagcgatgtacctgctgtccgtgacgcattcgcatcccattacccggacatattcggcctcccccatctgccagtctccactcaacgaccctcccacaacgtcaagtccgccgacggcacccaaataaaagttatgcattttatccccgatgcacctgcaggaatagatgcgccaccggctcgtgcagttatattctgttttggcggcggtttcattatgggaaaggcggacagcaacattgattttgccgccaacatggcaatccagacacacagccatgtgttcatgccaaactaccgcctcgcaccggaacacccagcaccggcggccgtggaggacgtctatgccacgctgaggtgggtgcagacgcatgccgcggggctcggtatcaatgcggaacgggtggttctttttggtgtgagcgctggcggtggaatcgccaccgggacggccctaatggcttacgacaaaagcctcaccagttcggaaaagcttccgctgccggccggcttggcgttgcggtaccctatgttagacgaccgcacgttcgggtcgatcgaggacccggagcatttctaccatgtctggaactgcgtagtcaataaaattgcgtggacagcgtacgcaggcggcaaggcaagagcggaaagaacgaacgatactatttctgtatacgcggcgccagcgcgggctgggccggataagctgcggggcctcccgcctacatttgtggacgtcgggggactggatttgttccgcgaagagattaccaagtttgtaaccgcgctggccaccgccggcgttaatgtcgagttccaccattactcggggcttccacacggcgttgaaataatggcgccggggatcagcaaagctattgccatgaataagaatacctgtagatttattggtagattttag

SEQ ID NO: 1322 - protein, 333 aa, Magnaporthe grisea
MASRAPIRRVDPELGLIWEGAPNMDTLSDVPAVRDAFASHYPDIFGLPHLPVSTQRPSHNVKSADGTQIKVMHFIPDAPAGIDAPPARAVIFCFGGGFIMGKADSNIDFAANMAIQTHSHVFMPNYRLAPEHPAPAAVEDVYATLRWVQTHAAGLGINAERVVLFGVSAGGGIATGTALMAYDKSLTSSEKLPLPAGLALRYPMLDDRTFGSIEDPEHFYHVWNCVVNKIAWTAYAGGKARAERTNDTISVYAAPARAGPDKLRGLPPTFVDVGGLDLFREEITKFVTALATAGVNVEFHHYSGLPHGVEIMAPGISKAIAMNKNTCRFIGRF

SEQ ID NO: 1323 - DNA, 3121 bp, Magnaporthe grisea
cacagggaagccaacaacctgttcgcttgccatgccatctttgaacctctgtcacatttcattttgtcccaaactatctacctcaacttgggtgcgcatcttcacctgacagtcggtgcgatcgggcgactcggtctcgtccaatgaagcattatccctgagatccaccaaagcattaatcacatgcttgtcccagaaacacaagcaagcaagcttcctttgttcacagcagctcaacccacctaacccgcctttccacaggtttgctacctaggccagacgatccaacatctgaacaaattgcacgttcgcttccattgaagctgccaaagacatgaactgccacctctcatagcctccagatgcgccaattaatatcagcgttcattactctgcgcagccgacactgagttcggcataaacgtaacaagccgcttgtacctctcgacgggatcgatcggtcaacattgcggctctgcgccagcccacggccacggccggccgtcacgtaacagacagccaatcggccgagacagattttatacactgccgccatgatagaccacgtactcgggagaccctcgaccaagtcgaggcgactccaaatattagccgtcttgacgttctggacattctacctgtcaaagtaggcaccaaacccaattcgctgccactgctggctccgatccccgtagaaggaagttaacagaggttttgtacatagagggaacaaacatggcccacctgggcttcgctacttgtcgaagctgctcaccaagcggctcacggcttggcaaacgattgtcattaccatgtcatacctatatgcggctcgcaacttcagcacgttggtgggactgtcggcccccgagccactcgccaatatgtatgaggccacatactttagagctacgtgggttcttacggctctcgacgcgggcttctggaccgccatgaagattcgtaacaagtggttgaggaatatatgcagcatcgtcttcaccgtgttctacttgttccaggccgaagcggccgacgaacgggttcgaaaggttcgcagcaacttgaacattgactacctcagggtcagctggaataagggtgtcacaccttacctgtccttcctgacgaggctcgtgaggccgcgttacacccgctggccccctcggcagatcaggattccgcgaccctctaccagtgacttccaggagcccgtatctggctggctttattttgatgggcccttggcagacctagtgcaccataatcgtatcgtactcgacgtgcctggcggtgggtttgtagccatggatccgcgatgcaacgacgacaggctgatggcttgggctggcaagactggcataccaatcctcagcttggactacggcaaggctcccgagtacccgtatccatatgcattgaacgaatgctacgacgtttacactaccatcatcaacagcaaggggcgctgtattggaatgtctggcaccgaggtccccaaggtcatcatcagtggcgacagtgcgggcggcaatctcgccacctcgacgacgctcatgatcattgagagtggaagttcacccgtacgccgctttcagggacagactgacctgccactacccgacgctgttattctcttctatcctggtcttgacatgaacattggcaactggatgtcggacgagcagatgactctgataaaggaccggcgcatgcgtgggactaaccgcagggtcgtccaccgaaagagcatgcagtacaaccacctggttggcacgccacaccactccagcgacgaggatgaaggcggttcttcggaccaagtacagcagcgaagcacggggcagcctacaattaagattgatacagatgtcgatgacgacgcaacaccgaccgggcccgacgactcgcgcagtccacacccggaatttgctcatgagggacccagcatttggggtaagcgccagtctcgaccaaactcggagccacagtcgccggaggtcacccagcgcaagaagcagagcacatcgcatcattcggaaacaatgcgcacgagacttgccacgtcatccatgatctcgtatttcaacgatcgcatcctgacgcccgaaatgatgcgcgccatgatcattttgtacattggaccccacaaccgacctgatttctcgaccgactaccttctttctcctgttcttgcgcccgatgtcctgctggccaagttcccgaaaacttacttttgtaccggcgaacgcgatccactggttgacgatacagtcatattctctggccgtctccgccgcgtcaaggctgccgtctatgcctcgggaggacgcaggttcgaatatcaagacaccgacagcctagcacctggtttcaacgagaaggatgtggccgagacggtgctcatccccgggatatcacatggcttcatgcagttccccagcatctacccgccggcccgcaagtggattgaccagtcggccaggtggatcgaggaggcgtttgcggccgcggaagtgcgcgagcgagaaagccgcaggaactcgatcgccacgcccaatggcgggctgcgtatcaccaacggcgagggccggggtcttcactcacgggccgacagcagcggggacgagtttgacaagcctctcgagatgacggtcgtgcggccacggggccggactgcgagcagtgggaacgcagaccgtcggtcgtaccatcgccagcagcaggaacgacaccagaggccgaggggaaatagcgatggcgctcagtcacagccgcaggagggcgcttcttcattgagcaccaacaccctggcgcccgccaatgggaccagcaatgggaacggaggcaagcgtaggagagggaatggggcaaagaaggaatacaaggatggaaatctcagccggctggcaagctctgacgatttactagggagaagaatgcagggccttgctggaggcttgacgggcttgattgaggaggaatgatttgcttgctgttttggaaatgcgagggttgcgatttttagccaggagtaaacgctgagagggctcagtttgtgaatatgttgccattttcgagttgtatgggataggttcaacatagatgtcaagtctcatgg

SEQ ID NO: 1324 - protein, 784 aa, Magnaporthe grisea
MIDHVLGRPSTKSRRLQILAVLTFWTFYLSKGNKHGPPGLRYLSKLLTKRLTAWQTIVITMSYLYAARNFSTLVGLSAPEPLANMYEATYFRATWVLTALDAGFWTAMKIRNKWLRNICSIVFTVFYLFQAEAADERVRKVRSNLNIDYLRVSWNKGVTPYLSFLTRLVRPRYTRWPPRQIRIPRPSTSDFQEPVSGWLYFDGPLADLVHHNRIVLDVPGGGFVAMDPRCNDDRLMAWAGKTGIPILSLDYGKAPEYPYPYALNECYDVYTTIINSKGRCIGMSGTEVPKVIISGDSAGGNLATSTTLMIIESGSSPVRRFQGQTDLPLPDAVILFYPGLDMNIGNWMSDEQMTLIKDRRMRGTNRRVVHRKSMQYNHLVGTPHHSSDEDEGGSSDQVQQRSTGQPTIKIDTDVDDDATPTGPDDSRSPHPEFAHEGPSIWGKRQSRPNSEPQSPEVTQRKKQSTSHHSETMRTRLATSSMISYFNDRILTPEMMRAMIILYIGPHNRPDFSTDYLLSPVLAPDVLLAKFPKTYFCTGERDPLVDDTVIFSGRLRRVKAAVYASGGRRFEYQDTDSLAPGFNEKDVAETVLIPGISHGFMQFPSIYPPARKWIDQSARWIEEAFAAAEVRERESRRNSIATPNGGLRITNGEGRGLHSRADSSGDEFDKPLEMTVVRPRGRTASSGNADRRSYHRQQQERHQRPRGNSDGAQSQPQEGASSLSTNTLAPANGTSNGNGGKRRRGNGAKKEYKDGNLSRLASSDDLLGRRMQGLAGGLTGLIEEE

SEQ ID NO: 1325 - DNA, 1859 bp, Penicillium expansum
ctgcagtgaggactttatattttaatttactttgccatcctgcatcttctaattttgacttaaaaaccccgcaaatccaagccaaccacatcgatccacaattgccgaaccctaagctaagttcccgactattgcttcacttcagcacctatgtattttcatacttcaaaaagggcgggccaggctccagaaataaaagcttcaccgaaagcaaaaataagagtaaaattaagacaaaaacgtttccggttagcgggtaataactggcccggtttcaggtcgggatccccgggtacgaaaatcccatgtgtttcgtataacacagcccgacaagatcacttctacttctggtggaagattgtgacgatctttatcaattggcgtcgatcagagtctgatcaaggttcaagctttaatatattcccggttgggaaggccaaggcgctttaattaaacacatgactatatttcacgcttccccgcaaatatttgttcgactagcccactttctggccgttttcagggctagccttgccaagtccatctttggttgctcatgtttctgctccacccgacggtacgagtacgatttttgtcaccgctagtgcaggtccaaccttttagccccgtagtatccatggatggtttgcaatacgagcgttccatggatccttccatcatccaccgcacattagatcgtaaggccaatttacacttttcacggtctttcttgccgcctatgtcttataacttgcggctaacctttctcactctttctataatactaatatggttcgtagcgggagcaggggtgtacagaatatgtaaagacccccacgatcacatgttatcacatgcccaaggatcatcccttatgtctatgttctaaaccttagttcatttattcgcctaattagtccatatgcgtatggatatagtggatgaagtggagcttgctatagtatactcacgttgtactccatagtggttgttcctccacttctgtcccctcttctagtgtccctttttctagtcttttgaattgcctccactctttttttttaaaagccatggcacgtggagaagtgtaccaaaaaaaatgccgcttgactaggctgtataagcgactaactacgcgttcttgttccatattttgaattcataatgcttaaattacgtatggtataagtctatgctcaattctctaaatgatatctttgcttattttatagcttattatatttaaattagatattgaacagctattgaatcgtcttgcacggagcgggttaacggtgagccaggccgtcgaaatttaatatgggaaaatcctccgtactacggccccatttctgtgcttcaagacataaacatcgccaaagtggttcacgggtagttattagcaattttgattagttcacgatggctttcggcacatatgtctcagcggcctggtcccatacggtgtgaagatcaaatgaggctttgaagcctataggtagtacttgcactcgctggggctgttatcgccatactggtaaaccgagaaatccacggagattccccgaatggttcatttgtaaattaccttgcatgatggcttcctgactctatactatgcattacctgtttgggatgtcatccccgacgcagtccacttggcgccacattcggccaccttccctgcatttagtgtgcaaatatagcgacaacgagtacgatgggactttgaggggtacctgaagaattatttaaagagcaagataaccccacacaattttctgtttgtgcatccaaagacaacggtccagcagccttccccaagagtattctataacaccctcatacattgtttcgat

SEQ ID NO: 1326 - DNA, 1093 bp, Aspergillus niger
cttgccctcaagagtgtcctgcattgtattgcctggctcccaagatgtttttccgcagggaatttggggctgttgcagccctatctgtgctggcccatgctgctcccgcacctgctccgatgcagcgtagagacatctcctctaccgtcttggacaatatcgacctcttcgcccaatacagtgcagcagcttactgctcctcgaacatcgagtccaccggcacgactctgacctgcgacgtaggcaattgccctctcgtcgaggcagccggtgccacgaccatcgatgagtttgacgacaccagcagctacggcgacccgactgggttcatcgccgttgacccaacgaacgagttaattgttctgtctttccggggtagttccgacctctcgaactggattgccgacctagacttcggcctcacctccgtaagcagcatctgtgatggctgtgagatgcacaagggcttctacgaggcctgggaagtcatcgcggacaccatcactagcaaggtggaggctgctgtctccagctatccggactacaccctcgtgttcactggacacagctacggcgctgcattggcggctgtcgcggccaccgtgctccgcaacgccggatacactcttgacctgtacaacttcggccagccccgtattggcaacctcgccttagccgactatatcaccggccaaaatatgggcagcaactaccgcgtcacgcacaccgatgacatcgtgcctaagctgcctccggagctgctgggctaccaccacttcagcccggagtactggatcaccagcggtaatgatgtgacggtgactacgtcggacgtgaccgaggtcgtgggggtggattcgacggctgggaatgacggcacgctgcttgacagtacgactgcccatcggtggtacacgatctacattagtgaatgctcatagagcattgctggtgctgtgctgtgattatgtgggttggatatagtcaagatggaatgaatctgtatatagttttagtaataacaggcgaagtaaataggctagtctgatcatgaaaccgttcgttcgaggcaaaaaaaaaaaaaaaaaaaaaa

SEQ ID NO: 1327 - protein, 298 aa, Aspergillus niger
MFFRREFGAVAALSVLAHAAPAPAPMQRRDISSTVLDNIDLFAQYSAAAYCSSNIESTGTTLTCDVGNCPLVEAAGATTIDEFDDTSSYGDPTGFIAVDPTNELIVLSFRGSSDLSNWIADLDFGLTSVSSICDGCEMHKGFYEAWEVIADTITSKVEAAVSSYPDYTLVFTGHSYGAALAAVAATVLRNAGYTLDLYNFGQPRIGNLALADYITGQNMGSNYRVTHTDDIVPKLPPELLGYHHFSPEYWITSGNDVTVTTSDVTEVVGVDSTAGNDGTLLDSTTAHRWYTIYISECS

SEQ ID NO: 1328 - DNA, 1063 bp, Aspergillus niger
gtgcattgcagcagtccgttggtctcacgtctctggttgcctcgattgtatatatactgcaggatgttctctggacggtttggagtgcttttgacggcgcacgctgcgctgagtgctgcggcaccgacaccacttgatgtgcggagtgtctcgacttccacgttggatgagctgcaattgttctcgcaatggtctgccgcagcttattgctcgaacaatatcgactcggacgactctaacgtgacatgcacggccgacgcctgtccatcagtcgaggaggcgagcaccaagatgctgctggagtttgacctgacaaataactttggaggcacagccggtttcctggccgcggacaacaccaacaagcggctcgtggtcgccttccgaggcagtagcaccatcaagaactggattgctgatctcgacttcatcctgcaagataacgatgacctctgtactggctgcaaggttcacactggattctggaaggcatgggaagccgctgcagacaatctgacgagcaagatcaagtccgcgatgagcacgtattcgggctataccctctacttcaccgggcacagcttgggcggcgcattggctacactgggagcaacggtcttgcgaaatgacggttatagcgttgaactgtacacctatggatgtcctcgagtcggaaactatgcgctggccgagcacatcaccagccagggatctggagcgaacttccgcgttacacacttgaacgacatcgtcccccggttgccacccatggactttggattcagccagccaagtccagaatactggatcaccagtggcaccggagccagtgtcacggcgtcggatattgaactcatcgagggaatcaattcgacggcggggaatgcaggcgaagcaacggtggacgttttggctcacttgtggtactttttcgcaatttcagagtgtctgctatagctggacagtccgatgaaataagtgcggagagaaagtgtaaatagtaattagtataaaagcaggcagagaagcagtggtggtcagagaaaaaaaaaaaaaaaaaaaa

SEQ ID NO: 1329 - protein, 297 aa, Aspergillus niger
MFSGRFGVLLTAHAALSAAAPTPLDVRSVSTSTLDELQLFSQWSAAAYCSNNIDSDDSNVTCTADACPSVEEASTKMLLEFDLTNNFGGTAGFLAADNTNKRLVVAFRGSSTIKNWIADLDFILQDNDDLCTGCKVHTGFWKAWEAAADNLTSKIKSAMSTYSGYTLYFTGHSLGGALATLGATVLRNDGYSVELYTYGCPRVGNYALAEHITSQGSGANFRVTHLNDIVPRLPPMDFGFSQPSPEYWITSGTGASVTASDIELIEGINSTAGNAGEATVDVLAHLWYFFAISECLL

SEQ ID NO: 1330 - DNA, 5304 bp, Yarrowia lipolytica
gatatcggtagcaaacagacacgaagaagaggccttggagaatttggaaacaacatccattcgtgctccttgtttctgcttgccatgcaaatgcaacagggggataccgggctgcagagttcggaaggtctcgtagacgtatcgcacctgttttgatgaactgaagaaaacgatgatcttgaacttggtgtgtgttctcaggaaaccccacagtgtgtccagcttgtcttgcagctccacgcagacatagttctgttcgaggttcttgggtgtgctggaagtggtgtccgggttggcggagatgtacttggggtcggcgagtgacaaacgggccagatcactgacgctcttggtctgtgttgcgctgaaaagcagagtctgtctgtccacaggcaggttttccaaaatggcatccatggtcttcttgaaacccatatcgaggattcgatcggcctcgtccagcaccagcatcttcacgttagaaagatcaaacccgctagtttggtccatgtgttgtaacagtcgtccgggtgtacaaatgagaatgttcagcttggccagtcggtcagcctccatggcaacgtcctttcctccaataaccaaaccagcagagaagctgtgacaacggccgatttttcgcagaacctggaaaatctggaccgccagttctcgagtcggactaataaccagggctcctaaaccatccacatcactccacttgtttcgaaacaggcactccaacacaggcaccagaaacgccagagtcttaccacttccggtacgcgctgctccaagcagatcgtggccttgcagagcgggagggatggcccgcttctgaacatcggtacaggtgacataatgtgaattttttagaccctcaatagtagcctcagacaagggcagctcctcaaacttggacacctccttgtcggcctcgtcctctccaaagttgtcgacgcgctcctgcagcttggagagcttctgtttgtgttcctctcgtttgattttacgaggatcggctcgtttcttcattttcgccatatctcaagctgtcggataaatttcttggacaaaaaaatctaacttttcgtgcgccttcacttttatcagtctgaaaattacacatgcatgcagcttggagtatggaggcgacagaggtgcatgccagagtgcatgaattagggcaacgggggtgtgaagaagggcgcaaaagatgtgacgacggtgcaagacgacggtatactgcagacaaggtctttcactgcaaaactcctggttaaatcgtgggtcccgcgtctccgtatcatatgactttgggtcacgtgactgcaagatttttaaggtttcgaactcccaaattgagtcacgtgtcgtctctctgcaacatgaggtatcgtaaattaggaatgactcgacctgacaggccatcaaggaccctgatgcaactctgaaattagagggaggaggtaatgagaaacagtgctggattgtggtgagacattgaagcgggattggttaacctgtttcttttttgtcgtttgctcttcattattgcgatttttgtagtcatttgattagatcagatcagcagtcccctcatgctgtcgttgatgggcgcgtaatcagtgtaacgctttgaatgaggatggtgtgagtaatactggtttcattgggggggggggggggggtactgttactcgaaaaacaaatcatatgcatctctgaacgtgccggggtgtggcatgtttctcgcttcgaaaaataaatgttggctgttccaggcttgtctcagacctgcaagaatcatactggcgtaatctccgccaggtctggtcaggaacaagagagtaaaagaaatgtttgagtctcggctttcacatcctcggcactagataagcagcaatatcaatgtcacattgcttgcttgtgcaggtcagggggagggggatgtatatgatacaagcaggttcgcatctacagaatctacagtatgtatctgatgatagccttacacagcgcacgcagatgtagtttttgggttgaacagtgtcagcggaagcggcgtagtggggtactgtagtacagaatcaacggaatgaagtttacaactgcttctgttactgtagcctttcactgttcaaatgataacgttggagaagagtgcaccctctgttagataggattacagtccagacacacattggcaccgaagtctgtagtcaaacattggtctcagttggtgtaatgacattcaatagactgattctgcaactcctacaccttgcattgtacacccgagaccccttgtacggcccgcatttctccttcacatgtcggcatgtgtcttgtctgtagccacttcaatgggatgcagtattagcactgtcggacacacctcagtcaatgggaatggaatgccatgctcctagcggctcattgtttgctaggaaatacagttaatagcacagatcatagagtctaggctctatacgtcttagaacaaccattatttgtttaaacgacaacttggtaagcgaattacagtaagtagctattgtttctatctctgtcagtgttcggataagtccttagatcaccatactcaaagtggtacgtttcgtcgcatcggacgagaagtgtgtctatcaccgtttctttttgccgctctcatttttgcggtcggaataattactgtggaccctcggcgccgaccgttttgcagggctcatcaacctaaaacttctccgagtctgtgccttcaggtgggcatagttgatgggtgttttgaagttaatagtggggaagaactatggcaaacaagcagatgcaggcaccttgtaactgcagaccggttcttgtctaccgactccgctgcacctgtgccgcggtacatgtcgtcacaggctgcggggttcggaggcccccttgcaacctcctttgatagttgctatggccccaaagagttatacgagatagacccacagatctacttgactgttgtcacagaacctgctaggtttgcttattgtacccgctttgtagctactgtacaacgacaacgtctaaaattgagacgcgaacaaactccagatgcagaacccaaacctctctctcagagtttcgagtgcttctacctcacagtaaagtggaggtggacctgcaagggaattcagtcacaaggccccgaatgtctccgaaactccaatcggaccgtttaaacagactaatatcacgtcattgattgatattagcatccggcaagagccgcaaggttatctcctcaccaatgagcctgttgtacggctcattccgcatctgcggctgattcagtttcgagtggggatggtagacttcattgcagcattcctaaccttctacttggtccgtggagatgtcatggacatcgattttgggctgagaagccttttgacgatgtcgatatcactgaccgctaatttactctggcagtttctccggctctcgaggcatcgtcgatcaccaaacactatctgctagtctaaatgtccgacacgacagcttttgatcgccgtgaacggcgcagacctcatgcaccatgcaccagggccaaatcaattacgggtcgcttagcgttgcagtcggggcattatggtggaagttccgatacggcacagacacattccatagtggggggattggattataaaagggccatagaaagccctcaattgatacccaagtaccagctcccctcactatgaagctttccaccatccttttcacagcctgcgctaccctggctgccgccctcccttcccccatcactccttctgaggccgcagttctccagaagcgagtgtacacctctaccgagacctctcacattgaccaggagtcctacaacttctttgagaagtacgcccgactcgcaaacattggatattgtgttggtcccggcactaagatcttcaagcccttcaactgtggcctgcaatgtgcccacttccccaacgttgagctcatcgaggagttccacgacccccgtctcatctttgatgtttctggttacctcgctgttgatcatgcctccaagcagatctaccttgttattcgaggaacccactctctggaggacgtcataaccgacatccgaatcatgcaggctcctctgacgaactttgatcttgctgctaacatctcttctactgctacttgtgatgactgtcttgtccacaatggcttcatccagtcctacaacaacacctacaatcagatcggccccaagctcgactctgtgattgagcagtatcccgactaccagattgctgtcaccggtcactctctcggaggagctgcagcccttctgttcggaatcaacctcaaggttaacggccacgatcccctcgttgttactcttggtcagcccattgtcggtaacgctggctttgctaactgggtcgataaactcttctttggccaggagaaccccgatgtctccaaggtgtccaaagaccgaaagctctaccgaatcacccaccgaggagatatcgtccctcaagtgcccttctgggacggttaccagcactgctctggtgaggtctttattgactggcccctgatccaccctcctctctccaacgttgtcatgtgccagggccagagcaataaacagtgctctgccggtaacactctgctccagcaggtcaatgtgattggaaaccatctgcagtacttcgtcaccgagggtgtctgtggtatctaagctatttatcactctttacaacttctacctcaactatctactttaataaatgaatatcgtttattctctatgattactgtatatgcgttcctctaagacaaatcgaaaccagcatgcgatcgaatggcatacaaaagtttcttccgaagttgatcaatgtcctgatagtcaggcagcttgagaagattgacacaggtggaggccgtagggaaccgatcaacctgtctaccagcgttacgaatggcaaatgacgggttcaaagccttgaatccttgcaatggtgccttggatactgatgtcacaaacttaagaagcagccgcttgtcctcttcctcgaaactctcaaacacagtccagaggtcctttatagcttgatctgtatccagatagcctccgtaattggtgtgtgtcttcaaatcccagacgtccacattggcatgtcctccactgataagcatttgaagttcatctgcgttgaacattgagacccacgaagggtcaatgagctggtatagaccgcccaagaatgcatctgtctgtgttctgatactggtgttaagctt

SEQ ID NO: 1331 - protein, 334 aa, Yarrowia lipolytica
MKLSTILFTACATLAAALPSPITPSEAAVLQKRVYTSTETSHIDQESYNFFEKYARLANIGYCVGPGTKIFKPFNCGLQCAHFPNVELIEEFHDPRLIFDVSGYLAVDHASKQIYLVIRGTHSLEDVITDIRIMQAPLTNFDLAANISSTATCDDCLVHNGFIQSYNNTYNQIGPKLDSVIEQYPDYQIAVTGHSLGGAAALLFGINLKVNGHDPLVVTLGQPIVGNAGFANWVDKLFFGQENPDVSKVSKDRKLYRITHRGDIVPQVPFWDGYQHCSGEVFIDWPLIHPPLSNVVMCQGQSNKQCSAGNTLLQQVNVIGNHLQYFVTEGVCGI

SEQ ID NO: 1332 - DNA, 1635 bp, Galactomyces geotrichum
caggcccccacggccgttcttaatggcaacgaggtcatctctggtgtccttgagggcaaggttgataccttcaagggaatcccatttgctgacccacctgttggtgacttgcggttcaagcatccccagcctttcactggatcctaccagggtcttaaggccaacgacttcagctctgcttgtatgcagcttgatcctggcaacgccatttctttgcttgacaaagtcgtgggcttgggaaatattcttcccgataaccttagaggccctctttatgacatggcccagggtacggtgtcgatgagtgaggactgtctctacctcaacgttttccgccccgctggcaccaagcctggagataagctccccgtcatggtttggatctacggtggtgcctttgtgtttggttcttctgcttcttaccctggtaacggctacgtcaaggagagtgtggaaatgggccagccagttgtgtttgtttccatcaactaccgtaccggtccctatggattcctgggtggtgatgccatcaccgctgagggcaacactaactctggtctgcacgatcagcgcaagggtctcgagtgggttagcgacaacattgccaactttggtggtgatcccgacaaggtcatgattttcggtgagtccgctggtgccatgagtgttgctcaccagcttattgcctacggtggtgacaacacctacaacggaaagcagcttttccactctgccattcttcagtctggcggtcctcttccttactttgactctacttctgttggtcccgagagtgcttacagtagatttgctcagtatgccggatgtgacaccagtgtcagtgacaatgacactctggcttgtcttcgcagcaagtccagcgatgtcttgcacagtgcgcagaactcgtacgatctcaaggacctgtttggactgctccctcaattccttggatttggtcccagacccgacggcaacattattcccgatgccgcttatgacctctaccgcagcggtagatacgccaaggttccctacattactggcaaccaggaggatgagggtactattcttgcccccgttgctattaatgctaccactactccccatgttaagaagtggttgaagtacatttgtagccaggcttcttatgcttcgcttgatcgtgttttgtcgctttaccccggttcttggtcggagggtgcgccattccgcactggcattcttaatgccctgaccccccagttcaagcgcattgctgccattttcactgatttgctgttccaatctcctcgtcgtgttatgcttaacgcgaccaaggacgtcaaccgctggacttaccttgccacccagctccataacctcgttccatttttgggtactttccatggcagtgatcttcttttccaatactacgtggaccttggcccatcttctgcctaccgccgctactttatctcgtttgccaaccaccacgaccccaacgttggcaccaacctccaacagtgggatatgtacactgatgcaggcaaggagatgcttcagattcatatgattggtaactctatgagaactgatgactttagaatcgagggaatctcgaactttgagtctgacgttactctcttcggttaa

SEQ ID NO: 1333 - protein, 544 aa, Galactomyces geotrichum
QAPTAVLNGNEVISGVLEGKVDTFKGIPFADPPVGDLRFKHPQPFTGSYQGLKANDFSSACMQLDPGNAISLLDKVVGLGNILPDNLRGPLYDMAQGTVSMSEDCLYLNVFRPAGTKPGDKLPVMVWIYGGAFVFGSSASYPGNGYVKESVEMGQPVVFVSINYRTGPYGFLGGDAITAEGNTNSGLHDQRKGLEWVSDNIANFGGDPDKVMIFGESAGAMSVAHQLIAYGGDNTYNGKQLFHSAILQSGGPLPYFDSTSVGPESAYSRFAQYAGCDTSVSDNDTLACLRSKSSDVLHSAQNSYDLKDLFGLLPQFLGFGPRPDGNIIPDAAYDLYRSGRYAKVPYITGNQEDEGTILAPVAINATTTPHVKKWLKYICSQASYASLDRVLSLYPGSWSEGAPFRTGILNALTPQFKRIAAIFTDLLFQSPRRVMLNATKDVNRWTYLATQLHNLVPFLGTFHGSDLLFQYYVDLGPSSAYRRYFISFANHHDPNVGTNLQQWDMYTDAGKEMLQIHMIGNSMRTDDFRIEGISNFESDVTLFG

SEQ ID NO: 1334 - DNA, 1029 bp, Candida antarctica
atgaagctactctctctgaccggtgtggctggtgtgcttgcgacttgcgttgcagccactcctttggtgaagcgtctaccttccggttcggaccctgccttttcgcagcccaagtcggtgctcgatgcgggtctgacctgccagggtgcttcgccatcctcggtctccaaacccatccttctcgtccccggaaccggcaccacaggtccacagtcgttcgactcgaactggatccccctctcaacgcagttgggttacacaccctgctggatctcacccccgccgttcatgctcaacgacacccaggtcaacacggagtacatggtcaacgccatcaccgcgctctacgctggttcgggcaacaacaagcttcccgtgcttacctggtcccagggtggtctggttgcacagtggggtctgaccttcttccccagtatcaggtccaaggtcgatcgacttatggcctttgcgcccgactacaagggcaccgtcctcgccggccctctcgatgcactcgcggttagtgcaccctccgtatggcagcaaaccaccggttcggcactcaccaccgcactccgaaacgcaggtggtctgacccagatcgtgcccaccaccaacctctactcggcgaccgacgagatcgttcagcctcaggtgtccaactcgccactcgactcatcctacctcttcaacggaaagaacgtccaggcacaggccgtgtgtgggccgctgttcgtcatcgaccatgcaggctcgctcacctcgcagttctcctacgtcgtcggtcgatccgccctgcgctccaccacgggccaggctcgtagtgcagactatggcattacggactgcaaccctcttcccgccaatgatctgactcccgagcaaaaggtcgccgcggctgcgctcctggcgccggcagctgcagccatcgtggcgggtccaaagcagaactgcgagcccgacctcatgccctacgcccgcccctttgcagtaggcaaaaggacctgctccggcatcgtcaccccctga

SEQ ID NO: 1335 - protein, 342 aa, Candida antarctica
MKLLSLTGVAGVLATCVAATPLVKRLPSGSDPAFSQPKSVLDAGLTCQGASPSSVSKPILLVPGTGTTGPQSFDSNWIPLSTQLGYTPCWISPPPFMLNDTQVNTEYMVNAITALYAGSGNNKLPVLTWSQGGLVAQWGLTFFPSIRSKVDRLMAFAPDYKGTVLAGPLDALAVSAPSVWQQTTGSALTTALRNAGGLTQIVPTTNLYSATDEIVQPQVSNSPLDSSYLFNGKNVQAQAVCGPLFVIDHAGSLTSQFSYVVGRSALRSTTGQARSADYGITDCNPLPANDLTPEQKVAAAALLAPAAAAIVAGPKQNCEPDLMPYARPFAVGKRTCSGIVTP

SEQ ID NO: 1336 - DNA, 1733 bp, Candida cylindracea
atggagctcgctcttgcgctcctgctcattgcctcggtggctgctgcccccaccgccacgctcgccaacggcgacaccatcaccggtctcaacgccatcatcaacgaggcgttcctcggcattccctttgccgagccgccggtgggcaacctccgcttcaaggaccccgtgccgtactccggctcgctcgatggccagaagttcacgctgtacggcccgctgtgcatgcagcagaaccccgagggcacctacgaggagaacctccccaaggcagcgctcgacttggtgatgcagtccaaggtgtttgaggcggtgctgccgctgagcgaggactgtctcaccatcaacgtggtgcggccgccgggcaccaaggcgggtgccaacctcccggtgatgctctggatctttggcggcgggtttgaggtgggtggcaccagcaccttccctcccgcccagatgatcaccaagagcattgccatgggcaagcccatcatccacgtgagcgtcaactaccgcgtgtcgtcgtgggggttcttggctggcgacgagatcaaggccgagggcagtgccaacgccggtttgaaggaccagcgcttgggcatgcagtgggtggcggacaacattgcggcgtttggcggcgacccgaccaaggtgaccatctttggcgagctggcgggcagcatgtcggtcatgtgccacattctctggaacgacggcgacaacacgtacaagggcaagccgctcttccgcgcgggcatcatgcagctgggggccatggtgccgctggacgccgtggacggcatctacggcaacgagatctttgacctcttggcgtcgaacgcgggctgcggcagcgccagcgacaagcttgcgtgcttgcgcggtgtgctgagcgacacgttggaggacgccaccaacaacacccctgggttcttggcgtactcctcgttgcggttgctgtacctcccccggcccgacggcgtgaacatcaccgacgacatgtacgccttggtgcgcgagggcaagtatgccaacatccctgtgatcatcggcgaccagaacgacgagggcaccttctttggcaccctgctgttgaacgtgaccacggatgcccaggcccgcgagtacttcaagcagctgtttgtccacgccagcgacgcggagatcgacacgttgatgacggcgtaccccggcgacatcacccagggcctgccgttcgacacgggtattctcaacgccctcaccccgcagttcaagagaatcctggcggtgctcggcgaccttggctttacgcttgctcgtcgctacttcctcaaccactacaccggcggcaccaagtactcattcctcctgaagcagctcctgggcttgccggtgctcggaacgttccactccaacgacattgtcttccaggactacttgttgggcagcggctcgctcatctacaacaacgcgttcattgcgtttgccacggacttggaccccaacaccgcggggttgttggtgaagtggcccgagtacaccagcagcctgcagctgggcaacaacttgatgatgatcaacgccttgggcttgtacaccggcaaggacaacttccgcaccgccggctacgacgcgttgttctccaacccgccgctgttctttgtgtaaggaccgtgttccatatcctcaacaaacgctgtatccacgcaacagactagatggctcggtgagcaccgggtcgtggtgatatc

SEQ ID NO: 1337 - protein, 549 aa, Candida cylindracea
MELALALLLIASVAAAPTATLANGDTITGLNAIINEAFLGIPFAEPPVGNLRFKDPVPYSGSLDGQKFTLYGPLCMQQNPEGTYEENLPKAALDLVMQSKVFEAVLPLSEDCLTINVVRPPGTKAGANLPVMLWIFGGGFEVGGTSTFPPAQMITKSIAMGKPIIHVSVNYRVSSWGFLAGDEIKAEGSANAGLKDQRLGMQWVADNIAAFGGDPTKVTIFGELAGSMSVMCHILWNDGDNTYKGKPLFRAGIMQLGAMVPLDAVDGIYGNEIFDLLASNAGCGSASDKLACLRGVLSDTLEDATNNTPGFLAYSSLRLLYLPRPDGVNITDDMYALVREGKYANIPVIIGDQNDEGTFFGTLLLNVTTDAQAREYFKQLFVHASDAEIDTLMTAYPGDITQGLPFDTGILNALTPQFKRILAVLGDLGFTLARRYFLNHYTGGTKYSFLLKQLLGLPVLGTFHSNDIVFQDYLLGSGSLIYNNAFIAFATDLDPNTAGLLVKWPEYTSSLQLGNNLMMINALGLYTGKDNFRTAGYDALFSNPPLFFV

SEQ ID NO: 1338 - DNA, 2043 bp, Candida cylindracea
aggctgtcgcacgtcactgctgcttggctttgccagcatgtggccgccacgccccgtctgcacgttctctggtctttactgcattggagccaggaaccgtagtgcaaccccgcgccggtccggggtataaaagcggaagcactctcactccagtctctccatgaagctctgtttgcttgctcttggtgctgcggtggcggcagcccccacggccaccctcgccaacggcgacaccatcaccggtctcaacgccattgtcaacgaaaagtttctcggcataccgtttgccgagccgcccgtgggcacgctccgcttcaagccgcccgtgccgtactcggcgtcgctcaacggccagcagtttaccctgtacggcccgctgtgcatgcagatgaaccctatgggctcgtttgaggacacacttcccaagaatgcgcggcatttggtgctccagtccaagatcttccaagtggtgcttcccaacgacgaggactgtctcaccatcaacgtgatccggccgcccggcaccagggccagtgctggtctcccggtgatgctctggatctttggcggtgggtttgagcttggcggctccagcctctttccaggagaccagatggtggccaagagcgtgctcatgggtaaaccggtgatccacgtgagcatgaactaccgcgtggcgtcatgggggttcttggccggccccgacatccagaacgaaggcagcgggaacgccggcttgcatgaccagcgcttggccatgcagtgggtggcggacaacattgctgggtttggcggcgacccgagcaaggtgaccatatacggcgagctggcgggcagcatgtcgacgtttgtgcaccttgtgtggaacgacggcgacaacacgtacaacggcaagccgttgttccgcgccgccatcatgcagctgggctgcatggtgccgctggacccggtggacggcacgtacggcaccgagatctacaaccaggtggtggcgtctgccgggtgtggcagtgccagcgacaagctcgcgtgcttgcgcggccttctgcaggacacgttgtaccaggccacgagcgacacgcccggcgtgttggcgtacccgtcgttgcggttgctgtatctcccgcggcccgacggcaccttcatcaccgacgacatgtatgccttggtgcgggacggcaagtacgcacacgtgccggtgatcatcggcgaccagaacgacgagggcactttgtttgggctcctgctgttgaacgtgaccacagatgctcaggcacgggcgtacttcaagcagctgttcatccacgccagcgatgcggagatcgacacgttgatggcggcgtacaccagcgacatcacccagggtctgccgttcgacaccggcatcttcaatgccatcaccccgcagttcaaacggatcctggcgttgcttggcgaccttgcgttcacgcttgcgcgtcgctacttcctcaactactaccagggcggcaccaagtactcgtttctcctgaagcagcttctggggttgcccgtcttgggcaccttccacggcaacgacatcatctggcaggactacttggtgggcagcggcagtgtgatctacaacaacgcgttcattgcgtttgccaacgacctcgacccgaacaaggcgggcttgtggaccaactggcccacgtacaccagcagtctgcagctgggcaacaacttgatgcagatcaacggcttggggttgtacaccggcaaggacaacttccgcccggatgcgtacagcgccctcttttccaacccgccactgttctttgtgtaggaaccgaatgcacggcgtcgagcaaacacccggagcgggcttggacacggagcaggcttggacgcaaagcaggctcggacacggagcaggcctgggctccgcgttccgttacggacttatcagtggggtgatcaggggcaagcctgccgcacggcgccgagtgagctgaggcggctgcacgaacaagccctgaaacccaaccgccgtctgtggttggtggatcaggatctgcatgc

SEQ ID NO: 1339 - protein, 548 aa, Candida cylindracea
MKLCLLALGAAVAAAPTATLANGDTITGLNAIVNEKFLGIPFAEPPVGTLRFKPPVPYSASLNGQQFTLYGPLCMQMNPMGSFEDTLPKNARHLVLQSKIFQVVLPNDEDCLTINVIRPPGTRASAGLPVMLWIFGGGFELGGSSLFPGDQMVAKSVLMGKPVIHVSMNYRVASWGFLAGPDIQNEGSGNAGLHDQRLAMQWVADNIAGFGGDPSKVTIYGELAGSMSTFVHLVWNDGDNTYNGKPLFRAAIMQLGCMVPLDPVDGTYGTEIYNQVVASAGCGSASDKLACLRGLLQDTLYQATSDTPGVLAYPSLRLLYLPRPDGTFITDDMYALVRDGKYAHVPVIIGDQNDEGTLFGLLLLNVTTDAQARAYFKQLFIHASDAEIDTLMAAYTSDITQGLPFDTGIFNAITPQFKRILALLGDLAFTLARRYFLNYYQGGTKYSFLLKQLLGLPVLGTFHGNDIIWQDYLVGSGSVIYNNAFIAFANDLDPNKAGLWTNWPTYTSSLQLGNNLMQINGLGLYTGKDNFRPDAYSALFSNPPLFFV

SEQ ID NO: 1340 - DNA, 5111 bp, Candida cylindracea
taattattataaacataaattgtattactggaatagaaaaaactagaaataaataaataaactatcaattactattaagaatcactgttatattatgttgatagtatttctagtttatataaacatctaatatattatttaatacaaatacttcattcctataaactttaaaccaatatattaatcgttttaatataattttatgaacaataaatctatttctcctatcatattaatgattcttgatggctggggccactcaactaatgcaaaaggaaatgcaattcatgaagctaacacaccaataatagacaaactttgggacaattatccaaaaactttgttaagtgcatctggtgaacatgttggcctaccacataagcaaatgggaaattcagaagtagggcatacaacaatcggggcaggaagaataattaatcaagacttagtaaaaatcagtaaatctataaaaaataaagaatttttcaacaattatcaattacataatatatacaagtattcatgtgaaaaaaattctaaagtacatattgtaggcttatgttctaatggtggagtccattctcacataaatcatttaaaagcattaatacaaatttcaaaacaatataaagttatgacttgcttgcatttaattactgatggaagagatacattgcccaagcaagcaaaactttttgtgaaagaaattatagatataattgatgaaaactataatacggaaatttgtacaataagtggcagatattatagcatggatagagactgtagatggtctagaacagaaaaagcatacaaagcaatggtagaaaactcatgtaatcaaaactcttcttctgatatactatcaatcatcgataaatattatgaacaaaatatctctgatgaatttctaccaccaactaaaatatcgatgcataatattgttcataacgatagtctgattttttttaattttagacctgacagaattagacaattgctccattcatttgcaaaacctaactttaaaggttttcaaagaaaaacaattaaaaatttaatgttaacaacatttacagaatatgattcaacattatcaataccaactgtttttccaaatgagccaaagaaaaattttttaggacaaattatctccaatagtggcttaaaacaattaaggttagccgagacagaaaaatatgcacatgtaacttatttttttaatggtggtattgaagagccatttccaggagaaaatagagaattaatagctagtccaaaagttgaaacttacgatttaccccctgaaatgtctgcatatcaattaactaacagcctaatagaagcaattaataaacaactatatcaatttatagtaataaattatgcaaatccggatatgataggacatacaggcaatatgaatgcaacaatagaagcaatagaaattgttgatcaatgtattgaaaaagttttacatacaattgaagatacgaacaatatacttattattacatctgatcatggtaatgcagattatatgctaacagatgaaaataaaccatgcacatcacatagtattaacccagttccttttatattaataaacaatagacaaaaaaaacaaacaaatttacattctcatggatcattagctgatattgcaccaactatactagatatattaaatataaatataccaaatgaaatgaatggaaaatctctaattacttgaatcaatattcacatatcgtactaatgaatatacaattaataaaaaattttaatcctattcttaaaattaatactcaatcatctaatataaaactgaacaaaatcattcctaatgaatggttatttatattaatgaacacaggatcatttacacaaaatttaaattcattactaattagtgatataaacatcaatatctctcaaaaatataattataatcaaccacaacaatttcacaatactcgtacagtatggctagcaaataataataatcagagatttgcttttgctcaatctagatggataataaaaaataattatacgaattatctaaatctactaaataataaaccaatcggtaaatcatttataatcaatgaaacagatttacataaaaagattgaagagatatattgtggtcattcatatattttagagaaaaattttcaatctcaacaactgatatggggaagaaaatatacattactttataataaaaaatcctttatagtaatacaagaatatttttcacccaacttaaccaaatttctaaaattccattagtttaataattataaaattacaaatatgtttaattttctattttctaacaagatcaatcaatatcaaagaatagtaaaacaaattaatagtttagattcaacatacaataaatactcagatcaagaattaaaacaacaaactaataaattaaaagatcaaattatagcaactcaagatatagatacaattcttcctaaagcatttgcaataacaaaagaagctattaaaagagctactggattattactctttgatgtacagctaattggagcaatcattctaaatcagggaaaaatagctgaaatgaaaacaggtgaaggcaaaacattagtagcaatgttaacagcatacttaaattcattatttaataaaggagtacatattgttactgttaatgaatatctagctaaaagagatgcaacattagcaaaacaaatttttgaatatttaaatattcatattggcataatagatcaatcaatgcactcacaagagcgaaaaaaacaatattcatgtgatattacatatctaacaaacagtgaattaggatttgattaccttagagataacatggccatacaaaaagaagatcttgtacaaagagactttttttttgcaattatagatgaaatagattcaatcctaatcgatgaagcaagaacaccacttattatttcaggtccagcaaataataaacttacagaatatttagaagctaataaagtggctaatttactaaatcaaaatacagattatgaaattgacgaaaaaaacaaaaatataattttaaatgagaatggaattaaaaaatcagaaaatattttagacataaataatctatatgatattcaaaagccatggataaaatatattttaaatgctttaaaggctaaagagatttttataaaaaataaagattatatagttaaaaataatgaaatagttatagttgatgaattcacaggtagaatcatggaaggcagaagatggagtgacggtctacatcaagctattgaagcaaaagaaaaacaaaaaattcaacaggaaaataaaactttagcctcaattacatatcaaaatctatttttattatatgaaaaattatcaggaatgacaggtacagcaaaaacagaagaagctgaactagaacaaatttataaattaaaagtagtagaaatacccactaataaattaaatcaacgtaaagacctttctgatttagtatataaaacagaatatgtaaaatggaaagcagtggcaaatgaatgttttgatatgtatcaaataggaaggccaacattagttggtacaacaagtattgaaaaatcagaacttttagctaaaatactaaaagagctacaagttccatacaatcttttaaatcgaaaaccagaaaatatcacccgagaatctgaaattataacacaagctggaagaaaatatactattactatctctaccaacatggcaggtagaggaactgatattattttaggtggaaacccgcagatacttgctaaaacagcactaactatacatatcaataaaatattaaatcttactcaatataatacaaattataagattgaaaatgagataacatatattctaaattctattaataatacattattgatcaataatatcgatattaatagtcaagacattagccagagcatcaataacattatcaataataatatgattcaagatgctaaatcatacaaaatatccaatatttataaaatagttttaaataaatacaaacaattatgtcacaatgaaaaacaagaaataattacattaggtggattgtatgtaattggaacagaaagacatgaatcaagaagaatagataatcaactaagaggcagatctggtagacaaggagatttacgttcatctagattttttttaagtttacaagataatttactaaaaatttttggcggcgataaaatatctgattttatgcaaaacctaaatatagatgaagatatgccaatcgaatcaagtattctaaacaaaagtctgagctcagcacaaaaaaaaatagaagcttatttttatgatgtaagaaaacaactttttgaatacgatgaagtattaaataatcaaagacaagctatatatatagaacgtaaacgtttactaaaatctaactatactagagattgtatcttagaatacgcagaaagcacaatagaagaaatgctagtaacatataatcagcaaacagatattagcgaaaaaacaaaaatactatctaaaatattaaagttattaaatcttaatatttatattaataataatattttactaaatatggaagaaaatgatattaaatcttttttatttgaacaattaagaataacatatgacttaagagaaagttatttagaacaattaagaccaggattaattagacaactagaaaagtattatttacttcaacaaattgattacgcatggcaagaacatattaacaaaatttctatattaaaagaatctattggctggagaagttatggtcaacaagatccattaatagaatacaaaaatgaagcatttaatctatttataaatatggtaacatatattagacaaacagtaatttacctaacaatgcgttcacgattaatcgtaaatatagataattaaattgaggcatggattaattaaaggttgacattaatatcaaaattgtttaacttattatatatatgtattagtaactatagacttcatatagcccccatcgtctagaggcctaggacatctccctttcacggaggtaacggggattcgaattc

SEQ ID NO: 1341 - protein, 510 aa, Candida cylindracea
MNNKSISPIILMILDGWGHSTNAKGNAIHEANTPIIDKLWDNYPKTLLSASGEHVGLPHKQMGNSEVGHTTIGAGRIINQDLVKISKSIKNKEFFNNYQLHNIYKYSCEKNSKVHIVGLCSNGGVHSHINHLKALIQISKQYKVMTCLHLITDGRDTLPKQAKLFVKEIIDIIDENYNTEICTISGRYYSMDRDCRWSRTEKAYKAMVENSCNQNSSSDILSIIDKYYEQNISDEFLPPTKISMHNIVHNDSLIFFNFRPDRIRQLLHSFAKPNFKGFQRKTIKNLMLTTFTEYDSTLSIPTVFPNEPKKNFLGQIISNSGLKQLRLAETEKYAHVTYFFNGGIEEPFPGENRELIASPKVETYDLPPEMSAYQLTNSLIEAINKQLYQFIVINYANPDMIGHTGNMNATIEAIEIVDQCIEKVLHTIEDTNNILIITSDHGNADYMLTDENKPCTSHSINPVPFILINNRQKKQTNLHSHGSLADIAPTILDILNINIPNEMNGKSLIT

SEQ ID NO: 1342 - protein, 179 aa, Candida cylindracea
MNIQLIKNFNPILKINTQSSNIKLNKIIPNEWLFILMNTGSFTQNLNSLLISDININISQKYNYNQPQQFHNTRTVWLANNNNQRFAFAQSRWIIKNNYTNYLNLLNNKPIGKSFIINETDLHKKIEEIYCGHSYILEKNFQSQQLIWGRKYTLLYNKKSFIVIQEYFSPNLTKFLKFH

SEQ ID NO: 1343 - protein, 878 aa, Candida cylindracea
MFNFLFSNKINQYQRIVKQINSLDSTYNKYSDQELKQQTNKLKDQIIATQDIDTILPKAFAITKEAIKRATGLLLFDVQLIGAIILNQGKIAEMKTGEGKTLVAMLTAYLNSLFNKGVHIVTVNEYLAKRDATLAKQIFEYLNIHIGIIDQSMHSQERKKQYSCDITYLTNSELGFDYLRDNMAIQKEDLVQRDFFFAIIDEIDSILIDEARTPLIISGPANNKLTEYLEANKVANLLNQNTDYEIDEKNKNIILNENGIKKSENILDINNLYDIQKPWIKYILNALKAKEIFIKNKDYIVKNNEIVIVDEFTGRIMEGRRWSDGLHQAIEAKEKQKIQQENKTLASITYQNLFLLYEKLSGMTGTAKTEEAELEQIYKLKVVEIPTNKLNQRKDLSDLVYKTEYVKWKAVANECFDMYQIGRPTLVGTTSIEKSELLAKILKELQVPYNLLNRKPENITRESEIITQAGRKYTITISTNMAGRGTDIILGGNPQILAKTALTIHINKILNLTQYNTNYKIENEITYILNSINNTLLINNIDINSQDISQSINNIINNNMIQDAKSYKISNIYKIVLNKYKQLCHNEKQEIITLGGLYVIGTERHESRRIDNQLRGRSGRQGDLRSSRFFLSLQDNLLKIFGGDKISDFMQNLNIDEDMPIESSILNKSLSSAQKKIEAYFYDVRKQLFEYDEVLNNQRQAIYIERKRLLKSNYTRDCILEYAESTIEEMLVTYNQQTDISEKTKILSKILKLLNLNIYINNNILLNMEENDIKSFLFEQLRITYDLRESYLEQLRPGLIRQLEKYYLLQQIDYAWQEHINKISILKESIGWRSYGQQDPLIEYKNEAFNLFINMVTYIRQTVIYLTMRSRLIVNIDN

SEQ ID NO: 1344 - DNA, 1318 bp, Candida cylindracea
tagcaatttttcttactatttcttactatatggcacactgagatgaacgcaggagggcgattgcattgcttttgacaacaagcagccgcatggtattgaacgggtggtgggtgataggtggtgtgtgtgtttctttagactcaagggggagtgtttggagcaggaatacgggaagcaattgagtttggtttagcccttccgccaaattcaagcgttcgctcccgcctctcgcagagaggaaaagtaagcgatgacctacgctacaccgaaagagcgatggcgtaacgcaagagcgtagctgatcgtcagcaaccctaatttttttagaggaaaaattagggttgatcgggcaggagacttgaaaatttgaagcctagctgagtgaaagtcaggaaatacaatcacaagtgttgaagtgaaataaatctctaaaggtgcgtcaatttatgggaatttgtggaaaattgggtgtagcggcgttggtggcgttgattgtcgggtgttcgcctgtccaatcccaagtgccaccattaactgaactttccccatcaatcagcgtgcatttactgctgggaaatcccagtggtgcaacgccaacaaagcttacacctgataattacctgatggtcaaaaatcaatatgcactctcctacaacaacagcaagggaactgctaactgggtagcttggcagcttaactcctcatggctagggaacgcagagcgtcaagataacttccgcccagacaaaacattgcctgcgggttgggtgcgagtgactccttctatgtactctgggagtggttatgaccgggggcatattgcaccttcagcagaccgcaccaagacaacagaagataatgcggctactttcctgatgacaaacatgatgccccaaacacccgataacaatagaaatacgtggggaaatttagaagattattgtcgagaattagtcagtcagggtaaagagctttacattgttgccgggcctaatggtagtcttggcaaacccctcaaaggtaaggtgacagttcccaaatccacttggaagattgttgtcgtactagatagcccaggctcagggcttgaaggtattactgctaatactcgcgttatcgcagtaaatattcccaacgacccagaattaaataatgactggagggcttataaagtcagtgttgatgaattagaaagtttgacgggttatgattttttgtctaatgtttcccccaatattcaaacaagtattgagagtaaagttgataattagtaaataggtcaagtttccacaactttagtagaaataccagctaaatt

SEQ ID NO: 1345 - protein, 274 aa, Candida cylindracea
MGICGKLGVAALVALIVGCSPVQSQVPPLTELSPSISVHLLLGNPSGATPTKLTPDNYLMVKNQYALSYNNSKGTANWVAWQLNSSWLGNAERQDNFRPDKTLPAGWVRVTPSMYSGSGYDRGHIAPSADRTKTTEDNAATFLMTNMMPQTPDNNRNTWGNLEDYCRELVSQGKELYIVAGPNGSLGKPLKGKVTVPKSTWKIVVVLDSPGSGLEGITANTRVIAVNIPNDPELNNDWRAYKVSVDELESLTGYDFLSNVSPNIQTSIESKVDN

SEQ ID NO: 1346 - DNA, 942 bp, Candida cylindracea
ctttccgctcggctgttttcctgcgcaggagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcagaccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcgggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcag

SEQ ID NO: 1347 - protein, 211 aa, Candida cylindracea [sequence omitted]

SEQ ID NO: 1348 - DNA, 1260 bp, Candida cylindracea
aaaagactagccggggttcagttaggtatttaaagcactcaccctagaaagcattagagtagagtgtgcggagaacctatccagatcccagttgcctgtaacaacatgagatcacttgtagtgctacttgctctattttctgttagttgggccggtgttcgccacccccacttcaagattgctggaaggaatggtgtagcacctgctgttaccacgcaaccattcaacccaactgtcgatgtccttccgctttacgggatcgatacctccgacagcaaccgtggtgcgggccaggtgattggcatcattgacgcttacggagcttcaactgccgagtccgatttggctgcattttccagagccaacggcctcccagcggccaacttccagaaagtagaccaaaatggtggaactaattaccctaaggatgaccctgatgatgccagtggcgacggatggggagttgagaccgctttggacttgcaaatcgctcatgcagttgcccccgcagccaaattgatcctttgcactgccaagtctgccagcgacaccaatcttaatgcgtgcattaaaactcttaccaacctccatgttaaccacatttccatgagctatggaggcagtgagggagatacatcctctgattcttacttccaacaagcacaagaagccgggatttcactttttgcatccgccggagacagcggagctgaggctgaataccctgctgcttcccaatacgttgttgctgtaggaggaaccaccctgcacacaaattccgatggatctttcaactctgagaccgcctggtccggaagtggaggtggctgcagcaaatacaccaaagtgatccctgagcaaaacgccgaccctggatacgcttcccttggatgcaaaggcaagaaggcactccctgatcttgctgccctcgctgaccccaattccggaatcaccatcatcttccacggacaagagttggagggtattggtggcactagtttggcagcccccctcacagccggaagagctgccatcaggggagaccaagtgacccctgcctacgtgtacactggaggaatccaatttagggatattacccaaggaagcaatggtcacagtgccaaggctggacttgatctcgttacaggagagggagcttggataggttctgagtaaataaattggcccttgcaattgtttacaaaataataaaaaatatttataataaaaaaaaaaaaaaaaaaaaaaaaaaaaaaaaaa

SEQ ID NO: 1349 - protein, 356 aa, Candida cylindracea
MRSLVVLLALFSVSWAGVRHPHFKIAGRNGVAPAVTTQPFNPTVDVLPLYGIDTSDSNRGAGQVIGIIDAYGASTAESDLAAFSRANGLPAANFQKVDQNGGTNYPKDDPDDASGDGWGVETALDLQIAHAVAPAAKLILCTAKSASDTNLNACIKTLTNLHVNHISMSYGGSEGDTSSDSYFQQAQEAGISLFASAGDSGAEAEYPAASQYVVAVGGTTLHTNSDGSFNSETAWSGSGGGCSKYTKVIPEQNADPGYASLGCKGKKALPDLAALADPNSGITIIFHGQELEGIGGTSLAAPLTAGRAAIRGDQVTPAYVYTGGIQFRDITQGSNGHSAKAGLDLVTGEGAWIGSE

SEQ ID NO: 1350 - DNA, 1116 bp, Yarrowia lipolytica
atggtatccctctctgctcgaatcaaagactttttttcggtcctcctcctcggagctgcaaccatcactccctccacacagaccgcaggcgtgtctcaagggttctatgattttgctcgggactttgcccatctgtccaacattgcctactgtgtcaatgctcccatcactccactgaacccggacttcacctgtggcaactcgtgcaagcactttccggacattgagcttgtgaagacatttggaggcaacttcttcaagacctccattacgggctacctggctgtcgatcatgtcaagaaggagaagtacgttgtcttccgaggaaccttttcgctggcagacgcgatcacggacatgcagttcctgctgtctcctttcctggtcgatgtgcctgccctgaacactttctcagctaatgacaccaccgcagaggcccagacgcactgtgagggctgcaaaattcacgacggcttctccaaggccttcaccgagacctggggtaacattggtgaggatctgcagaaacacctggacgctaacccggactaccagctgtacgtgactggccattctctgggagctgctgtggcccttcttggagctacttccattaaactcaagggctacgatcccattctcatcaactacggacagccccgagtcggaaacaagcccttcgctgagttcattaacaagttgtggtttggagaaggcaacggtctggaaatcacccccgagagaaagctgtaccgaatgacccactggaacgacatctttgttggcctgcccaactgggagggatacacccactctaacggtgaagtatacatcaacaaccggttcatcaaccctcctctcaaggatgtcatctcttgtgctggaggcgaaaactcgaagtgctaccgatcctcgttcagcctgctgtcccagatcaatctgctccaaaaccacctggcttacattgattacattggatactgcgctctgaacattggtcgacgagagcttgccgatcaggaacattacactggtccttattactatggtcatcgatctgaggaggactttaagaagttgggcttggagctatccaccccacaagttgagaactga

SEQ ID NO: 1351 - protein, 371 aa, Yarrowia lipolytica
MVSLSARIKDFFSVLLLGAATITPSTQTAGVSQGFYDFARDFAHLSNIAYCVNAPITPLNPDFTCGNSCKHFPDIELVKTFGGNFFKTSITGYLAVDHVKKEKYVVFRGTFSLADAITDMQFLLSPFLVDVPALNTFSANDTTAEAQTHCEGCKIHDGFSKAFTETWGNIGEDLQKHLDANPDYQLYVTGHSLGAAVALLGATSIKLKGYDPILINYGQPRVGNKPFAEFINKLWFGEGNGLEITPERKLYRMTHWNDIFVGLPNWEGYTHSNGEVYINNRFINPPLKDVISCAGGENSKCYRSSFSLLSQINLLQNHLAYIDYIGYCALNIGRRELADQEHYTGPYYYGHRSEEDFKKLGLELSTPQVEN

SEQ ID NO: 1352 - DNA, 1101 bp, Yarrowia lipolytica
atggtcagctttggagctcgaatcaaggacttcttttcggtactcctgtttggagctgcctccacctcttcttccaccaagaccgctcttgtttcgcagggcttctacgatgctgctctggacttttcccatctgtccaacattgcgtactgtgtgaatgcccccatcactccgttaaagagcgacttctcctgcggccagtcatgtgtacatttcccggatattgagctggtccacatctttggaggcgacttcttctccacatctatcaccggataccttgctctggaccacgtcaagaaggagaagtatgtggtcttccgaggtaccttctccattgccgatgctatcaccgacatccagttccagcagtcctcctttctggtaaatgttcccgctctcaacaccttcaccgccaacgatacagctccagaggcccagatcgattgcaaacagtgcaagatccatgacggcttctccaaggctttcaccgagacctggcacaacatcggagacctgctggagcagcatctcgactcgtatccagactaccaactgtacgtgacgggacactctctgggagccgcaatggcgttgttgggcgccacctccattaaactgagaggctacgaccccatcctgatcaactacggacagccccgagttggaaacaaggcgtttgcagactacatctccgcgctgtggtttggtaatggggacggcctggaaatcaaccagcagcgaagattgtatcgaatgacccactggaacgacgtgtttgtgggcctgcccaactgggacggatacactcactccaatggagaagtgtacatcaagggcaagtacgtcaaccctcctctgaaggacgtcttttcttgtgcaggaggagaaaactccaagtgctaccgatcggaattcaacctgctcgcacaaatcaatcttttgcagaaccatctctgctacattgattacattggtttctgtgctctgaacgtcggacgacgagaactcaacgacttgccccattacaatggtccgtacaagtatggacacaaaaccgaggagcagtttatcgccgagggtctcgagctctccaactaa

SEQ ID NO: 1353 - protein, 366 aa, Yarrowia lipolytica
MVSFGARIKDFFSVLLFGAASTSSSTKTALVSQGFYDAALDFSHLSNIAYCVNAPITPLKSDFSCGQSCVHFPDIELVHIFGGDFFSTSITGYLALDHVKKEKYVVFRGTFSIADAITDIQFQQSSFLVNVPALNTFTANDTAPEAQIDCKQCKIHDGFSKAFTETWHNIGDLLEQHLDSYPDYQLYVTGHSLGAAMALLGATSIKLRGYDPILINYGQPRVGNKAFADYISALWFGNGDGLEINQQRRLYRMTHWNDVFVGLPNWDGYTHSNGEVYIKGKYVNPPLKDVFSCAGGENSKCYRSEFNLLAQINLLQNHLCYIDYIGFCALNVGRRELNDLPHYNGPYKYGHKTEEQFIAEGLELSN

SEQ ID NO: 1354 - DNA, 1179 bp, Rhizopus niveus
atggtttcattcatttccatttctcaaggtgttagtctttgtcttcttgtctcttccatgatgctcggttcatctgttgttcctgtttctggtaaatctggatcttccaacaccgccgtctctgcatctgacaatgctgccctccctcctctcatctccagccgttgtgctcctccttctaacaagggaagtaaaagcgatctccaagctgaaccttacaacatgcaaaagaatacagaatggtatgagtcccatggtggcaacctgacatccatcggaaagcgtgatgacaacttggttggtggcatgactttggacttacccagcgatgctcctcctatcagcctctctagctctaccaacagcgcctctgatggtggtaaggttgttgctgctactactgctcagatccaagagttcaccaagtatgctggtatcgctgccactgcctactgtcgttctgttgtccctggtaacaagtgggattgtgtccaatgtcaaaagtgggttcctgatggcaagatcatcactacctttacctccttgctttccgatacaaatggttacgtcttgagaagtgataaacaaaagaccatttatcttgttttccgtggtaccaactccttcagaagtgccatcactgatatcgtcttcaacttttctgactacaagcctgtcaagggcgccaaagttcatgctggtttcctttcctcttatgagcaagttgtcaatgactatttccctgtcgtccaagaacaattgaccgcccaccctacttataaggtcatcgttaccggtcactcactcggtggtgcacaagctttgcttgccggtatggatctctaccaacgtgaaccaagattgtctcccaagaatttgagcatcttcactgtcggtggtcctcgtgttggtaaccccacctttgcttactatgttgaatccaccggtatccctttccaacgtaccgttcacaagagagatatcgttcctcacgttcctcctcaatccttcggattccttcatcccggtgttgaatcttggatcaagtctggtacttccaacgttcaaatctgtacttctgaaattgaaaccaaggattgcagtaactctatcgttcctttcacctctatccttgaccacttgagttactttgatatcaacgaaggaagctgtttgtaa

SEQ ID NO: 1355 - DNA, 1674 bp, Rhizopus niveus
ttcttagccgctgccgtaaacctagctggcgtcctggcccaggccccacggccgtctctcaatggcaacgaggtcatctctggtgtccttgagggcaaggttgataccttcaagggaatcccatttgctgaccctcctttgaatgacttgcgattcaagcacccccagcctttcactggatcctaccagggtcttaaggccaatgattttagccctgcttgtatgcagcttgatcctggcaactctctcactttgcttgacaaagctctgggattggcaaaagtcatccccgaagaatttagaggtcccctttatgatatggccaagggtaccgtgtcgatgaatgaggactgtctttacctcaatgttttccgccctgctggcaccaagcctgatgctaagctccccgtcatggtttggatttacggtggtgcgtttgtttacggttcttctgctgcctaccctggtaacagctacgttaaggaaagtatcaacatgggccagcccgttgtgtttgtttccatcaactaccgtaccggtccatttggattcctgggtggtgatgccatcaccgctgagggcaacaccaacgctggtctgcacgaccagcgcaagggtctcgagtgggttagcgacaacattgccaactttggtggtgatcccgataaggtcatgattttcggtgagtccgctggtgccatgagtgttgctcaccagcttattgcctatggtggtgacaacacctacaacggaaagaagcttttccactctgccattcttcagtctggtggccctcttccttaccacgactctagctccgttggtcccgatatttcctacaacagatttgctcagtatgccggatgtgacactagtgccagtgccaacgacactctggagtgtctccgcagcaagtccagctctgtcttgcacgatgcccagaactcttacgatctcaaagatctgtttggtctactccctcaattccttggatttggtcccagacccgacggcaacattattcccgatgccgcttatgagctcttccgcagcggtagatacgccaaggttccctacattagcggtaaccaggaggatgaaggtactgcttttgctcctgttgctctcaacgctaccacgactccccatgttaagaagtggttgcagtacattttctacgatgcttccgaggcttccattgaccgtgttttgtcgctgtacccgcagaccctctctgttggctcgcccttccgcactggcattcttaatgccctgaccccccagttcaagcgtgttgcggccatcttgtccgatatgcttttccagtctccccgccgcgtgatgcttagcgccaccaaggacgttaaccgctggacttacctttcgacccatctgcacaacctggtgccatttttgggtactttccatggcaacgagcttatcttccaattcaatgtgaacattggccccgctaactcctaccttcgttactttatttcctttgccaaccaccatgaccctaatgttggtactaacctgctccagtgggatcaatacactgatgaaggcaaggagatgcttgagattcacatgaccgataatgtcatgagaactgatgactacagaattgagggaatctcaaactttgagactgacgttaatctctacggttaa

SEQ ID NO: 1356 - DNA, 1205 bp, Rhizomucor miehei
atcagaatcatggttctcaagcagcgtgcaaactatctgggctttctgattgtattcttcacggcgttcctggtcgaagccgtgccaatcaagagacaatcaaacagcacggtggatagtctgccacccctcatcccctctcgaacctcggcaccttcatcatcaccaagcacaaccgaccctgaagctccagccatgagtcgcaatggaccgctgccctcggatgtagagactaaatatggcatggctttgaatgctacttcctatccggattctgtggtccaagcaatgagcattgatggtggtatccgcgctgcgacctcgcaagaaatcaatgaattgacttattacactacactatctgccaactcgtactgccgcactgtcattcctggagctacctgggactgtatccactgtgatgcaacggaggatctcaagattatcaagacttggagcacgctcatctatgatacaaatgcaatggttgcacgtggtgacagcgaaaaaactatctatatcgttttccgaggttcgagctctatccgcaactggattgctgatctcacctttgtgccagtttcatatcctccggtcagtggtacaaaagtacacaagggattcctggacagttacggggaagttcaaaacgagcttgttgctactgttcttgatcaattcaagcaatatccaagctacaaggttgctgttacaggtcactcactcggtggtgctactgcgttgctttgcgccctgggtctctatcaacgagaagaaggactctcatccagcaacttgttcctttacactcaaggtcaaccacgggtaggcgaccctgcctttgccaactacgttgttagcaccggcattccttacaggcgcacggtcaatgaacgagatatcgttcctcatcttccacctgctgcttttggttttctccacgctggcgaggagtattggattactgacaatagcccagagactgttcaggtctgcacaagcgatctggaaacctctgattgctctaacagcattgttcccttcacaagtgttcttgaccatctctcgtactttggtatcaacacaggcctctgtacttaagaaataccagttatacgatatgtaggaagtagtattttttaggaagagatttatatgtattaaacaaatatatatatatataccgctgcgcgagaacctgtatt

SEQ ID NO: 1357 - protein, 363 aa, Rhizomucor miehei
MVLKQRANYLGFLIVFFTAFLVEAVPIKRQSNSTVDSLPPLIPSRTSAPSSSPSTTDPEAPAMSRNGPLPSDVETKYGMALNATSYPDSVVQAMSIDGGIRAATSQEINELTYYTTLSANSYCRTVIPGATWDCIHCDATEDLKIIKTWSTLIYDTNAMVARGDSEKTIYIVFRGSSSIRNWIADLTFVPVSYPPVSGTKVHKGFLDSYGEVQNELVATVLDQFKQYPSYKVAVTGHSLGGATALLCALGLYQREEGLSSSNLFLYTQGQPRVGDPAFANYVVSTGIPYRRTVNERDIVPHLPPAAFGFLHAGEEYWITDNSPETVQVCTSDLETSDCSNSIVPFTSVLDHLSYFGINTGLCT

SEQ ID NO: 1358 - DNA, 1212 bp, Fusarium heterosporum
acacatcatcctcttcagatcgacaatccaacccaattgactctcatattgagacctctgtcatgatgctcgtcctatctcttctttccataattgcctttacggcagctggcccagtgccctctgttgatgagaatactcgggtacttgagcatcgagctgtgacagtcacgacgcaggatctgtcaaatttcaggttctatctccagcatgctgatgctgcgtattgcaatttcaatacggcagttggcaaaccagtccactgcagtgccgggaattgtcctgatattgaaaaggacgctgctatcgttgtcggatcggtagttggtacgaagacgggcatcggtgcctatgtggcaactgacaacgctcgtaaggagatcgttgtctctgtacggggcagcatcaacgtgcgaaactggatcacaaacttcaactttggtcaaaagacctgcgaccttgttgctggctgtggcgttcacaccggcttcttggatgcttgggaggaggttgcagccaatgtcaaagctgctgtctcagcagcgaagactgcaaaccctactttcaagttcgtcgttaccggacactccctcggtggtgccgtcgctactattgcggctgcgtacctgcgcaaagacggctttccttttgacctctacacctatggctctccaagagtaggaaacgacttcttcgccaacttcgtcactcagcagacgggcgctgaatatcgcgtcacacatggtgatgaccccgtcccacgtcttcctcctatcgtctttggataccgtcacactagcccagaatactggcttaacggtggcccacttgataaggactacaccgtgaccgagatcaaggtttgtgagggcatagcgaacgttatgtgcaatggtggcacgataggtctggacattcttgcgcacatcacctatttccagagcatggccacttgtgcaccaatcgcgatcccatggaagagggacatgtcagatgaggagttggaaaagaagttgactcagtatagcgagatggatcaggaatttgttaagcagatgatttaggccatggagagaattggtccatagtcttccttgccggcaaacaactggtaaatgacttttggacttagtattgaagtgggttcttaaaaaacatattttctttcttactagtataaattagtagaatactatttaaaatttagtaagc

SEQ ID NO: 1359 - protein, 333 aa, Fusarium heterosporum
MMLVLSLLSIIAFTAAGPVPSVDENTRVLEHRAVTVTTQDLSNFRFYLQHADAAYCNFNTAVGKPVHCSAGNCPDIEKDAAIVVGSVVGTKTGIGAYVATDNARKEIVVSVRGSINVRNWITNFNFGQKTCDLVAGCGVHTGFLDAWEEVAANVKAAVSAAKTANPTFKFVVTGHSLGGAVATIAAAYLRKDGFPFDLYTYGSPRVGNDFFANFVTQQTGAEYRVTHGDDPVPRLPPIVFGYRHTSPEYWLNGGPLDKDYTVTEIKVCEGIANVMCNGGTIGLDILAHITYFQSMATCAPIAIPWKRDMSDEELEKKLTQYSEMDQEFVKQMI

SEQ ID NO: 1360 - DNA, 1056 bp, Candida albicans
atgattagatcaatacgtttttactccaaagtaattgatcttaaaaaggaaggaaaaactgcagcaaagatcttgaagtcggaatacaaatcactcaaggatcactatgaggcgccgaaatacccaattgttctatgtcacgggttttccggatttgaccgtttatcattattgccaattcccaaagaggtaggccatcaaattgacaaggccaaggaatatgcacctagagggctcattgaattggattactggtatggaatcaaagaagcacttgaaaagttgggatccacggtattcatagctaaagttccagcattcggcgatattaagagcagagccgtaagtctagataaattcatcaacaaagaatgcaagagtctacgacaaaacgagtccaaatcttcaatatacaacgatctgaaccacgatccaacaacttttgaaaacaagaacgaaccaattaaagtcaacctaatcagccattcgatgggcggtttggatagtagatacttgatctccaagatacacaaagagaatgagaactataaggtggcgtcacttacgacaatttcgactccacaccatggctcagaatgtgctgattttattgtggatttaattggcaacaatcagatattaaaaaatgtatgtccacagtctatttttgatttgacaacgtcaaatatgaagaaattcaatcaatcagtaaaagatgaccccaatgtccaatatttttcgtttggtgccagattcaatcctcggtggtataatttgttcagcttgacatggttagtaatgaagtatgaaatcaaaaaggataaagctcgcgagttgcgccgtctaattgacaatgacggtcttgtgagtgtggaaagctcaaaatggggacagtacataggtactttagatgaggtcgaccatttagatttgatcaattggacaaacaaagcccggagcacttttgataaagtgatgtttgcccaagatcctacattcaaccccattgcattgtatttagatattgctgataaattagctgaaaagggattataa

SEQ ID NO: 1361 - protein, 351 aa, Candida albicans
MIRSIRFYSKVIDLKKEGKTAAKILKSEYKSLKDHYEAPKYPIVLCHGFSGFDRLSLLPIPKEVGHQIDKAKEYAPRGLIELDYWYGIKEALEKLGSTVFIAKVPAFGDIKSRAVSLDKFINKECKSLRQNESKSSIYNDSNHDPTTFENKNEPIKVNLISHSMGGLDSRYLISKIHKENENYKVASLTTISTPHHGSECADFIVDLIGNNQILKNVCPQSIFDLTTSNMKKFNQSVKDDPNVQYFSFGARFNPRWYNLFSLTWLVMKYEIKKDKARELRRLIDNDGLVSVESSKWGQYIGTLDEVDHLDLINWTNKARSTFDKVMFAQDPTFNPIALYLDIADKLAEKGL

SEQ ID NO: 1362 - DNA, 1056 bp, Candida albicans; identical to SEQ ID NO: 1360

SEQ ID NO: 1363 - protein, 351 aa, Candida albicans; identical to SEQ ID NO: 1361

SEQ ID NO: 1364 - DNA, 1176 bp, Rhizopus stolonifer
atggtttcattcatttccattactcaaggtgtaagtctttgtcttcttgtctcttccatgatgatgggctcttctgctgttcccgtttctggtaaaactggggcttcaagtgatgctgtatccacatctggcaactttactctccctcctatcatctctagtcgttgtgcgcctccttctggaaaaggatccagcagcgatcttcaatccgagccttactttgtcaagaaaaacaccgaatggtacactgcccatggtggagatctggctgccattggtaaacgtgacgataatcaagtcggtggcatgacattggatttacccgaaaatgctcctcctatcgcaagctcttattccctcgacagtgtctctgatagctcagtcgttgctgctactgccgctcaagttcaagagcttaccaagtatgctggtgtcgccgccactgcctattgtcgtagtgttgttcctggaaacaaatgggactgcaagcaatgtttgaagtgggttcctgatggtaaaattatcacaacattcacttctattctctcagacacaaatggttatgtcttaagaagtgataagcagaagactatctatcttgtttttcgtggtaccaactccttcagaagtgctatcacagacatcgtcttcaatttctcaaattataagcctgtttctggtgccaaggtacacactggcttcctctcttcttacgaacaagtcgtcaatgattacttccctgttatccaagcccagttaacagccaatcctagctaccaagttattgttactggtcactcacttggtggagcccaagctttgcttgctggtatggacttataccaacgcgaaaagagactgtctcccaagaacttgagtattttcaccatcggtggtcctcgtgtcgaaaaccctacctttgcttactatgttgaatctactggtattccttttcatcgtactgtccacaagagagatatcgtccctcacgtcccccctcaagcaatgggattccttcatcctggtgttgagtcttggatcaagtctggtgattctaatgttcaaatctgtaactctcaaatcgagaccaaggcttgtagtaactcaatcgttcctttcacttctattgctgaccacttgtcttactttggtatcaacgaaggaagctgtttgtaa

SEQ ID NO: 1365 - protein, 391 aa, Rhizopus stolonifer
MVSFISITQGVSLCLLVSSMMMGSSAVPVSGKTGASSDAVSTSGNFTLPPIISSRCAPPSGKGSSSDLQSEPYFVKKNTEWYTAHGGDLAAIGKRDDNQVGGMTLDLPENAPPIASSYSLDSVSDSSVVAATAAQVQELTKYAGVAATAYCRSVVPGNKWDCKQCLKWVPDGKIITTFTSILSDTNGYVLRSDKQKTIYLVFRGTNSFRSAITDIVFNFSNYKPVSGAKVHTGFLSSYEQVVNDYFPVIQAQLTANPSYQVIVTGHSLGGAQALLAGMDLYQREKRLSPKNLSIFTIGGPRVENPTFAYYVESTGIPFHRTVHKRDIVPHVPPQAMGFLHPGVESWIKSGDSNVQICNSQIETKACSNSIVPFTSIADHLSYFGINEGSCL

SEQ ID NO: 1366 - DNA, 1416 bp, Candida albicans
atgaaaaccctagttgtcttatgtactttattatcaataatatttgcttcgcccttaagtttgaaatcacctcttgtggatgacttctacaatccacctcgaggttatgaatcagcaaaattaggagaaatcttaaagttgagaaaaacgccaggcaaaataagcagtttgtttatccctgtggaggttaagaactcctggcagcttttagttagatccgaagattcatttggaaatgcagcagcaattgttaccactgttatcgaacctttcaacgccgacccttccaaagttgtatcttatcaaagttgggaagatgcagctaacattgaatgctcaccttcttacggtatgcaatttggggctccattgtcatcagtacaaacccaagtggatatgattttcatagttccattgttggataaaggttgttttgttgttcttccagattatgaaggtcccaaatctacatttggtgtaggaagacaatcaggaaaagctacattggattccatcaaagctgtcttgaaaactaaagacttttctggtattaatgatgatgcccaagttgctatgtgggggtattccggaggtacaatagctgctggctgggctgctactttgcagcccaaatatgcacaagagttgaagaaaaatttgattggtgcagctcttggtgggtttgtcattaatattactgctaccgctgaagcaaccgatggtacattgtttgctggattaatcccaaacgcactaaatggattagccaatgaatttcctgattttaaaaagagaatgtatgaagttgttgaaaaaagatatgaaggagctttacaacaggggactcaacactgtttaggaggggctattcttcattttgcctttgatcaggttttcactggtgaccatagatactttgaacagggttatggattgctcgaagaggaagtattcaaccgaaccattctggggaacagtttgttatacatggatcaagagtatttaccggatattccaatatttgtatatcacggctcgttggatggcattgttccaattcctgatgtacatggtgtttacaagaattggtgtgattggggcatcgactcatttgagtttgccgaagattcattgaatggccatctcaccgagattgttgttggagctcccgcagctataacatggttagatgcaagatttgatggccaaccagttgtggagggatgcaagaaaactactagaatcactaatttttcttatccaaacatttccgattcaactagaaatttcttcaaaggtattcttgattcacttactgcctcacaattgggacctggtgtcacatctgataatgtgaccttaagtggattaactggattcatggggggactttctaagttcaaaaagtcagtttag

SEQ ID NO: 1367 - protein, 471 aa, Candida albicans
MKTLVVLCTLLSIIFASPLSLKSPLVDDFYNPPRGYESAKLGEILKLRKTPGKISSLFIPVEVKNSWQLLVRSEDSFGNAAAIVTTVIEPFNADPSKVVSYQSWEDAANIECSPSYGMQFGAPLSSVQTQVDMIFIVPLLDKGCFVVLPDYEGPKSTFGVGRQSGKATLDSIKAVLKTKDFSGINDDAQVAMWGYSGGTIAAGWAATLQPKYAQELKKNLIGAALGGFVINITATAEATDGTLFAGLIPNALNGLANEFPDFKKRMYEVVEKRYEGALQQGTQHCLGGAILHFAFDQVFTGDHRYFEQGYGLLEEEVFNRTISGNSLLYMDQEYLPDIPIFVYHGSLDGIVPIPDVHGVYKNWCDWGIDSFEFAEDSLNGHLTEIVVGAPAAITWLDARFDGQPVVEGCKKTTRITNFSYPNISDSTRNFFKGILDSLTASQLGPGVTSDNVTLSGLTGFMGGLSKFKKSV

SEQ ID NO: 1368 - DNA, 1951 bp, Candida albicans
taactaaccttgaaaaattgcaataataattacacaatattgaaaatcccaccaggtttagtggagcagaggagcagaatggcaacaaaaacactatattcatgcatagattacccctcattgttaacataaaccatcagcgttgttaacatatcacaaaatagatcaaaatacctttttttggtaagcctgaaattatagaaagccccacaaatatataacggaaaagtctgatttccaccaatggcatgcttcaaaccaagacagccttagccatggttgtgctattgtaccaaactgaaaaactataaatgaacgttcaattctctccatgatctttaagcttattcatttttgtccacatcagtaagaaaatgttgtttttgttgtttttgttagttgctcccatctacgctggtcttattttaccaactaaaccatcaaatgatccattttacaatgcccccgcagggtttgaaaaagctgctgttggtgacatcttacagtctagaaaaacacccaaacccatcactggtgttttcgtcccagttaagattcaaaactcctggcaacttttagtcaggtctgaagattcattcggtaatccaaatgtgattgtcactactgttatggagccattcaatgctgacccttccaaactcgcttcatatcaagtctttgaagattccgctaaagctgattgtgccccctcctatgctcttcaatttggttctgatgtgactactatagccacccaagttgaaacgtatttattggcaccattattggaccaagggtactatgttgtttccccagactatgaaggtcctaaactgacattcactgttggcaaacaatccggtcaagccgtgttaaactccatccgtgcagcattaaagtctgggaaaatcactaatcttgctgagaatgctaaagttgttatgtggggatactctggtggctcattggcctcaggctgggccgctgctttgcaaccaaactatgcaccagaattgggtggtaacttattgggtgctgctttaggtggatttgttactaatattactgctacagcagaagccactgacggtactgtctttgcagggattatggcaaatgccttgggtggtgttgcaaatgagtaccccgaattcaaacaaatcttacaaaacgacaccgacaaacagtctgtgtttgatcaatttgataatcattgcttggctgatggtgtgatcaattatattggtaagcactttttatctggcaccaacaaaatcttcaaatccggctggaatattttaaagaacccaacaatttctaaaattgttgaggataatggtttggtttatcagaaacagctagttccaaaaatccccatcttgatctatcatggtgctattgaccaaattgtccctattgtcaacgtaaaaaaaacttatcaaaattggtgtgatgctggtattgcttcattggaattttctgaagatgcgactaatggtcacatcactgaaaccattgttggcgctcctgttgctttgacttggatcattaatagattcaatggaaaacaaaccgtgtctggctgtcaacatgttaaaagaacaagtaactttgaatatccaaacatcccaccttcgattcttaattactttaaggctgcattgaatatactcatccaaaaaggacttggacctgatattcaaaaggatcaagttaatcctgatggtttgaaaaagatttcaatacttgtatagtttctgccacacagcctagtaaataagcctaagtgtacatcgcactaaccaatgtaattgaaataacatcgtgttgttcatcattttccttatctcaagaatacactctattgctcagatatgagctacttcaacctttagttgatttttcacttttgattccctgatttctcttgtaaaacctctttaagttaact

SEQ ID NO: 1369 - protein, 459 aa, Candida albicans
MLFLLFLLVAPIYAGLILPTKPSNDPFYNAPAGFEKAAVGDILQSRKTPKPITGVFVPVKIQNSWQLLVRSEDSFGNPNVIVTTVMEPFNADPSKLASYQVFEDSAKADCAPSYALQFGSDVTTIATQVETYLLAPLLDQGYYVVSPDYEGPKSTFTVGKQSGQAVLNSIRAALKSGKITNLAENAKVVMWGYSGGSLASGWAAALQPNYAPELGGNLLGAALGGFVTNITATAEATDGTVFAGIMANALGGVANEYPEFKQILQNDTDKQSVFDQFDNHCLADGVINYIGKHFLSGTNKIFKSGWNILKNPTISKIVEDNGLVYQKQLVPKIPILIYHGAIDQIVPIVNVKKTYQNWCDAGIASLEFSEDATNGHITETIVGAPVALTWIINRFNGKQTVSGCQHVKRTSNFEYPNIPPSILNYFKAALNILIQKGLGPDIQKDQVNPDGLKKISILV

SEQ ID NO: 1370 - DNA, 1910 bp, Candida albicans
gtagtttgatttgactaacatttttgaaaactaaattttttatttacaatataactcatcctcccattgttctgcatagctattgttttcactttatcaaatggtttaaccaaatgataagtattgtgaacctgaaataatgaagagtgtcacaagcagttagactaaaatgcctgaaatgtaattcttgaacgtcaatggggatttggggaattgagtgattttgtttttgcaccaagtaaataccatgattgtacaactttcatgaaaaattataaatagatgtcaggtttcctcaataagttccaatatgtttacttatccaatcaagaaaaatgttgtatttaatacttttcctcattgcccccatatatgctggccttattttccctaccaaaccatcaagcgatcccttctataaccccccgaaaggttttgaaaatgctgccgttggtgatattttgcaatccagggcaacacccaaatctatcactggtgggttcacccctctcaagatccagaactcatggcaacttttagttagatctgaggattcatttggtaatccaaatgtcattgtcactactgttattgaaccagtcaacgctgatccatccaagattgcttcctaccaggtttttgaagatgcagctaaagctgattgtgctccttcctatgctcttcaatttggttctgatttgactactttcgttactcaagctgaaatgtacttgatggcaccattgttagatcaaggatattatgttgtgtctcctgattatgaaggacctaaactgacattcactattggtaaacaatcaggtcaagctgtgctaaactctattcgtgcagcattaaaatctggtaaaatcaccaacattaaagacgatgctaaagttgtcatgtggggatattctggtgggtcattagcctctggatgggcagctgctttacaaccaagctacgcacctgaattaggtggtaacttattgggtgctgccttaggtggatttgttaccaatattacagctaccgcacaagccactgacggtactgtttttgcaggaattgtggcaaacgctttgggtggtgttgctaatgagtatccggaattcaaatcaattttacagagtgatacagacaaaaaatcagtgtttgaggaatttgatggtcactgcttgattgacggtgtgctcaactatatcggtactctgttcttaactggtgatcataagattttcaaaactggttgggatattttaaagaacccaaaaattggtaaagttgttgaagacaatggattagtttatcagaagcagttggttccaaaaatacccgtgtttatttaccacggttcaattgatcaaatcgtccctattgtcgataccaaaaaaacttatcaaaattggtgtgatgctggtatttcctctttggaatttgctgaagatgctagtaatggtcacctcactgaagctattatgggtgcccctgctgctttgacttggattattgatagatttgatggtaaacaaactgtttctggttgtcaacatattcaaagattcagtaaccttgaatacccaaatattccttcttcaattgctaactatttcaaagcagcaatggatgttgttctccatctcggacttggcccagatgtccaaaaagatcaagtcagtcctgaaggaattaaaaaacttggatcaattgaaatgaggtggttataataggtactcttgtcatccatagatatgtaggtatgattgttaataaaagtctccctagtcaatgattaaggtggaagctctccccatgatgtgtaggaaatgaagtttacctggttgagaaaaaggaaatattcttctcgacaacgagaacgctagtatatgtaatcctcataattttttttt

SEQ ID NO: 1371 - protein, 463 aa, Candida albicans
MLYLILFLIAPIYAGLIFPTKPSSDPFYNPPKGFENAAVGDILQSRATPKSITGGFTPLKIQNSWQLLVRSEDSFGNPNVIVTTVIEPVNADPSKIASYQVFEDAAKADCAPSYALQFGSDLTTFVTQAEMYLMAPLLDQGYYVVSPDYEGPKSTFTIGKQSGQAVLNSIRAALKSGKITNIKDDAKVVMWGYSGGSLASGWAAALQPSYAPELGGNLLGAALGGFVTNITATAQATDGTVFAGIVANALGGVANEYPEFKSILQSDTDKKSVFEEFDGHCLIDGVLNYIGTSFLTGDHKIFKTGWDILKNPKIGKVVEDNGLVYQKQLVPKIPVFIYHGSIDQIVPIVDTKKTYQNWCDAGISSLEFAEDASNGHLTEAIMGAPAALTWIIDRFDGKQTVSGCQHIQRFSNLEYPNIPSSIANYFKAAMDVVLHLGLGPDVQKDQVSPEGIKKLGSIEMRWL

SEQ ID NO: 1372 - DNA, 1816 bp, Candida albicans
ttgttttgagtaatccccagttcaaatttggagggttcgagtttatatctttaatggtcaattgcttttgaaaagaaacaagcaatcagccaatgaaagttttttatttaatatgcaaacattgaatgttatttcccagtccaaaaacaaacacattaaataaggatatttagattttcatttggaacaagtatatataaataaagtcagcttccccagtactaaccatgtatttatatatctgcttgattaaattattttacaaatgagagatttaattttatttttgagtttgttgcatacaatatttgcatcacttttcagtttaaagccacccagccaagatgatttttacaaagcacctgctggttttaaagctgccaaaccaggggatattttgaaaacaagaaaatcacctaataagccaagtagcttatatgcacctgttgacgttcaaaattcatggcagctcttggtcaggtcggaagattcttttggtaacccaaatgcttttgtcacaaccatcattcaacccaagaatgccgatccatcgaaggtcgtgtcgtatcagaattgggaagatgcttccaacattaattgctccccatcatatggtctgcaacttggggctccattaagcacaatacttacccaattggatatgacatttatagttcctccattgaagagtggttattatgttgttcttccagattatgaaggtcccaaatctacatttggcgtaggaagacaatcaggaaaagctacattggattccatcaaagctgtcttgaaaactaaagatttttctggtattaatgatgacgcgaaagttgttttatgggggtattctggaggatcgtttgccagtggttgggctgcagttttgcaaccagaatatgccccagaattgaaagataatttgattggcgctgccttaggtggattcgccgctaaccttactggtattgctgaatcagttgatggtgaagtcttttctgggtttataccacttgcattgaacggtatagcaaatgagtatcctgattttaaaaagagattatacgaagaagttaaacctggtgccaaagctgatttacaaaaaggtgcagagaattgtttggctgcatcacttatcagttatccaatgtatcaatatttcacaggtccaagaagagtgtttgaaaaaggatggtcattgttggaagataaaaccattggcaagactttagaagacaacttgcttattgccttgagtaaagaacatatgccccagatccctatttttgtttatcatgggacaattgataaaatcattcctatcaaggattcgattaagatatataagaattggtgtgattggggaattggatcatttgagttttctgaagataaactgaatggtcatacaacggaaacagttgttggagcaccagcagctttaacgtggatagatgcaagatttgcaggaaagcctgcagttgaagggtgtctgttcaccaccagggcatcgaatttcttgtaccccaacatttcggaatctgctgcactgtacttcaaaggaatatatcaaacgatcttgagatcgaaattgggctcaggtgttacttctgatgatgtttctgtaaatggtttacgtagcttgtatcatacctagtttagtcacaggtgactataggtattttaaatatataggtaacattgtatcattgaaaaaaaaaatcaatatataggaaattaacgagttaactgattattatgataaatcaaatgattgcatctatattactcttctgctaaacacacaacagcctaa

SEQ ID NO: 1373 - protein, 463 aa, Candida albicans
MRDLILFLSLLHTIFASLFSLKPPSQDDFYKAPAGFKAAKPGDILKTRKSPNKPSSLYAPVDVQNSWQLLVRSEDSFGNPNAFVTTIIQPKNADPSKVVSYQNWEDASNINCSPSYGSQLGAPLSTILTQLDMTFIVPPLKSGYYVVLPDYEGPKSTFGVGRQSGKATLDSIKAVLKTKDFSGINDDAKVVLWGYSGGSFASGWAAVLQPEYAPELKDNLIGAALGGFAANLTGIAESVDGEVFSGFIPLALNGIANEYPDFKKRLYEEVKPGAKADLQKGAENCLAASLISYPMYQYFTGPRRVFEKGWSLLEDKTIGKTLEDNLLIALSKEHMPQIPIFVYHGTIDKIIPIKDSIKIYKNWCDWGIGSFEFSEDKSNGHTTETVVGAPAALTWIDARFAGKPAVEGCSFTTRASNFLYPNISESAASYFKGIYQTILRSKLGSGVTSDDVSVNGLRSLYHT

SEQ ID NO: 1374 - DNA, 1787 bp, Candida albicans
attagatttactaataaacaatactacatcaaacatgtttataggtgtttgttatactaatttattattggaaaactaccaaatataatataaatatatgtgacattgcgctaaggtactcaatttggtggcacattctcatttacacgacttgtatgtagtttcttatttttggaacattatctcaataactaggaataaacagggctctgatcagtccttataaaaagaaagaatgttgtttcttttgatatatcaagctcaacttagttctacttaacagatgcaaatcaaatgtttgttttccttgctttgatcactttgactacttgtctacaaatacctctcaatccaacaattgacgatttctataatccaccaaaagatctcgaaacaagccaattgggtgatgttttaaaatggaggaaaatgccattcccggtaactagcatgtttgtaaatcttccaatttctaatgcatggcaaatatcagttagatcgcaagatacattaaacaattctcttgctattgttgcaacaattttagaacctcctaatggtgataaaaacaagttgatatctcatcaagcttttgaaaactcgccattattactgtgttccccatcatattccatgcaagttccatcattcgagacatttcagattcaagcagatttgatttttatttctggtttactaagccaaggttggtatgtggtggtaccagattatgaaggaccaaattcagttttccctgtgggacgacaatctgcttattctgtattggatagtataagaggcacaatcaagttcttcaattcaactggaaactcaactgtgaaaacagcattattggggtattcatatggtgcagttgcttctctttgggcatcaattgtacagcccaactatgctccagagcttgaattggtgggagcagccgttggatgcactatacctaatatcaccgcatttattgaaaaagtagatgaaggtccatattcaggactaattgttaatatattcaatggactagcaaatgagtatcgccatttcagggacagattgatacattttggtgcattacaaccacttggatgtttatttcccatttgcagaaaattctttttccaaaaaatgattggtggagtatatgatgcccaagtgttgaccgatgaaactataaaggaaaccattgaaataaataatcttctttcaactcgagcggttccacaaattcctgtatttttgtttcattcaaaattcaatgaaatgtcaccgtttttagaaattttgaaattggaaaagctttggtgctcacagttaggggttaatctagagatagcagaagatatgagttataatcatatggttgaagccttttctggtatgccagcagcaatcacttggattgaaaagaggtggaataattcaaccttgggaggatgtaaacatgttcaccggttgtcaaattttgaatatcctggcatagcaccatttctcagtcagtacttccgttcgtctttacaaatggtgttaaataataatcgttatttcaacaatactacaagatagttgttaaagttctaattaattcatttcatctataaattacgtaacatcgtataaacgccgcttgtttgtaaaccccttttttatttttttttatttttgataatctggtatgtaactgggagtaggattatcattgcttcctgaataaaatacaagcggatcagtaagaaaggcgtccaatgagccatttgattccacttcggaaatgtagc

SEQ ID NO: 1375 - protein, 426 aa, Candida albicans
MFVFLALITLTTCLQIPLNPTIDDFYNPPKDLETSQLGDVLKWRKMPFPVTSMFVNLPISNAWQISVRSQDTLNNSLAIVATILEPPNGDKNKLISHQAFENSPLLSCSPSYSMQVPSFETFQIQADLIFISGLLSQGWYVVVPDYEGPNSVFPVGRQSAYSVLDSIRGTIKFFNSTGNSTVKTALLGYSYGAVASLWASIVQPNYAPELELVGAAVGCTIPNITAFIEKVDEGPYSGLIVNIFNGLANEYRHFRDRLIHFGALQPLGCLFPICRKFFFQKMIGGVYDAQVLTDETIKETIEINNLLSTRAVPQIPVFLFHSKFNEMSPFLEILKLEKLWCSQLGVNLEIAEDMSYNHMVEAFSGMPAAITWIEKRWNNSTLGGCKHVHRLSNFEYPGIAPFLSQYFRSSLQMVLNNNRYFNNTTR

SEQ ID NO: 1376 - DNA, 1787 bp, Candida albicans; identical to SEQ ID NO: 1374

SEQ ID NO: 1377 - protein, 426 aa, Candida albicans; identical to SEQ ID NO: 1375

SEQ ID NO: 1378 - DNA, 1383 bp, Candida albicans
atgttgtttttattattcttattaattactcccatttacgctggtcttattttccctaccaaaccatcaagcgatcccttctataatcctcctaaaggttttgaaaaggctgctgttggtgatattttgcaatccagggaaaccccaaagtctataactggtagatttgctcccctcaagatccaaaactcatggcaacttttagttagatccgaagattcattcggtaatccaaatgctattgtcactactgttattgaaccagtcaacgctgatccatccaagattgcttcctaccaggtttttgaagatgcagctaaagctgattgtgctccttcctatgctcttcaatttggttctgatttgactactttcgttactcaagctgaaatgtacttgatggcaccattgttagatcaaggatattatgttgtgtctccagattatgaaggtcctaagctgactttcactattggtaaacagtctggtcaagctgtgttgaactctattcgtgcaaccttaaaatctagtaaaatcaccaacattaaagaagatgctaaagttgtcatgtggggttattctggtggttcgttagcctctggatgggcagctgctttacaaccaagctacgcacctgaattgagtagcagcttgttgggtgctgccttaggtggatttgttaccaacattactgctaccgcacaagcagctgatggtactgtatttgcaggaattgtggcaaatgccttgggtggtgttgctaatgagtatccggaattcaaatcaattttgcagagtgatacagacaaaaaatcagtgtttgatgaatttgatagtcattgtttagctgatggtgtgatcgattatatcaatactctgttcttaactggtgacaataagattttcaaaactggttgggatattttgaaaagcccaacaattgctaaaatcgttgaagataatggattagtttatcaaaaacaattagtgccaaaaatccctatatttgtctatcatggttcaattgatcaaattgtccctattgttaatgttaaaaaaacttatcaaaattggtgcgaaggtggtatttcatctttggaatttgctgaagatggtactaatggtcatcttactgaaaccgttgtgggtgctcctgctgccttgacttggatcattgatagatttaatggtaaacaaactgtttctggttgtcaacatgataaaagattaagtaactttcaatatccaaatatttcttcttcaattcttaagtatttcaaagttgctttggacaccatgatgctgaatggtcttggttctgatattcaaaaagataaaattaccccagacgaccttagaaagtttttattaggaggctggtaa

SEQ ID NO: 1379 - protein, 460 aa, Candida albicans
MLFLLFLLITPIYAGLIFPTKPSSDPFYNPPKGFEKAAVGDILQSRETPKSITGRFAPLKIQNSWQLLVRSEDSFGNPNAIVTTVIEPVNADPSKIASYQVFEDAAKADCAPSYALQFGSDLTTFVTQAEMYLMAPLLDQGYYVVSPDYEGPKSTFTIGKQSGQAVLNSIRATLKSSKITNIKEDAKVVMWGYSGGSLASGWAAALQPSYAPELSSSLLGAALGGFVTNITATAQAADGTVFAGIVANALGGVANEYPEFKSILQSDTDKKSVFDEFDSHCLADGVIDYINTSFLTGDNKIFKTGWDILKSPTIAKIVEDNGLVYQKQLVPKIPIFVYHGSIDQIVPIVNVKKTYQNWCEGGISSLEFAEDGTNGHLTETVVGAPAALTWIIDRFNGKQTVSGCQHDKRLSNFQYPNISSSILKYFKVALDTMMSNGLGSDIQKDKITPDDLRKFLLGGW

SEQ ID NO: 1380 - DNA, 1829 bp, Candida albicans
ttttttatcgttgtctttgtttacatcaacaaagagatagcccactttctggaaaaaacaattctggtcgtcgtacactagatactcaattgtttgtgtgacgatgagatgatccaattacaagataatcaagcttattgttgatgaaatcaattcaaaaaataaaacaaaaacacatagaatgccttatcatttatctgacttggaagagtataaatctagcgcaaatgacctcccttttctttgatagttcttatttttagatgtttacttatccaatcaagaaaatgttatatttaatacttttccttatcgctcccatctatgctggggttttacttccaacaaaaccttcaattgatcctttctacaatgctcctgaaggtttcaaaaatgctactgttggagatatcttacaatttagaaaaactccaaaatcaatcactggtgggtttgttccgctcaatgtccaaaattcatggcaatttttagttagatccgaggattcatttggtaatccaaatgtcattgtcactactgttattgaaccagtcaacgctgatccatccaagattgcttcctaccaggtttctgaaaacgctgctagagctgattgtgccccatcgtatgcccttcaatttggctctgatgtaagtactttagccacccaggctgaaacgtatttattggcaccattgttggacaaaggatattatgttgtgtctcctgattatgaaggacctaaactgacattcactgtcggtaaacaatctggccaagctgtgttgaactccattcgcgcaagtttgaagtcaggaaaaatcactaatattgctgaagatgccaaagttttaatgtgggggtattctggtggatcattagcttcgggatgggcagctgctttacaaccagactatgcacctgaattgagtagaaatttgttgggtgttgctttaggtggatttattactaacgtcaccgctacagtagaagctactgatgatactatctttgctggaactgcagctaatgttttgggtggtatcgcaaacgaatatccagagttcaaatcaatcttgcaaaatgataccaataaactgtcgatattcaataaaatcaacaatcactgcttgacagatagctttataaagtatgtgggagctagatttttaactggtgacaacaaggttttcaaatctggttggaacatcttcaaaaacttggtagtgtctaagatcgttaaagataacggattggtgtatcaaaaacaattaattcctacaatacctgtgttcatctaccacggttcaatggatcaaatttctccaattttgaatccaaagaaaacttatcaaaattggtgtgatgctggtatttcctctatagaatttgctgaagatttgacaaatggacactttactgaatccattgttggtgctcctgctgctttgacttggattatcgacagattttctaacaaaccacccgtagatggctgtcaacatgttgtgagaactaccaactatgaatacccaaacgtttcctcttcaatacttgactattttaaggcagcaatggatgtcgttgcacaacaagggcttggtcctaatattcaaaaggatcaacttgaaattaaaagtaatttataaattgctggtcaagctcttcctcttttttttgtatactaagtaaacttttttatagctcaaatttgttcgaaatatatgttttaggaataaatatatcttctttcccattataatcttagtatatagcctttaatgagacatctcaatttggaaaaaattggtttcattgtggttgcgaga

SEQ ID NO: 1381 - protein, 453 aa, Candida albicans
MLYLILFLIAPIYAGVLLPTKPSIDPFYNAPEGFKNATVGDILQFRKTPKSITGGFVPLNVQNSWQFLVRSEDSFGNPNVIVTTVIEPVNADPSKIASYQVSENAARADCAPSYALQFGSDVSTLATQAETYLLAPLLDKGYYVVSPDYEGPKSTFTVGKQSGQAVLNSIRASLKSGKITNIAEDAKVLMWGYSGGSLASGWAAALQPDYAPELSRNLLGVALGGFITNVTATVEATDDTIFAGTAANVLGGIANEYPEFKSILQNDTNKSSIFNKINNHCLTDSFIKYVGARFLTGDNKVFKSGWNIFKNLVVSKIVKDNGLVYQKQLIPTIPVFIYHGSMDQISPILNPKKTYQNWCDAGISSIEFAEDLTNGHFTESIVGAPAALTWIIDRFSNKPPVDGCQHVVRTTNYEYPNVSSSILDYFKAAMDVVAQQGLGPNIQKDQLEIKSNL

SEQ ID NO: 1382 - DNA, 1915 bp, Candida albicans
aggtagaaacttttcagcgataccgatttctaaaaatgccaaaatgtcattcaatagcagattcaagagtacaaatacaaagctcttatcgattttgactttcttccattgtcatgaacttttggtgttttaatttacccccccaaaatttcatagcttgattaatttaaatagaaacagtatcttaatttcacacccacttcttttgaacagcctcagccattcactcccattcattccaagtataaaaacatagaagagcccatcaaaaggtttctctctttttcatttccctctactttctttccatacgtttcaatatctcagttcatgaaaaccttgttaatattccttgcttttttatcaagcatttttgcttccttgataggattgacgccacccagcaaagactcattttattcacctcccgttgggtttgcaactgctaagccaggtgatatcttaaaaattagaaacactcccagtgctcctagtagtttatatttacccattgttgttaaaaacgcttggcaacttttaatcagatccgaagactcttttggaaatccaaatgcttttgttgctacccttattcaaccattgaatgcaaacccttcaaaactagtttcttatcaaagttgggaagatgcctctcatattgactgctcaccttcatacgggatgcaattcaagtctccagctacaacagtgactactcaaattgatatgacactaattgtccctctattacagaacggctattatgttattatccctgattatgagggtccaaaatctacattcacagtaggtagacagtctgggaaggcaactctaaactcaatcagggcagcattacaaacgggagccttctcagggattaaaaaaactgccaaagttgctttgtggggatactctggtgggtctttggctactggctgggcaataagtttacagctgaaatatgccccagagttgaaggaaaatttaataggtgctgctgttggtggatttgctactaatattactgctgtggctgaagctgttgatggaactgtgttttctggatttataccacttgctttgaatgggttggcaaacgaatatcccgatttcaaaaagagattgtatggtgaagttaagctcagtgctagatctactatggaaaaaggatcacaaaattgcttggctgcttcgcttgttggttatccgatgagtcaatactttactgggcaaaacagggcttttgaaaaagggtggggacttttacaagatgaagtttttaacaaaaccattgaagacaacttgttgttaaaattggacaaaacctatttaccccaagtccctgttttgatttatcatggaaccatagatgagattattcccattaaagatgccaatgctcaatatcagatttggtgtgacaggggaatccagtcactagaatttgctgaagatttgctggcaggtcatttagcagaaacatttactggggcccctgctgctttgtcatggattgacgcaagattttctggcaaacctgctgttaatggatgtcaacgtacaatcaggtcttcaaacgtgttatacccgggtatttcaattacaattcgaatttactttgagggtatttctaaaacaattttcggggttaacttaggatcgggagttaacgctgataaatctattagcaataaatttttcgcttatattagaaaatatatttaaaatgacctccagattttagctgaggacaaacaaattaattgaacaaaagatctgtaatttctctttttagataattttgtacttgattttgaatatactttattggtattaaatattttgtagaaggaatttttagtttacaatgaagatagtgaaaaaccccgcaatttatgaaactacaattact

SEQ ID NO: 1383 - protein, 465 aa, Candida albicans
MKTLLIFLAFLSSIFASLIGLTPPSKDSFYSPPVGFATAKPGDILKIRNTPSAPSSLYLPIVVKNAWQLLIRSEDSFGNPNAFVATLIQPLNANPSKLVSYQSWEDASHIDCSPSYGMQFKSPATTVTTQIDMTLIVPLLQNGYYVIIPDYEGPKSTFTVGRQSGKATLNSIRAALQTGAFSGIKKTAKVALWGYSGGSLATGWAISLQSKYAPELKENLIGAAVGGFATNITAVAEAVDGTVFSGFIPLALNGLANEYPDFKKRLYGEVKLSARSTMEKGSQNCLAASLVGYPMSQYFTGQNRAFEKGWGLLQDEVFNKTIEDNLLLKLDKTYLPQVPVLIYHGTIDEIIPIKDANAQYQIWCDRGIQSLEFAEDLSAGHLAETFTGAPAALSWIDARFSGKPAVNGCQRTIRSSNVLYPGISITIRIYFEGISKTIFGVNLGSGVNADKSISNKFFAYIRKYI

SEQ ID NO: 1384 - DNA, 1961 bp, Candida albicans
ctcctcacccatgttttgttagctgccaggattatattccttttccgttgattcaaaattagtccaatttagtcagaaatctccttttgattatggatatccgaaacttaaaaaccaaatgtcttccgattccgccacttcattaacctaaaaaggaaaattcttgtcatcaccttctcatgtcactgtaccttgttttaaaaaaacactaatttcggttttgacaagatctgtcgagtaaaaataaacttcaccatataaatagatacaatattggacaagattttaaaacctagatttataaagtttaatcaaacaatccatttccatcaacttcacccctccttccaccatcaccaacaataatgagaggtattgctgttttccttgctttcatatcattaatattcgcctcccccttgactgtaaagtcaccccttgtggacgacttctatactgctcctgatgggtatgagtcagctaaattgggagaaatcttaaagttgagaaaaactcccagtaaactcagtagtatgttttttgaaatcgatattaagaactcctggcagcttttagttagatctgaagattcatttggaaatgcaacagcaattgttaccacagttatcgaaccatacaacgctgacccatccaaagtcctttcttatcaaacttttgaagattctgcaaatattgaatgttcaccttcttacggtatgcaatatggtgccccttggtcaactgtggctactcaaattgatatggctttaatggtacctatgttgaagcaaggttattacgttgtcagtcctgattatgagggaccaaaatccacatttactgttggtagacaatctgggaaagccactttagattccattagagctattctaaaatccaacaaattcactgggatcaagagtgatgcaaaagtcgccatgtggggatactctggtggttcattagcttctggttgggctgctgcattacaacctaagtatgctccagaattgaagaaaaatttgattggtgctgcccttggtgggtttgtcactaatattactgccactgccgaagcaaccgatggtacattatttgcgggattggttccaaatgccttgagtgggttagctaatgagtatcccgaattcaaagaaatactttaccaaaaagtctccaaagctgctactgacaatttgcgtcaaggtactgaacattgtattggaggtgctattctttactttgctgaagaccaatacttcactggcgatgatagagctttccctggaggttatggattacttaaagaagaggtggtgaacaagactattctggaaaacaatttgatgcaaatggataaagattatttaccagatattccaatttttgtataccatggtgcattggattccattgttccaatcagtaacgtccatgtcacttataaaaattggtgtgattgggggatcaactcatttgaattttctgaggatttattaaatggccatatcaccgaaactattgttggggccccggcagctataacatggttagaagcaagatttgacggtgaaccagtcgtcaagggatgcaaaaagacttccagaatcaccaacttttcttatccaaacatttctgattctactagtagtatcttcgaagggattctcaattctgttactggttccgaattgggtccaggtgtcacctctgataacataacgttggatggattaaccggattcttggggaactttattgacttaaaatagatgacaaacaagaaaaaaaaaaaaaccctacttacagccaaacctaatcatatccaccacctacaaatttatttattttcgttgccctttttcaatttctttacataccataattctaactttaaaagtgatttaattttaaatacatatatacaagttaacttaccataaaactaacatttctataaa

SEQ ID NO: 1385 - protein, 468 aa, Candida albicans
MRGIAVFLAFISLIFASPLTVKSPLVDDFYTAPDGYESAKLGEILKLRKTPSKLSSMFFEIDIKNSWQLLVRSEDSFGNATAIVTTVIEPYNADPSKVLSYQTFEDSANIECSPSYGMQYGAPWSTVATQIDMALMVPMLKQGYYVVSPDYEGPKSTFTVGRQSGKATLDSIRAILKSNKFTGIKSDAKVAMWGYSGGSLASGWAAALQPKYAPELKKNLIGAALGGFVTNITATAEATDGTLFAGLVPNALSGLANEYPEFKEILYQKVSKAATDNLRQGTEHCIGGAILYFAEDQYFTGDDRAFPGGYGLLKEEVVNKTISENNLMQMDKDYLPDIPIFVYHGALDSIVPISNVHVTYKNWCDWGINSFEFSEDLLNGHITETIVGAPAAITWLEARFDGEPVVKGCKKTSRITNFSYPNISDSTSSIFEGILNSVTGSELGPGVTSDNITLDGLTGFLGNFIDLK

SEQ ID NO: 1386 - DNA, 1978 bp, Candida albicans
aggaacaaccttgtacttaaagtttgtaaaaagtttatgttgatatattttttggttttggttctttaaagttattattagagaggggggagagcctaccatccgtctctccacttttaaacgtttcatggattgtttagacgacatcaaagcccattatcagatacacattaacccaagaaggaagttttcatgtatttatcttccccttgtacctttatttttagttaagggcttgttccttatgaaaaatgaatataaatagatcagattggcccccatgtcaagacataaattgatattattgctctttcttattcctcactactatcaacaaatcatcggttgctgcaatatatatttcctcaatgaaaggtttggttttcttacttggtttattaccaacaatctatgcttctttagtacacattactcctgctagtgaagatgacttttataatcctcctgctggtttcgaatctgccaagaatggtgatattttgaaattgagaaattcccctaacagacttgctagtttctatttccctattgatgtcaagaatgcttggcaactcttggtcaaatctgaagattcctttggtaacccaaatgcttttgttactacgcttattgaaccttataatgctgatccatcaaaagttgtgtcttatcaaacttgggaagatgcttccaacattaactgttccccatcctacggtgctcaatttggttctccattgagtactattactacccaaattgacatgactttgattgttcctcctttaagaagtggttactacgttgtcactccagattatgaaggtccaaaggctacatttgctgtgggaagacaatcaggacaagcaactttggattcagttagagctattttgaaatcaggatctttctctggtatcaatgaagatgctaaagttgccttatggggatactctggtggatctttggctactggttgggctgctgctttgcaaccagtctatgctccagagttgcaaaagaatattgttggtgctgctgttggtgggtttgctgctaacatcactgctattgctgaatctgttgatggtactattttctctggtttgatcactcttgcattgaatggtttagctaatgaatacccagacttgaaaacagcattctacgaagaactttccgactttgctgttccagaattcaaagccggtgctgaaaattgtttggctgaaaatatcttccattacccattacatcaatatttcactggtccaaagagagcttttgaaaaaggttggggattgcttaaagaggatattttcaacaaatctatccaagacaatttgttaattggtttgaataagacttacttgcctcaagtccctgttttgatttatcatggaactgttgatgaaattatcccaattaaagatccacatgctcaataccaactttggtgtgactggggtattgaatctcttgagtttgctgaagatttgctgactggtcatttggctgagacatttactggggctcctgctgccttggcctggattgatgcaagatttgatggtaaaactccaatccaaggatgtctgcacacaaccagattgacaaatcttttgtatccaaatacttctgattctactcacctgtacttccttggtatttaccaagcagttttcggtaccccattaggaccaggtatcaatggtgataacattactattaatagtggattacttggtcttgtaagcagtattatttaagattagactgctgatacccagttgattgttaatataattgcaatccatcaacatctttttatatttccaccaattatttatctacaaattgtgttctgtttcggtgataaaactaatttaataactttctataaaaaaaaactaatatcacattctcttttctataaaggaagcattataatggaacaaatccagatattcaacttcta

SEQ ID NO: 1387 - protein, 466 aa, Candida albicans
MKGLVFLLGLLPTIYASLVHITPASEDDFYNPPAGFESAKNGDILKLRNSPNRLASFYFPIDVKNAWQLLVKSEDSFGNPNAFVTTLIEPYNADPSKVVSYQTWEDASNINCSPSYGAQFGSPLSTITTQIDMTLIVPPLRSGYYVVTPDYEGPKATFAVGRQSGQATLDSVRAILKSGSFSGINEDAKVALWGYSGGSLATGWAAALQPVYAPELQKNIVGAAVGGFAANITAIAESVDGTIFSGLITLALNGLANEYPDLKTAFYEELSDFAVPEFKAGAENCLAENIFHYPLHQYFTGPKRAFEKGWGLLKEDIFNKSIQDNLLIGLNKTYLPQVPVLIYHGTVDEIIPIKDPHAQYQLWCDWGIESLEFAEDLSTGHLAETFTGAPAALAWIDARFDGKTPIQGCSHTTRLTNLLYPNTSDSTHSYFLGIYQAVFGTPLGPGINGDNITINSGLLGLVSSII

SEQ ID NO: 1388 - DNA, 2200 bp, Emericella nidulans
atgcggcatttcaaattagcatttccctggttagcccatctggctatcggaagccttcttctgcctctccaaagctccgcataccagtcgaatcccacacccatagtgaccctatccaatggccccaagagcagtactaccttcattggccgttccctccccgagttcgaccaagagctgttcctcggaatcaagtacgcagacaaaccagtacgcttcacgccttcgtctttgaaaacggtctacgcgtctaatgacagtgattcggggcctattcgtcactcgtctgtttctacacgtgggactgtgctttacaatgccactcaatatgggtatgactgtcctggctatgggtctgatacgacgacactgctgaacatgggcttaattgaaatgaatgaggactgtctcaatttgaatgtcatccggccgagaaggcatggagatgaagagttactgcctgtcttagtgtggatattcgggggcgggtggcagcagggtgctacggccgatccgaggtatgtattgacgatttgtgtggcagcggatcgatgtctgatatgaatggaaaggtataacatgacgtatataacccgacaggcagcattgaatggcaggcctattctgggcgtctctatcagttaccgtcttgctgcatttggttttttggattcggaggaggttcgggtacgtcttgttttcgttttcacgctatccagttggcaagcctgacactcattttaggcatctgggaacaacaatcttgggctgctagaccagcgggttgccatgcgctggatcaagaagaacattgaggccttcgggggtgacccgaccaagatcacgatctggggcgagtcagcgtgcgtatgccatgttaccagttactgataattgatgctgaccgacagcagaggagcatatagtgtcggtgcacatcttgtcgccaacgatggtaataatgaggggttatttagagcaggtacatgcttcccgttcagtgcaggcgaaggaacaaataatgaccaagaacagcaatcatggagtccggaaacgcagtcggcccaccctggaacggcacagactggcatcagccgatgtatgataggatagtggatgcagcagggtacgctcgatacatgaattgctaggagtatctgctaaccaacctagatgctcaacctcttcagataccctccaatgtctccgcgaagtacccttcgacacactttacggtgtcgcctacgaaggcttagaatggttcgccgctgttgacggtaaattcatcaaggaatatccccagattagcactacggaaggacgtctcgccaaagttcctatccttctcggatcaaatacagacgagggagtcagctttgggactacgggtgttgatacggatgaagattgcgttgcgcagcttgtttgtatgcttctttgcctccccctactatccgttatatgaggataacactgatgaggctaactagcatccaaacgatgggtcctaacaacggagcaagcagcaaaactcatagcttattacccggatgatccaatcggatccccctacggctggggcaatgtaacctggcctgagaaggggctaatgtacaaacggtactcgtccatggccggtgatatcaccatggctgcgccgcgacggctcctagcaaaaactatggcaaagtacgagcagcctgtttactcgtatcggtgggatgtcgcggctctgaacgcaacgaatactattggggtgaaccattttgctgaggtgcgctgctgcgaagctggcaatgttctgactttcagttcagccaagtagattagttgcacggggcaatgctgactgggcacttaatagatcccatttgttttcgcgaatccagtccagaatatcacgaaactgggggatgacccttctcgtttggaactagcgaatctagcagcacgcatgtgggcttcttttgtgacggatctggatccgaatgggcatggcagtacgtatacatcgatctgtgtaatttttgcaaggttaccctaaccctaagcagttgttgatatcccagaatggccgcaatattcgacctcggtcagcccgtcgaatttcgttttccgtcttcccaggaacgaaagctatattgaggctgatgattatcgggtcgatggtattgcgtatataaatactattccgcggtag

SEQ ID NO: 1389 - protein, 230 aa, Emericella nidulans
MRHFKLAFPWLAHLAIGSLLLPLQSSAYQSNPTPIVTLSNGPKSSTTFIGRSLPEFDQELFLGIKYADKPVRFTPSSLKTVYASNDSDSGPIRHSSVSTRGTVLYNATQYGYDCPGYGSDTTTLLNMGLIEMNEDCLNLNVIRPRRHGDEELLPVLVWIFGGGWQQGATADPRYVLTICVAADRCLIAALNGRPILGVSISYRLAAFGFLDSEEVRVRLVFVFTLSSWQA

SEQ ID NO: 1390 - DNA, 1166 bp, Gibberella zeae
atgcgtctcctgtcactcctctcagttgtcacccttgcagtagccagccctctgagcgttgaagaatacgccaaggctctcgatgaacgaggtacacacgatcatcattcctataacaaactccatactcacaaagtctctagctgtctctgtctccaccaccgactttggcaacttcaagttctacatccagcacggcgccgcagcatactgcaactccgaagccccggccggtgcaaaggtcacctgcagcggaaacggctgtccaactgttcagtccaacggtgctaccatcgtggcatccttcacgtaagtcccacccggcacaaacccatcaccaactccaagcttacacgttttctctcagtggatccaagactggaattggcggctacgtcgctacagaccctacacgcaaggagatcgtcgtctcgttccgtggtagcatcaacatccgcaactggcttaccaacctcgacttcgaccaggacgactgcagcctgacctcgggctgtggtgttcactcaggcttccagaatgcctggaacgagatctcagccgcagcaaccgccgctgtcgcaaaggcccgcaaggcaaacccttcgttcaaggtcgtctccgtaggtcactccctgggtggtgctgtagctacactggcaggcgcgaatctgcgagttggtggaacaccccttgacatctacacctacggttcaccccgagttggaaacacacagctcgctgcctttgtctcgaaccaggctggtggagagttccgcgttacgaacgccaaggaccccgtgcctcgtctcccccctctgatctttggataccgacacacatcccccgagtactggctgtctggcagcggaggtgacaagatcgactacaccatcaacgatgtcaaggtctgtgagggtgccgccaacctccagtgcaacggtggaacactcggattggatatcgatgcccatctccactacttccaggcaaccgatgcttgctctgctggcggcatctcgtggagaagatacaggagtgccaagcgtgagagcatctcagagagggctaccatgaccgatgctgagctcgagaagaagcttaacagctatgttgagatggataaggagtatatcaagactcatgccaggccgctcatcatagtatga

SEQ ID NO: 1391 - protein, 351 aa, Gibberella zeae
MRLLSLLSVVTLAVASPLSVEEYAKALDERAVSVSTTDFGNFKFYIQHGAAAYCNSEAPAGAKVTCSGNGCPTVQSNGATIVASFTGSKTGIGGYVATDPTRKEIVVSFRGSINIRNWLTNLDFDQDDCSLTSGCGVHSGFQNAWNEISAAATAAVAKARKANPSFKVVSVGHSLGGAVATLAGANLRVGGTPLDIYTYGSPRVGNTQLAAFVSNQAGGEFRVTNAKDPVPRLPPLIFGYRHTSPEYWLSGSGGDKIDYTINDVKVCEGAANLQCNGGTLGLDIDAHLHYFQATDACSAGGISWRRYRSAKRESISERATMTDAELEKKLNSYVEMDKEYIKTHARPLIIV

SEQ ID NO: 1392 - DNA, 1548 bp, KURTZMANOMYCES SP. I-11
gtccctgccactgcctctagtacctcctcgagtccatatcctgcgatgcgcttcttccttcgagccgtgctcggactggcggtcacagcgactgcagcactcgctgcccccctggagcctagagccgcactcccggatccaaatgaagatccgttttactcgacaccgtccaatatcgagacgttcgccaacggtcaaatcatccagtcgcgcaaggttcccaccgacattggcaactcgaacaatgccgcttcgtaccagctgtcgtaccgcaccacaaacacacaagaggatgctgttgctaacgttgctaccatctggatcccggccaagccatcgtcaccgccacgtatcttcacttatcaggtttacgaggactcgacccaactcgattgtgcacctagctacagctaccttactggatacgatcagcccaacaaggcaacggctgttctcgacactccgatcgtcatcagctgggccttgcaacagggctattatgtggtctctgcagaccatgaaggagcccgctctgccttcatcgctggctacgaagaaggcatggcggcccttgacggtattcgtgcgctcagaaattacgcaaaactaccacaggacagcgctgtcggagcctacggctattctggaggagcccatgctaccgtttgggcaacttccttggctgctgcctatgctcctgagatcaacttcatcggtgctgctcatggtggaacacccgttagcgcgaaggataccttcactttcatcaacggcggtttcttcgctgggtttgccattgctggtgtctcaggtttggccaacgctcaccctgatatggaagccttcatccagccccgtctgaacgctgagggtgtcaaaacactcaaacagatccgaagccgaggcttctgccttcccgaggtggtcactacttatcctttcaagaacgtcttcgccctggtcaatgacacgaacctgctcactgagcagcccatctccggcatcttgcagcaagagacgcttgttcaatcggaggcgagctacgctgtacctgtccctaagtttccccgcttcttgtggcatgctgctctcgacgagatcgtcccctacgtacctgtcaccgagtatgtcaaagaacagtgtgccaagggcgccaacatcaacttcaacacctacccgatcgccgagcatctcactgccgaaatcttcggtctcgttccaggtctttggttcttgagccaggcttacgagggcaaggcaccggcggttcagtgcggaactgcacttcctgcggctccttctgctcaacaggtacttggaaacgacttggccaaccaattgagcagcctcaacggcaagcaatctccgtttggcaagccattcggccccataagcccgacttcgcttgacaagttgctgtagagtcaccaatatcagagccggcgcaataactctccaggaatccattacctcccctgtcacttcaagtctcagtattgtaacatcgaattatcctctagtctcgagctgacccacatcccgaaaccg

SEQ ID NO: 1393 - protein, 458 aa, KURTZMANOMYCES SP. I-11
MRFFLRAVLGLAVTATAALAAPLEPRAALPDPNEDPFYSTPSNIETFANGQIIQSRKVPTDIGNSNNAASYQLSYRTTNTQEDAVANVATIWIPAKPSSPPRIFTYQVYEDSTQLDCAPSYSYLTGYDQPNKATAVLDTPIVISWALQQGYYVVSADHEGARSAFIAGYEEGMAALDGIRALRNYAKLPQDSAVGAYGYSGGAHATVWATSLAAAYAPEINFIGAAHGGTPVSAKDTFTFINGGFFAGFAIAGVSGLANAHPDMEAFIQPRLNAEGVKTLKQIRSRGFCLPEVVTTYPFKNVFALVNDTNLLTEQPISGILQQETLVQSEASYAVPVPKFPRFLWHAALDEIVPYVPVTEYVKEQCAKGANINFNTYPIAEHLTAEIFGLVPGLWFLSQAYEGKAPAVQCGTALPAAPSAQQVLGNDLANQLSSLNGKQSPFGKPFGPISPTSLDKLL

SEQ ID NO: 1394 - DNA, 2981 bp, CANDIDA DEFORMANS
ctcactttgaagataccgacacattggtctcagttgatgcgatgacatacagcacggtaagctgattctgcaactcggccaaattgcagcctaggctcgagcccccttgtacggcccgcattgcttattcgtatgagaggcatgagagggcatacgtcttatctatagccactggtaataatgatacctgtacaggtgggggtgttgagactaggactctgaggtataagcacgttttcaatcatttcattgataggggtaggttatagctaagattgccaatctgactccctacagtgcttgagtctcaaacttctttggagattttaaaccacctccactggacttggcaaatcaactctatgccggaaagagagaagagagtactgtcctgctggtcgtattcgttaaagatagatttcagatcaccatttcaaagtggttcggtttcttcttatcggacgatatccgtctcgccgacgtttctttttcggtcgctcttccgctctgccgctcggaataactgtggatcctcggccgttgtacagggctcatcaacctaaaagttttgccggtccgtatctttgggtgggcatggcggacatgtgttttgaagctaatgtgacgaggtaaactgacaagcaaacggatgcaggcaccctgtaactgcagacccggttctgtgtacaaggcctgtgtacagactcttgttctccgctgcagagatgttgtgctacatagcttcttgacgagacggtattataggttcagatacgtacaagtagttagtcctgaagatcaggcactagaagggatatagactcatagtgcctgcctggctgctgttacagaatctgacagatttgcttcttgtggttacacgactgccagaagaaatatcaagacgccaaacaaactcgagacgcggaacccaatatcattccaccctgagcttgttcgcctccagagtatcgggtgcttcttgaacatacaacaaggtggagttattcctgcaagggaaatcagtcacaagggcccaaaatctcaccagaagactagtcggcccttttccatgcgacagatgtcatgtcacagcttgttattagcaacccacacaagcccatcccctgaccaattaacccttcaaacggcttcatccgcatctgcagcttgttcagtttggagtggggatggtagacttcattgcagggtgcccaactttctcttttgcttctctgagatgctattacatcgtccgcattgaaactgagagctcacactcggtatcagctcgacttctcgacgacgtttctcgacgacgtttctaaattcattttagacatcgtcgatcaccaaacactatctcgctgtctaagcgacggcttttgatcgtcgtgagcggcgcagacctcatgcaatatgcacaagggccaagtccattgcgggtcgcttagctatgcagtcggagccttcaggtgggggggctccgatatgacacggatctgtgttgtacaatggaagttcaggactataaaagggcattgaaagaccctctgttgatacccaagcaccagctctcctcactatgaagctttctaccattctccttacagcttgcgctactctggtggccgctctcccctcccccgtcactccttctgaggccgcagccctccagaagcgagtctacacttcaaccgagacttctcacattaaccaggactcctacaacttctttgagaagtacgcccgtctggccaacattggatactgtgttggtcccggtaccaagatcttcaagcccttcaactgtggtctccagtgtgctcacttccccaatgttgagctcatccaggagttccatgatcctcggctcgtctttgatgtctctggctacctcgctgtggaccacacctcgaagcagatctacctggtgatccgaggaacccattctcttgaggatgtcatcaccgacatccgaatcctgcaggctcctctcaccaactttgatttcgctgccaacatctcttctactgctacttgtgatgattgtcttgtccacaaaggtttcatcgagtcttacaacaacaccttcaaccagattggccccaagcttgactctgtgattgctgagcaccccgactacgagattgccgtcaccggtcactctctcggcggtgctgctgcccttctcttcggaatcaacctcaaggttaacggccacgatcctcttgttgttactctgggtcagcccattgtcggtaacgccggcttcgccaactgggtcgacagactcttctttggtgaggagaaccccgacgtttccaaggtgaccaaggaccgaaagctctaccgaatcactcatcgaggagatattgtgccccagatccccttctgggacggttaccagcactgttctggtgaggtcttcatcgactggccccttatccaccctcctctctccaacgttgtcacgtgtgagggccagagaaacaagcagtgctctgccggtaacactttgctccagcaagccaacgttcttggaaaccatctgcagtacttcgtcacccagggtgtctgtggtatttaagctatttaacgcctttcagcttcccataactacactcaactctttacgtaataaatgaacattatatcttctctatgcaattaatacgctgtgggtaggcgatcttctaggacagatcaaatccagcgtgagaccgaatggcatataaaagcttcttccgaagctgatcaatgtcttggtagtcaggcaacttgaggaggttgacacatgtggaggcggttgggaaccggtcaacctgtcgaccggcgtttcgaatagcaaacgacgggttcaacgccttgaatccttgcaatggtgcctttgagactgacgtcacaaacttcaggaacagtcgcttgtcctcctcctcgagactctcaaacacagtccagaaatccttgactgtctgatc

SEQ ID NO: 1395 - protein, 334 aa, CANDIDA DEFORMANS
MKLSTILLTACATLVAALPSPVTPSEAAALQKRVYTSTETSHINQDSYNFFEKYARLANIGYCVGPGTKIFKPFNCGLQCAHFPNVELIQEFHDPRLVFDVSGYLAVDHTSKQIYLVIRGTHSLEDVITDIRILQAPLTNFDFAANISSTATCDDCLVHKGFIESYNNTFNQIGPKLDSVIAEHPDYEIAVTGHSLGGAAALLFGINLKVNGHDPLVVTLGQPIVGNAGFANWVDRLFFGEENPDVSKVTKDRKLYRITHRGDIVPQIPFWDGYQHCSGEVFIDWPLIHPPLSNVVTCEGQRNKQCSAGNTLLQQANVLGNHLQYFVTQGVCGI

SEQ ID NO: 1396 - DNA, 2889 bp, CANDIDA DEFORMANS
gtaaaggtgtgctacaagtacttgtacaaattgaggtaggtagacacgatttcatctaaatccgtccagagtcctggactcgcagtctaaacgttattggacagggaaacaagcaaccaacggaagatttgtgggcgcgccgtggcattggagattgggttgacgctgtttcacccctgctggaaagagatctagtttacttcatggtgtggggaagacagtagtatagagtagagtagtgccacgaaagaatcacgtgaatgggtgtggtggtgtacgacttgctgcgacttggttggaaagataattggagacggttggtgatgtcttgaagaccacttccatctgccaagaaagtgtatcatgttcggacccttggcagatggaatagatagtcgtattaagggaggttggtcagttgaagaaaaatcgacggatgcaaacacccccgacgcgttcttttagcggttcatactagggctatacaagggtgtactattgtgtacatcccgtggtgtgccttggatgtaatgataactgtgattagctaatttagtggcactgtgatgattagtagaaacacccaataatcacgtggaaaaaaaaggagtcatcttgattaagtcagttgaccacggagaatccgatggtgaagtccccgaggcgattaggggtgttttgggtgagtttttgcatatttgacggaactagaccactcgttcagattctccaaacacaccgttctacgaacagtgctctccaagaaatataccaaaaaggtgatacaggggcgcggtctagacatttcgcatccgaaaccgttcacactattttagccggtattgtagtgctggtttggtctggtcatgacaataacactggttcccctctttggcaagtgatggtatttatatagcagaagccgtaacaactccagcacactcattcaaaaccaccccctcaacatggtcaactttggagctcggatcaaggacttcttttcggtgctgctctttggagcagcttctacctcctcctcctctaagacagctctcgtctctcagggcttctatgacgcagctctggacttttcgcacctgtccaacgtggcctactgcgttcatgctccaattactccgttgaaagacgacttttcctgtggccagtcgtgtgtgcattttcccgatatggagctggttaccacgtttggaggtgatcagttctcgacgtccattaccggctacctggctctggatcacgtgaagaaggaaaagtacgtggttttccgcggcacgttttccattcccgacgctatcacggatattcggttccagcagtcgtcctttctcgtcaacgtgcctgctctcaacacgtttgcacccaacgacccttctggcgaggcccagatcgactgcaaggagtgcaaaatccacgacggcttttcgcgagccttcaccgagaccctccataacattggacccgtgctccagcagcatctcgattcatatccggagtaccagctctatgtcacaggacactctctgggagctgccatggctctgttggcaggcacatccatcaagctacagggctacgatcccattgtgatcaactacggacagccccgggtcggaaacagggcgtttgcagactacatttcgaccctatggttcggtaacggagacgggctggaaatcaaccgacaacgacgaatgtatcgaatgacccattggaatgatgtctttgtgggtctgcccaattgggacgggtatactcattccagtggagaagtgtacattaagggcaagtgggttaatccagctctgagagatgtcttttcctgtgctggaggagagaacccggaatgttaccggtcgactttcaatttgttggcccagatcaatttgctgcagaaccatttgtgctacattgattacattggattctgtgctctcaatgtgggaaggagagaggtcaacgaactacagacggatctgcctagttataccggtccgtatcggtacggaaataagacggaggaggattttgtcagggaggggttggagttggcgcagtgagtgcgaaatacgaactgcgagatgataccactcgagcaagatactgacctctaaccctcttttagactgatctcgaacaacccttccaattaatacactaactgatatagtctgtgagagtatgtaattgtgtagtagccgtgtatttttccagcagcccatcaaaaatgattatgagatagacaccaatccagaacttgcatcaaccgtagttttgttgaccgagcagtggtgggtcgaaaaaagaaaaaagcaaaagaaacatataaaatagttctgtggacggagtggttttgactctatcatgtctctccaagctggtgatcatggtggttgagctatttgttaaatggtgtgtgtactattgaggttagctcggttattgtgattaacgcggttaatcctatgattaagtaattcacacgatcacgtgattcctaccaactactgcaacaccttcgatcgccaaaaccatttcatgtgtgcagtctatggtcctccttaatcatcaattttttaaatgcagaacgtgtagcatttttcgggcgccttttccaggcatctgtactgagccagatcttgatggatgctcctgatttgtagccattctatcattcaagtgtccgctacaggttggacaaggactgactggtacttgtagcttgaggtcagttcctcgcgtgtaaaaaaaagccaaagaaaatacaagtagaaatacgtcttttggtctcaatttgtttccctctggtgtgctctttgacctattagaatcgtagcctagaggtgtcaaaaggaagcttagagacagctc

SEQ ID NO: 1397 - protein, 370 aa, CANDIDA DEFORMANS
MVNFGARIKDFFSVLLFGAASTSSSSKTALVSQGFYDAALDFSHLSNVAYCVHAPITPLKDDFSCGQSCVHFPDMELVTTFGGDQFSTSITGYLALDHVKKEKYVVFRGTFSIPDAITDIRFQQSSFLVNVPALNTFAPNDPSGEAQIDCKECKIHDGFSRAFTETLHNIGPVLQQHLDSYPEYQLYVTGHSLGAAMALLAGTSIKLQGYDPIVINYGQPRVGNRAFADYISTLWFGNGDGLEINRQRRMYRMTHWNDVFVGLPNWDGYTHSSGEVYIKGKWVNPALRDVFSCAGGENPECYRSTFNLLAQINLLQNHLCYIDYIGFCALNVGRREVNELQTDLPSYTGPYRYGNKTEEDFVREGLELAQ

SEQ ID NO: 1398 - DNA, 2845 bp, CANDIDA DEFORMANS
caaccccctcaacaacagtcatatatccaatttatgcgttctgcacatggacctagtgcgtgacgttgagatgcgtctttccgcgaggattctcggtcgaactcggtcaccgtttgttgatctgagacaagagtcgtgtttgtctggcgatattatggggttgcgtgatatgatgccctattgctgtgttaccatttcatttcatttcatttcagccgttcaaccacaacaagccgtccagcgccatccaccattctccaccactagtctatagtctaccgtctcccctcaacgatcccctgtaatgcaacctccaccaccgctggtcgcgaaaaaacaacaagcaaactctcagaacggatgctcacctcgaagtacagctacagctacagctacagacacatgccaagagcttcacgtgctggaatgctggcgggatcactcacgtctttgtttggggtcgttatgacaataatgatacctggaacgtgatctttacatggctgaccttttgaacacactacccatgactagctccacagttagctccaccgatctaagacagggaccaccgtttagccgacggccatttcccgactgccaacgcgcggtcttatccgctaatgcacgtttagatccgccaggaacccacccagtccttgtcaggttgcgtcatgtattggcagagatgtggcggggatcgataacaggagacaaagagcagccaggacgtgaacgctttgaaccgacggtcacaaggtgggtactgcacagatgattggggtataagaaggcgtctgtcgctctcatcaagcttgtctacagccttacagcttctcagccttccttcactctcagccctccatttactctcagccctccattcactctacaacctcgatcacagcctcttactgccatggtaaccctctctgctcgactcaaagacttcttttcggtgcttctgctcggagcagcccagatcaccccgtctacccaaacagcaggcgtgtcccagggcttctatgactttgcgcgcgactttgcccatctttccaacattgcttactgtgtggacgcccccatcactccgctgaatccagacttcacctgcggaaactcgtgcaagtactttccggacattgagctggtcaagacgtttggaggtgacttttttgaaacgtccatcacgggctacctggccgtggaccatgtcaagaaggaaaagtacgtcgtcttccgaggcaccttttctctgggagacgccatcacggactttcagttccagcagtctccctttctagttgatgttcctgccctcaacaccttttctgcaaacgatacttctgccgaggcccagatccaatgtgagggctgcaagatccacgacggcttctccaaggccttcaccgagacctggggcaacattggcgaggatctcaagaaacatctcgactccaacccggactaccagctctacgtgtctggacactctctgggagctgccatgtctcttttgggagccacctcgttcaagctgaagggctacgatcccatcctgatcaactacggccagccccgagttggaaacaaacccttttccgagttcatcaacaagctgtggttcggagacggcaacggtctggaaatcacccccgaacgaagactctaccgaatgactcactggaatgacatctttgtggggctgcccaactgggagggatacacccattccaacggcgaggtttacatcaagaaccggttcatcaacccgccagtcagtgacgtcatctcctgtgccggaggagaaaactcccagtgctaccgatcctcgtttaacatcctgtctcagatcaacctgctccagaaccatctagcgtacattgactacatcggatactgtgctctgaacattggacggcgagagttggctgatcagaaaaagtacacgggtaattattactatgctcatagaaccgaggaggatttcaagaagttgggtttggagctaggtccacgagctgcgaagcagtgagtggataaacgaagcctgacaatccaagtctttcacctaaagtctttcaaccaaagattatcaagccattcaagattggttctgaccacttcttgtcagttaccttttcaacttctataattgtataactaaccaactcatctctttcattctcacatgactacagtagcctataaccaacagcaatacaactcacggttagattagcacaagactgacttaatggttatattaattcccggttatctaacaccccgaatagctcccctcgagatattaagagtcctctacccacatactattcgtacctcgtagatgacgtccatctaatgtaggccatttagatactccaggttctagatggtataaaagcaaacaagctatgcttcttacatcctgagatctgtggaattctaatggtagcaagaatgaccgttttatcgccagtaattgccgtggtaataagtctactccttcaatctatgtcaacggataacccccgaccagttggtcgaaacctagcacaagacaactcctcagggaccgagtcacgtgcaaaaacaagatcacatttctacactgaaatgtggttcttctgattccaacaatactactgaattttcttcctgattgatatagcaaataatacaggacttgccccaactaaagctaagtaaatcaaaacaatttcaaatccagcaattacagcagaaataatacatctttcccaaatttcattaaataaaactgctcacattcacagcaaatcaacaccggtataaatccagtctttgtgagacatctggaaca

SEQ ID NO: 1399 - protein, 371 aa, CANDIDA DEFORMANS
MVTLSARLKDFFSVLLLGAAQITPSTQTAGVSQGFYDFARDFAHLSNIAYCVDAPITPLNPDFTCGNSCKYFPDIELVKTFGGDFFETSITGYLAVDHVKKEKYVVFRGTFSLGDAITDFQFQQSPFLVDVPALNTFSANDTSAEAQIQCEGCKIHDGFSKAFTETWGNIGEDLKKHLDSNPDYQLYVSGHSLGAAMSLLGATSFKLKGYDPILINYGQPRVGNKPFSEFINKLWFGDGNGLEITPERRLYRMTHWNDIFVGLPNWEGYTHSNGEVYIKNRFINPPVSDVISCAGGENSQCYRSSFNILSQINLLQNHLAYIDYIGYCALNIGRRELADQKKYTGNYYYAHRTEEDFKKLGLELGPRAAKQ

SEQ ID NO: 1400 - DNA, 2597 bp, Botryotinia fuckeliana
caccattctgatgtccagtcggcggggtttgcgagatgtcgagctatgagagattaaaagtgattagaaaaaggtcaggtggatgattctgttgtcactgaccgaggaagcacatgttgacgagatagaatttcacaatatttccttctgaaaatgggatacaatggcacactgatgtttgttataatacggagaaagaacgaagtgatggctttccaatttcggtagtctccactcattttcctacttcctttccgaaagagccacattccaattcatcaataatcatgaagctctcgctggtaccgatttttgctcttctgtcaaccgcatttgctcttccagtcgaaaatgccgagcgagatgtaccgattgaagaaagagctgcagccccaacagtgacaattgcatcaccggcagctactatcatcggaggtgctggtgcaactgttgaaacctttgctggtgttccattcgccaaacctcccgttggtgcacttcgacttaaaccacctcaacccatcacctctgcgttggggacaattaaagcaacagcccaagcagcttcttgtcctcagtttttcttcagcactacgattaatgatgcaattcctacatcagcactaggtcttctccttaacacaccagttttccaacaggttctcaacgctggagaagattgtttgtatctgaatattcaaagaccagttggcacaactgcttcatctaaattgccagttttattttggatttttggaggaggattcgaattgggaggaacagcgatgtatgatggatcttcatgggtagcggaaagtattgcagaggggaaaccgatcatttttgtccaagtggcttatagggttggtggatttggatttttacctggagcggaaattttggcggatggtagtgcgaatttgggattgctggatcagagattgggattgcaatggtacgttgtcctgtttaagagttttaattttttactaacaaagtctgtaaagggtcgctgataatatcgctgccttcggtggtgatccatccaaggtaactatctggggagagtcggccggtgcaatttcagtcttcgaccaaatggctttatatggaggcgacaacacatataaaggcaaatcgttattccgtggagccattatgaattccggaagtatagtcccagcagatccagtcgattgtccaaagggacaaattatctacgataacgtcgtagcctcagcaggatgttcggccgcagccaacactctaacttgcttacgaggcgtaccatattctactcttctaaatgcgacaaactctgttcctggtctccttagttattcgtctatcgcactatcttatcttccacgtccagatggtaccgctcttaccaaatcccctgatctcctgctcgcatcaggaaactgggcaaaggtcccctttataattggcgaccaagaagatgaaggaacaatctttgctcttttccaaagcaacatttccacaaccgctcaactcacaacctatttctccgatttctttttccacaacgcacctacctccgttctcaccgggcttcttaacacataccccaatgacttgatctctggctcccctttccgaactctcttgttgaacaattggtatccccaattcaaacgtctagccgccatcctcggtgatctcacattcaccctcacccgtcgtgtattcctcaaaaccgcactgaaagtcgcaccaactgttccctcctggtcttacctctcatcctatgattacggaacccctgttctcggcaccttccatggctcggatattctacaggtcttcaacggtatcaaaccaaactatgcggctagtgctagtaaagcatattatttgagttttgtgaatactttggacccaaacaatgggacaagtagtgcatatgcaaactggccccaatacagcaatggagcgcagttgttgaatttgtatgcgagctttgggggttttataagtgataatttcaggagtacgagctacgattatatagtggctaatttgcccagcttttatatttgagcgtgaaattggttgatgaagaataattattaccaggtagcaaagaaattttggctgggatgaggggtgggatatgagttatgagttatgaggtagaaagcggaattttatctcatttaatgatatagaactatttgcttcaaaattcaaagacaatttctcaaattcataaacaaatattatagcaagtgatcatttcatcacaagattactaacttgatattcattagggcgtgctccaaggagatattaatgaagattatatagaagagggctaatatttatatataaagtttatgcattgtaattgctgtggttgtcttaattaatcttataaaggacgtattagttatgcgatatcacaataccaaaaatgatccttatatgcgaaacaacttacgtcgttcgttagagattatagctgggaatgattggtgataccatgacgtaactcgcttgtgagaaacagaaagttttgcccttgatttacgtcttggattttgtaacatggtgaatgtgaaagattagagaga

SEQ ID NO: 1401 - protein, 574 aa, Botryotinia fuckeliana
MKLSLVPIFALLSTAFALPVENAERDVPIEERAAAPTVTIASPAATIIGGAGATVETFAGVPFAKPPVGALRLKPPQPITSALGTIKATAQAASCPQFFFSTTINDAIPTSALGLLLNTPVFQQVLNAGEDCLYLNIQRPVGTTASSKLPVLFWIFGGGFELGGTAMYDGSSWVAESIAEGKPIIFVQVAYRVGGFGFLPGAEILADGSANLGLLDQRLGLQWVADNIAAFGGDPSKVTIWGESAGAISVFDQMALYGGDNTYKGKSLFRGAIMNSGSIVPADPVDCPKGQIIYDNVVASAGCSAAANTLTCLRGVPYSTLLNATNSVPGLLSYSSIALSYLPRPDGTALTKSPDLLLASGNWAKVPFIIGDQEDEGTIFALFQSNISTTAQLTTYFSDFFFHNAPTSVLTGLLNTYPNDLISGSPFRTLLLNNWYPQFKRLAAILGDLTFTLTRRVFLKTALKVAPTVPSWSYLSSYDYGTPVLGTFHGSDILQVFNGIKPNYAASASKAYYLSFVNTLDPNNGTSSAYANWPQYSNGAQLLNLYASFGGFISDNFRSTSYDYIVANLPSFYI

SEQ ID NO: 1402 - DNA, 1604 bp, PENICILLIUM ALLII
gccattacccctcctctcttgggcgacattccatatgtgggttgtcattgacggtagaaaaggaagtctataaatatgggctaatttcccagagatcaacggaataggcggatttgcaattcagtcgtatacttacaaagtatcattcgacactatacatcattcgctatatctaatatggttgggttaatgatatttcgtgtgcttggagtgctatcactcagcgtggtaatcattgcatctcctgtccaactagcccgccgaggtgagttccgttccacctaaaataaaacacaatgtccaatctaacaatgacgaggcatcagcaatttcaaacgagctactggaacgattcacgctattttctcaattcgccaccctatcggcctgtgatcaaaacatcaaccacacgggccaaagtctgacctgcgactacgacacctgcgaactcgtagcagccgacaacacgacagtaatcaacgcattccacggcgataacggacctacgggctatattgccttagaccacacacggcaactgatcgtcctaacattccgcggcacagtatcgaaaaacgacggcaacacagatctcgatatcgttctcaacccgattgacgacgtgtgcactggatggaaagctcatcgtgggttctgggtttattggagcgccatagcgagtcaggcgacggcccagcttcaagatgcaactggcacatatccgggctacaggctgagcgttgtaggacacagtctgggtgggggtattgcggcgctagcagggactgttcttcgaacacaggggttcactttggatattgtaagtcaagtttcagaacaggacagcagagtagatgctagctaacatataaaaggaatcatcagtggacatttggaggaccgaaaccagggaactcgaagctggctgagttcatcaccaaccaacaaccgccaaacagcatctaccgagccacgcatactacagaccccatcccgaaagtgccgctcaacctgccatttttggattggagccagccttcgcctgaatattggattactcaggagactggggtgcaggtcaccactgatggggtggagtatattgaggggattaatagtagggctgggaatgcttgttcggatcgggatttgagggggccaaatcccgaacatgggtggtattttggaaatatgagcgtttgtgcggatccgtcagatgcatcatcatgataggcattagctgataggcgtgatgccgtgggagagtgttgaggttgtttacctctctggcagcatgtattcagttttaatggagaacgagggagactgcacagctaaagaataagaatgaatatattgttaccgagcctcctgaaacgccatatttacagactcaggcacccccaaatgtaggtaggtagggtgctatcgtattataaacctgcatcgctcaggacatcttagggcgcaggcgcagattcggcccttgcacaaactccagtccggtgtcaatatcaccactgtgagcaaacttcaagtccttcatgtagtgatcacgcggctgccacggtccacggtcagcagctttgggcaagacacgctca

SEQ ID NO: 1403 - protein, 308 aa, PENICILLIUM ALLII
MVGLMIFRVLGVLSLSVVIIASPVQLARRAISNELLERFTLFSQFATLSACDQNINHTGQSLTCDYDTCELVAADNTTVINAFHGDNGPTGYIALDHTRQLIVLTFRGTVSKNDGNTDLDIVLNPIDDVCTGWKAHRGFWVYWSAIASQATAQLQDATGTYPGYRLSVVGHSLGGGIAALAGTVLRTQGFTLDIWTFGGPKPGNSKLAEFITNQQPPNSIYRATHTTDPIPKVPLNLPFLDWSQPSPEYWITQETGVQVTTDGVEYIEGINSRAGNACSDRDLRGPNPEHGWYFGNMSVCADPSDASS

SEQ ID NO: 1404 - DNA, 1665 bp, Aspergillus flavus
ccgctcagatcaacatccttcttgaacatgccgaggctgatttcgtggatttttcgtcagcttaagcaagtggatccgtgtggatggtagtgtgaactgaaccaattcagctcgatccggccaagagcatcgatggtagactattgagatcgcgcatgccatgtctcactattttcagcggaaccacaaacaacccgattgtcggatcagggatatcgattttggcgaagtctgtatacagaatgtaactatttaatgggcgtcgtttccactgtctgctgtcttcatctgttcatgctcacaattgcctcgtctctatccattgagtagaccctgcgaagcacactggcaaagatgcgcttcctctccggcttcgtttctgttctgtcctcagtggccctgttgggttacgcttacccaacggcaattgatgttagaggtactgaatctgcttcatgatctgctggacggacactgactcaatgttaagacatccctactacccagctcgaagacttcaagttctgggtgcaatatgcggctgccacctactgccccaataactacgttgccaaagacggcgaaaagctgaattgctctgtgggcaactgccctgatgtcgaggcggccggttctactgtcaagctcagcttctccgagtaagtcacctgagttcccagtaccgtgacctccaactaacaaccctaacagtgataccatcaccgacactgccggcttcgtggccgtagacaacaccaacaaggccatcgtcgtcgctttccgtggctcctactctatccgcaactgggtcaccgacgcaaccttcccccaaaccgacccaggactgtgcgacggctgcaaggccgaactgggcttctggaccgcctggaaggtcgtccgcgaccgcatcatcaagaccctggatgagctgaagcccgaacacagcgactacaagatcgttgtcgtgggccacagtctcggcgccgccatcgcctcgctcgcagctgcggacctgcgcacgaagaattacgacgcgatcctgtacgcctacgccgcgccgcgtgtggccaacaagcctctggccgagttcatcaccaaccagggcaacaactaccgcttcactcacaatgacgaccccgtgcccaagctgccgctcttgactatgggctacgtgcacatcagccctgaatactatatcaccgcgccggacaacactaccgtcaccgacaaccaagtcaccgttctcgatggatacgtgaacttcaagggaaacaccggcacgagcggcggactgcctgacctccttgcgttccactcgcatgtctggtactttatccacgccgatgcctgcaagggtcctggattgccattgcgctaattcgttaccattttttttggtgaatttcttacatgatttggacggacgatgagatgagtctatgcttcgtactgtataaggtttgatgtggagttgaagcctacgtaaataatttaatatcccctaatctgaaacaaaatttaaatcgaaccaaatttcatcccagtcaaaccttaatcgccataaattctcgtctccacccacagagtaacttaggtacactattaccttcacaacaaaagatgagctaaagaaaactgaagagacccctcctcagcctccaaaaa

SEQ ID NO: 1405 - protein, 306 aa, Aspergillus flavus; identical to SEQ ID NO: 1288

SEQ ID NO: 1406 - DNA, 1654 bp, Aspergillus parasiticus
gccgtttgatcaacatcctgtttgaatatgccgaggctgatttcgtggcatttttcgtcagcttaagcaagtggatccgtgtggatggtagtgtcaactgaaccacttcagctcgatccggccaagagcatcgatggtagactattgagatcgcgcatgccatgtctcacaattttcagcggaaccacaaacccgattgtcggatcagggatatcgattttggcgaagtctgtatacagaatgtaactatttaatgggcgtcgtttccactgtccgctgtcttcgtctgttcattctcacaattgcattgtctctatccattgagtagaccctgcgaagcacattggccaagatgcgcttcctctccggcttcgtttctgttctgtcctcagtggccctgttgggttacgcttacccaacggcaattgatgttagaggtactgagatccgcttcatgatctgctggacgaacactgactcattgttaagacatccctactacccagctcgaagacttcaagttctgggtgcaatatgcggctgccacctactgccccaataactacgttgccaaagacggcgaaaagctgaattgctctgtgggcaactgccctgatgtcgaggcggccgattctactgtcaagctcagcttctccgagtaagtcacctgagttcccagtaccgtgacctccaactaacaaccctaacagtgataccatcaccgacactgccggcttcgtggccgtagacaacaccaacaaggccatcgtcgtcgctttccgtggctcctactctatccgcaactgggtcaccgacgcgacctttccccaaaccgacccaggactgtgcgacggctgcaaggccgaactgggcttctggaccgcctggaaggtcgtccgcgaccgaatcatcaagaccctggatgagctgaagcccgaacacagtgactacaagatcgtcgtcgtcggccacagtctcggcgccgccatcgcctcgctcgcagctgcagacctgcgcaccaagaactacgacgcgatcctgtacgcctacgccgcgccgcgtgtggccaacaagcctctggccgagttcatcaccaaccagggcaacaactaccgtttcactcacaatgacgaccccgtacccaagctgccgctcttgactatgggctacgtgcacatcagccctgaatactatatcaccgctccggataacactaccgtcaccgacaaccaagtcaccgttctcggtggatatgttaacttcgagggcaacaccggcaccagcggcgggctgcctgacctccttgcgttccactcgcatgtctggtactttatccacgccgatgcctgcaagggtcatggattgcccttccgctaatcccctgccattttttggacgaatttcttacacgaagtggacggacgatgagatgattctttgctgtgtactgtataaggtttgatgtggagttgaagcctacgtaaataattaatatcccctaatctgaaacaaaattcaaatcgaaccaaatttcatcccagtcaaaccttaatcgccataaattctcgtctccacctaacttaggtacactattaccttcagaacaaaaaggtgagctgaaaaaaacgaaaaaacccctctacagccaacaaat

SEQ ID NO: 1407 - protein, 306 aa, Aspergillus parasiticus
MRFLSGFVSVLSSVALLGYAYPTAIDVRDIPTTQLEDFKFWVQYAAATYCPNNYVAKDGEKLNCSVGNCPDVEAADSTVKLSFSDDTITDTAGFVAVDNTNKAIVVAFRGSYSIRNWVTDATFPQTDPGLCDGCKAELGFWTAWKVVRDRIIKTLDELKPEHSDYKIVVVGHSLGAAIASLAAADLRTKNYDAILYAYAAPRVANKPLAEFITNQGNNYRFTHNDDPVPKLPLLTMGYVHISPEYYITAPDNTTVTDNQVTVLGGYVNFEGNTGTSGGLPDLLAFHSHVWYFIHADACKGHGLPFR

SEQ ID NO: 1408 - DNA, 3916 bp, Yarrowia lipolytica
atcaacatgaactgtaaaggatgaagtcgggtacatgttctctgaacgggccgtttccaaacagacttggacctgaaagcatgtgattcaacaacttaaattactcaactgatttaattacataaactatatagctgtcacagcttgcggtccaagagtttctatagtaccatgttgtactctccaagttatgagtttgtccattttcttaaggctcttgatctgtgtcagacatttcatccgacacagttttcacgagattggatttagttattgtagtgtatctacaatacgtcgctttcaggctaaagcctgccctagtctcactcacttccgctacttcgctgtgtgtagcctgtcaaagatcgacagatcggcgttttcgcttctgcagacaacatgagaactagaacctttggtgtgaaataatcacatggagtacagcatggccaagggttggtacctgcttttagaggaactggaccacaggattttaccgacgaagagccagaatctattgagacttggtgaaagggccagcattatgggacatgttgcttgcaaacgatggactactgtacttatactgtagtttgtcgtcgctgtatataataacgacactctgtttacaccttttttcctaaaaagtgtaagtcggcaataaaacaaaatgatttgcagatccacgagatccgcaactgggtgctgtgggaaaagagaatttgccctataagttggcccagtctacaatctgtctcatacagtgttgtagcaacgataataaaaactatagagaactgctagtgtcgaatttactcgagatggaggttcatcaaggtagtggaatccagttctgaggtcgacgatgtattattcggagaattgttcatcattgtattttcatggaactgtggggtgcagcagacatgcgtgggaaatagaacgaagcctgtctctatgtactctggttcaatttgcgggaagtctactcgttcttttgggtcccgaatcacaggacggatctgcttgtagatagcggtcctcccgtgttgctgtcttgcatagggtacaactatttgtagtacactctgggcgacaaacatgatcaccaacgggtctcctgccaccaaatttcccacagttgtacaagtaagggcaccggggaccggaacagtgcatgcgaccttcaattaatgcacactctctggactcgccgcactacctatgtggactgccgatcatacgtcgatccagatgttcttcaaacgtgatattgacgacatcagacagttgccagtgatagggagctccaggggaaatggtgataacaccaatcgattcgtcgtgcgccggtaacgccatactccaattttcagctttccaagagcccatctaacacctcctccaccagttccgaataatgctatcatgcaggggtgtcggagtaggtatactctacagagcatattggctggtatatatagatcgtcggggcccgtttgataagacatatctccaaaaataatggcagggttcaacttcactttcgggcaggtgatttcgtacctggcttccatgctctatggacaggtggatgccacttcgtcctccactcgaatccaggccacccaggatctgtacgacttcacagccaagttttcgcgactctcaaacatcgcgtactgtatcaatgcccccttcacgcctctcagaacggacttcacctgcggagaaagctgtcggtacttccccgacctccagctggactcagtgtttggtggtaacttctcctcagcctccactaccggctacattgcatacgaccacaagaagaaggaaaagtacattgtgtttcgaggaactttcagtatccctgatatcgtcacagacattcaatttcagactgccccttggttgacctctctgcccacgcatctgatccctaccaaggaggactttgaacacaagcaggccatcctgaagcactacgctgccgaaaacaagggtctcagcaacctggaagagcgacaggatgttgtgcatgaagaccctagcctggttcccaagaaaatggacaagtgcgagaactgccagatccatgacggattcgccaagggcttcaacgagactatcgagcatgccggaccccagattgaaaagttcctgggaaataacaccgactacaagatgtttgttgttggccactctctaggagctgctcaggcccagctgtttgctacacagttcaaactgctgggatttgacccttacatgatcaactttggacagcctcgacttggaaaccctgagttcgccgcctacatcaaccagctgtggttcaacgatactggtctggttgtcaatgatgcccgacgattctaccgagtgactcactggaacgatatcgtcgtgggagtgcccgactggctcaattacacccactctatcggagaggtgttcatagacgaggagagcgtttaccccaagctggacaaggtggtggtgtgcgagggaggagagaaccccctgtgccaccgaggaactttcaacctgtggtcacgaatcaacttcctgcagaaccatttggcttatatcttctacattggtctgtgtgctttcaacattggccgaagagacgtgctcaacatgccacaataccagggcaacttctcgtaccagcacaacatcgaccccaactacaattacgataccaaggttcccacccggatcagtaaatcaaactaacaagattttcgtttctatatacttttctacgcctacatttcctccatataataccttacgacttgacgcttcttgaacatatatagtgacactagcaactaaccgcttttgaaagatatataaataaacacccatacagactccctctagcaacgtaactttcagccgccccgagcagctcttagctccttctccatggtgatgactttcataatcagcttggttctctcttccagcgtgtgttccagcagcttcagaacatctccagaggggtaagagagagccttatcggagaattccgtgcaaacagtgaccccttcttcctcctctgtagactttcggctcactatcacgagctggctagaagggggctccgtaatagtatcttcagtatcagcagtctcggggatatctcctgggtgctgcttattatcgttgctggagtcatctcgggtatctgtgtcggtggagccacaggcatctgcgttgtcacttccttctgccggagcgggtgagtccagtctttgcgagttagggtcgacagcatcgactccaatgacctcgggttcaggcaccccaacagagattgagtgagcttccatgtcatggatatctgtgtcgtcccctaagacgtatgtggtactctcgtgagataccagcacatagttgaccaggcacgcggcaacaaactcctccagcccttcatggtatggcaccacaagcattcttaaaacgccaccattatcggtatctttgaggaaagttttcagccattccatctttgtcgtcacaggtgcagtgtggaggtcaacgtgtccgtcatccgacaaccacgtactgtccatcccatagatatcaactggctggaccattgagggtaacttcttgagggtttccatagtatcgtcaaagagatgcttgttgcgcctggtgaatgttcggaaccagtagcgggtattcatctcggtgctggtcaggctgcacatgtaggaagcgattttcaggtatgtgtccctggtcactactgacgccaacgtggacatgaagaggatcccgtagaacgccagcatcgtttcgaacgttcgcggcagtgggcgcgtcgagggttctctgcaataacctccacccgaatgcattgttgggggactgtcgcgtctgactcagtgtgggt

SEQ ID NO: 1409 - protein, 406 aa, Yarrowia lipolytica
MAGFNFTFGQVISYLASMLYGQVDATSSSTRIQATQDLYDFTAKFSRLSNIAYCINAPFTPLRTDFTCGESCRYFPDLQLDSVFGGNFSSASTTGYIAYDHKKKEKYIVFRGTFSIPDIVTDIQFQTAPWLTSLPTHLIPTKEDFEHKQAILKHYAAENKGLSNLEERQDVVHEDPSLVPKKMDKCENCQIHDGFAKGFNETIEHAGPQIEKFLGNNTDYKMFVVGHSLGAAQAQLFATQFKLLGFDPYMINFGQPRLGNPEFAAYINQLWFNDTGLVVNDARRFYRVTHWNDIVVGVPDWLNYTHSIGEVFIDEESVYPKLDKVVVCEGGENPLCHRGTFNLWSRINFLQNHLAYIFYIGLCAFNIGRRDVLNMPQYQGNFSYQHNIDPNYNYDTKVPTRISKSN

SEQ ID NO: 1410 - DNA, 4642 bp, Candida parapsilosis
aagcttgaatcacgtttatggcttttaccgttgcgcgggtcagcagttttggatcctagaacgtagtgagaacctcatgagatgttcaatatgaacagaatgcagctacggctacgcgcattggatgtcatttcaacaaataaagggatccttgttatttgccaaagttggctttatacgatcctaggaggacttgatctggaatttatagggagcgatgttatgtggccgaggaaggagataaggtttttaagcatgtgataaaaaatagtttccatcgaattctacaaagcacaagaccaatctccaacttaggcaaattattaaattgcatttgacaggaatttagagatccaccgaaactacccgaactaaaaactttatatctgcttattgagtttcttcatagtatgttatttgggttttccattttccattttccattttgcggagtagcgcgtttcacaaagggtgtccgacttgcatggtctgcgcatcggtttaaaaaaaaaagctcgtttttcctaattaggtaaagttcttttatctccagtggtaagatttttcgaaagtacacattagtttatgtgtaaacgcatgaaatctatttcctaatatgtcaattctatggggttgcagtttggaatgttccattgttaaagaaccaagtgtggtccacaaaacaacatgaattcctcaaatgtttgttaatcctcgcaatcactctcgcataatggcttcgatttatgagctgagttctccaccatatgaaaagcggatttatttctgctttcacttccgcaatggtataagtataagtataaaggtgcagccttctcaaagtcggttcacagaatatccaaggcatctcccgtcacttccctccctaaaccatgcatttttggttcctatccatattcctcattcaaggagttttcgcagccgtcattgccccagttaaaccatcacaagataacttttataccccacctgatggttatgagaatctgaaagtgggcacaatacttaaatttagaaataccccatttccattatctggaataattaatactgtcaatgttcagaactcttggcagctacttgtgagatctgaggatacatttggtaaccccaatgccatagtcacaaccgttattcaaccattcaacgcaacttctgacaaggtggtgtcttaccaaacatgggaagatgcagcaaacttggatttttcaccgtcatatggaattcaatatggtgcagatttaaccacattgatttccctgtttgagatgtattttatgtcagcattgttggatcaaggttactatgttgtcactcccgattacgaaggtccaaagagcacatttaccgttggattacaatcaggcaaagctacattgaattcaataagagctgcacttggttcagggaacttgactggtatcgattccaacgctgaagttatgatgtggggttattcaggtggcactattgcatcaggttgggcagcagcaattcaaagtgaatatgccccagaattgactgacaatttgattggtgctgcacttggggggtttgtcacaaatataacggctactgcagaagcaaccgatggtgggctatttgctggtttgattgcaaatgcgctaggtggattaggaaatgaatattcaaatttaaccacattcatgcaagagagtgtaagtagtgagcaacaaccagcatttgaaagaagggatgaccactgtttagtcgacagtatccttggcaatattggtagtcaattcttttctggggaggacagatggtttcccgatggttggaaaatatttgatgaagagccagttgattcaatagtcaaaaataatggtttagtttatcaaccgaaaaaatatcttccccaaatacctatattcgtttatcaaggaactcaggataatattgttcccatcaaaagtgccaagacgactttcaaacaatggtgtgaatggggactagaatccggggagtttgctgaggatgaggctactggtcacataactgaagtctttgtcggggcgccggctgctttgacttggatcatcaataggtttaatggagttgagcctgttcaaggttgtaatcatacatcaagagcatccaattttgattacccgggaataagtcaatcctatgtcgaatatttcacggctgcgttaaacgttgttcttggtataaatatggggccattgacaaagagagaggttaacagtatacaagatttgaacaacttagagtatgtaaaagtgtaattgcaaagtatagtgaaaaaaacaatagttgcatacgtgagatgagcattcgatgagtaactttatcaatacaattgaatacaccaagcgactcagcccccatagtgcttataagcaattgagccatccctcgtgcagaaacgataatcatgcttttctgcatagcactttatcgcacctatgaccattcaccaagctattgggtagcggaccattgcgcaattaatggccatgataagaaacacatctgtctgcaaaacaggtttcttctaaatcaaactaataatacattctgtacataatgatacaaatttctaaacgcaatgttttacatcatctaaaaagcaaaacgttccaacttgagcaatccgcccaaagtaaccttatctctcttaacatctggacccaaatcaaagcccaaaattgcgtgcaatgcagcttcaaagtaattcttgattgattgtggagttcctggatattccaagtttgaagctctcacattatgttgacatccatcaactggaggctgtccattgaaacgattgataatccaagtcaaagcagctggtgcacccacaattgattcagtaatgtgtccattggtcaaatcttcattatattcaccagatttgagtccccaatcacaccattgttggaatgtctttcttgagttgacaatggggacaattgcatccaaggtaccgtggtagatgaataatggaatttgtggggtcaagtcctttggttggtaaaccaatccattatcttgcaagatggttttgataggttcttggttgacaagatcccatccatcagggaaatatctaataattctggaaaagaatgatttaccgaaataagcaataccaccatcaagcaaacagtgagtgtttcccaaacgataagtgattgaaagcaatggtgacacttttttcaaaagatagtttttgaaatcagggtattcatttccaataccagccaatgcattggagatgattcctgcaaatggaccactatcaacagcttcagcagtggcagtaatgtttgtaacgaatccaccaagtgcagcaccaagcaagtttttactcaactctggagcatattctttttgtatagcagcagcccatcctgaagcaagacttcctcctgaataaccccacaataatgtctcagcgtctgatgaaacaccagtcaagtttcctgatttcaaagtagctctaagcgaattcaaagtagctcttcctgattgcaaccctacagtgaatgtactctttggaccctcgtaatcaggagtgacaacatagtaaccttgatctaataaagcagagatgtagtacatttcaccttgagtggtcaaagtcgaaatgtccgatccatattgaatagcatatgatggagcacaatccaatttaccagaatcttcaaatgtttgataagaaacaagcttatcctttttagcattgaaaggttgaataatggtagtgactatggcgtttgggttaccaaatgtatcttcagatctaaccaataattgccatgcattttgaactttaactggagtgaaaacattagtcaatggattggggacgtttcttgttttcaaaatagaaccaagaggttgagcttcataaccttgtggtggagtgtagaaatcgtcttgagatggctttttgggagccaagacaaaagctgaaatggtattgatgagcaagaaagcaatagcaaagtaacgcatagtggtgagtagtgctgctgttgatgacgttgttgttgagaaatgacaaattgactgagtaacttgggaatccttatggatatttatattcttccatgaggtggttgtccatcatcgtgtttgccttaccgaggaagagaccccacactttccaccactgttattcaacttgtaaacaaaccacggtgcgcttcaagcttattgaaggtgcaactgactcaaaaccacgccatggatggtttgtttacaccatttcggaaaacacatatttgtaccaacttgataatctaaccaatgaaaaagccagacccaaacgtttccaatcctcaattcacctgcgattgcacttgcgattgcatttgcaattgcacatcattgtcattcgatctcaacccacaattgcaaatagaacaatggaggaaaagcacgacacacttgcaaatcaacttgcaaaaacacgttaagagcttcaacaaaaaccgcctattgtcgactcgaattactcattggccattgttcttttccaggagaacacaaatgaggtgaaatgattcgtaaaaccaaaatgaaaaacgtttttgctttgtcaattgtgcttatatggaaatgtgaattc

SEQ ID NO: 1411 - protein, 465 aa, Candida parapsilosis
MHFWFLSIFLIQGVFAAVIAPVKPSQDNFYTPPDGYENSKVGTILKFRNTPFPLSGIINTVNVQNSWQLLVRSEDTFGNPNAIVTTVIQPFNATSDKVVSYQTWEDAANLDFSPSYGIQYGADLTTLISSFEMYFMSALLDQGYYVVTPDYEGPKSTFTVGLQSGKATLNSIRAALGSGNLTGIDSNAEVMMWGYSGGTIASGWAAAIQSEYAPELTDNLIGAALGGFVTNITATAEATDGGLFAGLIANALGGLGNEYSNLTTFMQESVSSEQQPAFERRDDHCLVDSILGNIGSQFFSGEDRWFPDGWKIFDEEPVDSIVKNNGLVYQPKKYLPQIPIFVYQGTQDNIVPIKSAKTTFKQWCEWGLESGEFAEDEATGHITEVFVGAPAALTWIINRFNGVEPVQGCNHTSRASNFDYPGISQSYVEYFTAALNVVLGINMGPLTKREVNSIQDLNNLEYVKV

SEQ ID NO: 1412 - protein, 465 aa, Candida parapsilosis
MRYFAIAFLLINTISAFVLAPKKPSQDDFYTPPQGYEAQPLGSILKTRNVPNPLTNVFTPVKVQNAWQLLVRSEDTFGNPNAIVTTIIQPFNAKKDKLVSYQTFEDSGKLDCAPSYAIQYGSDISTLTTQGEMYYISALLDQGYYVVTPDYEGPKSTFTVGLQSGRATLNSLRATLKSGNLTGVSSDAETLLWGYSGGSLASGWAAAIQKEYAPELSKNLLGAALGGFVTNITATAEAVDSGPFAGIISNALAGIGNEYPDFKNYLLKKVSPLLSITYRLGNTHCLLDGGIAYFGKSFFSRIIRYFPDGWDLVNQEPIKTILQDNGLVYQPKDLTPQIPLFIYHGTLDAIVPIVNSRKTFQQWCDWGLKSGEYNEDLTNGHITESIVGAPAALTWIINRFNGQPPVDGCQHNVRASNLEYPGTPQSIKNYFEAALHAILGFDLGPDVKRDKVTLGGLLKLERFAF

SEQ ID NO: 1413 - DNA, 1213 bp, Penicillium expansum
ggtgcatccaaagacaacggtccagcagccttccccaagagtattctataacaccctcatacattgtttcgatatgttgttcaactaccaatctttactcgtgggagtctctctgatctctcaagccctgtctgcacctattttggagtcgagggcaactgctggtatgtcaatttatcagcccagctccattcgactaggcagctctaacattttctcaagacgccgctgccttccctgatctgcaccgtgcagcaaagctttcttccgctgcctacacaggttgcatcggaaaggccttcgatgtcactatcaccaagaggatttatgacctcgtgaccgacaccaatgtaggcgtggtatttgccctatacgttggcaaataactaatttcaatagggattcgtcggatactccaccgagaagaagaccatcgcggtcatcatgaggggctcgactaccagtatggcaaaatcacttcttaatactagctcaacatgctaattaatccagtcaccgacttcgtgaacgacattgacattgctctcatcactcctgagctctcgggcgtgactttcccctctgatgtgaagatcatgagaggtgttcacagaccttggtccgctgtacacgacaccatcattactgaagtcaaggctctcattgcgaagtaccctgattacactctggaagcagtcggacattccctcggtggtgccctcacatccattgcccacgttgccctggcccagaacttcccggacaagtcacttgtcagcaatgcccttaacgccttccccatcggcaaccaagcgtgggccgactttggtactgcgcaggccggtaccttcaaccgcggaaataacgttcttgacggtgtccctgtaagccatggttgaaactgacatgctatattaaagtagctaaccatacaacacagaacatgtactcgagcccgcttgttaacttcaagcactatggaaccgtgagttatcctaccgattcccctttagatatcaatgttcaatcgcttatcaaccataaccatgcacaggaatactacagctctggtaccgaggctagcaccgtgaagtgcgaaggccagcgtgacaagtcttgctctgccggcaatggcatgtacgctgtcactcccggtcacatcgcaagctttggcgtcgtgatgcttactgctggttgtggctatctgagctga

SEQ ID NO: 1414 - protein, 285 aa, Penicillium expansum
MLFNYQSLLVGVSLISQALSAPILESRATADAAAFPDLHRAAKLSSAAYTGCIGKAFDVTITKRIYDLVTDTNGFVGYSTEKKTIAVIMRGSTTITDFVNDIDIALITPELSGVTFPSDVKIMRGVHRPWSAVHDTIITEVKALIAKYPDYTLEAVGHSLGGALTSIAHVALAQNFPDKSLVSNALNAFPIGNQAWADFGTAQAGTFNRGNNVLDGVPNMYSSPLVNFKHYGTEYYSSGTEASTVKCEGQRDKSCSAGNGMYAVTPGHIASFGVVMLTAGCGYLS

SEQ ID NO: 1415 - DNA, 1129 bp, Penicillium CYCLOPIUM
ggtgcatccaaagacaacggtccagcagccttccccaagagtattctataacaccctcatacattgtttcgatatgttgttcaactaccaatctttactcgtgggagtctctctgatctctcaagccctgtctgcacctattttggagtcgagggcaactgctgacgccgctgccttccctgatctgcaccgtgcagcaaagctttcttccgctgcctacacaggttgcatcggaaaggccttcgatgtcactatcaccaagaggatttatgacctcgtgaccgacaccaatggattcgtcggatactccaccgagaagaagaccatcgcggtcatcatgaggggctcgactaccatcaccgacttcgtgaacgacattgacattgctctcatcactcctgagctctcgggcgtgactttcccctctgatgtgaagatcatgagaggtgttcacagaccttggtccgctgtacacgacaccatcattactgaagtcaaggctctcattgcgaagtaccctgattacactctggaagcagtcggacattccctcggtggtgccctcacatccattgcccacgttgccctggcccagaacttcccggacaagtcacttgtcagcaatgcccttaacgccttccccatcggcaaccaagcgtgggccgactttggtactgcgcaggccggtaccttcaaccgcggaaataacgttcttgacggtgtccctaacatgtactcgagcccgcttgttaacttcaagcactatggaaccgaatactacagctctggtaccgaggctagcaccgtgaagtgcgaaggccagcgtgacaagtcttgctctgccggcaatggcatgtacgctgtcactcccggtcacatcgcaagctttggcgtcgtgatgcttactgctggttgtggctatctgagctgagtaccagaagcgaatatgacagcaatgttcgacacagatcacttattctgaggacagagcgacctcggataactaatatattatctactgttctaatagttagtttatacttatttgtgtatattggatggttggtcatccaaagcgatcagcgtaataaaaatacatctgatttgaaaaaaagaaaaaaaaaaaaaa

SEQ ID NO: 1416 - protein, 285 aa, Penicillium CYCLOPIUM; identical to SEQ ID NO: 1414

SEQ ID NO: 1417 - DNA, 1701 bp, PSEUDOMONAS SP.
atgggtgtgttagactacaagaacttcaagggtgaggcgggcaaggcgttgtacagcgatgcgctggcgttgaccctctacgcctacacgcccaccgggcagccgctggcgtcgggctggacggcgattggtgccgagccactggggtatcagggcaaggtcgggccccaaggcaccttcttcggtgagcagccaggctttaccagcgccgaagtggaagtgctggggcgttatgacgaggccggcaagctgctgtcgatcggcatcgcctttcgcggcaccggcgggctgggcttcagcgataccctgggcgacatcaagaacaacctgctggcggcggtcgggccggtgggctacgcggcgaactacagcaagaatgccttcgacaagctgttctccagcgtcgccgagttcgccaaggcccagggcctgagcggccaggatgtgctggtcagcggccacagcctgggtggcctgggggtcaacagcctggccgagctgagcggcgagcactggggcagtttctacgccgatgcccgctatgtggcattcgcctcgccgacccagagcccgggggacaaggtgctgaacatcggctacgaaaacgacccggtgttcagggtgctcgacggcaccaccttcaatgcctcgtccctgggtagccatgacaaggtccaggcgtcggcgaccaacaacatcgtcaacttcaacgagcactatgcgtcgaccctggagaacctgctgccgcagagcatcctcaacccgctgtcgtggaaggcccacggctccgcgggttacgccgatggcttgaaccgggtagtcgattcggcgttctacgacctgaccggcaaggactcgaccctgatcgtctccacgctgtccgagggcagtcgcggcaagacctgggtcgaggacctcaatcgcaatgccgagccgcacaagggcagtacctttatcttcggcaccgatggcaatgatctgctcaagggcgggcgcggcaacggcttcatcgaaggccgcgacggcaacgacaccttccgcgacgagggtggctacaacatcctgctgggcggcaaggggcataacgtcttcgacctgcagcagtcgctcggcaagttcagcgtggtcaacgatggcgacggcagcctgtatgtacgcgatgcctatggcggcatcagcatgacccgcgacatcggtgcgctggtgagcaaggaaccgggtttcgcctggggcctgttcagcaaggaggtgacccacagcgtgaccgaccagggcttgctggccagtaaccagttgactcactacaaccactcgctcaatggcgatgcctacggcaatgcgctggtggccagcgtcgacggcgactggttgttcggtcacgggggcgacgatgtgctgcgcagcgacaagagcgacgtgacctttgacggcggcgccggcaacgatgtcatgtactccagcggcggcggatccaacaccttcctgttcagtggcgccttcggcttcgatgcgatccatggctaccagggcagcgacaagctggtgtccatgggcgtggcgggcgcggggcagggctacgactacacgcagcacctgtcacagagcggccaggacaccttgctcagcgtcggcgactacgccgtgacgctggtcggggtcgcgccggacaacctctctgcaggggggatcgtctttgcatag

SEQ ID NO: 1418 - protein, 566 aa, PSEUDOMONAS SP.
MGVLDYKNFKGEAGKALYSDALALTLYAYTPTGQPLASGWTAIGAEPLGYQGKVGPQGTFFGEQPGFTSAEVEVLGRYDEAGKLLSIGIAFRGTGGLGFSDTLGDIKNNLLAAVGPVGYAANYSKNAFDKLFSSVAEFAKAQGLSGQDVLVSGHSLGGLGVNSLAELSGEHWGSFYADARYVAFASPTQSPGDKVLNIGYENDPVFRVLDGTTFNASSLGSHDKVQASATNNIVNFNEHYASTLENLLPQSILNPLSWKAHGSAGYADGLNRVVDSAFYDLTGKDSTLIVSTLSEGSRGKTWVEDLNRNAEPHKGSTFIFGTDGNDLLKGGRGNGFIEGRDGNDTFRDEGGYNILLGGKGHNVFDLQQSLGKFSVVNDGDGSLYVRDAYGGISMTRDIGALVSKEPGFAWGLFSKEVTHSVTDQGLLASNQLTHYNHSLNGDAYGNALVASVDGDWLFGHGGDDVLRSDKSDVTFDGGAGNDVMYSSGGGSNTFLFSGAFGFDAIHGYQGSDKLVSMGVAGAGQGYDYTQHLSQSGQDTLLSVGDYAVTLVGVAPDNLSAGGIVFA

SEQ ID NO: 1419 - DNA, 633 bp, BACILLUS SP. NK 13
atgaagaaaacgtttgtcgcattaatttttgctttatccctggttgtatctgcattaggaattcagccttcgaatgctaaggccgaagcaaaccataatccggttgttcttgttcatggaatcagcggtgcgtcctataactttattgctatcaaaaactatctaatcgctcaagggtgggatcgcaatgatctttatgctattgattttatagataagacaggcaacaatttgaataatggacctcagcttgctcgatacattgatcaagtgttgaaagagacgggagctaagaaggtagatattgttgctcatagtatggggggagcaaacacgctgtactatattaaatatctagggggagggaataagattgaaaatgtcgtgacgttaggaggggcgaatggtttagtttcttcgacagcactcccaggtacagatctcaatcaaaaaattctttatacgtcgatctacagcataaatgatcaaattgttgttaatagtctctctaggctgcaaggagcaagaaatattcaactttatggcattggacatattggattgctttcgaatagtcaggttaacgcgtacataaaagaagggctgaatggcgggggacaaaatacaaactaa

SEQ ID NO: 1420 - protein, 210 aa, BACILLUS SP. NK 13
MKKTFVALIFALSLVVSALGIQPSNAKAEANHNPVVLVHGISGASYNFIAIKNYLIAQGWDRNDLYAIDFIDKTGNNLNNGPQLARYIDQVLKETGAKKVDIVAHSMGGANTLYYIKYLGGGNKIENVVTLGGANGLVSSTALPGTDLNQKILYTSIYSINDQIVVNSLSRLQGARNIQLYGIGHIGLLSNSQVNAYIKEGLNGGGQNTN

SEQ ID NO: 1421 - DNA, 1977 bp, UNCULTURED BACTERIUM
gatcacggcggtcgcgtgtcgcaacatgatgcccgacccggcgttctacgcggagtgcctgcgcggcagcttcgacgagttgatggcggcgattgacgcgaggccctccgcggcgcacccgccggcgcccggcgggaagccggcgcggatccatgcagtaacggcgaagcggcggcgcgccaagcctgtcgcgccgccgccggtgagtccgcgtgcgcgcgcgacggcgaaggggaagatgaagacgaagacgaagacgaggacgcagtccggggccaaggcgcggggcgcgccggcggtggccaaatcgaagaagaggcgcggatgagcgccccgatcacccgcgcgagcgcgctgccgccctacgcgaaattcatctcgcctgccaagggcgggtggcagcggtgggcgaccaaccttctttttcgcctcacggcgaagcggatgttgcgccccgacagcgacctcggcgaattgcgcgccaaggtggcggagatggatgcaaagttcggccacgtcgatgccgcggcgaagcgaacgcccgtcgactgcaacggcgtgccggccgaatggatctccgtgccggagagccggccggagcgcgtgctgttctatcttcacggcggcgcgttcatgttccggatgccgggcacccatgccgcgatggtcgcgcgctggtgccggcggctcggcgcgcgcaccctgatggtcgactaccggctggcgccggagcacagatatcccgccgcgcccgacgactgtcacgccgcctatcggtggctgctggcgcaaggatgcgatccgcggagcatcgtcatcggcggcgactccgccggcggcaacctcacgttggcgacgctgcatcgcgtcaagcttgccggcgagccgctgccggcctgcgcggtgctgctgtcgccgttcgtcgatttcacgctgagcggtgccagcctgtatgcgaacgaggatcgcgacccgatgttcacactggccggcatggtcgcgctgcgcgcgcattacgcgccgccggagcgattcctcgatccgccactgtccccgctgttcggcgatttccatgggttgccgccgatgcttttccaggccggcagcgaggaaatgctcgtcgacgagtccgtgcgggccgcggcgaaggcccatgcctgcggcgtgccggtcgagctcgagctgtgggaccggctgccgcacgtctttcaggcgctggagaaattgccccaggccgcggaagcggcggaacacatcgtccggttcatcggcgagcgcgcaggctggcgctgactgcaggcgccgcgccttcgctccggcgatcgccgacttccgatgaatcgcccccgaccgacgatgaacaacaccgtcgccgccctggcggcgatctcgctgttcgtcggcgcgccggcgggcgcggccgacgaggtcgtccagggcaccgtcaccgcggtcggcagcggcgacacgttcaccatcggcaccgacggacgcccgacggtcgtccgcctgtccgacatcaacgccccgcacgggagcgagttctacgcgcccgcgtcgcggacgctgctcacggctttgctgctgggcaagccggtgcgtgtcgtcgtgcacggccgctggggagacggtaacgtgttcggtcgcgtgtttgccggcgaactcgacgtcaacctcgaaatggtccggcgcgcggcggccttcgtctgctgggatttcgtgcagcagaccgattacgcgccctgggaggcaaacgcgaagcgcgagcgacgagggctttggagccagacctgggaaatcgaggcgcggggcgcctgcctgcgccgcccgccagtcgagttgccgcccgccaagcccgggtaaccgggcgcgaccgtacctaaccaccataagggaacgccatgcgcagcttcaaggacaaggtcgcggtcatcaccggcgcggggtcgggcatcggacgcgcgttggcgcaggatc

SEQ ID NO: 1422 - protein, 322 aa, UNCULTURED BACTERIUM
MSAPITRASALPPYAKFISPAKGGWQRWATNLLFRLTAKRMLRPDSDLGELRAKVAEMDAKFGHVDAAAKRTPVDCNGVPAEWISVPESRPERVLFYLHGGAFMFRMPGTHAAMVARWCRRLGARTLMVDYRLAPEHRYPAAPDDCHAAYRWLLAQGCDPRSIVIGGDSAGGNLTLATLHRVKLAGEPLPACAVLLSPFVDFTLSGASLYANEDRDPMFTLAGMVALRAHYAPPERFLDPPLSPLFGDFHGLPPMLFQAGSEEMLVDESVRAAAKAHACGVPVELELWDRLPHVFQALEKLPQAAEAAEHIVRFIGERAGWR

SEQ ID NO: 1423 - protein, 175 aa, UNCULTURED BACTERIUM
MNRPRPTMNNTVAALAAISLFVGAPAGAADEVVQGTVTAVGSGDTFTIGTDGRPTVVRLSDINAPHGSEFYAPASRTLLTALLLGKPVRVVVHGRWGDGNVFGRVFAGELDVNLEMVRRAAAFVCWDFVQQTDYAPWEANAKRERRGLWSQTWEIEARGACLRRPPVELPPAKPG

SEQ ID NO: 1424 - DNA, 1312 bp, UNCULTURED BACTERIUM
gatccgcaggtgcgcgccgcgggcggcttcgtcgaggtgcccgacggggccggcacgacgctgcttccgaacacgccggcggatttccatggcacgccttcgctgccgcgctggatggcgccgagcctcgggcagcacagcgacgagctgctgcgcgagctcggcaagagcgaagcggagcgcaagacgctcttcgagaagggagtggtggtctgatggcacgcgtgcgcgcgaacgggatagagctcgagtacgaccatttcggctcgccgtcgggccggccgctgctcctgatcatgggcctcggcgggcagctgctcatgtgggacgaaggcttctgcgaggcgctcgccgcgcgcggccactacgtcgtgcgcttcgacaaccgcgacgtcgggctctcgacgcggttcggcgcggccggcgtcccgaacgtgctggagctgatgcagcggagcgccgcaggcgagacgctcgcggtgccctactcgctcgacgacatggcggacgacgccgcggccctgctgggcgcgctcggcctcgagagcgcgcacgtctgcggcgcctcgatgggcggcatgatcgcgcagacgctcgcgatccgtcacggcggccgactgcgtagcctcacctcgatcatgtcgaccacgggcaatcccgagctgccgcccgcgaagcccgaggcgatggccgtgctgttgacgccgccaccgacggaccgcgcgggcagcctcgacgccgccgtccgcacctggcgcacgatcgggagccccggcttccccttcgacgaggcgaagatccgcgcgcgggccggccgcctctacgaccgcgccttctatcccgagggcatcgcgcggcagctcgccgccgtcctcgcgcacggcagccgcgccccgcagctgcgcggcgtgagcgtgcccacgctcgtgatccacggcgcggccgacccgctcgtcccgctcgcgggcgggcaggacaccgcacgctcgatccccggcgccgagctgctcgtgatcgaaggcatgggccacgacctgcccgaaggcgcctggccggcgctggtcggcgcgatcagcgagcacaccgcgaaagccgaagcgaggcgcacatgacggggacgttcttcgaaacatcgaaatgtctgctcgtcgcgttcgctctcgcctgcgccggcggcggcagtgcgagcgagatcacgcccgccgcgctgctcgcgcgcagcgacgcgccgctcgtgctcgacgtgcggagccccgaggagttcgcggccggccacgtgcccggcgcgcgcaacgtcgcgcacgacgagatc

SEQ ID NO: 1425 - protein, 298 aa, UNCULTURED BACTERIUM
MARVRANGIELEYDHFGSPSGRPLLLIMGLGGQLLMWDEGFCEALAARGHYVVRFDNRDVGLSTRFGAAGVPNVLELMQRSAAGETLAVPYSLDDMADDAAALLGALGLESAHVCGASMGGMIAQTLAIRHGGRLRSLTSIMSTTGNPELPPAKPEAMAVLLTPPPTDRAGSLDAAVRTWRTIGSPGFPFDEAKIRARAGRLYDRAFYPEGIARQLAAVLAHGSRAPQLRGVSVPTLVIHGAADPLVPLAGGQDTARSIPGAELLVIEGMGHDLPEGAWPALVGAISEHTAKAEARRT

SEQ ID NO: 1426 - DNA, 2670 bp, UNCULTURED BACTERIUM
gatcgtcgtccccggcgggcagcgttatcgcgcgatggacttcatggtcgagcctgacgcctcgagcgcgagttattttgccgcggctgccgcactgattggcggcaccgtcacgcttgcgcgcctgaccgccgattcggtccaaggcgacattggtgtactgcgcgtgctcgagcgtatgggggcgcatatacaatggaaccgcgactcgatcgaagtcaccggcggcggacgcctcgccggcgttgatatcgatatgaatgcaatgcctgacatggtgccgacgcttgccgcgatcgcgccgttcgcctcatcgccgacccgaattcgcaacgtcgccttcatccgtcatcacgagagcgaccgcctgcgcgcactcgccaccgaactgcgccgcctcggcgcgacggtacaggaattcaacgacggccttggcatcgagccgtcggtgctcaagcctgccgcggtcgagacctacgacgaccatcggatcgcgatggcgttctccgtagtcggcctcaaactcgccggcgtgcaaatcaaaaatcccggctgcgtgtcgaaaacgtaccccggttttttcgacgacctcgcccgcctgcattgataacacgctcgtcaattgcggcgtcttgcggggcgcttgccaatgcgcgcaattctgctgacaatcacatcgctcgacgaagttcgtccttaatcttgcctgaggaggcgactatgcaactcgatccccagatgaaggctatcctcgaccaggccgcggcggcgggcgcccaacctttccatacgatgacgccggcgcaagcgcgggctgctatcgataccatgttccgggcgtttcgcggtcagccgaaggaagttgcgaagtccgaggaccgcaaaatcccgggtcccgccggcgatattcctgtccgaatctacacgcccgcgggaagcggccccttcggcgcgcttgtgtacttccatggcggcggatgggtgatcggcaacatcgagacgcacgacgtcacctgccgcgaactcacgcacggcaccccatgcgtcaccgtgtcagtcgattaccgtctcgcgcccgagcataagttcccggccggacccgaggattgttacgtggcgaccaaatgggtggccgacaacgcgcgctcgctcaacgtagacccgaatcgaatcgccgtcggtggcgatagcgccggcgggaacctcgcggccgcaatctccctcatgtcgcgcgatcgtggcgggccaaaactcgcgtaccagttgctgatttatcccgcgatcgattccgccgacgaaactccgtcgcatcgcgaattcacgaaggacggctacatcctctcgcgcgccgatatggaatggttctggggctattacctggcggacaaggaccgcaccaacccatacgcgtgcccctcgcgcgcgaagagcctcgccgggctcccgcccgcgttcgtacttacggcagagtttgacccgttgcgcgacgagggcgaagcctacggtcaggagttgcgcaaggcgggcgttgccgttacggccaagcgctacgacggcgtctgccacggcttcgtcagcatggcgtcactgctcgacgccggcaaacgcgccgtcgctgaatgctgcgccgagctgcgaggcgcgatcgggaggtaattatcgacgtctgttctgggcgaggggaggtggctaagagccaactctatctcgaaagcgatacagtgccttgaggtccgtcataaatcagggtgcatgaccgcagttgtgttcgccccaagatgatttggtgtctttgcccacctatcgccgcaagcattgcggtgaattcacgaatttggagattcgtaatctcgatttcaacttgataaacatccaccatctgctgtgaagggccagctgctccaattggccatcggtcgatccaatgcggttgcagacgtcccacgagaccgacatcaatcaagctgtattcacttccggtatcgattagggcagacagcgatacttcttgaccgtagccggagcgcaagattactggaacggcagcgccgacttgaattatgtgatggaccgtttgagcttcggaaaaagaaacgccaacttctctaatcagataacaatcacgcccgaattgtttgattgctgttctggcggcattatcaaaacttgcgaaggcatcaacgaactttccctgatgaaagagcacgaattgtccgcgcagtttgtctttccattcgactggctgggcctcaaatgcgcggatatttaaatcaagggctcgccgatacgcatcgtcagtctttgctgttttgagggacttttcagaactcacgacacgcctcttcacgccgtgccactctcggctcatgttcttcagttgacacgtatcgctaacacgtatcaacccctacaaaaatgcccatagacgtttgcgctgtggtgaacgcgctcatagcgatagcccatcaacggcaggggttcgtaaaagagcgccgcatcagtgccgcagcttgtcggtgggcgcgagcggggcgaaacaacgatttaggcgccaaatcgtcgtcgagtgaagacgcactccaagctcatccgaagcgcggcatcaccttcgacgcgaacagctccagctcgtcgagcacctcgcctttttcgagatagccctggccgatc

SEQ ID NO: 1427 - protein, 311 aa, UNCULTURED BACTERIUM
MQLDPQMKAILDQAAAAGAQPFHTMTPAQARAAIDTMFRAFRGQPKEVAKSEDRKIPGPAGDIPVRIYTPAGSGPFGALVYFHGGGWVIGNIETHDVTCRELTHGTPCVTVSVDYRLAPEHKFPAGPEDCYVATKWVADNARSLNVDPNRIAVGGDSAGGNLAAAISLMSRDRGGPKLAYQLLIYPAIDSADETPSHREFTKDGYILSRADMEWFWGYYLADKDRTNPYACPSRAKSLAGLPPAFVLTAEFDPLRDEGEAYGQELRKAGVAVTAKRYDGVCHGFVSMASLLDAGKRAVAECCAELRGAIGR

SEQ ID NO: 1428 - DNA, 1380 bp, UNCULTURED BACTERIUM
gatcttctgattttccctcttgcgtccttggcgtcctttgttggtgaatccaccttgcttcgttcgccaccgaactctagaatgaaccgacattcaatgaacggggggagagctttcatgccagtcaccgtaaaccagggagtcaaaattcattggaatgaagagggcgccggcgagcctcttttgctcatcatggggctgggatatccgtcggctgcctggtaccgcactcgtccggcgctgtcgcgcaaatatcggaccatcgcgctcgacaatcggggagttggccagagcgacatgccaccggggccctatccgattccagtcatggcctccgacgcagccgcggtgctcgatgccgctggcgtagaaagcgcacacgtatttggcatctccatgggcggcatgatctctcaggagttcgcgctgcaatatccaaatcgggtgcgttctttgatcctgggatgcacggccgctggaggtcccaatgccgtgcgcgccgatcaggacgccaccaacatggtcatggcacgcggcgccatgacgcaagaggaagctgcgcaggcagccataccgttcatctatgatcccagcacgccacgaaatgtgatcgatgaagacctcgccatccgcaggccgtggtttccgcgtcaggaagcttacaacgcgcagttacagggaatcatcgcctgggagtctgatagccgcctggacaagatcaccgcgccgacgctggtgattcatggcgactccgaccggctggtccccccaggcaatggaaagcggatcgcggaaaaaattcccggcgcccgcttggtaatgttgcgtcaggccagccacatctttaccaccgatcaacccgcagcagcccaaaaagcaattctggaattcctgcaggagcacagcacgcaacaagtagcagtgagtgtccagcgatagcacactcgcttcgctttcgatttcttttcaacgtaaatcaggggaaagcagcgcgccgatatgaactgatctcatatgatggacacgcgatccgcgttcatcagcggcaatcagcggtaagtttgtctgcggctcctctttggacttgtcgccaacgggcagggcttatcgagttttgagcagcacacgctttcgctctccgtctttcaactcgatgatttgcaaaggtcctgttttgaatcctggcctgctcgtgaaccgaacactgtagcggcccggcagcagatggtccaggacgaacgcaccatcaggcgcgggagttgcgttccggacggtattccagggcctgtcatcgggagtgaccgtatcgatggtgacccagccgtcgattgcgcctccatccgcggactgtaccttcccgctaatgctacctgaaggtcc

SEQ ID NO: 1429 - protein, 273 aa, UNCULTURED BACTERIUM
MPVTVNQGVKIHWNEEGAGEPLLLIMGLGYPSAAWYRTRPALSRKYRTIALDNRGVGQSDMPPGPYPIPVMASDAAAVLDAAGVESAHVFGISMGGMISQEFALQYPNRVRSLILGCTAAGGPNAVRADQDATNMVMARGAMTQEEAAQAAIPFIYDPSTPRNVIDEDLAIRRPWFPRQEAYNAQLQGIIAWESDSRLDKITAPTLVIHGDSDRLVPPGNGKRIAEKIPGARLVMLRQASHIFTTDQPAAAQKAILEFLQEHSTQQVAVSVQR

SEQ ID NO: 1430 - DNA, 1419 bp, UNCULTURED BACTERIUM
gatcgtcggcgcgcgattccagtcgatgctgcaaagaatcgcgaagcacgggttccagataatattgtacctgcggatggttcccgtgattccgtacaacgcgctcaacttgctggcaggcgcgtctccgatcgacgtttttgacgaggaaccgccgccggccaaccatccgtttaggactatggacaacgtcaccgtcacgccgcatctgggatacgtgacgcgcgaggcgctgaccgcattttatgccgacacgctggaagcggtggccgcctttgcgaacggcgcgccgattcgagtcgcgaatcccgacgcgctggcgcatcggaagaagtgaggagcaagaacgctaatccagttacccgaaacatgcgggtttcaggatatagttgggttcgatcaacactcggagggaaaatcatgccgctcgacccgcaagccaggatgctgatggatcaactcgcagccgcgtccggacccaagttgaactcgctcgagccggccgacgcgcgccgcttgaccgccaacatgttcagagtgccgccggagcgagccgaaagagtcgccaaggttgaagatcgcaaaattcccggtccggccggcgagattccgattcgagtttacacgcccgaaggtgcggggccgtttccggtgctggtatttttccacggcggcggatgggtgatttgcggcctcgatacgcacgacgggccgtgccgcgcgctcaccaacaaggccggatgcgtgacggtgtcggtcgattaccggctcgcgcccgagaataaattccccgccggcgtggaagactgctttgccgcgaccaagtgggtcgccgcgcacgccaaagagctcaacgcggacgccgaccggctggcagtcggcggcgacagcgccgggggaaacctgtccgccgtgatttcacagctcgcgcgcgacgcgggcgggccgaagatagcgttccagctgctcatctatcccgcgaccgaggccgagctcgacacttactcgcacaaaaccttcaccgactactttctgaccagggacgacatagtttatttctggaagcattacctgcgcagccctgccgaccgcaaagatccgcgcgtggcgcccgccctggccggcaacttcaagggactgccgcccgcgctcgttatcacggcggaattcgatccgctgcgcgatgaaggcgagacttacggcgagaagctgcgcgcggccggcgttcccgtcaccgtctcgcgctacgagggaatgatccacggatttttttcgatgtacgaagtgctcgacaagggcaagctggcgatcgaggaatccgccgaggcgctccgcaaagcgctcgcgaagtagcgtcgagcgtcaccactgctcatagtgcacggagcgccgttcgtagcctgcgccgcgaagcagatc

SEQ ID NO: 1431 - protein, 310 aa, UNCULTURED BACTERIUM
MPLDPQARMLMDQLAAASGPKLNSLEPADARRLTANMFRVPPERAERVAKVEDRKIPGPAGEIPIRVYTPEGAGPFPVLVFFHGGGWVICGLDTHDGPCRALTNKAGCVTVSVDYRLAPENKFPAGVEDCFAATKWVAAHAKELNADADRLAVGGDSAGGNLSAVISQLARDAGGPKIAFQLLIYPATEAELDTYSHKTFTDYFLTRDDIVYFWKHYLRSPADRKDPRVAPALAGNFKGLPPALVITAEFDPLRDEGETYGEKLRAAGVPVTVSRYEGMIHGFFSMYEVLDKGKLAIEESAEALRKALAK

SEQ ID NO: 1432 - DNA, 759 bp, SHEWANELLA PIEZOTOLERANS
atgcactatacgaccaatggcaatggaccggttgtgattcttatccacggattatttggagatctcgataaccttaaagcgcttggtaaaagtttagaagatagctttaccgtcgtgagagttgatgttgccaaccatggaagtagtaagaaagtctcctctatgacctacctatcgttggctgaagatatcaagcggctcattgaaaccctaaaagttaacagtgctattttagttggccactccatgggcggtaaaatagcgatggcgacagcgctatcttaccctggcctggttaacaagctggtggtagcagatatagcccccgtctcctataacagtcgccatgataaagtatttgaagcgctcgaaagtatgccgctgaaccaaattaaagacagacgcgatgcactcgaacatatgcgtgcgcatgatatcgatgaaggtaccgctcagtttcttttaaaatcgctagtgcgtcgtgaccaaggttttaaatggaagatgaatttaaccggcttaaaacaaagctatagcgacataattagttggccaacattcacatcgccataccaaggagcttgtctatttattagaggcggcgactcagactatgttacgtcggcacaccgaaacgctataattgagcaattcccaacagttaaagcaaagactattgagggcacgggccattggttacatgctcaaaaagccagcatttttaaccgtatggttaaagatttcattaccaataaatga

SEQ ID NO: 1433 - protein, 252 aa, SHEWANELLA PIEZOTOLERANS
MHYTTNGNGPVVILIHGLFGDLDNLKALGKSLEDSFTVVRVDVANHGSSKKVSSMTYLSLAEDIKRLIETLKVNSAILVGHSMGGKIAMATALSYPGLVNKLVVADIAPVSYNSRHDKVFEALESMPLNQIKDRRDALEHMRAHDIDEGTAQFLLKSLVRRDQGFKWKMNLTGLKQSYSDIISWPTFTSPYQGACLFIRGGDSDYVTSAHRNAIIEQFPTVKAKTIEGTGHWLHAQKASIFNRMVKDFITNK

SEQ ID NO: 1434 - DNA, 1254 bp, BACILLUS SP. TOSH
atgatgaaatgctgtcgggttatgtttgtgttgctcggattatggcttgtattcggcctatcggtcccgggagggcgggctgaagcggcaacttcacgcgccaacgatgcacccatcgtgcttctccatggttttaccggctggggaagagaagaaatgtttgggttcaagtactggggcggcgtgcgcggcgatatcgaacaatggctgaacgacaacggttatcgaacttatacgctggcggtcggaccgctctcgagcaactgggaccgggcgtgtgaagcgtatgctcagcttgtcggcgggacggtcgattatggggcagcccatgcggcaaagcacggccatgcgcggtttggccgcacttatcccggcctgttgccggaattgaaaaggggtggccgcatccatatcatcgcccacagccaaggggggcagacggcccgcatgcttgtctcgctcctagagaacggaagccaagaagagcgggagtacgccaaggcgcacaacgtgtcgttgtcgccgttgtttgaaggtggacatcattttgtgttgagtgtgacgaccatcgccactcctcatgacgggacgacgcttgtcaacatggttgatttcaccgatcgcttttttgacttgcaaaaagcggtgttggaagcggcggctgtcgccagcaacgcgccgtacacaagcgaaatatacgattttaagctcgaccaatgggggctgcgccgcgagccaggcgaatcgttcgaccattattttgaacggctcaagcgctcccctgtctggacatcgaccgataccgcccgctacgatttatccgttcccggggctgagacgttgaatcgatgggtgaaagccagcccgaatacgtattatttgagcttttctaccgaacggacgtatcgaggagctctgacaggcaactattatcccgaacttggaatgaacgcattcagcgcgattgtctgcgccccgtttctcggctcgtaccgcaatgcggcgcttggcattgacagccattggcttgagaacgacggcattgtcaataccatttcgatgagcggtccgaagcgtggatcaagcgatcggatcgtaccgtatgacggggcgttgaaaaaaggggtttggaatgacatgggaacgtacaatgtcgaccatttggaaatcatcggcgttgacccgaatccgtcatttgatattcgcgccttttatttgcggcttgccgagcagttggcgagcttgcggccttaa

SEQ ID NO: 1435 - protein, 417 aa, BACILLUS SP. TOSH
MMKCCRVMFVLLGLWLVFGLSVPGGRAEAATSRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNAPYTSEIYDFKLDQWGLRREPGESFDHYFERLKRSPVWTSTDTARYDLSVPGAETLNRWVKASPNTYYLSFSTERTYRGALTGNYYPELGMNAFSAIVCAPFLGSYRNAALGIDSHWLENDGIVNTISMSGPKRGSSDRIVPYDGALKKGVWNDMGTYNVDHLEIIGVDPNPSFDIRAFYLRLAEQLASLRP

SEQ ID NO: 1436 - DNA, 641 bp, Bacillus subtilis
atgaaatttgtaaaaagaaggatcattgcacttgtaacaattttgatgctgtctgttacatcgctgtttgcgttgcagccgtcagtaaaagccgctgaacacaatccagtcgttatggttcacggcattggaggggcatcattcaattttgcgggaattaagagctatctcgtatctcagggctggtcgcgggacaagctgtatgcagttgatttttgggacaagacaggcacaaattataacaatggaccggtattatcacgatttgtgcaaaaggttttagatgaaacgggtgcgaaaaaagtggatattgtcgctcacagtatggggggcgcgaacacactttactacataaaaaatctggacggcggaaataaagttgcaaacgtcgtgacgcttggcggcgcgaaccgtttgacgacaggcaaggcgcttccgggaacagatccaaatcaaaagattttatacacatccatttacagcagtgccgatatgattgtcatgaattatttatcaagattagacggtgctagaaacgttcaaatccatggcgttggacacatcggccttctgtacagcagccaagtcaacagcctgattaaagaagggctgaacggcgggggccagaatacgaattaatg

SEQ ID NO: 1437 - protein, 212 aa, Bacillus subtilis
MKFVKRRIIALVTILMLSVTSLFALQPSVKAAEHNPVVMVHGIGGASFNFAGIKSYLVSQGWSRDKLYAVDFWDKTGTNYNNGPVLSRFVQKVLDETGAKKVDIVAHSMGGANTLYYIKNLDGGNKVANVVTLGGANRLTTGKALPGTDPNQKILYTSIYSSADMIVMNYLSRLDGARNVQIHGVGHIGLLYSSQVNSLIKEGLNGGGQNTN

SEQ ID NO: 1438 - DNA, 891 bp, Pseudomonas fluorescens
atgtcccaagagcttgccacccgttaccccctggtcctggtgcccggcatgctcggctttgtccgcctgctgctgtacccctactggtacgggatcattccggccttgcgccggggcggggcgcaggtgatcgcggtgcaggtctcgccgctcaattccagcgaggtgcgcggtgagcagttgctggcgcagatccagcggatcatggccgagaccggcgccgcccgagtcaacctgatcggccacagccagggcgcgctcaccgcgcgctacgccgccgccaggcgcccggactgggtggcctcggtaacgtcggtggcggggcccaaccatggctccgagctggcggattatctgcagcggcattcacccgcccatagcctgcgggggcgagtgctgagcctgctgctgagggggatttcaagcctgatgcggttgctggaaaccggctatcgcggaccgaagcagccggtggatatccatgcttcgcaccagtccctgaccaccgagggcgtggccctgttcaaccgccagtacccccagggattgccgcaggaatggggcgggcaagggccggcgcaggtcgacggtgtgcactactactcctggtccggcattttgcagccgggcaagaccaaccgcgggcgtaacctgttcgacggcaccaaccgcagttgccggctgttcgcccgcaccttcgtccgtgaagccggccagtgcgacggcatggtggggcgctacagctcgcacctggggcaggtcattggcgatgattacccgctggaccatttcgatatcgtcaaccagtccctggggctggtgggcaagggcgcggagccgatccgcctgttcgtcgaacatgcccggcgcctcaaggccgccggcctctga

SEQ ID NO: 1439 - protein, 296 aa, Pseudomonas fluorescens
MSQELATRYPLVLVPGMLGFVRLLLYPYWYGIIPALRRGGAQVIAVQVSPLNSSEVRGEQLLAQIQRIMAETGAARVNLIGHSQGALTARYAAARRPDWVASVTSVAGPNHGSELADYLQRHSPAHSLRGRVLSLLLRGISSLMRLLETGYRGPKQPVDIHASHQSLTTEGVALFNRQYPQGLPQEWGGQGPAQVDGVHYYSWSGILQPGKTNRGRNLFDGTNRSCRLFARTFVREAGQCDGMVGRYSSHLGQVIGDDYPLDHFDIVNQSLGLVGKGAEPIRLFVEHARRLKAAGL

SEQ ID NO: 1440 - DNA, 1595 bp, Pseudomonas fluorescens
aagcttgcatgcctgcagacaagccccctgttgcaaacaaaccgcctgaggcaagccgaccccctgtggcgagcgggcttgcccgttgggctgcgcagcagcaataaaaccacacaatctccggccaattccaacaacaagagagacaagacaatgggtgtatttgactacaagaacctcggcaccgaagccagcaaaaccttgttcgccgatgccaccgcaatcacgttgtatacctatcacaacctggataacggcttcgcagtcggctaccagcaacatggcttggggctcggctgccggcacactggtcggggcgttgctcggcagcacagactcccagggagtgatcccccggcattccctggaatcctgactcggaaaaggccgccctggacgcggtgcacgcagccggttggacgccaatcaagcgccagcgcactgggctacggcggcaaggtggatgcgcggggcactttttttggcgagaaggccggctacaccacggcccaggccgaagtgctgggcaagtacgatgacgccggcaaactgctcgagatcggcatcggttttcgtggcacctcgggccctcgggaaagcctgattacgactccatgccgatctggtcagcgacctgctcgccgcgctgggccccaaggactatgcgaaaaactatgccggcgaacgtttggcggcttgctcaagacggtggccgactatgccggcgcccatggcctgagtggcaaggatgtgctggtcagcggccacagcctgggcggcctggcggtcaacagcatggccgacctgagcaccagcaaatgggcgggtttctacaaggacgccaactacctggcctacgcctcgcccacccagagcgccggcgataaggtcctgaatatcggctacgaaaacgacccggtattccgtgcgctggacggctccaccttcaacctgtcgtccctcggcgtgcatgacaaggcccacgagtcgaccaccgacaacatcgtcagcttcaacgaccactacgcctcgacgttgtggaatgtgctgccgttttccatcgccaacctgtcgacctgggtgtcgcatttgcccagcgcttacggcgacggcatgacgcgtgtgctggaatcggggttctacgagcaaatgacccgtgactcgacgattatcctgtgcccaacctggtccgacccggcgcgcgccaacacctgggtccaggacctcaaccgcaatgccgagccgcacacaggcaataccttcatcatcggcagcgacggcaatgacctgatccagggcggcaagggcgcggacttcatcgaaggcggcaagggcaatgacacgatccgcgacaacagcgggcacaacacctttttgttcagcgggcattttggccaggatcggattatcggctaccagccgacaggctggtgttccagggcgccgacggcagcaccgacctgcgcgaccacgcgaaggccgtgggggccgatacggtgctgagttttggcgccgactcggtgacctggtcggggtcgggctgggcggcctgtggagcgagggtgtgctgatccccgggtaccgagctcgaattc

SEQ ID NO: 1441 - protein, 449 aa, Pseudomonas fluorescens
MGVFDYKNLGTEASKTLFADATAITLYTYHNLDNGFAVGYQQHGLGLGCRHTGRGVARQHRLPGSDPPAFPGILTRKRPPWTRCTQPVGRQSSASALGYGGKVDARGTFFGEKAGYTTAQAEVLGKYDDAGKLLEIGIGFRGTSGPRESLITTPCRSGQRPARRAGPQGLCEKLCRRTFGGLLKTVADYAGAHGLSGKDVLVSGHSLGGLAVNSMADLSTSKWAGFYKDANYLAYASPTQSAGDKVLNIGYENDPVFRALDGSTFNLSSLGVHDKAHESTTDNIVSFNDHYASTLWNVLPFSIANLSTWVSHLPSAYGDGMTRVLESGFYEQMTRDSTIILCPTWSDPARANTWVQDLNRNAEPHTGNTFIIGSDGNDLIQGGKGADFIEGGKGNDTIRDNSGHNTFLFSGHFGQDRIIGYQPTGWCSRAPTAAPTCATTRRPWGPIRC

SEQ ID NO: 1442 - DNA, 1095 bp, Burkholderia cepacia
atggccaggacgatgcgttccagggtggtggcaggggcagtggcatgcgcgatgagcatcgcgccgttcgcggggacgaccgcggtgatgacgctcgcgacgacgcacgcggcaatggcgcccaccgcgcccgccgctggctacgcggcgacgcgttacccgatcatcctcgagcacgggctctcgggtaccgacaagtacgccggcgtgctcgagtattggtacggcatccagcaggacctgcaacagaacggtgcggccgtctacgtcgcgaacctgtcgggtttccagagcgacgacggcccgaacgggcgcggcgaacagttgctcgcttacgtgaagacggtgctcgcggcgacgggggcgaccaaggtcaatctcgtcggtcacagccagggcggcctctcgtcgcgctatgttgctgccgtcgcgcccgatctcgttgcgtcggtgacgacgatcggcacgccgcatcgcggctccgaattcgccgacttcgtgcaggacgtgctcgcgtacgatccgaccgggctttcgtcatcggtgatcgccgcgttcgtcaatgtgttcgggatcctgacgagcagcagccacaacaccaaccaggacgcgctcgccgcactgcagacgctgaccaccgcacgggccgccacgtacaaccagaactatccgagcgcgggcctgggtgcgccgggcagttgccagaccggtgcgccgaccgaaaccgtcggcggcaacacgcacctgctgtattcgtgggccggcacggcgatccagccgacgctctccgtgttcggcgtcacgggcgcgacggacacgagcacccttccgctcgtcgatccggcgaacgtgctcgacctgtcgacgctcgcgctgttcggcaccggcacggtgatgatcaaccgcggctccgggcagaacgacgggctcgtgtcgaagtgcagtgcgctgtacggcaaggtgctgagcacgagctacaagtggaaccacctcgacgagatcaaccagctgctcggcgtgcgcggcgcgtatgcggaagatcccgtcgcggtgatccgcacgcatgcgaaccggctgaagctggcgggcgtgtaa

SEQ ID NO: 1443 - protein, 364 aa, Burkholderia cepacia
MARTMRSRVVAGAVACAMSIAPFAGTTAVMTLATTHAAMAPTAPAAGYAATRYPIILEHGLSGTDKYAGVLEYWYGIQQDLQQNGAAVYVANLSGFQSDDGPNGRGEQLLAYVKTVLAATGATKVNLVGHSQGGLSSRYVAAVAPDLVASVTTIGTPHRGSEFADFVQDVLAYDPTGLSSSVIAAFVNVFGILTSSSHNTNQDALAALQTLTTARAATYNQNYPSAGLGAPGSCQTGAPTETVGGNTHLLYSWAGTAIQPTLSVFGVTGATDTSTLPLVDPANVLDLSTLALFGTGTVMINRGSGQNDGLVSKCSALYGKVLSTSYKWNHLDEINQLLGVRGAYAEDPVAVIRTHANRLKLAGV

SEQ ID NO: 1444 - DNA, 2485 bp, BURKHOLDERIA SP. HY-10
ggtgcgcgtgagcgcgaagctgtgacgcgaggcccgcatgtgcggcgcagcatgcgcatgcgcgggcagacccccgcccgaacgggcggggcgcgtcaagcgattagagaaccgtgtctagtcagggcgcaaatgttcacgactcgtgcttcactccggcagtcgacggtcagacgcgtgcgagggcgtcgcgggtgtcgattcgatgtcgttcgtaccgtgagcacaataatcaggagaacttgcatggccagatcgatgcgttccagggtggtggcaggggcagtggcgtgcgcgatgagcgtcgcgccgttcgcgggaagcgccgcgttgatgttggcggcgacgacgcgcgcggcgatggcggcgagcgcgccggccgatacttacgcggcgacgcgttatccgatcattctcgtgcacgggctcaccggcaccgacaagtacgcgggcgtgctcgaatactggtatggcatccgggaagacctgcagtcgcacggtgcgaccgtctacgtcgcgaatctgtcgggcttccagagcgacgacggcccgaacgggcgcggcgaacagctgctcgcgtacgtgaagacggtgcttgccgcgacgggcgcgaccaaggtcaacctgatcggccacagccagggcggcctgacgtcccgctacgtcgcggccgtcgcgcccgatctcgtcgcgtcggtgacgacgatcggcacgccgcatcgcggctccgagttcgcggacttcgtgcaggggctgctgaaactcgatcctactggactgtcgtcgtcggtattggccggcttcgccaatctcttcggggtgctgacgagcagctcgaacagcacgaaccagaatgcgattgccgcgctcggcgcgctcgaaacgtcgcaggcggcgatcttcaaccagaactatccgagcgcgggcctcggcgcgccgggcagttgccagaccggtgcgtcgaccgagaccgtcggcggcaacaagcacctgctgtactcgtgggcgggcaccgctatccagccggtcacttccttgttcggctcgacgggtgcgaaggatgtgagcacgattccgctcgtcgatccggcgaacgcgctcgacctgtcgacgctcgcgctgctgggcaccggcaccgtgatgatcagtcgcggctcgggcccgaacgacgggctcgtgtcgaagtgcagcgcgctgtacgggcaggtgctgggcacgaattacaagtggaaccacatcgacgagatcaaccagttgctcggcgtgcgcggcgcctatgcggaagatccggtcgcggtgatccgcacgcatgcgaaccggttgaagctcgcgggcgtgtgatcgatgaccgtgcgtgaaggtgaaggacgcgcgccgctggcgcggcgcgccgtggtctatggcgtcgtggggctggcggcggttgccggcgccgcggtgtggagcggggcggcatggcatcgcggtgccgataccccgcgcggatcgacggatgcggtgacctcgggcggcgcggccgccgcgttgccgcaagccgtcgtgccggcgagcggaggcttgccggcgccactggccggttccagcgcgccgcggctgccgctcgatgccggcggacatctcgcgaagtcgcgcgcggtgcgcgacttcttcgactattgcctgaccgcgcagagcgacctgagcgcgcccgcgctcgatgcgcttgtcgtgcgcgagatcgcggcgcagctcgacggcaccgtcgcgcagcccgaggcgctcgatgtctggcaccgctatcgcgcgtatctcgatgcgctcgcgaagttgcccgccgccggcgcggtcgacaagtcggacatgagcgcattgcagctcgcgctcgatcagcgcgcgtcgatcgcgtaccggacgctcggcgactggagccagccgttcttcggtgcggagcagtggcggcagcgctacgatctcgcgcggctcgggatcgtgcaggatcgcacgctgaccgacgcgcagaaggccgagcggctcgcggcgctcgcgcagcagatgccggccgacgaacgggccgcgcagcagcgcgctgagcagcagcaggccgcggtcgaccagatcgcgcaattgcggaagaacggcgcgacgcccgatgcgatgcgcgcgcaactgacgcagtcgctcggccctgaggccgccgcgcgggtcgtgcagatgcagcaggacgacgcgtcgtggcaaagccgttacgcggactattcggcccagcgcgcgcagatcgacggagccgggctgtcgccgtcggatcgcgacgcgcagatcgccgcgctgcggcagcggatcttcacgaagcccggcgaagcggtgcgcgcggcgtcgctcgaccgcggcgcgggcgccgcgcggtaacgccggcgcgccgcgccgccggctcgctcacgccgcccgcgtggcgcgccgcggcagatgctgttcgatgaccgcggcgagcgttcgaaggccgaggcac

SEQ ID NO: 1445 - protein, 364 aa, BURKHOLDERIA SP. HY-10
MARSMRSRVVAGAVACAMSVAPFAGSAALMLAATTRAAMAASAPADTYAATRYPIILVHGLTGTDKYAGVLEYWYGIREDLQSHGATVYVANLSGFQSDDGPNGRGEQLLAYVKTVLAATGATKVNLIGHSQGGLTSRYVAAVAPDLVASVTTIGTPHRGSEFADFVQGLLKLDPTGLSSSVLAGFANLFGVLTSSSNSTNQNAIAALGALETSQAAIFNQNYPSAGLGAPGSCQTGASTETVGGNKHLLYSWAGTAIQPVTSLFGSTGAKDVSTIPLVDPANALDLSTLALLGTGTVMISRGSGPNDGLVSKCSALYGQVLGTNYKWNHIDEINQLLGVRGAYAEDPVAVIRTHANRLKLAGV

SEQ ID NO: 1446 - protein, 346 aa, BURKHOLDERIA SP. HY-10
MTVREGEGRAPLARRAVVYGVVGLAAVAGAAVWSGAAWHRGADTPRGSTDAVTSGGAAAALPQAVVPASGGLPAPLAGSSAPRLPLDAGGHLAKSRAVRDFFDYCLTAQSDLSAPALDALVVREIAAQLDGTVAQPEALDVWHRYRAYLDALAKLPAAGAVDKSDMSALQLALDQRASIAYRTLGDWSQPFFGAEQWRQRYDLARLGIVQDRTLTDAQKAERLAALAQQMPADERAAQQRAEQQQAAVDQIAQLRKNGATPDAMRAQLTQSLGPEAAARVVQMQQDDASWQSRYADYSAQRAQIDGAGLSPSDRDAQIAALRQRIFTKPGEAVRAASLDRGAGAAR

SEQ ID NO: 1447 - DNA, 2629 bp, Pseudomonas aeruginosa
accatttcagcctgttttgctcgcaaaacgacgccgcgggcgtgcgctaccgcacactcggtcgctgggcgttgtgcggggaagattcaaacgagcgtttcgcgccgtaacaacccgcctcttccgctctgccacgcaggttatgaccggccgccaggaagccgcggatttcctggcctggaggaaaaaagccgaagctggcacggttcctgcgcaagggacagcgaagcggttctcccggaaggattcgggcgatggctggcaggacgcgcccctcggccccatcaacctgagatgagaacaacatgaagaagaagtctctgctccccctcggcctggccatcggcctcgcctctctcgctgccagcccgctgatccaggccagcacctacacccagaccaaataccccatcgtgctggcccacggcatgctcggcttcgacaacatcctcggggtcgactactggttcggcattcccagcgccttgcgccgtgacggtgcccaggtctacgtcaccgaagtcagccagttggacacctcggaagtccgcggcgagcagttgctgcaacaggtggaggaaatcgtcgccctcagcggccagcccaaggtcaacctgatcggccacagccacggcgggccgaccatccgctacgtcgccgccgtacgtcccgacctgatcgcttccgccaccagcgtcggcgccccgcacaagggttcggacaccgccgacttcctgcgccagatcccaccgggttcggccggcgaggcaatcctctccgggctggtcaacagcctcggcgcgctgatcagcttcctttccagcggcagcaccggtacgcagaattcactgggctcgctggagtcgctgaacagcgagggggccgcgcgcttcaacgccaagtacccgcagggcatccccacctcggcctgcggcgaaggcgcctacaaggtcaacggcgtgagctattactcctggagcggttcctcgccgctgaccaacttcctcgatccgagcgacgccttcctcggcgcctcgtcgctgaccttcaagaacggcaccgccaacgacggcctggtcggcacctgcagttcgcacctgggcatggtgatccgcgacaactaccggatgaaccacctggacgaggtgaaccaggtcttcggcctcaccagcctgttcgagaccagcccggtcagcgtctaccgccagcacgccaaccgcctgaagaacgccagcctgtaggaccccggccggggcctcggccccggccctttcccggaagccccctcgcgtgaagaaaatcctcctgctgattccactggcgttcgccgccagcctggcctggttcgtctggctggaaccttcccccgcccccgagacggcgcccccggccagcccgcaggcgggcgcagaccgcgccccgccagcagcctccgcgggagaagcggtgccggccccccaggtcatgccggccaaggtcgcgccgctgccaacctccttcaggggcaccagcgtcgatggcagtttcagtgtcgacgccagcggcaacctgctgatcacccgcgacatccgcaacctgttcgactacttcctcagcgccgtcggcgaagagcccctgcagcaaagcctggaccgcctgcgcgcctacatcgccgccgaactccaggagccggcgcgcggccaggcgttggcgctgatgcagcaatacatcgactacaagaaggaactggtgctgctcgaacgcgacctgccgcgcctggccgacctcgacgccctgcgccagcgggaagccgcggtgaaagccctgcgcgcgcggatcttcagcaacgaagcgcacgtggcgttcttcgccgacgaggaaacctacaaccagttcaccctggagcgcctggcgatccgccaggacggcaagctcagcgccgaggaaaaggccgccgccatcgaccgcctgcgcgccagcctgccggaagaccagcaggaaagcgtgctgccgcaactgcaaagcgaactgcagcagcagaccgccgccctccaggccgctggcgccggcccggaagccatccgccagatgcgtcagcaactggtgggcgccgaagccaccacccgcctggagcaactcgatcggcaacgctcggcctggaagggccggctggacgactatttcgccgagaagagccggatcgaaggcaataccgggctgagcgaagccgaccgccgcgcggcggtcgaacgcctggccgaggagcgcttcagcgaacaggaacgcttgcgcctgggcgcgctggaacagatgcgccaggccgagcagcgctgaccggcacggaaacgccgagaacgcggcgaagggcgcttcggcggataacgctaccctcaggggtgcagccctggcgtggccggcgaggcggaaacctgtgctgcgcgccgcaacgaaaaagggcggccacccgaaggtgtccgccctttttcgtcgccagcccggttcagcgggacagcttgccgtccagcgagaacttgccggcgccatcgatcagcagcgccacgctgatcatcagcagggtcagggcatattcatagccgttgtcggtgatgaagaagccattgccgatgtgcacgctgaagatcgccacgat

SEQ ID NO: 1448 - protein, 311 aa, Pseudomonas aeruginosa
MKKKSLLPLGLAIGLASLAASPLIQASTYTQTKYPIVLAHGMLGFDNILGVDYWFGIPSALRRDGAQVYVTEVSQLDTSEVRGEQLLQQVEEIVALSGQPKVNLIGHSHGGPTIRYVAAVRPDLIASATSVGAPHKGSDTADFLRQIPPGSAGEAILSGLVNSLGALISFLSSGSTGTQNSLGSLESLNSEGAARFNAKYPQGIPTSACGEGAYKVNGVSYYSWSGSSPLTNFLDPSDAFLGASSLTFKNGTANDGLVGTCSSHLGMVIRDNYRMNHLDEVNQVFGLTSLFETSPVSVYRQHANRLKNASL

SEQ ID NO: 1449 - protein, 340 aa, Pseudomonas aeruginosa
MKKILLLIPLAFAASLAWFVWLEPSPAPETAPPASPQAGADRAPPAASAGEAVPAPQVMPAKVAPLPTSFRGTSVDGSFSVDASGNLLITRDIRNLFDYFLSAVGEEPLQQSLDRLRAYIAAELQEPARGQALALMQQYIDYKKELVLLERDLPRLADLDALRQREAAVKALRARIFSNEAHVAFFADEETYNQFTLERLAIRQDGKLSAEEKAAAIDRLRASLPEDQQESVLPQLQSELQQQTAALQAAGAGPEAIRQMRQQLVGAEATTRLEQLDRQRSAWKGRLDDYFAEKSRIEGNTGLSEADRRAAVERLAEERFSEQERLRLGALEQMRQAEQR

SEQ ID NO: 1450 - DNA, 1828 bp, Pseudomonas fluorescens
gcgcgcgggtcagcctggcgttgagcaaggacgcgaaggtgaatcttgattacaacggcctgctggccagcaaggagaaagtccatggcgtcggcttgagcctcgactgggcgttctgaaataccgttgtttggctttctcgacaattccaacaaaagagaggcaataccatgggtgtctttgactataaaaacctcgggaccgagggctccaaagcgttgttcgccgatgccatggcgatcacgttgtactcctaccacaacctggataacggctttgcagtgggctaccagcacaacggttttggcctgggcctgcccgcaaccctggtgggcgcgttgctgggcagtactgattcccaaggggtgattccggggattccctggaaccccgattcggaaaaggccgccctcgatgcggtgcacaaggccggctggacgcccatcagcgccagcaccctgggctacggtggcaaggtcgacgcccggggcacgttcttcggtgaaaaagccggctataccaccgctcaggtggaagtgctgggcaagtacgatggtgacggcaagttgctggaaatcggcatcggttttcgcggcacctccggcccccgggaaaccctgatcagcgattccatcggcgatttggtcagtgacctgctggccgcgctggggccgaaggattacgcgaaaaactacgcgggcgaagcctttggcaccttgctcaaggatgtcgcggcgtatgccggcagccatgggttgacgggcaaggacgtggtggtcagcggccatagcctgggtggcctggcggtcaacagcatggccgacttgagcggcaataaatggtcgggattctacaaggattccaactacgtggcctacgcctcgccgacccagagtgccggcgacaaggtgctgaacatcgggtatgaaaatgacccggtatttcgtgccctggacggttcgtcgttcaatttctcgtccctgggcgtgcacgacaagccccatgagtcgaccaccgacaatatcgtcagcttcaacgatcactatgcgtcgacgctgtggaatgtcctgccgttttccatcgtcaatgtgccgacctggatctcccatttgcccacggcgtatggggatggcttgacgcgggtgctggactcgcagttctacgacctgaccagccgggactcgacgattatcgtggccaacctgtcggacccggcccgcgccaatacctgggtgcaggaccttaaccgcaacgccgagccccacaagggcaacacgttcatcatcggcagtgacggtaatgacctgattcagggcggcaagggcgtggacttcatcgagggtggcaagggcaatgacacgatccgcgacaacagtgggcataacacctttctgttcggagggcagtttgggcaggaccgggtgatcggctaccagcccaccgacaagctggtgttccgggatgtggagggcagtgctgactggcgcgatcacgccaaggtggtgggtagcgatacggtgctgagttttggcgcggactcggtaacgctggtgggggttggactggccggggtgtggggcgatggaatttccatcagctaaatagcgctgctgttgtggcgagggagcaagctccctcgccacagggttagtcagcgtctggggaggggttatctccagtagtggccgtggttccagtacgggcgatggggttggccgtagccgtagccgtagtaatgaccgcttggccagtagcctcgcgggccgtagccataaccccagtggccgtagtagccgggaggaggcggttgcacgattaccacgcgcgc

SEQ ID NO: 1451 - protein, 476 aa, Pseudomonas fluorescens
MGVFDYKNLGTEGSKALFADAMAITLYSYHNLDNGFAVGYQHNGFGLGLPATLVGALLGSTDSQGVIPGIPWNPDSEKAALDAVHKAGWTPISASTLGYGGKVDARGTFFGEKAGYTTAQVEVLGKYDGDGKLLEIGIGFRGTSGPRETLISDSIGDLVSDLLAALGPKDYAKNYAGEAFGTLLKDVAAYAGSHGLTGKDVVVSGHSLGGLAVNSMADLSGNKWSGFYKDSNYVAYASPTQSAGDKVLNIGYENDPVFRALDGSSFNFSSLGVHDKPHESTTDNIVSFNDHYASTLWNVLPFSIVNVPTWISHLPTAYGDGLTRVLDSQFYDLTSRDSTIIVANLSDPARANTWVQDLNRNAEPHKGNTFIIGSDGNDLIQGGKGVDFIEGGKGNDTIRDNSGHNTFLFGGQFGQDRVIGYQPTDKLVFRDVEGSADWRDHAKVVGSDTVLSFGADSVTLVGVGLAGVWGDGISIS

SEQ ID NO: 1452 - DNA, 930 bp, Streptomyces fradiae
atgctgcccccgcgcccgcccgccgcaccgcggcgcaccctgcgagccctgaccgcgctcctcctgctcgccgccgcgctcctcttcgccccggccgccaccgcgcacgccgcgaccccgcccgccgccaccgaccggaccgccgccacggccgccacggccggggcgtccggggcgggctggaacgactacgcctgcaagccctccgccgcccacccgcgccccgtcgtcctcgtccacggcacgttcggcaactccgtcgacaactggctgggactcgccccctacctggtgcggcgcggctactgcgtcttctccctcgactacgggcagctgcccggtgtgccgttcttccacggccccggcctcgtcgccgagtccgccgggcagctcgacgcgtacgtcgaccgggtcctcggcgcgaccggtgcccgcgaggtggacatcgtgggccactcccagggcggcatgatgccccgccactacctcaagttcctcggcggcgccgagaaggtgaacgcgctcgtcggcatcgcccccgacaaccacggcaccaccctgcacggcctcacccggctgctgccgcacttccccggcgcggccgacctcatcagcgcgaagacccccgccctcgccgaccagatcgccggctcccccttcctccagcggctcaacgagggcggcgacacggtgcccggcgtccgctacaccgtcatcgccacccggtacgaccaggtcgtcaccccgtaccgctcctcgttcctcgacgggccgaacgtgcgcaacgtgctcctccaggacctgtgccccctcgacctctccgagcacctggccatcgggctggtcgaccggatcgccttccacgaggtggccaacgccctcgaccccgcgcgcgccacccccaccacctgcgcctcggtcctcggctga

SEQ ID NO: 1453 - protein, 309 aa, Streptomyces fradiae
MLPPRPPAAPRRTLRALTALLLLAAALLFAPAATAHAATPPAATDRTAATAATAGASGAGWNDYACKPSAAHPRPVVLVHGTFGNSVDNWLGLAPYLVRRGYCVFSLDYGQLPGVPFFHGPGLVAESAGQLDAYVDRVLGATGAREVDIVGHSQGGMMPRHYLKFLGGAEKVNALVGIAPDNHGTTLHGLTRLLPHFPGAADLISAKTPALADQIAGSPFLQRLNEGGDTVPGVRYTVIATRYDQVVTPYRSSFLDGPNVRNVLLQDLCPLDLSEHLAIGLVDRIAFHEVANALDPARATPTTCASVLG

SEQ ID NO: 1454 - DNA, 1952 bp, GEOBACILLUS ZALIHAE
gcggtgatggaacgctgccatgacatagtgcatcaccctctcgctgtcggcgagaaacgaaatatgacggcacaaaagtgcatttttctctttccctcatcagaaaacccgacaattgccgggactgaatagcctgattatttagtatagaatattcaggtaattcggaataaaggggttcagtcgattcgaggggaggagaaggagagcgtgatgaaatgctgtcggattatgtttgtgttgctcggattatggtttgtgttcggcctatcggtcccgggagggcggacggaagcggcatccctacgcgccaatgatgcaccgattgtgcttctccatgggtttaccggatggggacgagaggaaatgtttggattcaagtattggggcggcgtgcgcggcgatatcgaacaatggctgaacgacaacggttatcgaacgtatacgctggcggtcggaccgctctcgagcaactgggaccgggcgtgtgaagcgtatgctcagcttgtcggcgggacggtcgattatggggcagcccatgcggcaaagcacggccatgcgcggtttggccgcacttatcccggcctgttgccggaattgaaaaggggtggccgcatccatatcatcgcccacagccaaggggggcagacggcccgcatgcttgtctcgctcctagagaacggaagccaagaagagcgggagtacgccaaggcgcataacgtgtcgttgtcaccgttgtttgaaggtggacatcattttgtgttgagtgtgacgaccatcgccactcctcatgacgggacgacgcttgtcaacatggttgatttcaccgatcgcttttttgacttgcaaaaagcggtgttggaagcggcggctgtcgccagcaacgtgccgtacacgagtcaagtatacgattttaagctcgaccaatggggactgcgccgccagccgggtgaatcgttcgaccattattttgaacggctcaagcgctcccctgtttggacgtccacagataccgcccgctacgatttatccgtttccggagctgagaagttgaatcaatgggtgcaagcaagcccgaatacgtattatttgagtttctctacagaacggacgtatcgcggagcgctcacaggcaaccattatcccgaactcggaatgaatgcattcagcgcggtcgtatgcgctccgtttctcggttcgtaccgcaatccgacgctcggcattgacgaccgatggttggagaacgatggcattgtcaatacggtttccatgaacggtccaaagcgtggatcaagcgatcggatcgtgccgtatgacgggacgttgaaaaaaggggtttggaatgatatgggaacgtacaacgtcgaccatttggaaatcatcggcgttgacccgaatccgtcatttgatattcgcgccttttatttgcggcttgccgagcagttggcgagcttgcagccttaaaacgagtattttgcgaaaaagccatctcgatcggatggctctttttatggaaaagttcccatgggcagcgcgctttgccctccacccggggatgaaattcacgcgtcagtcctgcatgttcacggaaaagtctcatgggcgactcgctcccctaaacccggggatgaaaatgactatcaagaagtatgcatgttcacggaaaaggtccatgggcaacggtttgccctctacccaaggataaaaatgacccatcccagcacgtgcattttcacagaagcgcattatgttgtatgacggccgcggatgtccgatggtataataagggtaaagcaagcggatgggggaatggacgtgaagccgcccgagcggcaaaaggaacggtatacgtatcaagattatgtcaagtgggacggacggtgggagctgatcaacggcgtgccctacaacatggcaccgaccccttcatttgtccgccagtctatcgtcgg

SEQ ID NO: 1455 - protein, 416 aa, GEOBACILLUS ZALIHAE
MKCCRIMFVLLGLWFVFGLSVPGGRTEAASLRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNVPYTSQVYDFKLDQWGLRRQPGESFDHYFERLKRSPVWTSTDTARYDLSVSGAEKLNQWVQASPNTYYLSFSTERTYRGALTGNHYPELGMNAFSAVVCAPFLGSYRNPTLGIDDRWLENDGIVNTVSMNGPKRGSSDRIVPYDGTLKKGVWNDMGTYNVDHLEIIGVDPNPSFDIRAFYLRLAEQLASLQP

SEQ ID NO: 1456 - DNA, 4012 bp, PSEUDOMONAS SP. MIS38
tacagttaaaagcaatgcaagtagtactgaaatgctccgggcgtgcccgtgaggggcgccctggctgtgagctatcttgacaattccaacaaaagagaggcaatagcaatgggtgtgtatgactacaagaacttcggcacagccgattccaaggcgctgttcagcgatgccatggcgatcacgctgtattcctaccacaacctcgataacggctttgccgccggttatcagcacaacggcttcggcctcggcctgccggccacgttggtcaccgcactgctcggcggtactgattcgcaaggggtgattcccggtattccgtggaaccccgactcggaaaaactcgcccttgacgccgtgaaaaaagctggctggacaccgatcaccgcctcgcaactgggctacgacggcaagaccgacgcgcgcggaaccttcttcggtgagaaggccggttacaccaccgctcaggtggaaatcctcggcaagtacgacgcccagggccatctcacggaaatcggcatcgcctttcgcggcaccagcggcccgcgggaaaacctgatcctcgattccatcggcgacgtgatcaacgacctgctggcagcgttcggtcccaaggactacgccaagaattacgtcggcgaagcgttcggcaatctactgaatgacgtggtggcgttcgccaaggccaacggcctcagcggcaaggacgtgctggtcagcggccacagcctcggcgggttggcggtcaacagcatggctgacctgagtggcggcaagtggggcggattcttcgccgattccaactacatcgcctacgcctcgccgacccagagcagcaccgacaaagtgctcaacgtcggttacgaaaacgatccggtgtttcgcgccctcgacggctcgaccttcaccggcgcctcggtcggcgtgcacgacgcgcccaaggaatcggccaccgacaacatcgtcagcttcaacgatcactacgcctcgaccgcgtggaatctgctgccgttctcgattctcaatatcccgacctggatctcgcatctgccgaccgcttacggcgacggcatgaaccgcatcatcgagtcgaagttctacgacctgaccagcaaggactcgacgatcatcgtcgccaacctgtcggacccggcgcgggccaacacctgggtgcaggatctgaaccgcaacgccgaaacccacaagggcagcacgttcatcatcggcagtgacagtaatgacctgatccagggcggcagcggcaacgactacctcgaaggtcgcgccggcaatgacactttccgtgacggtggtggctacaacgtgattctcggtggcgccggcaacaacaccctcgatttgcagaagtcggtgaacaccttcgacttcgccaacgacggcgccggcaatctgtacgtgcgcgacgccaacggcgggatcagcatcacccgcgacatcggtagcatcgtcaccaaggagccgggctttctctgggggctgttcaaggacgacgtgacccacagcgtcacggccagcggtctgaaggtcggcagcaacgtcactcagtatgatgccagcgtgaagggcaccaatggcgccgatacgctcaaggcgcatgccggcggtgactggttgtttggtctggatggcaacgatcatttgattggcggcgtcggcaatgatgtgtttgtcggtggcgccggtaatgacctgatggaatcggggggcggggcggatacgttcctgttcaacggcgcgttcggtcaggatcgggtggtgggttttacgtcgaacgacaaactggtgttccttggcgtccagggtgtgttgcccaatgatgacttccgcgcgcatgcctcgatggtggggcaggacacggtgctgaagtttggcggggattcggtgacattggttggggtggcgctgaatagcctcagtgccgatggaattgtgatcgcctgatgcatccgtaacctgtggcgagggagcttgtccgagctcgaatttacagttaaaagcaatgcaagtagtactgaaatgctccgggcgtgcccgtgaggggcgccctggctgtgagctatcttgacaattccaacaaaagagaggcaatagcaatgggtgtgtatgactacaagaacttcggcacagccgattccaaggcgctgttcagcgatgccatggcgatcacgctgtattcctaccacaacctcgataacggctttgccgccggttatcagcacaacggcttcggcctcggcctgccggccacgttggtcaccgcactgctcggcggtactgattcgcaaggggtgattcccggtattccgtggaaccccgactcggaaaaactcgcccttgacgccgtgaaaaaagctggctggacaccgatcaccgcctcgcaactgggctacgacggcaagaccgacgcgcgcggaaccttcttcggtgagaaggccggttacaccaccgctcaggtggaaatcctcggcaagtacgacgcccagggccatctcacggaaatcggcatcgcctttcgcggcaccagcggcccgcgggaaaacctgatcctcgattccatcggcgacgtgatcaacgacctgctggcagcgttcggtcccaaggactacgccaagaattacgtcggcgaagcgttcggcaatctactgaatgacgtggtggcgttcgccaaggccaacggcctcagcggcaaggacgtgctggtcagcggccacagcctcggcgggttggcggtcaacagcatggctgacctgagtggcggcaagtggggcggattcttcgccgattccaactacatcgcctacgcctcgccgacccagagcagcaccgacaaagtgctcaacgtcggttacgaaaacgatccggtgtttcgcgccctcgacggctcgaccttcaccggcgcctcggtcggcgtgcacgacgcgcccaaggaatcggccaccgacaacatcgtcagcttcaacgatcactacgcctcgaccgcgtggaatctgctgccgttctcgattctcaatatcccgacctggatctcgcatctgccgaccgcttacggcgacggcatgaaccgcatcatcgagtcgaagttctacgacctgaccagcaaggactcgacgatcatcgtcgccaacctgtcggacccggcgcgggccaacacctgggtgcaggatctgaaccgcaacgccgaaacccacaagggcagcacgttcatcatcggcagtgacagtaatgacctgatccagggcggcagcggcaacgactacctcgaaggtcgcgccggcaatgacactttccgtgacggtggtggctacaacgtgattctcggtggcgccggcaacaacaccctcgatttgcagaagtcggtgaacaccttcgacttcgccaacgacggcgccggcaatctgtacgtgcgcgacgccaacggcgggatcagcatcacccgcgacatcggtagcatcgtcaccaaggagccgggctttctctgggggctgttcaaggacgacgtgacccacagcgtcacggccagcggtctgaaggtcggcagcaacgtcactcagtatgatgccagcgtgaagggcaccaatggcgccgatacgctcaaggcgcatgccggcggtgactggttgtttggtctggatggcaacgatcatttgattggcggcgtcggcaatgatgtgtttgtcggtggcgccggtaatgacctgatggaatcggggggcggggcggatacgttcctgttcaacggcgcgttcggtcaggatcgggtggtgggttttacgtcgaacgacaaactggtgttccttggcgtccagggtgtgttgcccaatgatgacttccgcgcgcatgcctcgatggtggggcaggacacggtgctgaagtttggcggggattcggtgacattggttggggtggcgctgaatagcctcagtgccgatggaattgtgatcgcctgatgcatccgtaacctgtggcgagggagcttgtccgagctcgaatt

SEQ ID NO: 1457 - protein, 617 aa, PSEUDOMONAS SP. MIS38
MGVYDYKNFGTADSKALFSDAMAITLYSYHNLDNGFAAGYQHNGFGLGLPATLVTALLGGTDSQGVIPGIPWNPDSEKLALDAVKKAGWTPITASQLGYDGKTDARGTFFGEKAGYTTAQVEILGKYDAQGHLTEIGIAFRGTSGPRENLILDSIGDVINDLLAAFGPKDYAKNYVGEAFGNLLNDVVAFAKANGLSGKDVLVSGHSLGGLAVNSMADLSGGKWGGFFADSNYIAYASPTQSSTDKVLNVGYENDPVFRALDGSTFTGASVGVHDAPKESATDNIVSFNDHYASTAWNLLPFSILNIPTWISHLPTAYGDGMNRIIESKFYDLTSKDSTIIVANLSDPARANTWVQDLNRNAETHKGSTFIIGSDSNDLIQGGSGNDYLEGRAGNDTFRDGGGYNVILGGAGNNTLDLQKSVNTFDFANDGAGNLYVRDANGGISITRDIGSIVTKEPGFLWGLFKDDVTHSVTASGLKVGSNVTQYDASVKGTNGADTLKAHAGGDWLFGLDGNDHLIGGVGNDVFVGGAGNDLMESGGGADTFLFNGAFGQDRVVGFTSNDKLVFLGVQGVLPNDDFRAHASMVGQDTVLKFGGDSVTLVGVALNSLSADGIVIA

SEQ ID NO: 1458 - DNA, 1431 bp, UNCULTURED BACTERIUM
atgggtatctttgactataaaaacctcggtaccgagggctccaaagcgctgtttgccgacgccttggcgatcacgctgtattcctatcacaacctggatcacggctttgccgtgggctaccagaaccacggctttggcctcggcctgccggccacactggtcactgcagtgctgggcagtacggattcgcaaggcgtgattcccggcatcccctggaaccctgactcggaaaaagccgcccttgaagccgtgcaaaaagccggctggacgcctatcagcgccagcaccctgggctacggcggcaaagtcgatgcccgcggcacgttcttcggcgaaaaggccggctacaccacggcccaggtcgaggtgctgggcaagcacgatgacaccggtaagttgctggaaatcggcatcagttttcgcggcacatcggggccacgggagcacttgatcagtgactccatcggcgacctgatcagcgatctgctcgctgccctgggacccaaggattatgcaaaaaactacgccggcgaagcattcggcagtttgctcaagaacgtcgccgattatgccggcgcccatggcttgacgggccaggacgtgttggtcagcggccacagcctcggcgggttggcggtcaacagcatggcggacctgagcaacagccgatgggcgggcttctacaaggacgccaactacgtggcgtatgcctcgccgacccagagcgccggggacaaggtgctcaatatcggctatgagaacgacccggtgttccgtgccctggacggctcatccttcaacctgtcctccttgggcgtgcacgacaagccccatgagtcgactaccgacaatatcgtcaacttcaacgaccattacgcctcgacgttgtggaacgtgctgccattctccatcgtcaacctgccgacctggctctcccatttgcccttcggctatggcgatggcatgacccgcatcctcgaatccggcttctatgagcagatgacccgcgactctacggtgatcgtcgccaatctgtccgacccggcacgggccaacacctgggtacaggacctcaaccgcaatgcggaggcccacaagggcaacacgttcatcatcggcagtgacggcaacgacctgatccagggtggcaagggcgcggacttcatcgaaggcggcaagggcaatgacaccctccgtgacaacagtgggcataacacctttctgttcagcggccacttcggcaatgaccgggtgatcggctatcagcccacggacaagctggtgttcaaggacgtggaaggcagcaccgacctgcgtgaccatgccaaagtggttggcgcggacacggtgctcagctttggcgccgactcggtgaccctggtcggcgtcgggcatggcggcctatggacggacggcgtcagcatcggctga

SEQ ID NO: 1459 - protein, 476 aa, UNCULTURED BACTERIUM
MGIFDYKNLGTEGSKALFADALAITLYSYHNLDHGFAVGYQNHGFGLGLPATLVTAVLGSTDSQGVIPGIPWNPDSEKAALEAVQKAGWTPISASTLGYGGKVDARGTFFGEKAGYTTAQVEVLGKHDDTGKLLEIGISFRGTSGPREHLISDSIGDLISDLLAALGPKDYAKNYAGEAFGSLLKNVADYAGAHGLTGQDVLVSGHSLGGLAVNSMADLSNSRWAGFYKDANYVAYASPTQSAGDKVLNIGYENDPVFRALDGSSFNLSSLGVHDKPHESTTDNIVNFNDHYASTLWNVLPFSIVNLPTWLSHLPFGYGDGMTRILESGFYEQMTRDSTVIVANLSDPARANTWVQDLNRNAEAHKGNTFIIGSDGNDLIQGGKGADFIEGGKGNDTLRDNSGHNTFLFSGHFGNDRVIGYQPTDKLVFKDVEGSTDLRDHAKVVGADTVLSFGADSVTLVGVGHGGLWTDGVSIG

SEQ ID NO: 1460 - DNA, 3397 bp, Burkholderia cepacia
tgtattacgaattcgagctcggtacccggggatcctctagagattacgcgggctacgtgcaggatttcatcctgttcgactatgcgaccggcatgatgggcccgaccacgcaggcgaccaacgtcaacgcgcagatcatgggtggcgaggccggcgtgtcgtggcggccggtcgcgccgctgcgcgtcgagacgtcgctcgcgtatgcgtgggggcgcaacgtggcgagcggcgatccgctgccgcagatgccgccgctggaggcgcgcatcgggctcgaatacacgcgcggcgcctggtcggcgggcggcctgtggcgcatcgttgcgtcgcagcatcgctatgcgctgaacgagggcaacgtggtcggcaaggacttcggcccgagcgccggattcggcgtgctgtcgctgcatacgcagtacaacgtcagcaagaccgtgcagatttcggtgggggtcgacaacgtgctgaacaaggcctacaccgagcatttgaaccttgccggcaacgcgggtttcggctatccggcgaatgcgccggtgatggagccggggcgtaccgcgtgggtgcgcgtgagcgcgaagctgtagcccgcagcgcgcgtgtgcatcgcagcatgcgcacgcctgaacgccgcaccgcccgaacgggcggcgcgcgtcaaccgattagagaaccgtgtctagtcagggcgcaaacgttcgcgagtcgtgcttcactccgcattcgacacacgaggtccgtgcgaggcggcgtgcgtgtcgatccggtgtcattcgcaccggcagcacaataatcaggagaacatgcatggccaaatcgatgcgttccagggtaatggcaggggcagtggcatgcgcgatgagcgtcgcgccgttcgcggggacgaccgcgctgacgacgctcgcgacgacgcacgcggcgatggcggcaaccgcgcccgccgacgactatgcgacgacgcgctatccgatcattctcgtgcacgggttgaccggcaccgacaagtacgcgggcgtactcgattactggtacggcatccaggaagacctgcaacagcatggcgcgaccgtctacgtcgcgaacctgtcgggcttccagagcgacgacggcccgaacgggcgcggcgaacagctgctggcttacgtgaagacggtgctcgccgcgaccggcgcgaccaaggtcaatctcgtcggtcacagccagggcgggctgacgtcgcgctatgtcgcggccgtcgcgcccgatctcgtcgcgtcggtgacgacgatcggcacgccgcatcgcggctccgagttcgccgacttcgtgcaggacgtgctcgcatacgatccgacggaactgtcgtcgacggtgtacgccgcgttcgtcaatgtattcgggatcctgacgagcagcagccacaacacgaaccaagacgcactcgcgtcgctgaagacgctgacgaccgcgcaggccgccacctacaaccagaactatccgagcgcgggcctcggcgctcccggcagttgccagaccggcgcgccgacggaaaccgtcggcggcaacacgcatctgctgtattcgtgggccggcacggcgatccagccgacgctgtcgctgttcggcgtgacgggggcgacggatacgagcaccgttccggtcgtcgatccggcgaacgtgctcgacccgtcgacgctcgcgctgttcggcacgggcacggtgatgatcaaccgcggttcgggcgagaacgacgggctcgtgtcgaaatgcagcgcgctgtacggtgctgtgagcacgcgctacaagtggaaccatatcgatgagatcaaccagctgctcggcgtgcgcggcgcgtatgcggaagacccggtcgcggtgatccgcacgcatgcgaaccggctgaagctcgcgggcgtgtaatcgatggcggcacgtgaagggcgcgcgccgctcgtgcggcgcgctgcgatctacgggggcgtggggctcgcggcaatcgccggcgtcgcgatgtggagcggtgcgggatcgcatcgcggcactggcgcagcgggtgatgcgccggaggcggccgcggtgggcggcgtggcggtcgccgcaccgcaggccgcggtgccggcgagtgcgggcgtgccgccgtcgctcgccggttccagtgcgccgcggttgccgctcgatgcaggcggccatctcgcgaagtcgcgcacggtgcgcgatttcttcgactattgcctgaccgcgcggagcgacctgagcgcggccgcgctcgatgcgttcgtcgttcgcgagatcgccgcgcagctcgacggcacggtcgcacaggcggaggcgctcgacgtgtggcatcagtatcgcgcgtatctcgatgcgctcgcgacattgcgcgacgccggtgcggtcgacgagtccgacccgggcgcggtgcggctcgcgctcgatcaacgcacgtcgatcgcgtaccgcacgctcggcgactggagccagccgttcttcggcgcggagcagtggcggcagcgctatgacctcgcacgcttgaagatcactcaggaccgctcattgaccgatgcgcagaaggccgaacggctgccgcggcgctcgagcagcagatgccggccgacgaacgcgaggcgcagcagctcgggtggaccggcagcgcgcggcgatcgaccagatcgcgcaattgcggaagctagcggcgcgacgcccgatgcgatgcgcgcgcaactgacgcagacgctcggatgcccgaggcggcggcgcgcgtcgcgcagatgcagcaggacgatgcgtcgtccggcagagccgttacgcggattatgcggcgcagcgtacgcagatcgagtcggcgccggcctgtcgccgcaggaccgcgacgcacagattgccgcactgcggcacggcgcgtgttcacgaagcccggcgaagccgtacgcgcggcgtcgctcgatctggcggcgcgggcagcgcgcattgaccccagggtgtcgccgcgtgtggcgggcttcatgccgcgcgcgtgatgtgtcgcgacgcagatgttgctcgatggtatcggcgagcgtatcgaacgcgggccggatggcccttcgtgcgcgacgcatgcatagccgagcagcaggccctgccgcgcggtaggtcggggttgctgtagtagctggtcagcgggcgcacgatcacgcccgcgtcacgaacgcgctctgcgtgaccgcgcgatcgtcgcacgcatcgggcaggccgcgagcaccagatgcaggccggcctcgtcgcccatcacgggcagcgcctcgccgcgaagcgcgcccggatcgcgtcgatcatcagttgccggcgctcgccgtacacggcgtgcgcattcgtcggacgtgtgaagtgaggtggccgtccatgatgaatgctcggcaagcacggcctg

SEQ ID NO: 1461 - protein, 363 aa, Burkholderia cepacia
MAKSMRSRVMAGAVACAMSVAPFAGTTALTTLATTHAAMAATAPADDYATTRYPIILVHGLTGTDKYAGVLDYWYGIQEDLQQHGATVYVANLSGFQSDDGPNGRGEQLLAYVKTVLAATGATKVNLVGHSQGGLTSRYVAAVAPDLVASVTTIGTPHRGSEFADFVQDVLAYDPTELSSTVYAAFVNVFGILTSSSHNTNQDALASLKTLTTAQAATYNQNYPSAGLGAPGSCQTGAPTETVGGNTHLLYSWAGTAIQPTLSLFGVTGATDTSTVPVVDPANVLDPSTLALFGTGTVMINRGSGENDGLVSKCSALYGAVSTRYKWNHIDEINQLLGVRGAYAEDPVAVIRTHANRLKLAGV

SEQ ID NO: 1462 - protein, 403 aa, Burkholderia cepacia
MAAREGRAPLVRRAAIYGGVGLAAIAGVAMWSGAGSHRGTGAAGDAPEAAAVGGVAVAAPQAAVPASAGVPPSLAGSSAPRLPLDAGGHLAKSRTVRDFFDYCLTARSDLSAAALDAFVVREIAAQLDGTVAQAEALDVWHQYRAYLDALATLRDAGAVDESDPGAVRLALDQRTSIAYRTLGDWSQPFFGAEQWRQRYDLARLKITQDRSLTDAQKAERLPRRSSSRCRPTNARRSSSGGPAARGDRPDRAIAEASGATPDAMRAQLTQTLGCPRRRRASRRCSRTMRRPAEPLRGLCGAAYADRVGAGLSPQDRDAQIAALRHGACSRSPAKPYARRRSIWRRGQRALTPGCRRVWRASCRARDVSRRRCCSMVSASVSNAGRMALRARRMHSRAAGPAAR

SEQ ID NO: 1463 - DNA, 1296 bp, PSYCHROBACTER SP.
atgcctattttaccagtgccatcgctcaatgctttattgacaaaaacgcttaagaccgtaaaaaagacagccgctaaaaatgtgcaccagcatcatattttgcaccatacgctaaaagggttggataatctgccaacgccgctactcgaacgagttaatcaccaattaaaagcgtctacagcggagcaatatccccttgctgacgcccatctgcgcctgatacttgcggtcagtaataagctcaagcgcccgttagcactggataagctacccaacctacggcagaaatttggtacagatgcggtgtcgttgcaagcacctagcgtttggcaacaaaatgctgaggcctcaggaaattcagagaatgccgtcagctggcaagataagaccattgccaatgcggatggtggtgatatgaccgtgcgctgctaccagcagtcgaagcagaataacgagggaaaaagtacggatgaagtcgccatgctgttttttcatgggggcgggttttgtattggcgatatcgacacgcatcatgagttttgtcatacggtctgtgcccaaactggctgggcagtcgtgagtgtcgactatcgcatggctcctgaatatccagcgccaacagctcttaaagactgtctgtcggcttacgcttggctgactgaacattctcagtcacttggtgcattgccatcgcgcatcgtattgtctggtgatagtgcaggtggttgcttggcagcactggtggcgcagcaggttatcaagcctatcgatgcattatggcaagataataatcaagctactgagactgataaaaaagccaatgacacctttaaaaaatcactggctgatttgccgcgacctttagcacaattgccgctctaccctgtcactgattatgaggctgaatatccaagttgggagctttatggtgaaggcttgctgctcgatcacaacgatgcaaatgtctttaatactgcctacactcagcacagtggtctaatgcagtcccacccgcttatctcagtcatgcacggtgacaatgcgcacctgtgtccaagctatgtcgtcgttgcggaattagatatcttgcgagatgaaggactggcttatgccgagcttttgcaaaaagaaggcgttaaggtagaaacttatacagtgctaggcgcaccgcatggttttattaacttgatgagtgtccatcaaggtcttggcaatcagacaaactatattatcaagtcgtttgcttgttttgtgcaaaacctactgaccagtgagggtgatgagccaaatctctga

SEQ ID NO: 1464 - protein, 431 aa, PSYCHROBACTER SP.
MPILPVPSLNALLTKTLKTVKKTAAKNVHQHHILHHTLKGLDNLPTPLLERVNHQLKASTAEQYPLADAHLRLILAVSNKLKRPLALDKLPNLRQKFGTDAVSLQAPSVWQQNAEASGNSENAVSWQDKTIANADGGDMTVRCYQQSKQNNEGKSTDEVAMLFFHGGGFCIGDIDTHHEFCHTVCAQTGWAVVSVDYRMAPEYPAPTALKDCLSAYAWLTEHSQSLGALPSRIVLSGDSAGGCLAALVAQQVIKPIDALWQDNNQATETDKKANDTFKKSLADLPRPLAQLPLYPVTDYEAEYPSWELYGEGLLLDHNDANVFNTAYTQHSGLMQSHPLISVMHGDNAHLCPSYVVVAELDILRDEGLAYAELLQKEGVKVETYTVLGAPHGFINLMSVHQGLGNQTNYIIKSFACFVQNLLTSEGDEPNL

SEQ ID NO: 1465 - DNA, 639 bp, Bacillus subtilis
atgaaatttgtaaaaagaaggatcattgcacttgtaacaattttgatgctgtctgttacatcgctgtttgcgttgcagccgtcagtaaaagccgctgaacacaatccagtcgttatggttcacggcattggaggggcatcattcaattttgcgggaattaagagctatctcgtatctcagggctggtcgcgggacaagctgtatgcagttgatttttgggacaagacaggcacaaattataacaatggaccggtattatcacgatttgtgcaaaaggttttagatgaaacgggtgcgaaaaaagtggatattgtcgctcacagtatggggggcgcgaacacactttactacataaaaaatctggacggcggaaataaagttgcaaacgtcgtgacgcttggcggcgcgaaccgtttgacgacaggcaaggcgcttccgggaacagatccaaatcaaaagattttatacacatccatttacagcagtgccgatatgattgtcatgaattacttatcaagattagatggtgctagaaatgttcaaatccatggcgttggacacatcggccttctgtacagcagccaagtcaacagcctgattaaagaagggctgaacggcgggggccagaatacgaattaa

SEQ ID NO: 1466 - protein, 212 aa, Bacillus subtilis; identical to SEQ ID NO: 1437

SEQ ID NO: 1467 - DNA, 639 bp, Bacillus subtilis; identical to SEQ ID NO: 1465

SEQ ID NO: 1468 - protein, 212 aa, Bacillus subtilis; identical to SEQ ID NO: 1437

SEQ ID NO: 1469 - DNA, 3476 bp, Aeromonas hydrophila
agggcacgcgtggtggcctgccataggggccgtcgctggtcgggtctggtattcgggatgaagctgttaacctatcgagcccgtttctattccaattccttgatgctgtacacaaaaaaagcagatcagatgaccgaccagaggcttaataattgttgcgttgctgttaagatgtaacggtcgggttctcacccaactcagtcagcacttcatggataacaactaaaaagagataaggatatgaaaaggaagctaatttacgccgcggttgtcagtgctatgctggctggctgtggtggcagtgacgataacaaaggcgacacctccagctatctcgactatctgttgaccggttccaacgccgtgtgccccagtgctctggcagcccgggccagcgatggcaccctgaaattctccaccgaaacggcagatctctccaacccggtgtcggccatgtcgaccctggatggctggtccacgacccaggctatccagatcgtgcccgtgacgtcatccggcatccaggtgcaggccccggccgcggcggagttagccgcctcggtcgcgccgctctacctgctggagctgagctttgacagcgccgccctgcgcccgaacggcgtgaagaaggtgctgacctacggggtggacttcgtggtggccgcttcggccggcaaactgaacctggtgccgctcaagccgctgaatccctcctcctactacatgatcgtggccaccgactccctcaaggacagcagcggcaacgcggtcaaggccggcaacgactacggcaactacaagaacaacgtcggcagcaatgcccaggagcagaccatcaacggtctgatcgccctgcaggaaggcctgttcaaggctgccaccggcgtctccaccgatcacgtcatcttctccgactggttcggtacccagtcaggtgccgacgtgctggtggcggtgaaaggggctgcggcgtccgtgctgaagagcccgaccctggatgcggccgccctgtggaagcaggatgccaagggcaacaccagcctgccgggcacctataccctgagcgtgaccggcagcaatgccttcctgacccagctggacgccgagcagttcctgccgcaggagcagaaagatgcgatcgccaccgccttcggccccggtgctccgctcaacccgattgctcaagcgaccaaggtctataccggcaccgtcaagctgccttacttcctcgcctcgccggccaccgccggttcctgggacaaggccaagacccagtcctggcacggcgccatccccagcctgtacgccatcgccaatgccctgaaagcgtccgacagcgaagtgatcgccgggctggtgggcgcgggtgtggacccggccctgctggcgacgctgattgccgatccgacccgtcaggccgagctgctggccgaggcgagcaagctgatcggggtgaccctcacctccggcggcaagccgctggatgccgagcagaacatcggccgcttcaacccgctgcccatgctggaagaggtgcagtcggtgccgatgcgggtcttcgccaaggatgccctcaacaccatcaccgacgtgatcatctaccagcacggcgtgacttcggtgaaagagaacgcctatgcgctggcgctgggccagatctatgccggcatgcaggcaggcaagaaggtggcgctggtggtgatcgatcacccgctgcacggtgagcgcggcttcgccctgagcggcagcatggcgaccgtgaccacctccgacaacccgaccccgtatctgaacctgagctacctgaccgtggcccgcgacaacctgaaacagagcgtggcggatctgctgggcctgcgtctggcggtcggtctggccaatgccaagggtgctctgggcgtggctggcgtcaaggtacacttcctgggccactccttgggtgccatctccggtaccaacctgctggcagttgccaaccagcccatcggcaatgcgcaggcggatgccctgttcaagttcgataccggcggcctggccatgccgggtggcggcatcgcgccgctgctgctgaactcgccgaccttcggtccgaccatcaagatgggcgtgctgaccagcggcagtgccgagctgaaagcgggcttcaccgcctacgcgcccaactgcaagaccgcggtgccgacctgcttcgtcaacgagttcctgccaagcctgagcactacccagcaggcggcggcggccagcacgttgcagagctacagcttcgcggcccagtcggtgctggattcggctgacccgatcaacctcggccgcggcatccagagcagcttcccgctgttcgccaccgagatcgtcggcgatggcgcgctgagcctgtctgaccaggtgatcccgaacagcatcgcctccgccccgctgggtggtaccgagccgctgttcaaggtactggctctgcagccgctgaccgccaccggtgcggccagccacaacgcggcccgtttcgtggcaggtggccacagctcgttgctggcgccggacgagaacttcgacccgagcggcgatgtgaccaccgagatgcagtcccagttcgccagcttcttcatgagcggcggtacagcggtcaaggtgaccaatggcagcctgctcaagcagtaagccagtcggccaataaaaacgccgcccctcggggcggcgttttgttttccagcatggtgcttgtcgctggttcagattggcctggttggtggccgctcaggctgccgagcagcttgcttcacctcgatgactaccactcagacgggctgatgatgtctgtccagccagccctgcagcagcccgaccagcaggccggccaggtgggccatgttggcggtacgggtgccgagcagatcgaagaagccgagcgccagccagaacagcatgaagcccatcagcgccggtggcagggtgaggccgcaggccggctgcaacttgctgcgcagccagcagtagccgagcagggcatagaccaccccggagaggccgccaaacagcgggccgctgacgaagaactcggccaggttgggcagggcggcgcctaccagcagcaggatcagcagcttgccgctgccgagccgctgttcgatctggccccccagataccaccaccacagcaggttgaacaccaggtgcagcaccgagaagtggatgaaggccggggtgaagtagcgccacgcctgccagtcggtgaactgggccagggtcgggtggaaggccagctcatcgaagatcggcaggccgatggcatcgagcccgtagatggccagacaggcgatgatcaccaccagggtcagcggcccggcctgatgcaggaagtcggtgaccggatcggtcatccccttgctgtagtcgatgcgggcatcggcccggccggattgccaggaggcttccatgtagcgggggtgggtcggctcggccaggaagcgtttcacctccag

SEQ ID NO: 1470 - protein, 804 aa, Aeromonas hydrophila
MKRKLIYAAVVSAMLAGCGGSDDNKGDTSSYLDYLLTGSNAVCPSALAARASDGTLKFSTETADLSNPVSAMSTLDGWSTTQAIQIVPVTSSGIQVQAPAAAELAASVAPLYLLELSFDSAALRPNGVKKVLTYGVDFVVAASAGKLNLVPLKPLNPSSYYMIVATDSLKDSSGNAVKAGNDYGNYKNNVGSNAQEQTINGLIALQEGLFKAATGVSTDHVIFSDWFGTQSGADVLVAVKGAAASVLKSPTLDAAALWKQDAKGNTSLPGTYTLSVTGSNAFLTQLDAEQFLPQEQKDAIATAFGPGAPLNPIAQATKVYTGTVKLPYFLASPATAGSWDKAKTQSWHGAIPSLYAIANALKASDSEVIAGLVGAGVDPALLATLIADPTRQAELLAEASKLIGVTLTSGGKPLDAEQNIGRFNPLPMLEEVQSVPMRVFAKDALNTITDVIIYQHGVTSVKENAYALALGQIYAGMQAGKKVALVVIDHPLHGERGFALSGSMATVTTSDNPTPYLNLSYLTVARDNLKQSVADLLGLRLAVGLANAKGALGVAGVKVHFLGHSLGAISGTNLLAVANQPIGNAQADALFKFDTGGLAMPGGGIAPLLLNSPTFGPTIKMGVLTSGSAELKAGFTAYAPNCKTAVPTCFVNEFLPSLSTTQQAAAASTLQSYSFAAQSVLDSADPINLGRGIQSSFPLFATEIVGDGALSLSDQVIPNSIASAPLGGTEPLFKVLALQPLTATGAASHNAARFVAGGHSSLLAPDENFDPSGDVTTEMQSQFASFFMSGGTAVKVTNGSLLKQ

SEQ ID NO: 1471 - DNA, 1971 bp, ACINETOBACTER SP. MBDD-4
caagtagtactgaaatgctccggggcgtgcccgcgaggggcgccttggctgtgagctatctctgacaattccaacaaaagagaggcaatagcaatgggtgtgtatgactacaagaacttcggtacagccgactccaaggcgttgttcagcgatgccatggcgatcacgctgtattcctatcacaacctcgataacggctttgccgccggttatcagcacaacggcttcggtctcggcctgcctgccacgctggtcacggcgctgctcggcggtactgattcgcaaggggtgattcccggaattccgtggaaccccgactcggaaaaactcgccctcgacgccgtgaaaaaggctggctggactccgatcaccgcctcgcaactgggctacgacggcaagaccgacgcgcgcggaaccttcttcggcgagaaggccggttacaccaccgcccaggtggaaatcctcggcaagtacgacgcccagggccatctcacggaaatcggcattgcgtttcgcggcaccagcggcccgcgggaaaacctgatcatcgactccatcggcgacgtgatcaacgacctgctggcagccttcggtcccaaggactacgccaagaactacgtcggcgaagcgttcggcaatctgctcaatgacgtggtggctttcgccaaggccaacggccttaccggcaaggacgtgctggtcagcggccacagcctcggcgggctggcggtcaacagcatggctgacctgagtggcggcaagtggggcggattcttcgccgattccaactacatcgcctatgcctcgccgacccagagcggcaccgacaaggtgctcaacgtcggttacgaaaacgatccggtgttccgcgccctcgacggctcaaccttcaccggcgcctcggtcggcgtgcacgacgcgcccaaggagtcggccaccgacaacatcgtcagcttcaacgatcactacgcctcgactgcgtggaatctgctgccgttctcgattctcaatattccgacctggatctcgcacctgccgactgcttacggcgacggcatgaaccggatcatcgagtcgaagttctacgatctgaccagcaaggactcgacgatcatcgtcgccaacctgtcggatccggcgcgggccaacacctgggtgcaggacctcaaccgcaacgccgaaacccacaagggcagcaccttcatcatcggcagcgacagcaacgacctgatccagggcggcagcggcaatgactacctcgaaagtcgcgccggcaacgacaccttccgtgacggtggcggctacaacgtgattctcggtggcgccggcaacaataccctcgatttgcagaaatcggtgaacaccttcgacttcgccaacgacggcgccggcaacctgtacgtgcgcgatgccaacggcgggatcagcatcacccgcgacatcggcagcatcgtcaccaaggagccgggcttcctctggggcctgttcaaggacgacgtgacccacagcgtcacggccagcggtttgaaggtcggtaacaacgtcacccagtacgagtccagcgtcaaaggcaccagcggtgccgacacgctcaaggcgcacgccggtggtgactggttgtttggtctggacggcaacgaccacttgatcggcggcgcaggcaacgacgtgtttgtcggtggcgccggtaatgacctgatggagtccgggggcggggtggatacgttcctgttcaacggcgcgttcggtcaggatcgggtggtgggttttacgtcgaacgacaaactggtgttccttggcgtgcagggggtgttgcccaatgacgacttccgcgcgcatgcctcgatggtggggcaggacacggtgctcaagtttggcgctgactcgttgacgctggttggtgtggcgctgaatagcctcagtggcgatggaattgtgatcgcctgagttgatagggcgccagtaggccct

SEQ ID NO: 1472 - protein, 617 aa, ACINETOBACTER SP. MBDD-4
MGVYDYKNFGTADSKALFSDAMAITLYSYHNLDNGFAAGYQHNGFGLGLPATLVTALLGGTDSQGVIPGIPWNPDSEKLALDAVKKAGWTPITASQLGYDGKTDARGTFFGEKAGYTTAQVEILGKYDAQGHLTEIGIAFRGTSGPRENLIIDSIGDVINDLLAAFGPKDYAKNYVGEAFGNLLNDVVAFAKANGLTGKDVLVSGHSLGGLAVNSMADLSGGKWGGFFADSNYIAYASPTQSGTDKVLNVGYENDPVFRALDGSTFTGASVGVHDAPKESATDNIVSFNDHYASTAWNLLPFSILNIPTWISHLPTAYGDGMNRIIESKFYDLTSKDSTIIVANLSDPARANTWVQDLNRNAETHKGSTFIIGSDSNDLIQGGSGNDYLESRAGNDTFRDGGGYNVILGGAGNNTLDLQKSVNTFDFANDGAGNLYVRDANGGISITRDIGSIVTKEPGFLWGLFKDDVTHSVTASGLKVGNNVTQYESSVKGTSGADTLKAHAGGDWLFGLDGNDHLIGGAGNDVFVGGAGNDLMESGGGVDTFLFNGAFGQDRVVGFTSNDKLVFLGVQGVLPNDDFRAHASMVGQDTVLKFGADSLTLVGVALNSLSGDGIVIA

SEQ ID NO: 1473 - DNA, 1950 bp, Photorhabdus luminescens
atgaaaagggcatttatatttgcaccaggcatgttagcactttcgataagtgcaatttcgaatgcacacacttatgaccatctatatgtttttggtgatagtttgagtgatggtagaaaaggtcatcgatacatgataaatggtaaaaccaatgagttgtataacgatcttattgctcaacatttagggactaaactgatgcctttcgatgaaggtgggactaattacgccgtgggtggatcgactgctgttcctgatttgaacaaagataacaatactcaaaatcaagtagataattatttggcaagccacggtggtcgtgctgatcctaatggcatgtatgttcactggattggcggtaatgatcttaaagctgtcatgttaggaggcgatccgaaaattgttggaaatagcgcgatgaacgcctcggcacaggtgtataaacttcttgatgcgggagctgggatcgttattgtacccactgttcccgatctcggtaaaacaccaatgattatgaaagccgttgtttctcaaggactcgatatgctcccgatttctctcactcctgaccagattaaggaattaaaggatatgattcgtgcgggcactaataaacatccaacgataaatgaagatgttcgctctcaagttatccaaggtgtttttaaagagcttgcggatagggcttcaaaaggggatgctaaaaaagcggaagaatataagcgactattacttaataagtataacgaaacaagcaacaaagcctcaggattggttgacaagtacaatgaattagaagatatcgcacttagcaagaagggcggcaatattgttcgggttgatgttaatgcacttttgcatgaagttattgataatcctttacgctacggtttttccaataccttaggctatgcttgtgttcgggataaggaggctaattcttgtagttctgatgatcccggttttgatgccagtaaatcctttttgttctctgatgattttcatccgactccagccgcacagcgtatgattggtgagcagactatttcaatccttaatgctccacatcaggttatgtcactgacgaataccaacaatgtgccggtaaaggggtcgcttgcctctcttgacaaccgtttgcaacagttacgcagcgtgggtaacgagcagggtaaaataggcgtattcggtggttatagtggtaatcacaacagtacactgacactgggtagtgactatcaactcacggataatattctgttagggggaatgatctcgcgttatcaggataagcgctcagttaatcatttccgcgctgatggtcgtggttatgtattcaccacttatggcttatggcgttattacgataagggttggattagcggcgatcttcactatttggacatgaaatatgaggatattacgcgaggtatcgtgctcaatgagtggctgcgcaaggagcatgcttcgactactggtcatcagtggggaggacgcattactgcgggttgggatattccgctgacacctgaggtgatgaccagcccgattatccaatacgcttgggataagagttatgttaaaggttaccgtgaatcaggtaatagcagtacggccatgcatttcggtgatcaacgttacgattctcaggtcggaacattaggctggcgtctggacactaattttagtcgttttaacccctatgctgaggttcggtttaaccaccagttcggcgataggcgctatcagattagtagtgccattaactcaactaagacatctttcgttagtaaaagccaaaagcaggacaccaactggcgtgaatatgttatcggtatgaatgctgctattacaaaagattggggaacttttgcgtcaatatcccgcaatgatggtgacgttcaaaatcacacctatgcgttcagcttaggtgttaatgccagtttctaa

SEQ ID NO: 1474 - protein, 649 aa, Photorhabdus luminescens
MKRAFIFAPGMLALSISAISNAHTYDHLYVFGDSLSDGRKGHRYMINGKTNELYNDLIAQHLGTKLMPFDEGGTNYAVGGSTAVPDLNKDNNTQNQVDNYLASHGGRADPNGMYVHWIGGNDLKAVMLGGDPKIVGNSAMNASAQVYKLLDAGAGIVIVPTVPDLGKTPMIMKAVVSQGLDMLPISLTPDQIKELKDMIRAGTNKHPTINEDVRSQVIQGVFKELADRASKGDAKKAEEYKRLLLNKYNETSNKASGLVDKYNELEDIALSKKGGNIVRVDVNALLHEVIDNPLRYGFSNTLGYACVRDKEANSCSSDDPGFDASKSFLFSDDFHPTPAAQRMIGEQTISILNAPHQVMSLTNTNNVPVKGSLASLDNRLQQLRSVGNEQGKIGVFGGYSGNHNSTLTLGSDYQLTDNILLGGMISRYQDKRSVNHFRADGRGYVFTTYGLWRYYDKGWISGDLHYLDMKYEDITRGIVLNEWLRKEHASTTGHQWGGRITAGWDIPLTPEVMTSPIIQYAWDKSYVKGYRESGNSSTAMHFGDQRYDSQVGTLGWRLDTNFSRFNPYAEVRFNHQFGDRRYQISSAINSTKTSFVSKSQKQDTNWREYVIGMNAAITKDWGTFASISRNDGDVQNHTYAFSLGVNASF

SEQ ID NO: 1475 - DNA, 978 bp, UNCULTURED BACTERIUM CLONE
atgcccagtcaacgtgcccgcctgaccaacgaattcctgagattgaccacgaagtcgatgtggaaacctgacctcgaccttgggtcgatccgggcgcacatggccagaatggatgcccgactcggccgtcgcgccctgcctgtcgcccgcgaagaaatccgcatcgccggcgttccggccagctggattggcgaaaaggcgctcgaagccgccggtacaatcctgtacatccacggcggcgcgtggtgcctgcatgccccggcggcctacgcgcgactggccacatccctgtccgcggcgaccgggatgcgggtgctgctcatcgactaccgcctggcgccggagcatcgttttcccgccggcagcgacgactgcctgggcgtgtaccgctggctgatcgaacagggttatcacgagcggcccctggtcgtcgccggggactccgcgggcggcaacctgacactcgtcacgttgcagagggcgcgtgatgccggactgcctatgccctgctgtgcggtgccgatctcaccgtcgaccgacatgaccatgtcgggaccgtccggccagtacaacgccgaagccgactcgatgttctctctcgcggcggcggatatttttcccggcctctattgtccgggcgaagacctcaccaacccgatgatctcgccgctgttcggtaactggtgggggcttccgcccctgttgtttcacgccgggtctaccgagttgctgctcgatgactcggtgcgtgcccaggatcgcgcgcgccaggccggggtcgaggcgtacatacaagtctggctgaatctgcctcacgtatttcacgtatttcactggctgccggagtcgcaacagggcatcgcggccattgctcacttcattgccgcgatgtcgaagacttcgccgaggaccgtgccctaccgcataccgggcctgccgcaggtcgagcgtgccacggccgagggcctcaccgcctag

SEQ ID NO: 1476 - protein, 325 aa, UNCULTURED BACTERIUM CLONE
MPSQRARLTNEFLRLTTKSMWKPDLDLGSIRAHMARMDARLGRRALPVAREEIRIAGVPASWIGEKALEAAGTILYIHGGAWCLHAPAAYARLATSLSAATGMRVLLIDYRLAPEHRFPAGSDDCLGVYRWLIEQGYHERPLVVAGDSAGGNLTLVTLQRARDAGLPMPCCAVPISPSTDMTMSGPSGQYNAEADSMFSLAAADIFPGLYCPGEDLTNPMISPLFGNWWGLPPLLFHAGSTELLLDDSVRAQDRARQAGVEAYIQVWLNLPHVFHVFHWLPESQQGIAAIAHFIAAMSKTSPRTVPYRIPGLPQVERATAEGLTA

SEQ ID NO: 1477 - DNA, 1251 bp, GEOBACILLUS THERMOLEOVORANS
atgaaaggctgccgggttatgtttgtgttgctcggattatggcttgtattcggcctatcggtcccgggagggcgggctgaagcggcaacttcacgcgccaacgatgcacccatcgtgcttctccatggttttaccggctggggaagagaagaaatgtttgggttcaagtactggggcggcgtgcgcggcgatatcgaacaatggctgaacgacaacggttatcgaacttatacgctggcggtcggaccgctctcgagcaactgggaccgggcgtgtgaagcgtatgctcagcttgtcggcgggacggtcgattatggggcagcccatgcggcaaagcacggccatgcgcggtttggccgcacttatcccggcctgttgccggaattgaaaaggggtggccgcatccatatcatcgcccacagccaaggggggcagacggcccgcatgcttgtctcgctcctagagaacggaagccaagaagagcgggagtacgccaaggcgcacaacgtgtcgttgtcgccgttgtttgaaggtggacatcattttgtgttgagtgtgacgaccatcgccactcctcatgacgggacgacgcttgtcaacatggttgatttcaccgatcgcttttttgacttgcaaaaagcggtgttggaagcggcggctgtcgccagcaacgcgccgtacacaagcgaaatatacgattttaagctcgaccaatgggggctgcgccgcgagccaggcgaatcgttcgaccattattttgaacggctcaagcgctcccctgtctggacatcgaccgataccgcccgctacgatttatccgttcccggggctgagacgttgaatcgatgggtgaaagccagcccgaatacgtattatttgagcttttctaccgaacggacgtatcgaggagctctgacaggcaactattatcccgaacttggaatgaacgcattcagcgcgattgtctgcgccccgtttctcggctcgtaccgcaatgcggcgcttggcattgacagccattggcttgagaacgacggcattgtcaataccatttcgatgaacggtccgaagcgtggatcaagcgatcggatcgtaccgtatgacggggcgttgaaaaaaggggtttggaatgacatgggaacgtacaatgtcgaccatttggaaatcatcggcgttgacccgaatccgtcatttgatattcgcgccttttatttgcggcttgccgagcagttggcgagcttcgggccttaa

SEQ ID NO: 1478 - protein, 416 aa, GEOBACILLUS THERMOLEOVORANS
MKGCRVMFVLLGLWLVFGLSVPGGRAEAATSRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNAPYTSEIYDFKLDQWGLRREPGESFDHYFERLKRSPVWTSTDTARYDLSVPGAETLNRWVKASPNTYYLSFSTERTYRGALTGNYYPELGMNAFSAIVCAPFLGSYRNAALGIDSHWLENDGIVNTISMNGPKRGSSDRIVPYDGALKKGVWNDMGTYNVDHLEIIGVDPNPSFDIRAFYLRLAEQLASFGP

SEQ ID NO: 1479 - DNA, 656 bp, Bacillus pumilus
gggaatgaaagtgattcgttttaagaaaaggagtttgcaaattcttgttgtgcttgcattggtgatgggttcaatggccttcatccagccaaaagagatcagagcggctgagcataatccggttgtgatggtacatggcatgggcggtgcgtcttataactttgcttcgattaaaagttacttggtatcacaaggatgggatcgaaaccaattatttgctatcgatttcatagacaaaacaggtaataaccgcaacaatggtccgcgtctatccagattcgtcaaagatgtgctagccaaaacaggtgccaaaaaagttgatattgtggctcatagtatgggcggagcgaacacgttatactatattaagaatctagacggcggcgataaaatagaaaacgtcgttacacttggtggagcgaacggactcgtttcactcagagcattaccaggcaccgatccaaatcaaaaaatcctttacacctctgtctatagctcagccgatcttatcgtcgtcaacagcctctcgcgtttaattggcgcaagaaacgtcctcattcacggcgttggtcacatcggtctattagcttcaagccaagtcaaaggctatatcaaagaaggactgaatggcgtgggacagaatacgaattaaaaaa

SEQ ID NO: 1480 - protein, 215 aa, Bacillus pumilus
MKVIRFKKRSLQILVVLALVMGSMAFIQPKEIRAAEHNPVVMVHGMGGASYNFASIKSYLVSQGWDRNQLFAIDFIDKTGNNRNNGPRLSRFVKDVLAKTGAKKVDIVAHSMGGANTLYYIKNLDGGDKIENVVTLGGANGLVSLRALPGTDPNQKILYTSVYSSADLIVVNSLSRLIGARNVLIHGVGHIGLLASSQVKGYIKEGLNGVGQNTN

SEQ ID NO: 1481 - DNA, 1431 bp, Pseudomonas fluorescens
atgggtatctttgactataaaaacctcggcaccgagggctccaaaacgctgttcgccgatgccatcgcgatcacgctgtattcctaccacaacctggataacggctttgccgtgggttaccagcacaatggcctggggcttggcttgccggccacgctggtgggtgcgttgctgggcagcacggattcacaaggtgtgattcccggtattccctggaaccccgactcggaaaaagctgcgctggaagcggtgcaaaaagccggctggacgcccatcagcgccagtgacctgggctatggcggcaaggtcgatgggcgcggcactttctttggcgaaaaggccggctacaccacggcccaggtcgaggtgctgggcaagtacgatgacgccggcaaactgctcgaaatcggcatcggctttcgtggcacctcggggccacgggaaagcttgatcaccgactccatcggcgacgtgatcagcgacctgctggcggcctttggccccaaggattatgccaagaactacgcgggcgaagcctttggcggcttgctcaaaaatgtcgccgactatgccggcgcccatggcctgagcggcaaggacgtggtggtcagcggccacagcctgggcgggctggcggtcaacagcatggcggatttaagcaacaacaaatggtcggggttctacaaggacgccaactacgtggcctatgcctcaccgacccagagcgcgggcgataaagtgttgaacatcggctacgaaaacgacccggtgttccgcgcgcttgacggctcatccttcaacttgtcgtccctgggcgtgcacgacaaaccccacgagtcgaccaccgacaatatcgtcagcttcaacgaccactacgcctcgacgctgtggaatatcctgccgttttcgatcgtcaacctgccgacctgggtctcgcatttgcccaccggctatggcgacggcatgacgcgcatcctcgagtccggcttctacgaccagatgacccgcgactccacggtgatcgtcgccaacctgtccgacccggcgcgggccaccacctgggtgcaagacctcaaccgcaatgccgaaccccacaagagcaacaccttcatcatcggcagccacggcaatgacctgatccagggcggcaagggcgcagactttatcgaaggcggcaaaggcaatgacacgatccgcgacaacagtgggcataacaccttcctgttcagcggtaattttggcaatgatcgggtgatcggctaccaaaccacggacaagctggtgttccagaacgtggagggcagcaccgacctgcgcgaccatgccaaagtggtcggtgccgacacggtgctcacttttggcgccgactcggtgaccctggtcggcgttgggcatggcggcctgtgggcggacggggtcagcatcggctga

SEQ ID NO: 1482 - protein, 476 aa, Pseudomonas fluorescens
MGIFDYKNLGTEGSKTLFADAIAITLYSYHNLDNGFAVGYQHNGLGLGLPATLVGALLGSTDSQGVIPGIPWNPDSEKAALEAVQKAGWTPISASDLGYGGKVDGRGTFFGEKAGYTTAQVEVLGKYDDAGKLLEIGIGFRGTSGPRESLITDSIGDVISDLLAAFGPKDYAKNYAGEAFGGLLKNVADYAGAHGLSGKDVVVSGHSLGGLAVNSMADLSNNKWSGFYKDANYVAYASPTQSAGDKVLNIGYENDPVFRALDGSSFNLSSLGVHDKPHESTTDNIVSFNDHYASTLWNILPFSIVNLPTWVSHLPTGYGDGMTRILESGFYDQMTRDSTVIVANLSDPARATTWVQDLNRNAEPHKSNTFIIGSHGNDLIQGGKGADFIEGGKGNDTIRDNSGHNTFLFSGNFGNDRVIGYQTTDKLVFQNVEGSTDLRDHAKVVGADTVLTFGADSVTLVGVGHGGLWADGVSIG

SEQ ID NO: 1483 - DNA, 1588 bp, GEOBACILLUS STEAROTHERMOPHILUS
gggttggaaggggccttgggtcttatgtataaatattctggtaattcagaatgaaaagatttcggcctattgaaggaaaggagagggagaacatgatgaaatgctgtcggcgtgttgcccttgtgttgctcggattatggtttgtgttctgcatatctgttctgggagggcgagctgaagcggcggcttcgcgagccaacgatgcgccgattgtacttctccacgggtttaccggctggggaagagaagaaatgtttgggttcaagtactggggcggcgtgcgcggcgatatcgaacaatggctgaacgacaacggttatcgaacttatacgctggcggtcggcccgctctcgagcaactgggatcgggcgtgcgaagcgtatgcccagcttgtcggcgggacggtcgattatggggcagcccatgcggcaaagcacggccatgcgcggtttggccgcacctatcccggcctgttgccggaattgaaaaggggcggtcgcatccatatcatcgcccacagccaaggagggcagacggcccgcatgcttgtatcgctcctagagaatggaagccaagaagagcgggagtacgctaaggcgcataacgtgtctttgtcgccgttgtttgaaggcggacatcattttgtgttgagagtgacaaccattgccacccctcatgacgggacgacgcttgtcaacatggttgatttcaccgatcgcttttttgacttgcaaaaagcggtgttgaaagcagcggctgtcgccagcaatgtgccgtacacaagtcaagtatacgattttaagctcgaccaatggggactgcgccgccagccaggtgaatcgtttgaccaatattttgaacggctcaaacggtcccctgtttggacgtcgacagataccgctcgctatgatttatccgttcccggggctgagaagttgaatcaatgggtgaaagcaagcccgaatacgtattatttgagctttgccacagaacggacgtatcgcggagcgctcacaggcaactattatcccgaactcggaatgaatgcattcagcgccgtcgtatgcgccccgtttctcggttcgtaccgcaatgcgacgctcggcattgacgaccgctggcttgagaacgatggcatcgtcaatacgttttcgatgaacggaccaaagcgcggatcgaccgatcggatcgtgccgtatgacgggacaataaaaaaaggggtttggaatgatatgggaacgtacaatgtcgatcatttggaagtcatcggcgttgacccgaatccgttgtttgatatccgtgccttttatttgcgccttgccgagcagttggcgagcttgcaaccttaaaactagtattttgcgaaaaaagccatctcgatcggatggcgctttttttcgtgaacattcatgcgccttggttggtcattttcatgcccgggtggagaacaaacgctgttcatgaacttttctgtgaatatgcacgttcctttaactttcagtttcatgtcggggtgaaaaacgaaaaatggtttatggatgttttggagaacaagcagctgattggtatgacggccgcggaatcccga

SEQ ID NO: 1484 - protein, 418 aa, GEOBACILLUS STEAROTHERMOPHILUS
MMKCCRRVALVLLGLWFVFCISVLGGRAEAAASRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLRVTTIATPHDGTTLVNMVDFTDRFFDLQKAVLKAAAVASNVPYTSQVYDFKLDQWGLRRQPGESFDQYFERLKRSPVWTSTDTARYDLSVPGAEKLNQWVKASPNTYYLSFATERTYRGALTGNYYPELGMNAFSAVVCAPFLGSYRNATLGIDDRWLENDGIVNTFSMNGPKRGSTDRIVPYDGTIKKGVWNDMGTYNVDHLEVIGVDPNPLFDIRAFYLRLAEQLASLQP

SEQ ID NO: 1485 - DNA, 2218 bp, Serratia marcescens
ccgcataccaataacgtttcatcaatcagtctccttaatgactatatcgagctatcagtataggagagcctgcgccggcactgttaaccaacgcacaatctcgccaatttgattcgcagacctaatatttggcactaataataattctaccgatgttggtcctccgaccagctgtcgttcggctaacgttgtttccctgtttccaccgccggcgcatgagagttcgcttccaggccaggcggcatacttcataaggaactgatatgggcatctttagctataaggatctggacgaaaacgcgtcgaaggcgctgttttccgacgccttggccatctctacctacgcttaccacaatatcgataacggcttcgatgaaggctatcaccagaccggtttcgggctgggtctgccgctgacgctggtcactgcgctcatcggcagcacccagtcgcagggcggcctgccgggcctcccctggaatcccgactccgaacaggccgcgcaggaggcggtaaacaatgccggctggtcggtgatcagcgccgcgcagctcggttacgccggcaaaaccgatgcgcgcggcacctactacggcgagaccgccggttacaccaccgcacaggccgaggtgctgggcaaatatgacagcgaaggcaatctcaccgccattggcatctcatttcgcggcaccagcggcccgcgcgagtcgttgatcggcgataccatcggcgatgtgattaacgatctgctggccgggttcgggccgaaaggctacgccgacggctacacgctgaaggccttcggcaacttgctgggcgacgtggcgaaattcgcgcaggcccacgggctgagcggcgaggacgtggtggtcagcggccacagcctcggcgggctggcggtcaacagcatggcggcgcagagcgacgccagctggagcggcttctacgcgcagtccaactatgtcgccttcgcctcgccgacccagtacgaaaccggtggcaaggtgctcaacatcggctacgagaacgacccggtgttccgcgcgctcgacggcaccacgctgaccggggcgtcgttgggcgttcacgatgcgccccatacctccgccaccaacaatatcgtcaacttcaacgatcactacgcctcggacgcctggaacctgctgccgttttccattctcaacattccgacctggctgtcgcacctgccgttcttctatcaggacggcctgatgcgggtgctgaactccgagttttattcgctgaccgacaaagactcgaccatcatcgtctccaacctgtcgaacgtcacgcgcggcaatacctgggtggaagacctgaaccgcaacgcggaaacgcacagcgggccgacgtttatcatcggcagcgacggcaatgatttgatcaagggcggcaaaggcaacgactatctcgagggccgcgacggcgacgatatcttccgcgacgccggcggctataacctgatcgccggcggcaaaggccacaatatcttcgatacccagcaggcgttgaaaaataccgaggtcgcctacgacggcaacacgctttacctgcgcgatgccaagggcggcattacgctggcggacgacatcagcaccctgcgcagcaaagaaacctcctggcttatcttcaacaaagaagtggatcatcaggtaaccgccgccggattgaaatcggactcaggcctcaaagcctatgccgccgccgccaccggcggtgacggcgatgacgtcctgcaggctcgcagccacgacgcctggctgttcggcaacgccggcaacgacacgctgatcggccacgccggcggcaacctgaccttcgtcggcggcagcggcgatgacgttctgaagggcgtcggcaacggcaacaccttcctgttcagcggcgatttcggccgcgatcagctgtatggcttcaacgccagcgataaactggtgtttatcggcaccgaaggcgccagcggcaatatccgcgattacgccacgcagcaaaacgacgatctggtgctggccttcggccacagccaggtcacgctgatcggcgtctcgctcgatcacttcagcaccgatcaggtggtgttggcctaagcatcggcataaaaaaagccgggcgctttcgccgcccggctttcctctttctgcccgccttaaggcacgtcataccccagcgccgccttgcgaaggcggaaccactgctg

SEQ ID NO: 1486 - protein, 614 aa, Serratia marcescens
MGIFSYKDLDENASKALFSDALAISTYAYHNIDNGFDEGYHQTGFGLGLPLTLVTALIGSTQSQGGLPGLPWNPDSEQAAQEAVNNAGWSVISAAQLGYAGKTDARGTYYGETAGYTTAQAEVLGKYDSEGNLTAIGISFRGTSGPRESLIGDTIGDVINDLLAGFGPKGYADGYTLKAFGNLLGDVAKFAQAHGLSGEDVVVSGHSLGGLAVNSMAAQSDASWSGFYAQSNYVAFASPTQYETGGKVLNIGYENDPVFRALDGTTLTGASLGVHDAPHTSATNNIVNFNDHYASDAWNLLPFSILNIPTWLSHLPFFYQDGLMRVLNSEFYSLTDKDSTIIVSNLSNVTRGNTWVEDLNRNAETHSGPTFIIGSDGNDLIKGGKGNDYLEGRDGDDIFRDAGGYNLIAGGKGHNIFDTQQALKNTEVAYDGNTLYLRDAKGGITLADDISTLRSKETSWLIFNKEVDHQVTAAGLKSDSGLKAYAAAATGGDGDDVLQARSHDAWLFGNAGNDTLIGHAGGNLTFVGGSGDDVLKGVGNGNTFLFSGDFGRDQLYGFNASDKLVFIGTEGASGNIRDYATQQNDDLVLAFGHSQVTLIGVSLDHFSTDQVVLA

SEQ ID NO: 1487 - DNA, 703 bp, Bacillus subtilis
ccttacttaattaatttggtaacgtaatataatggagaatttgttacaaaaaaaggaggatattatgaaatttgtaaaaagaaggatcattgcacttgtaacaattttgatgctgtctgttacatcgctgtttgcgttgcagccgtcagtaaaagccgctgaacacaatccagtcgttatggttcacggtattggaggggcatcattcaattttgggggaatcaaaagctatctcgtatctcacggctggtcgcgggacaagctgtatgcagttgatttttgggacaagacaggcacaaattataacaatggaccggtattatcacgatttgtgcaaaaggttttagatgaaacgggtgcgaaaaaagtggatattgtcgctcacagcatggggggcgcgaacacactttactacataaaaaatctggacggcggaaataaagttgcaaacgtcgtgacggttggcggcgcgaaccgtttgacgacaggcaaggcgcttccgggaacagatccaaatcaaaagattttatacacatccatttacagcagtgccgatatgattgtcatgaattatttatcaagattagacggtgctagaaacgttcaaatccatggcgttggacacatcggccttctgtacagcagccaagtcaacagcctgattaaagaagggctgaacggcgggggccagaatacaaactaa

SEQ ID NO: 1488 - protein, 212 aa, Bacillus subtilis
MKFVKRRIIALVTILMLSVTSLFALQPSVKAAEHNPVVMVHGIGGASFNFGGIKSYLVSHGWSRDKLYAVDFWDKTGTNYNNGPVLSRFVQKVLDETGAKKVDIVAHSMGGANTLYYIKNLDGGNKVANVVTVGGANRLTTGKALPGTDPNQKILYTSIYSSADMIVMNYLSRLDGARNVQIHGVGHIGLLYSSQVNSLIKEGLNGGGQNTN

SEQ ID NO: 1489 - DNA, 1371 bp, Pseudomonas aeruginosa
ggaagccccctcgcgtgaagaaaatcctcctgctgattccactggcgttcgccgccagcctggcctggttcgtctggctggaaccttcccccgcccccgagacggcgcccccggccagcccgcaggcgggcgcagaccgcgccccgccagcagcctccgcgggagaagcggtgccggccccccaggtcatgccggccaaggtcgcgccgctgccaacctccttcaggggcaccagcgtcgatggcagtttcagtgtcgacgccagcggcaacctgctgatcacccgcgacatccgcaacctgttcgactacttcctcagcgccgtcggcgaagagcccctgcagcaaagcctggaccgcctgcgcgcctacatcgccgccgaactccaggagccggcgcgcggccaggcgttggcgctgatgcagcaatacatcgactacaagaaggaactggtgctgctcgaacgcgacctgccgcgcctggccgacctcgacgccctgcgccagcgggaagccgcggtgaaagccctgcgcgcgcggatcttcagcaacgaagcgcacgtggcgttcttcgccgacgaggaaacctacaaccagttcaccctggagcgcctggcgatccgccaggatggcaagctcagcaccgaggaaaaggccgccgccatcgaccgcctgcgcgccagcctgccggaagaccagcaggaaagcgtgctgccgcaactgcaaagcgaactgcagcagcagaccgccgccctccaggccgctggcgccggcccggaagccatccgccagatgcgtcagcaactggtgggcgccgaagccaccacccgcctggagcaactcgatcggcaacgctcggcctggaagggccggctggacgactatttcgccgagaagagccggatcgaaggcaatgccgggctgagcgaagccgaccgccgcgcggcggtcgaacgcctggccgaggagcgcttcagcgaacaggaacgcttgcgcctgggcgcgctggaacagatgcgccaggccgagcagcgctgaccggcacggaaacgccgagaacgcggcgaagggcgcttcggcggataacgctaccctcaggggtgcagccctggcgtggccggcgaggcggaaacctgtgctgcgcgccgcaacgaaaaagggcggccacccgaaggtgtccgccctttttcgtcgccagcccggttcagcgggacagcttgccgtccagcgagaacttgccggcgccatcgatcagcagcgccacgctgatcatcagcagggtcagggcatattcatagccgttgtcggtgatgaagaagccattgccgatgtgcacgctgaagatcgccacgatcatggtgaagcccccggg

SEQ ID NO: 1490 - protein, 340 aa, Pseudomonas aeruginosa
MKKILLLIPLAFAASLAWFVWLEPSPAPETAPPASPQAGADRAPPAASAGEAVPAPQVMPAKVAPLPTSFRGTSVDGSFSVDASGNLLITRDIRNLFDYFLSAVGEEPLQQSLDRLRAYIAAELQEPARGQALALMQQYIDYKKELVLLERDLPRLADLDALRQREAAVKALRARIFSNEAHVAFFADEETYNQFTLERLAIRQDGKLSTEEKAAAIDRLRASLPEDQQESVLPQLQSELQQQTAALQAAGAGPEAIRQMRQQLVGAEATTRLEQLDRQRSAWKGRLDDYFAEKSRIEGNAGLSEADRRAAVERLAEERFSEQERLRLGALEQMRQAEQR

SEQ ID NO: 1491 - DNA, 1020 bp, Pseudomonas aeruginosa
aagcttggggacgcgcccctcggccccatcaacctgagatgagaacaacatgaagaagaagtctctgctccccctcggcctggccatcggcctcgcctctctcgctgccagccctctgatccaggccagcacctacacccagaccaaataccccatcgtgctggcccacggcatgctcggcttcgacaacatcctcggggtcgactactggttcggcattcccagcgccttgcgccgtgacggtgcccaggtctacgtcaccgaagtcagccagttggacacctcggaagtccgcggcgagcagttgctgcaacaggtggaggaaatcgtcgccctcagcggccagcccaaggtcaacctgatcggccacagccacggcgggccgaccatccgctacgtcgccgccgtacgtcccgacctgatcgcttccgccaccagcgtcggcgccccgcacaagggttcggacaccgccgacttcctgcgccagatcccaccgggttcggccggcgaggcaatcctctccgggctggtcaacagcctcggcgcgctgatcagcttcctttccagcggcagcaccggtacgcagaattcactgggctcgctggagtcgctgaacagcgagggggccgcgcgcttcaacgccaagtacccgcagggcgtccccacctcggcctgcggcgagggcgcctacaaggtcaacggcgtgagctattactcctggagcggttcctcgccgctgaccaacttcctcgatccgagcgacgccttcctcggcgcctcgtcgctgaccttcaagaacggcaccgccaacgacggcctggtcggcacctgcagttcgcacctgggcatggtgatccgcgacaactaccggatgaaccacctggacgaggtgaaccaggtcttcggcctcaccagcctgttcgagaccagcccggtcagcgtctaccgccagcacgccaaccgcctgaagaacgccagcctgtaggaccccggccggggcctcggcccccgccctttccc

SEQ ID NO: 1492 - protein, 311 aa, Pseudomonas aeruginosa
MKKKSLLPLGLAIGLASLAASPLIQASTYTQTKYPIVLAHGMLGFDNILGVDYWFGIPSALRRDGAQVYVTEVSQLDTSEVRGEQLLQQVEEIVALSGQPKVNLIGHSHGGPTIRYVAAVRPDLIASATSVGAPHKGSDTADFLRQIPPGSAGEAILSGLVNSLGALISFLSSGSTGTQNSLGSLESLNSEGAARFNAKYPQGVPTSACGEGAYKVNGVSYYSWSGSSPLTNFLDPSDAFLGASSLTFKNGTANDGLVGTCSSHLGMVIRDNYRMNHLDEVNQVFGLTSLFETSPVSVYRQHANRLKNASL

SEQ ID NO: 1493 - DNA, 894 bp, UNCULTURED BACTERIUM CLONE
atggccggaccagaaatcgtgaaactcaaaaagattcttcgtgagaaggctgtaccgccaggcacagaagtgccgcttgatgtcatgcgcaaggggatggagaaagtcgcttttaaggcggcggatgatattcaagttgagcaggtgaccgtggcgggttgcgcggcggagtgggtgcgcgccccgggctgtcaggcgggcaaagcgattctctacctgcacggcggcggctacgtcatgggctccatcaatacccatcgctctatggtgggagaaatttcccgtgcttcgcaggcagcggcgttgctgcttgattatcgcttggctccagagcatccatttcccgctgcagtggaagacggcgtggctgcttaccgttggctattggatcaggggttcaagccgcagcatctttccatctctggggattccgcaggcggtgggttggtgctggcggtgcttgtgtctgcgcgcgatcaaggtctgcctatgccggcgtccgcgataccgatcagtccatgggccgatatgacctgcacgaacgattcgttcaaaacgcgcgctgaagccgatcctatggtggctccaggcggcatcaacaaaatggcggctcgatatttgaacggcgcggacgcgaagcatccgtatgcttcgccgaacttcgccaacctcaaaggattgccgccgctgttgatccatgtgggacgggatgaagtcttacttgatgactctattaagttggatgccaaagccaaagccgacggagtgaagagcacgttggaaatctgggatgacatgatccatgtgtggcatgcctttcatcccatgttgccggaagggaaacaggcgattgtccgtgttggtgaatttatgcgcgagcagtgggcggcgtaa

SEQ ID NO: 1494 - protein, 297 aa, UNCULTURED BACTERIUM CLONE
MAGPEIVKLKKILREKAVPPGTEVPLDVMRKGMEKVAFKAADDIQVEQVTVAGCAAEWVRAPGCQAGKAILYLHGGGYVMGSINTHRSMVGEISRASQAAALLLDYRLAPEHPFPAAVEDGVAAYRWLLDQGFKPQHLSISGDSAGGGLVLAVLVSARDQGLPMPASAIPISPWADMTCTNDSFKTRAEADPMVAPGGINKMAARYLNGADAKHPYASPNFANLKGLPPLLIHVGRDEVLLDDSIKLDAKAKADGVKSTLEIWDDMIHVWHAFHPMLPEGKQAIVRVGEFMREQWAA

SEQ ID NO: 1495 - DNA, 2457 bp, Serratia marcescens
ccaagcgccgcataccaataacgtttcatcaatcagtctccttaatgtctatgcagagctatcagtataggagagccagcgccggcactgttaaccaacgcacaatctcgccaatttgattcgcacgcctaatatttagggctaatactatttctaccgatgttggtcctctgaccagctgtcgttcggctaacgttgtttccctgtttccaccgccgacgcatgagagttcactccccggccaggcggcataattcataaggaactgatatgggcatctttagctataaggatttggacgaaaacgcgtcgaaagcgctgttttccgacgccttggccatctccacctacgcttaccacaatatcgataacggcttcgacgaaggctaccaccagaccggtttcggtcttggcctgccgctgacgctgatcaccgcgctgatcggcagcacccaatcgcagggcggcctgccccgcattccctggaaccccgactccgaacaggccgcgcaggagacggtgaacaatgccggctggtcggtcatcagcgccgcgcagctgggttacgccggcaaaaccgatgcacgcggcacctattacggcgagaccgccggttacaccaccgcgcaggccgaggtgctgggcaaatatgacagcgaaggcaatctcaccgccattggtatctcatttcgcggtaccagcggcccgcgcgagtcgctgatcggcgataccatcggcgatgtgattaacgatctgctggccggtttcgggccgaaaggctacgctgacggctacacgctgaacgccttcggcaatctgctgggcgacgtggcgaaattcgcgcaggcgcacgggctgagcggcgaggacgtagtggtcagcggccacagcctcggcgggctggcggtcaacagcatggcggcgcagagcgacgccaactggggcggcttctacgcgcagtccaactatgtcgccttcgcctcgccgacccagtacgaagccggcggcaaggtgatcaacatcggctacgagaacgacccggtgttccgcgcgctcgacggcacctcgctaaccctgccgtcactgggcgtacacgatgcgccgcacgcctccgccaccaacaatatcgtcaacttcaacgaccactacgcgtcggacgcctggaacctgctgccgttttccattctcaacattccgacctggctgtcgcacctgccgttcttctatcaggacgggctgatgcgggtgctgaactccgagttttattcgctgaccgacaaggactcgaccatcatcgtctccaacctgtcgaacgtgacgcgcggcaatacctgggtggaagacctgaaccgcaacgcggaaacgcacagcggaccgacgtttatcatcggcagcgacggcaatgatttgatcaagggcggcaaaggcaacgactatctcgagggccgcgacggcgacgatatcttccgcgacgccggcggctataacctgatcgccggcggcaaaggccacaatatcttcgatacccaacaggcgttgaaaaacaccgaggtcgcctacgacggcaatacgctttacctgcgcgacgccaaaggcggtattacgctggcagacgacatcagcaccctgcgcagcaaagaaacctcctggctgattttcagcaaagaggtggatcatcaggtgaccgctgcgggattgaaatcggactcgggcctcaaagcctatgccgccgccaccaccggcggcgacggcgatgacgtcctgcaggctcgcagccacgacgcctggctgttcggcaacgccggcaacgacacgctgatcggccatgccggcggcaacctgaccttcgtcggcggcagcggcgatgacatcctgaagggcgccggcaacggtaataccttcctgttcagcggcgatttcggccgcgaccagctgtatggtttcaacgccaccgataaactggtgtttatcggtaccgaaggcgccagcgggaatatccgcgactatgccacacagcaaaacgacgatctggtgctggccttcggccacggccaggtcacgctgatcggcgtctcgctcgatcacttcaacaccgatcgggtggtgttggcctaagggtcggcgtaaaaaaagccgggcgctttcgccgcccggctttcctcttttttttgctccgccttacggcacgtcataccccagcgccgccttgcgaatgcggaaccactgctggcggttcagcaccagtttctgcgccttcagcgccgagcgcacccgctcaattttgccggagccgataatcggcagcggcgatgacggcaggcgcatcacccaggcgtacaccacctgctcgatggtctcggcgccgatctcttgcgccacccgttgcagctcgtcgcgcagcggctggaactcggcgtcgttaaacaggcgcccgccccccaggcaggaccaggccag

SEQ ID NO: 1496 - protein, 614 aa, Serratia marcescens
MGIFSYKDLDENASKALFSDALAISTYAYHNIDNGFDEGYHQTGFGLGLPLTLITALIGSTQSQGGLPRIPWNPDSEQAAQETVNNAGWSVISAAQLGYAGKTDARGTYYGETAGYTTAQAEVLGKYDSEGNLTAIGISFRGTSGPRESLIGDTIGDVINDLLAGFGPKGYADGYTLNAFGNLLGDVAKFAQAHGLSGEDVVVSGHSLGGLAVNSMAAQSDANWGGFYAQSNYVAFASPTQYEAGGKVINIGYENDPVFRALDGTSLTLPSLGVHDAPHASATNNIVNFNDHYASDAWNLLPFSILNIPTWLSHLPFFYQDGLMRVLNSEFYSLTDKDSTIIVSNLSNVTRGNTWVEDLNRNAETHSGPTFIIGSDGNDLIKGGKGNDYLEGRDGDDIFRDAGGYNLIAGGKGHNIFDTQQALKNTEVAYDGNTLYLRDAKGGITLADDISTLRSKETSWLIFSKEVDHQVTAAGLKSDSGLKAYAAATTGGDGDDVLQARSHDAWLFGNAGNDTLIGHAGGNLTFVGGSGDDILKGAGNGNTFLFSGDFGRDQLYGFNATDKLVFIGTEGASGNIRDYATQQNDDLVLAFGHGQVTLIGVSLDHFNTDRVVLA

SEQ ID NO: 1497 - DNA, 1908 bp, Pseudomonas fluorescens
gaattccaacaaaagagaggcaatggcaatgggtgtatacgactacaagaacttcggcacagccgattccgcggcgctgttcggcgatgccatggcgatcacgctgtattcctatcacaacctcgataacggcttcgccgccggttaccagcacaacggctgcggcctcggtctgccggcgacgctggttaccgcgctgattggcggcaccgattcgcaaggagtgatccccggtatcccgtggaatcccgattcggaaaaactcgccctcgaggccgtgcaaaaggccggctggacaccgatcagcgccgcgcaattgggctacgacggcaagaccgatgcacgcgggacgttcttcggcgagaaggacggctacaccagcgcgcaagtggaaatcctcggcaagtacgacgctcagggtcacctcaccgaactggggatcgcctttcgcggcaccagcggcccgcgcgaaatcctcatcggtgattcgattggcgacgtgatcaacgatctgctcgccgcgttcggcccggccgattacgcaaaaaactacgtcggcgaagctttcggcaatctgctctacgatgtcgtcgcattcgctcgggccaatggcctcagcggcatggacgtactggtcagcggccacagcctgggcggtctggcggtgaacagcatggctgacttgagcgctggcaagtggggcggtttcttcgccgactccaactacatcgcctacgcctcgccaacgcaaagcagcggcgacaaggtgctaaatatcggttacgaaaacgacccggtgtttcgtgccctcgacggctcgactttcagcagcgcctcggcaggcgtgcacgacgcgccgcatgcctcgaccaccgacaatatcgtcagcttcaacgatcactacgcctcgaacgcctggaacgtgctgccgtattcgatcctgaacattccgacgtggatttcgcacctgcccagcggttacggcgacggcatgacccgcgtgctggaatcgaagttctacgacctgaccagccgcgactcgacgatcatcgtcgccaacctgtccgacccggcgcgggccaacacttgggtgcaggacctcaaccgcaacgccgaaacccacaaaggcagcacgtttattattggcagtgacggcaacgacctgatccagggcggcagcggcaatgactatctggaggggcgcgccggcaatgacagcttccgtgacagcggcggctacaacatcattctgggcgggcagggcagcaacaccctcgacttgcagcagacggtgaagaacttcgatttcgccaacgacggcgctggccacctgtacatccgcgatgccaacggcgggatcagcatcacccgtgacattggcagcatcgtcagcaaagagccggggtttctctggggcgtgttcaaggacgacgtgttgcacaacgtcacggacatggggttgaaagtcggcagtaacctcactgcttatgaatcgagcgttagaggaacggccggcgctgacacactgaaggcgcatgccggcggtgaccggctgtttggcctggagggcaacgatcatttgctcggcagcgcgggcaatgatgtgtttgtcggtggcgctggcaatgacctgatggaatcgggcggcggggcggatacgtttctgttcaatggcgcgtttggccaggatcgtgtggttggctatacggccgatgacaaactggtgtttcttggcgtgcagggggtgttgccgggggatgatttgcgcgcccatgcctcggcggtcgggcaggatacggtgctgacgtttggtggggattcggtgaccttggtaggggtggcgcttggcagcctcaacagcgacggaattgtgatcgcctgatgtcgactggaatctctagaggatcc

SEQ ID NO: 1498 - protein, 617 aa, Pseudomonas fluorescens
MGVYDYKNFGTADSAALFGDAMAITLYSYHNLDNGFAAGYQHNGCGLGLPATLVTALIGGTDSQGVIPGIPWNPDSEKLALEAVQKAGWTPISAAQLGYDGKTDARGTFFGEKDGYTSAQVEILGKYDAQGHLTELGIAFRGTSGPREILIGDSIGDVINDLLAAFGPADYAKNYVGEAFGNLLYDVVAFARANGLSGMDVLVSGHSLGGLAVNSMADLSAGKWGGFFADSNYIAYASPTQSSGDKVLNIGYENDPVFRALDGSTFSSASAGVHDAPHASTTDNIVSFNDHYASNAWNVLPYSILNIPTWISHLPSGYGDGMTRVLESKFYDLTSRDSTIIVANLSDPARANTWVQDLNRNAETHKGSTFIIGSDGNDLIQGGSGNDYLEGRAGNDSFRDSGGYNIILGGQGSNTLDLQQTVKNFDFANDGAGHLYIRDANGGISITRDIGSIVSKEPGFLWGVFKDDVLHNVTDMGLKVGSNLTAYESSVRGTAGADTLKAHAGGDRLFGLEGNDHLLGSAGNDVFVGGAGNDLMESGGGADTFLFNGAFGQDRVVGYTADDKLVFLGVQGVLPGDDLRAHASAVGQDTVLTFGGDSVTLVGVALGSLNSDGIVIA

SEQ ID NO: 1499 - DNA, 1101 bp, Stenotrophomonas maltophilia
atgacacgcccgcacctacgtgtctgttcgtgcacggtggtggcggtcggcccggccttcatcgccttcaagcagcagggcatggacccgcacgctgcgggcatcgccacctggcagctgggcatggccgcgctggtcatcatgggcgtgctcaagttcgtgctgtcgttcttcggcgaagcggtcacccgcgcgctgccgcgagccgcgctgctggccatctccggcagcatcgcgctggtgctgatgggtctgctgccgctgctggaaacgctgcgctcgccgctggtcggcttcaccacgctcggtttgctgctgtacgtgctgatcgccaagggcaagctgccggtgcgtggcccgggcgtgctgctggccttcgtgttcggcaccgtgctgtactacggcctcggcctggccgggctgggcgcacccggcttccatgtacctgagtgggtgccgccgcaggtggtgctgccgctgccgacactgggcttcctcgacggcctgcccaccgcgatgacctacctgccgctgctgctgccgttcggcctgctgatggtggtcggtggcatcaacgtctctgaaagcgcgcgcgcggccggcgacgactaccgcacccgcgacatcctgctggtggaagcggtggccacgctggtggccggcgtctgtggcggcgtggcgcagaccacgccgtaccttgggccagccacccgcgtgcacagcggctcccccgacggcagcaatctcaccgctgccctcaacgccgggtattcgctgggcgaaggcaacctcaaatacggcccggtggccggcctgacctggcagaagatcaagctcgacgtgtacgtggccatcgatatcaccacccaagccttccaggccacgccgcgtcaccacaccggtgcgatggtgttcggtttcctgccgtcggtggcgtacctgctggcgatcaaggcacccggctggatcggaagagcggatccactagttctagagtctagaactagtggatccgctcttccgatccagccgggtgccttgatcgccagcaggtacgccaccgacggcaggaaaccgaacaccatcgcaccggtgtggtga

SEQ ID NO: 1500 - protein, 366 aa, Stenotrophomonas maltophilia
MTRPHLRVCSCTVVAVGPAFIAFKQQGMDPHAAGIATWQLGMAALVIMGVLKFVLSFFGEAVTRALPRAALLAISGSIALVLMGLLPLLETLRSPLVGFTTLGLLLYVLIAKGKLPVRGPGVLLAFVFGTVLYYGLGLAGLGAPGFHVPEWVPPQVVLPLPTLGFLDGLPTAMTYLPLLLPFGLLMVVGGINVSESARAAGDDYRTRDILLVEAVATLVAGVCGGVAQTTPYLGPATRVHSGSPDGSNLTAALNAGYSLGEGNLKYGPVAGLTWQKIKLDVYVAIDITTQAFQATPRHHTGAMVFGFLPSVAYLLAIKAPGWIGRADPLVLESRTSGSALPIQPGALIASRYATDGRKPNTIAPVW

SEQ ID NO: 1501 - DNA, 5792 bp, Listonella anguillarum
caaatccgtctttaaaaatccacctccatggtaccgtcgacgttccacgtttcgtggctgttattcaatttatacgctgattttacaatttctgcaatcaattgatggatgggccgtggtagggtgcgttacgccccatacgtatttgtcagagctatggtaagcgcatcattggttaagctatgacggtacaagtaatctataagactgaaattgcgattgatgttgaggcatgcatcggtccgcatatcacgtttcccgttggatatggctgtgaggttttcaaacaagctatgagcatcaaacaggatgatatttaccccttgcatctgataatacagtgcttgttgctgaataaacgcattgaaggtggtgatcttagcgctgactttcgctatctcttctgctgttgaatatttgtactgcggggctttggttgcatcgggcagggtgagtagaataatatttttggcccctgaatccacaagacgaatcatcgcgctgctaaaatctgctttgacttcatatacttcacggttgtaattcataaagtcatttaagccaaattcaagggtaaagagcgtattttctggctggtagtttttggccattgtcatgtaatttagataagagcggacttgatcgttcacacccgtcagcgcgatatattgattacgccctgcggcaccgccaatcgcccagttatatacaggtaaattgtgcatttttgctaaatactctgtccacaccaaaccattggaaaagtgtcctaaaaaccaagagttaggattgggaaatttccattgtgacgcattgaatatatttcctgtatccgaaaggctgtcacctatggtcaccatttgtctgctgcgaaataagtaatatctgcagaatcgtgactgacgccgagtgctgatgaatcccctaatgattttggtaaaaatcattaagttaaggtggatacacatcttgtcaaggggattcatatgcccactcccaatctgttgctgggtcaaagtgtaggtttgcttattttgcgtattcattacgccataagcggtaactggttctgaggtggtatccgtattttctgcaatcgccatggagagtggcaatattgcggtcatcaataacgtcattagtttcatattttttctcttattggtttaggcacgtatctactaaagaataagtgcgaaagtgaaattaaaaaactggtcagacctattgtatggatttatggtgttaagcgtcaatcaataaacgactatgttgaacattatttggtattaagatcaaacaatgaactgtcagtggagaaaatacgaagggtttttataaatcctaatttagataaataacaataaggttttgctttattaattttgttctaatgttaaatcttagtagcttaataaaaatatcaataaaattataatcagtcaatatgtgtaaaaatcaaacagttttattgtgattttaagccacattaaaaatcatttctctttgtgtttgttattttaagatctattaataattcgccacaaaggtgccaaaaaaccaatgtccttttattttgtggtctgaaaaaataaaaaatgggtatcattttcttttaaatactgtgataacaataaaaatgcttacgaggtttatatgtcctttatattgtggtctgaaaaaataaaaaatgggtattcattttcttttaaatactgtgataacaataaaaatgcttacgaggtttatatgtcaataaacagaagaaaagcacttggcgctattgccattatgtcaggtttggtatggaacaccgctcaagctgacgtgaatcagccgcaaggtttggccattgaaatgtcagtgagcttcaggatgacagccaaatcaattacttcaatgcgagctattggttacaaggagaggttgaggccccgagcacttatgcagatgcgtgacgatgtactgaaccaacatatgcgctatattgtcgatttcagttacgatgaaggtgagtcgcaaaatacgacagaggcgaaagcattgctcaggaaaaaactgggcttagcgtttgcagtgacttttttgatcatcactgaacacaaaggagaattgttgttcacaccgttagatgacgagaatgatgccaacattcgtctactggaagccgccccaattgcccattctcgtcaggcccgtagtacgcagtatgtgtcaaatagtggttcggaaacgaactctttgccacacgtcgcgttttatttgaatgtcaaacggcctaatactgattatgaatgtacgtttaataactcacatctttgggatcgaggtacgcgagtgttttgcgattacccgaatatctctttgatctatagagttaatttagagcgttcattacaatatggcacactggctctgcaacaccggaccgaaaattgtcgcatcagcttagatgatgatacaacgggtgcggggatcatctcaatgactcttgattatcgtcaatcaggtgctgattacgtgacattagatgcttatttccgagactggtcgaccgatgccatcgctcaagactatcaatttgtatttaactcttcgaacaacaaagcgcagatcttaaaaacgttcccgagagaaaatctcaatgccgaatatgaggtaaaagaggtatccggcttccagctaggggtgagtggtggtgtcgaggttagtgctgatgggcctaaaggaaagttagaagctaatgctagctacaaccaaagccgttggttaacctttaaaacgcatgattaccgtgttgaacgtagcactaataacgcgcaaaacgtcagcttcaaatggaatcgtagccaatatgcgaccgccgaatcgatgatgaatcgctcctacgatgcaatatgggtcaatacttaccctgtggataccaaccgcattaacccgattggttacgcaagctttgtaccaaaaatggatgtgatctataaagccgctcccaatgtgacggggacaacggagttcaccattgactcttcggtcaatatccgtcctatttataacggtgcttataagcattattatgttgtaggtgggcatcagtcctaccatggtttgaaaaatacgacgcgtcgcagagtgagcaaagtgaccagttttacagtggattgggagcacccagtattcacgggcggtcgtccagtgaatttgcaattgggcagctttaataatcgttgcgttgatgtggccgataatggcgtactctctgcctcaagctgtgatgaaaaccaaaactcacaatcttttatttatgatcagttaggtcgctatgtgagtgcaaacgacatccatcaatgtttggatggacaatcactgggtcaattacaaccttgtagttcgagtttagtccagcgttgggaatggatagaaaacagcgataagctgagtaatgttttctctcatgagttacttggtcatgataaaaccagcggtgagttaggtttgtatgctgatggcaatgatcaggtaagtgtgcgcaccattaccgcttacaccaacgtatttcattcagatagtgaatcggccgtatttgggtttacatcgggttcattggccttacaagatgttggtcaatcggggacactgtatattcgccatggtgctgcgattgatgcaatgggtacgcaagccaatgcgatgcaaggcggtgaaagtggtagtttgactgaaattgatctgaaacgcgttacgcaaataaccgttacttccggtgagttcaagtacggtggcaaccatttactccgtatgacttttaagcttgatgatggttcaaccaaagtagtggggtcaaaagactacgcaatcagtacccacgatgaagtgtttgagttgccagccggatcggccattcggcaagtcaaggtttgtgtcttgaagttttgtttatccgattggttatttctattttattattataatagtctctattctattttctatgattggagttagcaggcatgagatgatattcattatttactaggtgggccctcgggagcgcccgaatgtactcgctggtcgaaggatatgagattagggtggcgccgacaaccaccaaaacaaaaagtgatagtaggcaccaccaagctgaaaaaaatgctgctgctttttgtctgctgagtaccacggcgctggcggcaaccagcacggtggcgttaagtaagacaggctatacccaaacccagtaccctattgtgttagttcatggcttatttggttttgatacgctggccggagtcgattatttctacggcattccgcaatcactgacgaaagatggcgcaaaggcctacgtggctcaagtctcagcaatcaacagctctgagctgagaggtgaacaactattgcaacaagtggagtcacttttagccgccactggcgctcaaaaagttaacctgattggccatagccatggcggaccaacggctcgctatgttgcatcagttcggcccgatcttgtggcgtctgtgactagcattggtggtgtgaataaaggctcaatcgtggcagatttagtgaaatcaacggcttgcttgggatacaccacctttttgaaactgaccccgttaccttgtatcgccagcacgcataatcgattgaagcattcaaggtttataacttcgaggttgatagtctcgaggttgatagtttacgaggtttataacttcaagttttgtaacatcaaactttataaggattggctaaaaaagcccgcactatttggttttatcgtgatcatcttggggagcatcggtgcggtgctttttctgcaaaagccagtatcatcacagagcgcgttacacgccatctcacagaacgagatgataatattcatcatttgtttgaaacggatcccgtcaccctttatcgccagcacgccaatcgtctgaaactacaagggctgtatgaaaaagcccgcactatttggttttatcgtgatcatcttggggagcatcggtgcggtgctttttctgcaaaagccagtatcatcacagagcgcgttacaaacgccatctcaacaagatacgcagatagacagtgcatcgagtcttgatttaattcactattttatctctacattaggagagagctcattgcctgaggttgagctgcgcattgcccagcatgctgagcaggatgatggcgtggtgatcgatccaatactttttgaacagtttatccaatacaaacaagcattagctgagttagaggctaattcttccatcgccaatctcgatcttgctaccttagctgagatcaatcagcagttactgaaaatacaaagtcaattttttaacgttgatcagcaaagtatgctgtttggtgaagagaatgcgttgcgaaatttagcattagaaaagctgcgcattaaagctcaagcagtcgattcatatgatgagcagttgcagtggcaaacgttattagcgcagcagccagaatacattcagcgcagtgaacgcaatgtacaactactgccagcactcaacgcgagtcgccatttgtccacgcaagatcaatacttagcttggaacgagttggttggcgaacaaggagcacagcggttaacgcagcttagtgaacaacgagagcagttttctcagcatctcgaaaactattacaacagcgttcggcggtgcctgaaatacgcgtttgagccagatgaaaaaacagcaatacgcaactgcgtacccaacgttggagccaacactcacgtcagctggaagggtagtgatcgctaa

SEQ ID NO: 1502 - protein, 339 aa, Listonella anguillarum
MKLMTLLMTAILPLSMAIAENTDTTSEPVTAYGVMNTQNKQTYTLTQQQIGSGHMNPLDKMCIHLNLMIFTKIIRGFISTRRQSRFCRYYLFRSRQMVTIGDSLSDTGNIFNASQWKFPNPNSWFLGHFSNGLVWTEYLAKMHNLPVYNWAIGGAAGRNQYIALTGVNDQVRSYLNYMTMAKNYQPENTLFTLEFGLNDFMNYNREVYEVKADFSSAMIRLVDSGAKNIILLTLPDATKAPQYKYSTAEEIAKVSAKITTFNAFIQQQALYYQMQGVNIILFDAHSLFENLTAISNGKRDMRTDACLNINRNFSLIDYLYRHSLTNDALTIALTNTYGA

SEQ ID NO: 1503 - protein, 782 aa, Listonella anguillarum
MSFILWSEKIKNGYSFSFKYCDNNKNAYEVYMSINRRKALGAIAIMSGLVWNTAQADVNQPQGLAIEMSVSFRMTAKSITSMRAIGYKERLRPRALMQMRDDVLNQHMRYIVDFSYDEGESQNTTEAKALLRKKLGLAFAVTFLIITEHKGELLFTPLDDENDANIRLLEAAPIAHSRQARSTQYVSNSGSETNSLPHVAFYLNVKRPNTDYECTFNNSHLWDRGTRVFCDYPNISLIYRVNLERSLQYGTLALQHRTENCRISLDDDTTGAGIISMTLDYRQSGADYVTLDAYFRDWSTDAIAQDYQFVFNSSNNKAQILKTFPRENLNAEYEVKEVSGFQLGVSGGVEVSADGPKGKLEANASYNQSRWLTFKTHDYRVERSTNNAQNVSFKWNRSQYATAESMMNRSYDAIWVNTYPVDTNRINPIGYASFVPKMDVIYKAAPNVTGTTEFTIDSSVNIRPIYNGAYKHYYVVGGHQSYHGLKNTTRRRVSKVTSFTVDWEHPVFTGGRPVNLQLGSFNNRCVDVADNGVLSASSCDENQNSQSFIYDQLGRYVSANDIHQCLDGQSLGQLQPCSSSLVQRWEWIENSDKLSNVFSHELLGHDKTSGELGLYADGNDQVSVRTITAYTNVFHSDSESAVFGFTSGSLALQDVGQSGTLYIRHGAAIDAMGTQANAMQGGESGSLTEIDLKRVTQITVTSGEFKYGGNHLLRMTFKLDDGSTKVVGSKDYAISTHDEVFELPAGSAIRQVKVCVLKFCLSDWLFLFYYYNSLYSIFYDWS

SEQ ID NO: 1504 - protein, 294 aa, Listonella anguillarum
MYSLVEGYEIRVAPTTTKTKSDSRHHQAEKNAAAFCLLSTTALAATSTVALSKTGYTQTQYPIVLVHGLFGFDTLAGVDYFYGIPQSLTKDGAKAYVAQVSAINSSELRGEQLLQQVESLLAATGAQKVNLIGHSHGGPTARYVASVRPDLVASVTSIGGVNKGSIVADLVKSTACLGYTTFLKLTPLPCIASTHNRLKHSRFITSRLIVSRLIVYEVYNFKFCNIKLYKDWLKKPALFGFIVIILGSIGAVLFLQKPVSSQSALHAISQNEMIIFIICLKRIPSPFIASTPIV

SEQ ID NO: 1505 - protein, 277 aa, Listonella anguillarum
MKKPALFGFIVIILGSIGAVLFLQKPVSSQSALQTPSQQDTQIDSASSLDLIHYFISTLGESSLPEVELRIAQHAEQDDGVVIDPILFEQFIQYKQALAELEANSSIANLDLATLAEINQQLLKIQSQFFNVDQQSMLFGEENALRNLALEKLRIKAQAVDSYDEQLQWQTLLAQQPEYIQRSERNVQLLPALNASRHLSTQDQYLAWNELVGEQGAQRLTQLSEQREQFSQHLENYYNSVRRCLKYAFEPDEKTAIRNCVPNVGANTHVSWKGSDR

SEQ ID NO: 1506 - DNA, 1254 bp, GEOBACILLUS SP.
atgatgaaaggctgtcgggttatgtttgtgttgctcggattatggtttgtgttcggcctatcggtcccgggagggcggacggaagcggcatctccacgcgccaatgatgcacccatcgtgcttctccatgggtttaccggatgggggcgagaggaaatgcttggattcaagtattggggcggcgtacgcggcgatatcgaacaatggctgaacgacaacggatatcgaacgtatacgctggcggtcggaccgctctcgagcaactgggaccgggcgtgtgaagcgtacgcccagcttgtcggcggaacggtcgattatggcgcggcccatgcggcgaagcacggccatgcgcggtttggccgcacgtatccggggttgctgccggaattgaaaagaggaggccgcgtccatatcatcgcccacagccaaggagggcagacggcccgtatgcttgtctcgctcctagagaacggaagccaagaagagcgggagtacgccaaggagcacaacgtgtcgttgtcgccgttgtttgaaggcggacatcgttttgtgttgagcgtgacgaccatcgccacccctcatgacggaacgacgcttgtcaacatggttgatttcaccgatcgcttttttgacttgcaaaaagcggtgctggaagcggcggctgtcgccagcaacgcgccgtacacaagcgaaatatacgattttaagctcgaccaatgggggctgcgccgcgagccaggcgaatcgttcgaccattattttgaacggctcaagcgctcccctgtttggacgtccacagataccgcccgctacgatttatccgtttccggagctgagaagttgaatcaatgggtgcaagcaagcccgaatacgtattatttgagctttgccacagaacggacgtatcgcggagcgctcacaggcaactattatcccgaactcggaatgaatgcattcagcgcggtcgtatgcgctccgtttctcggttcgtaccgcaatccgacgctcggcattgacgaccgctggcttgaaaacgatggtattgtcaatacggtttccatgaacggtccaaagcgtggatcaagcgatcggatcgtaccgtatgacggggcgttgaaaaaaggggtttggaatgacatgggaacgtacaatgtcgaccatttggaaatcatcggcgttgacccgaatccgtcatttgatattcgcgccttttatttgcggcttgccgagcaactggcgagtttgcagccttaa

SEQ ID NO: 1507 - protein, 417 aa, GEOBACILLUS SP.
MMKGCRVMFVLLGLWFVFGLSVPGGRTEAASPRANDAPIVLLHGFTGWGREEMLGFKYWGGVRGDIEQWLNDNGYRTYTLAVGPLSSNWDRACEAYAQLVGGTVDYGAAHAAKHGHARFGRTYPGLLPELKRGGRVHIIAHSQGGQTARMLVSLLENGSQEEREYAKEHNVSLSPLFEGGHRFVLSVTTIATPHDGTTLVNMVDFTDRFFDLQKAVLEAAAVASNAPYTSEIYDFKLDQWGLRREPGESFDHYFERLKRSPVWTSTDTARYDLSVSGAEKLNQWVQASPNTYYLSFATERTYRGALTGNYYPELGMNAFSAVVCAPFLGSYRNPTLGIDDRWLENDGIVNTVSMNGPKRGSSDRIVPYDGALKKGVWNDMGTYNVDHLEIIGVDPNPSFDIRAFYLRLAEQLASLQP

SEQ ID NO: 1508 - DNA, 1413 bp, UNCULTURED PSEUDOMONAS SP.
atgggtatctttgactataaaaacctcggcaccgagggctccaaagcgttgtttgccgatgccatggcgatcacgctgtattcctaccacaacctggataacggccttgccgtgggttaccaacacaacggcctggggctgggcttgccggcgacgttggtcggtgcgctgctgggcagcacgaactcccagggcgtgatccctggcattccctggaacccggactcagaaaaagccgccctggaggccgtgcaaaaggccggttggacccccatcagtgccagcgcgctgggctacggtggcaaggtcgatgcgcggggcacatttttcggcgaaaaggccggctacaccacggcccaggtcgaggtgctgggcaagtacgatgacgccggaaaactgctggaaatcggcatcggttttcggggtacctcagggcctcgtgaaagcctgatcagcgactccatcggcgatctggtcagcgatctgctggcggccctggggcccaaggattacgcgaagaattacgcgggagaggcctttggcggcttgctcaagaacgtcgccgactacgccagtgcgcacggcttgaccggcaaggaagtggtggtcagcggccacagcctgggcgggctggccgtcaacagcatggccgacctgagcaacaacaagtgggcggggttctacaaggacgccaactacgtggcctacgcctcgcccacccagagtgcaggcgacaaagtgctcaacatcggctacgagaacgatccggtgttccgtgcgctggatggctcatccttcaacctgtcgtccctgggcgtgcacgacaaaccccatgagtcgaccaccgacaatatcgtcagcttcaacgaccactacgcctcaacgctgtggaatgtgttgccgttctccatcgtcaacctgccgacctgggtttcccatctgcccacgggctatggcgacggtctgacgcgggtgctcgaatcgggtttttacgagcagatgacccgcgattccaccgtgatcgtggccaacctgtccgacccggcgcgggccaatacctgggtgcaggacctgaaccgcaatgccgagccgcacaagggcaataccttcatcatcggcagcgacggcaatgacctgatccagggtggcaagggcgcggacttcatcgagggtggcaagggcaatgacacgatccgtgacaacagcgggcacaacaccttcttgttcagcgggcatttcgggcaggaccgggtaattggctatcagtcgacggacacgctgctgttcaaggatgtgcaggggaatgtggattaccgtgagcacggcggggatacggtgatcagcgtcggtggggattcggtgacgcttgtgggggtgagtggctggtcgggggaggggatggttatcgcgtga

SEQ ID NO: 1509 - protein, 470 aa, UNCULTURED PSEUDOMONAS SP.
MGIFDYKNLGTEGSKALFADAMAITLYSYHNLDNGLAVGYQHNGLGLGLPATLVGALLGSTNSQGVIPGIPWNPDSEKAALEAVQKAGWTPISASALGYGGKVDARGTFFGEKAGYTTAQVEVLGKYDDAGKLLEIGIGFRGTSGPRESLISDSIGDLVSDLLAALGPKDYAKNYAGEAFGGLLKNVADYASAHGLTGKEVVVSGHSLGGLAVNSMADLSNNKWAGFYKDANYVAYASPTQSAGDKVLNIGYENDPVFRALDGSSFNLSSLGVHDKPHESTTDNIVSFNDHYASTLWNVLPFSIVNLPTWVSHLPTGYGDGLTRVLESGFYEQMTRDSTVIVANLSDPARANTWVQDLNRNAEPHKGNTFIIGSDGNDLIQGGKGADFIEGGKGNDTIRDNSGHNTFLFSGHFGQDRVIGYQSTDTLLFKDVQGNVDYREHGGDTVISVGGDSVTLVGVSGWSGEGMVIA

SEQ ID NO: 1510 - DNA, 1023 bp, PHOTOBACTERIUM SP. M37
atgtcttatacaaaagaacaactcatgttggcattcagctatatgagctactatggcatcactcacacaggttcagcaaaaaaaaatgctgagctcatccttaaaaaaatgaaagaagccttgaaaacatggaagccttttcaggaagatgactgggaagtcgtctggggtcctgcggtttataccatgcctttcacaatcttcaacgatgccatgatgtatgtcatacagaagaaaggtgctgaaggggaatacgtgatagccattcgcggcaccaatccagtatcaatttcagactggctgtttaatgatttcatggtcagcgcaatgaagaagtggccttacgcatccgttgaaggccgcatactcaaaatatccgaaagtaccagctacggactgaaaaccttacagaaattgaagccaaaatcccatatccccggcgaaaataaaacgattctgcagttcctgaatgaaaagataggcccagagggtaaagcaaaaatctgtgtaacaggccacagtaaaggcggcgccttgtcttccactctggcactgtggttgaaggacatccaaggagtaaaactctcgcaaaacatcgatatctcaacgattccgtttgccggaccaacagccggtaatgctgactttgccgattactttgatgattgtcttggtgatcaatgcacccgcattgccaactcgttagatattgtgccttatgcctggaatacaaattcattaaaaaaacttaaatctatatatatttctgaacaagcatcagttaaaccgcttctatatcaacgcgctttaatccgtgcaatgatcgcagaaactaaaggtaaaaaatacaagcaaattaaggcggaaacaccaccattagaaggcaacattaatcctattcttattgaataccttgtgcaggcagcatatcagcatgtcgtcggttacccagaattaatgggtatgatggatgatattcctttaacagacatattcgaagatgcgatcgcgggtttgttataa

SEQ ID NO: 1511 - protein, 340 aa, PHOTOBACTERIUM SP. M37
MSYTKEQLMLAFSYMSYYGITHTGSAKKNAELILKKMKEALKTWKPFQEDDWEVVWGPAVYTMPFTIFNDAMMYVIQKKGAEGEYVIAIRGTNPVSISDWLFNDFMVSAMKKWPYASVEGRILKISESTSYGLKTLQKLKPKSHIPGENKTILQFLNEKIGPEGKAKICVTGHSKGGALSSTLALWLKDIQGVKLSQNIDISTIPFAGPTAGNADFADYFDDCLGDQCTRIANSLDIVPYAWNTNSLKKLKSIYISEQASVKPLLYQRALIRAMIAETKGKKYKQIKAETPPLEGNINPILIEYLVQAAYQHVVGYPELMGMMDDIPLTDIFEDAIAGLL

SEQ ID NO: 1512 - DNA, 1698 bp, Pseudomonas fluorescens
cgctcccacatttggatcaccgggaatcaggtagatttgcgtcagtctggaggccatcatcgcaggcaagccagttcccacataaagcctgtcccctcaggggcaacgggtgttttcgctttctctacaaatccaacaacagagaggcactaccatgggtatctttgactataaaaacctcggcaccgagggttccaaagcgctgtttgccgacgccatggcgatcacgttgtactcctaccacaacctggataacggctttgccgtgggttaccagcacaatggcttggggcttggtttgccggccacgctggtgggtgcactgctcggcagcacgaattcacagggtgtcattccgggcattccctggaacccggattcggaaaaagccgcgctggaggcggtgcaaaacgccggttggacgcccatcagtgcaagcaccctcggctacggcggcaaagtcgacgcgcgcggcacgtactttggcgaaaaagccggttacaccaccgctcaggtcgaggtgctgggcaagtacgatgacgccggcaaattgctggaaatcggcatcggttttcgcggcacgtcggggccgcgggaaaccttgatcagcgactccatcggcgacctggtcagcgatctgcttgcggccctgggccccaaggattacgcaaagaactacgccggcgaagcgttcggcgggctgctcaaaaacgtcgccgattacgccgctgcccatggccttaccggcaaggacgtggtggtcagcggccacagcctgggcggcctggcggtcaacagcatggcggatttaagcaccaacaaatggtcgggcttctacacggacgccaactacgtggcctatgcatcgccgacccaaagcgccggcgacaaggtgctcaacatcggctatgaaaacgacccggtgtttcgcgcgctggacggctcatccttcaatctgtcgtccctgggcgtgcacgacaagccccacgagtcgaccaccgataacatcgtcagcttcaacgaccactacgcctcgaccctgtggaatgtgctgccgttctccatcgtcaacctgccgacctgggtctcgcacctgccgaccgcatacggcgacggcatgacgcgcatcctcgactccgggttctatgaccagatgacccgtgactccacggtaatcgtcgccaacctgtccgacccggcgcgggccactacgtgggtgcaggacctcaaccgcaatgccgaaccgcacaagggcaataccttcattattggcagcgatggcaacgacctgatccagggtggcaagggcgcggactttatcgaaggcggcaaaggcaatgacacgatccgcgacaacagtgggcataacaccttcctgttcagtggccagttcggcaacgatcgcgtgattggctaccagaccaccgacaagctggtgttccaggacgtgcaggggagcaccgacctgcgtgaccatgccaaagtggtcggcgcggacacggtgctcacgtttggcgccgactcggtgaccctggttggcgtcggccatggcggcctgtgggcggacggcgtcagcatcggctgatcaccgccaagggtgcccccgccagccgccgccccaatacggccggtgggggttgccatagccgtaaccgtagacatgatgcggatagtaatagggccgtgggccataacccc

SEQ ID NO: 1513 - protein, 476 aa, Pseudomonas fluorescens
MGIFDYKNLGTEGSKALFADAMAITLYSYHNLDNGFAVGYQHNGLGLGLPATLVGALLGSTNSQGVIPGIPWNPDSEKAALEAVQNAGWTPISASTLGYGGKVDARGTYFGEKAGYTTAQVEVLGKYDDAGKLLEIGIGFRGTSGPRETLISDSIGDLVSDLLAALGPKDYAKNYAGEAFGGLLKNVADYAAAHGLTGKDVVVSGHSLGGLAVNSMADLSTNKWSGFYTDANYVAYASPTQSAGDKVLNIGYENDPVFRALDGSSFNLSSLGVHDKPHESTTDNIVSFNDHYASTLWNVLPFSIVNLPTWVSHLPTAYGDGMTRILDSGFYDQMTRDSTVIVANLSDPARATTWVQDLNRNAEPHKGNTFIIGSDGNDLIQGGKGADFIEGGKGNDTIRDNSGHNTFLFSGQFGNDRVIGYQTTDKLVFQDVQGSTDLRDHAKVVGADTVLTFGADSVTLVGVGHGGLWADGVSIG

SEQ ID NO: 1514 - DNA, 1023 bp, Pseudomonas aeruginosa
atgaagaaaatcctcctgctgattccactggcgttcgccgccagcctggcctggttcgtctggctggaaccttcccccgcccccgagacggcgcccccggccagcccgcaggcgggcgcagaccgcgccccgccagcagcctccgcgggagaagcggtgccggccccccaggtcatgccggccaaggtcgcgccgctgccaacctccttcaggggcaccagcgtcgatggcagtttcagtgtcgacgccagcggcaacctgctgatcacccgcgacatccgcaacctgttcgactacttcctcagcgccgtcggcgaagagcccctgcagcaaagcctggaccgcctgcgcgcctacatcgccgccgaactccaggagccggcgcgcggccaggcgttggcgctgatgcagcaatacatcgactacaagaaggaactggtgctgctcgaacgcgacctgccgcgcctggccgacctcgacgccctgcgccagcgggaagccgcggtgaaagccctgcgcgcgcggatcttcagcaacgaagcgcacgtggcgttcttcgccgacgaggaaacctacaaccagttcaccctggagcgcctggcgatccgccaggatggcaagctcagcgccgaggaaaaggccgccgccatcgaccgcctgcgcgccagcctgccggaagaccagcaggaaagcgtgctgccgcaactgcaaagcgaactgcagcagcagaccgccgccctccaggccgctggcgccggcccggaagccatccgccagatgcgtcagcaactggtgggcgccgaagccaccacccgcctggagcaactcgatcggcaacgctcggcctggaagggccggctggacgactatttcgccgagaagagccggatcgaaggcaatgccgggctgagcgaagccgaccgccgcgcggcggtcgaacgcctggccgaggagcgcttcagcgaacaggaacgcttgcgcctgggcgcgctggaacagatgcgccaggccgagcagcgctga

SEQ ID NO: 1515 - protein, 340 aa, Pseudomonas aeruginosa
MKKILLLIPLAFAASLAWFVWLEPSPAPETAPPASPQAGADRAPPAASAGEAVPAPQVMPAKVAPLPTSFRGTSVDGSFSVDASGNLLITRDIRNLFDYFLSAVGEEPLQQSLDRLRAYIAAELQEPARGQALALMQQYIDYKKELVLLERDLPRLADLDALRQREAAVKALRARIFSNEAHVAFFADEETYNQFTLERLAIRQDGKLSAEEKAAAIDRLRASLPEDQQESVLPQLQSELQQQTAALQAAGAGPEAIRQMRQQLVGAEATTRLEQLDRQRSAWKGRLDDYFAEKSRIEGNAGLSEADRRAAVERLAEERFSEQERLRLGALEQMRQAEQR

SEQ ID NO: 1516 - DNA, 1174 bp, Bacillus pumilus
gccttggtgattggttcaatggctttttctccagccgaatgacggtgatggcggcctgagcataatccggttgtgatggtacatggtattggtggtgcctcttataactttgcttcgattaaaagttacttggttggacaaggctgggatcgaaaccaattatatgctaactatttcatagacggggcaggaaataaccgcaacaatggtccgcgtctatccagattcgtcaaagatgtgttagacaaaacaggtgccaaaaaagtagatattgtggctcatagtatgggcggagcgaacacattatactatattaagaatctagatggcggagataaaattgaaaacgttgtcacgattggtggagcaaacggactcgtttcaagcagagcattaccaggcacagatccaaatcaaaaaattctttacacatccgtttatagttcagccgatctcatcgtcgtcaacagcctctctcgtttaattggtgcaaaaaacgtcctaattcacggcgttggccatatcggtctattaacctcaagccaagtgaaaggctatattaaagaaggactgaacggcggaggacaaatcaaagaagtttgcaaattctcgttgcacttgcattggtgattggttcaatggcttttatccagccgaaagaggtgaaggcggctgagcataatccggttgtgatggtacatggtattggtggtgcctcttataactttgcttcgattaaaagttacttggttggacaaggctgggatcgaaaccaattatatgctatcgatttcatagacaaaacaggaaataaccgcaacaatggtccgcgtctatccagattcgtcaaagatgtgttagacaaaacaggtgccaaaaaagtagatattgtggctcatagtatgggcggagcgaacacattatactatattaagaatctagatggcggagataaaattgaaaacgttgtcacgattggtggagcaaacggactcgtttcgggacaagagcattaccaggcacagatccaaatcaaaaaattctttacacatccgtttagtagttcagccgagtctcatcgtcgtcaacagcctcgtctcgtttaattggtgcaagaaaacgtcctacgtcacggcgttggccatatcggtctagtaacctcaagccaagtgaa

SEQ ID NO: 1517 - protein, 184 aa, Bacillus pumilus
MVHGIGGASYNFASIKSYLVGQGWDRNQLYANYFIDGAGNNRNNGPRLSRFVKDVLDKTGAKKVDIVAHSMGGANTLYYIKNLDGGDKIENVVTIGGANGLVSSRALPGTDPNQKILYTSVYSSADLIVVNSLSRLIGAKNVLIHGVGHIGLLTSSQVKGYIKEGLNGGGQIKEVCKFSLHLHW

SEQ ID NO: 1518 - DNA, 679 bp, Bacillus pumilus
gattagagtcgtataagatgaataagggggaatgaaagtgatgtttgttaagaaaaggagtttgcaaattctcattgcgcttgcattggtgattggttcaatggcttttatccagccgaaagaggtgaaggcggctgagcataatccggttgtgatggtacacggcattggcggtgcctcttataactttttttctattaaaagttatttggttggacaaggctgggatcgaaaccaattatatgctatcgatttcatagacaaaacaggaaataaccgcaacaatggtccgcgtctatccagattcgtcaaagatgtgttagacaaaacgggtgccaaaaaagtagatattgtggctcatagtatgggcggagcgaacacattatactatattaagaatctagatggcggcgataaaattgaaaacgttgtcacaattggtggagcaaacggactcgtttcaagcagagcattaccaggcacagatccaaatcaaaaaattctttacacatctgtctacagctcagctgatctcatcgtcgtcaacagcctctctcgtttaattggcgcaagaaacgttctgatccatggcgttggccatatcggtctattaacctcaagccaagtgaaaggctacattaaagaaggactgaacggcggaggacagaatacgaattaa

SEQ ID NO: 1519 - protein, 215 aa, Bacillus pumilus
MKVMFVKKRSLQILIALALVIGSMAFIQPKEVKAAEHNPVVMVHGIGGASYNFFSIKSYLVGQGWDRNQLYAIDFIDKTGNNRNNGPRLSRFVKDVLDKTGAKKVDIVAHSMGGANTLYYIKNLDGGDKIENVVTIGGANGLVSSRALPGTDPNQKILYTSVYSSADLIVVNSLSRLIGARNVLIHGVGHIGLLTSSQVKGYIKEGLNGGGQNTN

SEQ ID NO: 1520 - DNA, 1251 bp, GEOBACILLUS THERMOLEOVORANS
atgaaatgctgtcgggttatgtttgtgttgctcggattatggcttgtattcggcctatcggtcccgggagggcgggctgaagcggcaacttcacgcgccaacgatgcacccatcgtgcttctccatggttttaccggctggggaagagaagaaatgtttgggttcaagtactggggcggcgtgcgcggcgatatcgaacaatggctgaacgacaacggttatcgaacttatacgctggcggtcggaccgctctcgagcaactgggaccgggcgtgtgaagcgtatgctcagcttgtcggcgggacggtcgattatggggcagcccatgcggcaaagcacggccatgcgcggtttggccgcacttatcccggcctgttgccggaattgaaaaggggtggccgcatccatatcatcgcccacagccaaggggggcagacggcccgcatgcttgtctcgctcctagagaacggaagccaagaagagcgggagtacgccaaggcgcacaacgtgtcgttgtcgccgttgtttgaaggtggacatcattttgtgttgagtgtgacgaccatcgccactcctcatgacgggacgacgcttgtcaacatggttgatttcaccgatcgcttttttgacttgcaaaaagcggtgttggaagcggcggctgtcgccagcaacgcgccgtacacaagcgaaatatacgattttaagctcgaccaatgggggctgcgccgcgagccaggcgaatcgttcgaccattattttgaacggctcaagcgctcccctgtctggacatcgaccgataccgcccgctacgatttatccgttcccggggctgagacgttgaatcgatgggtgaaagccagcccgaatacgtattatttgagcttttctaccgaacggacgtatcgaggagctctgacaggcaactattatcccgaatttggaatgaacgcattcagcgcgattgtctgcgccccgtttttcggctcgtaccgcaatgcggcgcttggcattgacagccattggcttgagaacgacggcattgtcaataccatttcgatgaacggtccgaagcgtggatcaagcgatcggatcgtaccgtatgacggggcgttgaaaaaaggggtttggaatgacatgggaacgtacaatgtcgaccatttggaaatcatcggcgttgacccgaatccgtcatttgatattcgcgccttttatttgcggcttgccgagcagttggcgagcttgcggccttaa

SEQ ID NO: 1521 - protein, 416 aa, GEOBACILLUS THERMOLEOVORANS
MKCCRVMFVLLGLWLVFGLSVPGGRAEAATSRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNAPYTSEIYDFKLDQWGLRREPGESFDHYFERLKRSPVWTSTDTARYDLSVPGAETLNRWVKASPNTYYLSFSTERTYRGALTGNYYPEFGMNAFSAIVCAPFFGSYRNAALGIDSHWLENDGIVNTISMNGPKRGSSDRIVPYDGALKKGVWNDMGTYNVDHLEIIGVDPNPSFDIRAFYLRLAEQLASLRP

SEQ ID NO: 1522 - DNA, 1077 bp, PSEUDOMONAS SP. CL-61
tgcagcaagaaagctgaagctggcacagttgctgcgcaagcgacagcgaagccgttctccgggaagaattcgctgaaaggctggcaggacgcgccccgacaatccatcgacctgagaagagacaacatgcccttaattcaaaagttaggccacatattacaggaatttatcgaacccctctcccccttttcagtagactccgcctataaatatagaattgacgctttaaacctcccctccggacccgtcgacgaaatccccatgggcgaagtttccgaaagaattgctgctgacggaggaaaccttgacgttaccatttgtcgcccagccggtaaagaatttaatctccccgttatgatgttttttcacggcggcggctggctcggcaacgtcgacacccacgaactttttagactcgtctccggcaccgaagccgccgccgttagcgttaaatatactcccgcccccgaaatgcaccaacccgatgccattcttggacattatgccgccacctattgggttgttgaacacaaaggtgaaattaacgtcaccggacccagattagctgttgccattcttatgaccagatccgccggaggagactccgtcggtggaaacatggccctcgttgttggcaacctcgccaaacaaaaagatccccccgccattctctcccaaaaacttttttggcccgtcaccgacgccatgtgtgatacccactcctataaagaatatgccgaaggtcactttcttactgccggtggaatgatgaaatggttttggcaagactatgtctgtgacggtacccaaggcgatgaacttcccgcctccccccttagggctcaaactaaacttcttggtgaccttccccctcataaacttacttttgaagatgatctccgcgatgaaggtgaagcctacgctattaaacttccccaagctggcgttattgtccaagttagaagagacgaaggtatgattcattggtttaccctcaacccctttgccgaacctcatgctggcctttccgccgccgaccatctccctactgccatgcttgtcgagactgttatctag

SEQ ID NO: 1523 - protein, 316 aa, PSEUDOMONAS SP. CL-61
MPLIQKLGHILQEFIEPLSPFSVDSAYKYRIDALNLPSGPVDEIPMGEVSERIAADGGNLDVTICRPAGKEFNLPVMMFFHGGGWLGNVDTHELFRLVSGTEAAAVSVKYTPAPEMHQPDAILGHYAATYWVVEHKGEINVTGPRLAVAILMTRSAGGDSVGGNMALVVGNLAKQKDPPAILSQKLFWPVTDAMCDTHSYKEYAEGHFLTAGGMMKWFWQDYVCDGTQGDELPASPLRAQTKLLGDLPPHKLTFEDDLRDEGEAYAIKLPQAGVIVQVRRDEGMIHWFTLNPFAEPHAGLSAADHLPTAMLVETVI

SEQ ID NO: 1524 - DNA, 1125 bp, BURKHOLDERIA SP. 99-2-1
accggcagcacaataatcatgagaacatgcatggccaggacgatgcgttccagggtggtggcaggggcagtggcatgcgcgatgagcatcgcgccgttcgcggggacgaccgcggtgatgacgctcgcgacgacgcacgcggcaatggcggccaccgcgcccgccgctggctacgcggcgacgcgttacccgatcatcctcgtgcacgggctctcgggtaccgacaagtacgccggcgtgctcgagtattggtacggcatccaggaggacctgcaacagaacggtgcgaccgtctacgtcgcgaacctgtcgggtttccagagcgacgacggcccgaacgggcgcggcgaacagttgcttgcttacgtgaagacggtgctcgcggcgacgggggcgaccaaggtgaatctcgtcggtcacagccagggcggcctctcgtcgcgctatgttgctgccgtcgcgcccgatctcgttgcgtcggtgacgacgatcggcacgccgcatcgcggctccgaattcgccgacttcgtgcagaacgtgctcgcgtacgatccgaccgggctttcgtcatcggtgatcgccgcgttcgtcaatgtgttcgggatcctgacgagcagcagccacaacaccaaccaggacgcgctcgccgcactgcagacgctgaccaccgcacgggccgccacctacaaccagaactatccgagcgcgggcctgggtgcgccgggcagttgccagaccggtgcgccgaccgaaaccgtcggcggcaacacgcacctgctgtattcgtgggccggcacggcgatccagccgacgctctccgtgttcggcgtcacgggcgcgacggacacgagcacccttccgctcgtcgatccggcgaacgtgctcgacctgtcgacgctcgcgctgttcggcaccggcacggtgatgatcaaccgcggctccgggcagaacgacgggctcgtgtcgaaatgcagtgcgctgttcggcaaggtgctgagcacgaactacaagtggaaccacctcgacgagatcaaccagctgctcggcgtgcgcggcgcgtatgcggaagatccggtcgcggtgatccgcacgcatgtgaaccggctgaagctggcgggcgtgtaa

SEQ ID NO: 1525 - protein, 364 aa, BURKHOLDERIA SP. 99-2-1
MARTMRSRVVAGAVACAMSIAPFAGTTAVMTLATTHAAMAATAPAAGYAATRYPIILVHGLSGTDKYAGVLEYWYGIQEDLQQNGATVYVANLSGFQSDDGPNGRGEQLLAYVKTVLAATGATKVNLVGHSQGGLSSRYVAAVAPDLVASVTTIGTPHRGSEFADFVQNVLAYDPTGLSSSVIAAFVNVFGILTSSSHNTNQDALAALQTLTTARAATYNQNYPSAGLGAPGSCQTGAPTETVGGNTHLLYSWAGTAIQPTLSVFGVTGATDTSTLPLVDPANVLDLSTLALFGTGTVMINRGSGQNDGLVSKCSALFGKVLSTNYKWNHLDEINQLLGVRGAYAEDPVAVIRTHVNRLKLAGV

SEQ ID NO: 1526 - DNA, 1458 bp, BURKHOLDERIA SP. MC16-3
gtcgacaacgtgctgaacaaggcctataccgagcacctgaacctcgcgggcaacgcgggctttggctatccggcgaattcgccggtgatggagccgggccggaccgcctgggtgcgcgtgagcgcgaagctgtaacgcgtcgcgcgtgtgcgttgcagcatgcgcacgcatgaacgcggccccgcctgaacgggcggggcgcgtcaaccgattagagaaccgtgtctagtcagggcgcaaacgttcgcgagtcgtgattcactcccgcattcgacgcacacggtgcgcgcgacgttcgcgatgcagggtgtgtgtcgatccggcttcattcgcaccggcagcacaataatcaggagaacatgcatggccaggacgatgcgttccagggtggtggcaggggcagtggcatgcgcgatgagcatcgcgccgttcgcggggacgaccgcggtgatgacgctcgcgacgacgcacgcggcaatggcggccaccgcgcccgccgctggctacgcggcgacgcgttacccgatcatcctcgtgcacgggctctcgggtaccgacaagtacgccggcgtgctcgagtattggtacggcatccaggaggacctgcaacagaacggtgcgaccgtctacgtcgcgaacctgtcgggtttccagagcgacgacggcccgaacgggcgcggtgaacagttgctcgcttacgtgaagacggtgctcgcggcgacgggggcgaccaaggtgaatctcgtcggtcacagccagggcggcctctcgtcgcgctatgttgctgccgtcgcgcccgatctcgttgcgtcggtgacgacgatcggcacgccgcatcgcggctccgaattcgccgacttcgtgcaggacgtgctcgcgtacgatccgaccgggctttcgtcatcggtgatcgccgcgttcgtcaatgtgttcgggatcctgacgagcagcagccacaacaccaaccaggacgcgctcgccgcactgcagacgctgaccaccgcacgggccgccacgtacaaccagaactatccgagcgcgggcctgggtgcgccgggcagttgccagaccggtgcgccgaccgaaaccgtcggcggcaacacgcacctgctgtattcgtgggccggcacggcgatccagccgacgctctccgtgttcggcgtcacgggcgcgacggacacgagcacccttccgctcgtcgatccggcgaacgtgctcgacctgtcgacgcttgcgctgttcggcaccggcacggtgatgatcaaccgcggctccgggcagaacgacgggctcgtgtcgaagtgcagtgcgctgtacggcaaggtgctgagcacgaactacaagtggaaccacctcgacgagatcaaccagctgctcggcgtgcgcggcgcgtatgcggaagatcccgtcgcggtgatccgcacgcatgcgaaccggctgaagctggcgggcgtgtaa

SEQ ID NO: 1527 - protein, 364 aa, BURKHOLDERIA SP. MC16-3
MARTMRSRVVAGAVACAMSIAPFAGTTAVMTLATTHAAMAATAPAAGYAATRYPIILVHGLSGTDKYAGVLEYWYGIQEDLQQNGATVYVANLSGFQSDDGPNGRGEQLLAYVKTVLAATGATKVNLVGHSQGGLSSRYVAAVAPDLVASVTTIGTPHRGSEFADFVQDVLAYDPTGLSSSVIAAFVNVFGILTSSSHNTNQDALAALQTLTTARAATYNQNYPSAGLGAPGSCQTGAPTETVGGNTHLLYSWAGTAIQPTLSVFGVTGATDTSTLPLVDPANVLDLSTLALFGTGTVMINRGSGQNDGLVSKCSALYGKVLSTNYKWNHLDEINQLLGVRGAYAEDPVAVIRTHANRLKLAGV

SEQ ID NO: 1528 - DNA, 1854 bp, Pseudomonas fluorescens
atgggtgtgtatgactacaagaacttcggtacggcggaatccaaggcgctgttcagcgatgccatggccattacgctgtattcctaccacaacctcgataacggctttgccgtcggttatcagcacaacggcttcggcctcggtttgccggccacgctggtgaccgcgctgatcggcggtacggattcccagggggtgatccccggcattccgtggaaccccgattcggaaaaagccgcactcgacacggtgaaaaaagccggctggaccccgatcaccgccgcgcaactgggttacgagggcaagaccgatgcgcgcggcacctttttcggcgaaaaagccggctacaccagcgctcaggtagaaatcctcggcaaatacgacgctcagggccatctgacggaaatcggcattgcctttcgcggcaccagtggcccacgggaaatcctgattggcgactccatcggtgacgtgatcaacgacttgctcgccgcattcgggcccaaggattacgccaagaactacgtcggcgaggcctttggcaacctgatgaacgatgtggtggcgttcgccaaggccaacggcctgagcggcaaggacgtgctggtcagcggtcacagcctcggcgggctggcggtcaacagcatggcggacttgagcaccagcaaatggagcgggttcttccaggattccaactacatcgcctacgcctcgccgacccagagcagcaccgacaaggtgctcaacgtcggctacgaaaacgatccggtgttccgcgccctcgacggctcgaccttcaccggcgcctcgctcggcgtgcacgacgcgcccaaggagtcggcgaccgacaacatcgtcagcttcaacgaccactacgcctcggcggcgtggaacgtgctgccgttctcgatcgtcaacattccgacctggatctcgcacctgccgaccgcctatggcgacggcatgaaccgggtgatcgagtcgaagttctacgacctgaccagcaaggactcgacgatcatcgtcgccaacctgtcggatccggcgcgggccaacacctgggtccaagacctgaaccgcaacgccgaaacccacaagggcagcaccttcatcatcggcagcgacggtaatgatttgatccagggcggcagcggcaacgattacctggagggccgcgccggcaacgacaccttccgtgatggcgggggctacaacatcctgcttggcggctcgggcaacaacaccctcgagttgcagacgtcggtcaatagcttcgacttcgccaacgacggcgccggcaacctgtacatccgcgatgccaacggcgggatcagcatcacccgcgacatcggcagcatcgtcaccaaggagccgggcttcctctggggcctgttcaaggacgacgtgacccacagcgtcacggcggccggtcttaaggtcggcaacaacgtcacccagtacgaatcgagcgtgaagggcaccggcggtgccgacaccctcaaggccaaggccagcggagactggctgttcggcctggacggtaacgaccatctgatcggcggggcgggcaacgacgtgttcgtcggcggtgccggcaatgatctgctggagtcgggcggcggcgcggataccttcctgttcagcggcgcattcggccaggatcgcgtggtgggttacaccgccaacgacaaactggtgttcctcggcgtgcagggggtgttgccgggcgacgacttgcgcgcacacgccacggcggtggggcaggatacggtgctgaagtttggcgctgattcggtaacgctggtcggggttgccttgaacagcctgagtgccgacgggatcgtgatcgcctga

SEQ ID NO: 1529 - protein, 617 aa, Pseudomonas fluorescens
MGVYDYKNFGTAESKALFSDAMAITLYSYHNLDNGFAVGYQHNGFGLGLPATLVTALIGGTDSQGVIPGIPWNPDSEKAALDTVKKAGWTPITAAQLGYEGKTDARGTFFGEKAGYTSAQVEILGKYDAQGHLTEIGIAFRGTSGPREILIGDSIGDVINDLLAAFGPKDYAKNYVGEAFGNLMNDVVAFAKANGLSGKDVLVSGHSLGGLAVNSMADLSTSKWSGFFQDSNYIAYASPTQSSTDKVLNVGYENDPVFRALDGSTFTGASLGVHDAPKESATDNIVSFNDHYASAAWNVLPFSIVNIPTWISHLPTAYGDGMNRVIESKFYDLTSKDSTIIVANLSDPARANTWVQDLNRNAETHKGSTFIIGSDGNDLIQGGSGNDYLEGRAGNDTFRDGGGYNILLGGSGNNTLELQTSVNSFDFANDGAGNLYIRDANGGISITRDIGSIVTKEPGFLWGLFKDDVTHSVTAAGLKVGNNVTQYESSVKGTGGADTLKAKASGDWLFGLDGNDHLIGGAGNDVFVGGAGNDLLESGGGADTFLFSGAFGQDRVVGYTANDKLVFLGVQGVLPGDDLRAHATAVGQDTVLKFGADSVTLVGVALNSLSADGIVIA

SEQ ID NO: 1530 - DNA, 1254 bp, GEOBACILLUS STEAROTHERMOPHILUS
atgatgaaaggctgtcgggttatgtttgtgttgctcggattatggcttgtattcggcctatcggtcccgggagggcgggctgaagcggcaacttcacgcgccaacgatgcacccatcgtgcttctccatggttttaccggctggggaagagaagaaatgtttgggttcaagtactggggcggcgtgcgcggcgatatcgaacaatggctgaacgacaacggttatcgaacttatacgctggcggtcggaccgctctcgagcaactgggaccgggcgtgtgaagcgtatgctcagcttgtcggcgggacggtcgattatggggcagcccatgcggcaaagcacggccatgcgcggtttggccgcacttatcccggcctgttgccggaattgaaaaggggtggccgcatccatatcatcgcccacagccaaggggggcagacggcccgcatgcttgtctcgctcctagagaacggaagccaagaagagcgggagtacgccaaggcgcacaacgtgtcgttgtcaccgttgtttgaaggtggacatcattttgtgttgagtgtgacgaccatcgccactcctcatgacgggacgacgcttgtcaacatggttgatttcaccgatcgcttttttgacttgcaaaaagcggtgttggaagcggcggctgtcgccagcaacgtgccgtacacgagtcaagtatacgattttaagctcgaccaatggggactgcgccgccagccgggtgaatcgttcgaccattattttgaacggctcaagcgctcccctgtttggacgtcgacagataccgcccgctacgatttatccgtttccggagctgagaagttgaatcaatgggtgcaagcaagcccgaatacgtattatttgagctttgccacagaacggacgtatcgcggagcgctcacaggcaactattatcccgaactcggaatgaatgcattcagcgcggtcgtatgcgctccgtttctcggttcgtaccgcaatccgacgctcggcattgacgaccgctggcttgaaaacgatggtattgtcaatacggtttccatgaacggtccaaagcgtggatcaagcgatcggatcgtaccgtatgacggggcgttgaaaaaaggggtttggaatgacatgggaacgtacaatgtcgaccatttggaaatcatcggcgttgacccgaatccgtcatttgatattcgcgccttttatttgcgacttgccgagcagttggcgagcttgcagccttaa

SEQ ID NO: 1531 - protein, 417 aa, GEOBACILLUS STEAROTHERMOPHILUS
MMKGCRVMFVLLGLWLVFGLSVPGGRAEAATSRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNVPYTSQVYDFKLDQWGLRRQPGESFDHYFERLKRSPVWTSTDTARYDLSVSGAEKLNQWVQASPNTYYLSFATERTYRGALTGNYYPELGMNAFSAVVCAPFLGSYRNPTLGIDDRWLENDGIVNTVSMNGPKRGSSDRIVPYDGALKKGVWNDMGTYNVDHLEIIGVDPNPSFDIRAFYLRLAEQLASLQP

SEQ ID NO: 1532 - DNA, 1053 bp, BURKHOLDERIA MULTIVORANS
atggccgcccgtgacgggcacgcgtcgccaatgcggcgcgtcgccgtgtatgcagtagccggttgtgcggctgtggccgccgtcgtgctgtggcgcggcgcggcgccgccgcgcggcatcgaagtcgcgcacgccggatcgcaggcgggcgaacgcagcgcgattgcattgccatcgccggcggcgcggccggccggtgcaagcgtgcccgcgccgctggccggatcgagcgcgccgcgcttgccgctcgatccgggcggccatctggcgaagtcgcgcgcggtgcgcgatttcttcgactattgcctgactgcacagagcgagatcgacgccgcggcgctcgatgcgctcgtcgcccgcgagatcgccgcgcagctcgacggcacggtcgcgcaggcggaagcgctcgacgtctggcatcggtatcgcgcctatcgcgacgcgcttgcaaagctgcccgacgcgggcgccgtcaccgacaagtccgatctcggcgcgctgcagctcgcgctcgaccggcgcgcgtcgattgcgtaccggacgctcggcgactggagcgaaccgtttttcggtgcggagcagtggcggcagcgctacgacctcgcgcggctgcgcatcatgcaggaccgcacgctgaccgatgcgcagaaggccgagcggctcgcggcgctcgatcagcagatgccggccgacgagcgtgcggcgcagcagcgcgcgaacgcgcagcaggccgcaatcgaccggatcgcacagtcgcagaagagcggggcggcgcccgacgcgacgcgcgcggcactggcgcagacgctcggtgcggacgtcgccgcgcgtgtcgcgcagctgcagcaggacgacgcgtcgtggcaaagccgctatgccgattacgcggtgcagcgcgcgcagatcgaagccgccggtctgtcgccgcaggatcgcgacgcgcagatcgccgcgctgcggcagcgcgtgtttacgaaaccgggcgaagcggtgcgcgcggcgtcgctcgatcgcggtgcggccgctgcggctacggcgggcaccgcgcagtaa

SEQ ID NO: 1533 - protein, 350 aa, BURKHOLDERIA MULTIVORANS
MAARDGHASPMRRVAVYAVAGCAAVAAVVLWRGAAPPRGIEVAHAGSQAGERSAIALPSPAARPAGASVPAPLAGSSAPRLPLDPGGHLAKSRAVRDFFDYCLTAQSEIDAAALDALVAREIAAQLDGTVAQAEALDVWHRYRAYRDALAKLPDAGAVTDKSDLGALQLALDRRASIAYRTLGDWSEPFFGAEQWRQRYDLARLRIMQDRTLTDAQKAERLAALDQQMPADERAAQQRANAQQAAIDRIAQSQKSGAAPDATRAALAQTLGADVAARVAQLQQDDASWQSRYADYAVQRAQIEAAGLSPQDRDAQIAALRQRVFTKPGEAVRAASLDRGAAAAATAGTAQ

SEQ ID NO: 1534 - DNA, 1098 bp, BURKHOLDERIA MULTIVORANS
atggccagatcgatgcgttccagggtggtggcagcagcagtggcgtgcgcgatgagcgccgcgccgttcgcggggacgaccgcgttgatgacgctcgcgacgacgcgcacggcgctcgccgcgatcgcgccggccgacgattacgcggcgacgcgctatccgatcgtcctcgtgcacggactcacgggcaccgacaaatacgcgggcgtgctcgagtactggtacggcatccaggaagacctgcagcggcacggcgcgacggtgtacgtcgcgaacctgtcgggattccagagcgacgacggtccgaacggacgcggcgaacaattgctggcatacgtcaagcaggtgctcgccgcgaccggcgcgacgaaggttaatctgatcggccatagccagggcggtctcacgtcgcgctacgtggcggccgtcgcgccggatctcgtcgcgtcggtgacgacgatcggcaccccgcatcgcggctcggagttcgcggacttcgtgcagagcgtgcttgcgtacgacccgaccgggttgtcgtcgtcggcgatcgccgcactcgtcaacgtgttcggcatcctgacgagcagcagtcacaacacgaaccaggacgcgctcgccgcactgacgactctgacgaccgcgcaggccgcgacctacaaccggaacttcccgagcgcgggtctcggtgcacccggcagctgcacgaccggtgcgttgacggagacggtcggcggcaatacgcatctgctgtactcgtgggccggcaccgcgattcagccgacgaatgccgcgttcggcgtcacgggcgcgagcgacacgagcacgattccggtcgtcgatccggcgaatgcactggatgcgtcgacgctcgcgctgctcggcacgggtaccgtgatgatcaatcgcggctcggggcagaacgacggactcgtgtcgaagtgcagcgcgctgtacggacaggtgctcggcacgaacttcaaatggaatcatctcgacgagatcaaccagctgctcggcgtgcgcggtgcgtatgcggaagatccggtcgcaatgattccgcacgcacgcgaaccggttgcaacactcgcgggcgtctga

SEQ ID NO: 1535 - protein, 365 aa, BURKHOLDERIA MULTIVORANS
MARSMRSRVVAAAVACAMSAAPFAGTTALMTLATTRTALAAIAPADDYAATRYPIVLVHGLTGTDKYAGVLEYWYGIQEDLQRHGATVYVANLSGFQSDDGPNGRGEQLLAYVKQVLAATGATKVNLIGHSQGGLTSRYVAAVAPDLVASVTTIGTPHRGSEFADFVQSVLAYDPTGLSSSAIAALVNVFGILTSSSHNTNQDALAALTTLTTAQAATYNRNFPSAGLGAPGSCTTGALTETVGGNTHLLYSWAGTAIQPTNAAFGVTGASDTSTIPVVDPANALDASTLALLGTGTVMINRGSGQNDGLVSKCSALYGQVLGTNFKWNHLDEINQLLGVRGAYAEDPVAMIPHAREPVATLAGV

SEQ ID NO: 1536 - DNA, 736 bp, Bacillus pumilus
ggccgcgggaattcgattagagtcgtataagatgaataagggggaatgaaagtgattctatttaagaaaagaagtttgcaaattctcgttgcacttgcattggtgattggttcaatggcttttatccagccgaaagaggtgaaggcggctgagcataatccggttgtgatggtacatggtattggtggtgcctcttataactttgcttcgattaaaagttacttggttggacaaggctgggatcgaaaccaattatatgctatcgatttcatagacaaaacaggaaataaccgcaacaatggtccgcgtctatccagattcgtcaaagatgtgttagacaaaacaggtgccaaaaaagtagatattgtggctcatagtatgggcggagcgaacacattatactatattaagaatctagatggcggagataaaattgaaaacgttgtcacgattggtggagcaaacggactcgtttcaagcagagcattaccaggcacagatccaaatcaaaaaattctttacacatccgtttatagttcagccgatctcatcgtcgtcaacagcctctctcgtttaattggtgcaaaaaacgtcctaattcacggcgttggccatatcggtctattaacctcaagccaagtgaaaggctatattaaagaaggactgaacggcggaggacagaatacgaattaaaaaacgaaaaaagccagcggcatgaatcactagtgaattcgcg

SEQ ID NO: 1537 - protein, 215 aa, Bacillus pumilus
MKVILFKKRSLQILVALALVIGSMAFIQPKEVKAAEHNPVVMVHGIGGASYNFASIKSYLVGQGWDRNQLYAIDFIDKTGNNRNNGPRLSRFVKDVLDKTGAKKVDIVAHSMGGANTLYYIKNLDGGDKIENVVTIGGANGLVSSRALPGTDPNQKILYTSVYSSADLIVVNSLSRLIGAKNVLIHGVGHIGLLTSSQVKGYIKEGLNGGGQNTN

SEQ ID NO: 1538 - DNA, 1568 bp, Bacillus SP. TP10A.1
ccgcggcgctaatcgatccgctttttccgccgtcatcgcctggatgtggctgatcaactgccgctctttggcggtcaagtcgcgatccgatatagccgcgtttcctttctccggcaggaaaccccgacaattgcggggattgaaggggcttggtcttatgtataaaatatttaggtaattcaaaaaatacttcagcccgttggaaggagagggagaacatgatgaaatgctgtcggcgtgttgcccttgtgttgctcggattatggcttgtgttctgcctatctgttccgggagggcgagctgaagcggcggcttcgcgagccaatgatgcgccgattgtgcttctccatggctttaccggctggggacgagaagaaatgtttgggttcaagtactggggcggggtgcgcggcgatatcgaacaactgcttaacgcccaggggtatcgaacgtacacgttggcggtcggcccgctctcaagcaactgggaccgggcatgcgaagcgtacgcccagcttgtcggcggaacggtcgattatggtgcggcccatgcggcgaagcacggccatgcgcggtttggccgcacgtatccgggcttgctgccggaattgaaaagaggcggccgcgtccatatcatcgctcatagccaaggaggacagacggcccgcatgcttgtgtctctcctagagaacggaagcaaagaagagcgggagtacgccaaggcgcataacgtgtcgttgtcgccgttgtttgaaggcggacataattttgtgttgagtgtgacaaccattgccactcctcatgacgggacgacgcttgtcaatatggtcgatttcactgatcgcttctttgacctgcaaaaagcggtgttgaaagcggcggctgtcgccagcaatgtgccgtacacgagtcaagtatacgattttaagctcgaccaatgggggttgcgccgtcagccgggtgaatcgtttgaccaatattttgagcggctcaaacagtcccccgtttggacgtccgcagataccgcccgctatgatttatccgttcccggtgcggaggcgctgaaccaatgggtgcaggcaagtccgaacacgtattatttgagctttgccacagaacggacgtatcgaggagctctcacaggcaactattatcccgaactggggatgaatgtattcagcgccgccgtatgcgccccgtttctcggctcgtaccgcaatgcggcgcttggcattgacgaccgctggcttgagaacgatggcatcgtcaacacgttttcgatgaacgggccgaagcgtggatcgaccgatcggatcgtgccgtatgacgggacgttgaaaaaaggagtttggaatgacatgggaacgtacaatgtcgatcatttggaagtgatcggcgttgacccgaatccgttgtttgatattcatgccttttatttacgccttgccgagcagttggcgagtttgcggccttaatgaagggattatcaggagaacggacaaaaagccatctcggtcagatggctctttttttgtggagcaagcacctgagttgtatgacggccgcgg

SEQ ID NO: 1539 - protein, 418 aa, Bacillus SP. TP10A.1
MMKCCRRVALVLLGLWLVFCLSVPGGRAEAAASRANDAPIVLLHGFTGWGREEMFGFKYWGGVRGDIEQLLNAQGYRTYTLAVGPLSSNWDRACEAYAQLVGGTVDYGAAHAAKHGHARFGRTYPGLLPELKRGGRVHIIAHSQGGQTARMLVSLLENGSKEEREYAKAHNVSLSPLFEGGHNFVLSVTTIATPHDGTTLVNMVDFTDRFFDLQKAVLKAAAVASNVPYTSQVYDFKLDQWGLRRQPGESFDQYFERLKQSPVWTSADTARYDLSVPGAEALNQWVQASPNTYYLSFATERTYRGALTGNYYPELGMNVFSAAVCAPFLGSYRNAALGIDDRWLENDGIVNTFSMNGPKRGSTDRIVPYDGTLKKGVWNDMGTYNVDHLEVIGVDPNPLFDIHAFYLRLAEQLASLRP

SEQ ID NO: 1540 - DNA, 2740 bp, Staphylococcus warneri
tttaaattattttgcttggcaccaataattttgatttctgacatgtgtttcacctcttaatacggtattaccctaatatgtattttcaattcgttatgaatagtcatttaatagcgcttattcgccataagatgaagtgtgtataattacaaaaaataaaaattgtatagaattggatttgattattgacttttcagacaaattttcgtaacattttaatcaattactagttaaagtaagtgtaagtgatgatgtcgaaattttttattttaatattattgtaagcgcttactaacaaaagaaaggatggttcttatgaaagcttggtttacaaaattaattgagtttttactacgtgcaattgtcaatttattcatctagtcatttaggattgatttaaaaataaaataaaatagaggtgccgaatatgaaaaatagagaaaataaatatagtattcgtaaatttagtgtaggaacatcttccattttaatcgcagcattattatttattggtggaggttctgctcaagcagctgaaaatcaagataagggaaatgttgattcagaagcacaacaagcacaatctattggggaacaacagggaaatgatgttaaaaatgaacaaacaaatcaatctagtgaattaaaagaacgtaacgatagcgttgaagcacaaaatgacaatcaacaagatgcaacaccaacaagcttacataaagaaacatctgagaaagatactacacaaacgtcacaagacaatactgaagagaaacaaacaaaagatgcaacagtagaaactgagcaatcagctaatcaagtgcaacaagatgttaaaacaactaaagaaaaaacaacagaagatcaagcaacaaagtctgttgaaaaatctgatgctacaacgccaaatcaaaaggacaaagctgatggcaaagcaacaaaagaagaaacgccaacaactagtccaaaggcgcaagataaagcatcatcaactcaaacgcatcaacatgatgtagatccagaatttaatagcaaacataaagcttcacaagtggatccagaatttagtcataagcaagcgcaaaagaaagcggatgtagattcagagttcaataaaaatcataaagcgcaacaggtcgatccagatttctctcgacgtcatgctacagaaaaagcgactcatgctactgtgaataaagaaaaagcagatgccacaattaatcaaaaagaccaacaaaaagtgacagcacaatcagttgatcaaaaagctacagctccgaagcaaactgattcatctcaaaaatcaaaacaaaagcaacctgtctctcttgaacaattagaaaaagattcaccattattatcaaaagataatccaagtaaaaaagataaagaacaaaaagacggtttacaagcgctaaaatcgaattcagttgccacattaaataatcagtctaaaaataaagtagctgtagcagataaagaccaaacaaataagaaagctaaacaacaacagtataaaaatcatgatcctatcattctcgttcatggatttaatggattcactgatgatattaacccagctgttttatcacattattggggtggcgataaaatgaatattcgccaagatttagaagaaaacggctacaaatcatatgaagcaagtatcagtgccttcggtagtaactatgacagagcggtagaactatactactatatcaagggtggtcgtgtagattacggtgcagcacatgctgcgaaatatggtcatgagcgatatggtaaaacatatgaaggtgtatataaagactggaaaccaggtcaaaaagtgcacttagttggtcatagtatgggtggacaaacgattcgccaacttgaagaacttttaagaaatggtaaccaagaggaaattgagtatcagaagaaacatggtggtacaatttcaccattattcaaaggcaataatgataatatggtttcttcaattacgacacttggtacaccacataatggtacacacgcttcagatgtattaggtaatgaagcggttgtaagacaggttgtttatgatattggtaaagcctttggtaataaagattcaagagtcgactttggtttatctcaatggggcttaaaacaaaaaccaaatgaatcatatatcgattatgctaaacgtgtgaaaaactctaagttatggaaatcacaagacaatggtttctatgatttaactcgagatggtgcaacagacttaaaccgtaaaacatcattaaatccaaatattgtatataaaacatatactggtgaggcaacacatccatcactatttggtagacaaaaagcagatttaaacatgttcttaccatttattttaactggaaatgtgatcggtaaagctaacgaaaaagaatggagagaaaatgatggacttgtatctgtgatttcttcacaacatccatttaatcaaaaatatacacaagcaacagataaaaaccaaaaaggtatttggcaagtaacacctacaaaacatgattgggatcatgttgactttgttggacaagatagttctgatacagtaagaactagagaagaattacaacaattctggcatggtctagcagatgatttagtacaaagtgaaaagttaacatcagagcaaaaagcacaagcataattaagatactatatctttaataaagaaaggagcatgcactatgactgcggatttcttccaattaatcggatc

SEQ ID NO: 1541 - protein, 746 aa, Staphylococcus warneri
MKNRENKYSIRKFSVGTSSILIAALLFIGGGSAQAAENQDKGNVDSEAQQAQSIGEQQGNDVKNEQTNQSSELKERNDSVEAQNDNQQDATPTSLHKETSEKDTTQTSQDNTEEKQTKDATVETEQSANQVQQDVKTTKEKTTEDQATKSVEKSDATTPNQKDKADGKATKEETPTTSPKAQDKASSTQTHQHDVDPEFNSKHKASQVDPEFSHKQAQKKADVDSEFNKNHKAQQVDPDFSRRHATEKATHATVNKEKADATINQKDQQKVTAQSVDQKATAPKQTDSSQKSKQKQPVSLEQLEKDSPLLSKDNPSKKDKEQKDGLQALKSNSVATLNNQSKNKVAVADKDQTNKKAKQQQYKNHDPIILVHGFNGFTDDINPAVLSHYWGGDKMNIRQDLEENGYKSYEASISAFGSNYDRAVELYYYIKGGRVDYGAAHAAKYGHERYGKTYEGVYKDWKPGQKVHLVGHSMGGQTIRQLEELLRNGNQEEIEYQKKHGGTISPLFKGNNDNMVSSITTLGTPHNGTHASDVLGNEAVVRQVVYDIGKAFGNKDSRVDFGLSQWGLKQKPNESYIDYAKRVKNSKLWKSQDNGFYDLTRDGATDLNRKTSLNPNIVYKTYTGEATHPSLFGRQKADLNMFLPFILTGNVIGKANEKEWRENDGLVSVISSQHPFNQKYTQATDKNQKGIWQVTPTKHDWDHVDFVGQDSSDTVRTREELQQFWHGLADDLVQSEKLTSEQKAQA

SEQ ID NO: 1542 - DNA, 1765 bp, Staphylococcus warneri
gcagctattcctacactgaatttagcaaatgaaatcaatccatggattggattagttttaacaattattatgttggcagtaatgtataacactatattagggttatgttactcatttgcagcacgtttcactgaaccatatagtaaaaaatatcatgtgttcattattataatgatgattgcggcctacattttaagtttcgtaggatttgctgatttaattaactatttatataatattatgggtgtagtcggtttatttatagttgttgccgtactaatcaaatattataaacgtaagagtgatgacaaaaaacatattgcataatgatatgtaatttgatgtactttacaattaaatgcgattgatttaatcttaaaagcaattcatctttttaaatagaaggggaattgcttttttaatgtaattattatgccaattaataatataagtgagcattgatgagaggattatccgtcatgaaggcaaaacataaatggttgttgataactgtcgttattattttaatagtaggtactagtactggtctgttattgaaaaaatattatgatcatgaacaccgacaacaacaaaataaagaaaaagtccaaataaataataaaaacgtgaaagtcttacagaatatttcttatggtcaaggcatacctaatagtaaattagatattattatgccatctgatatgaataaagatagtaagttaccagtcatcttttggatgcatggtggtggttttattgctggtgataaacagtataaaaatcctttactatctaaaatagctgagcaaggttacattgtggtaaacgtcaactatgcgttagcgcctcaatacaagtatcctacacctattgaacaaatgaacaaagctgtcaaatttataaaaacgaatgaacatgatttgcctattgattttgatcaagtcattataggtggtgattctgctggcgcacaattaaccagtcaatatgttgctatgcaaacaaatcaatcgttacgtgatgaaatgaaatttgaacccgaatttaaaccttctcaaattaaagcagcgatattctttggtggtttctatgatatgaagacagttaaagctacagagtttcctaggatccaattatttatgagaagttatacaggtacaacaaattgggagagtaattttaaaaacttatctcaaatgtctacgataaatcaaataactaaagattatccgcctacatttttatcagtgggtgatgcggatccattttatagtcagaatatagatttttataaaaaattaaaagaaaaagatgtgccagctgaaacattattttatgatggttcacatcacttacaccatcaatatcaatttcatttaaataaaccagaatccaaagagaatattaaacgggtactcttattcttaagtagaaacacatcttcttcaggtgttgaacgaaacaatcaatctaatcacaatgaaaacaataatttgaatcaagatgtacaattagacccatttagtgaataaatgaagcaaaacaccgtaaaacgacaacaatagtcgctttacggtgtttttatacatgatatatcgttatcaacttatttcatctaattatatgataaaattcaatatgtaattatcataaataattaatttaaaattttagccatcacgtattcattataatatttgttgttaatatacaacttatcttttagttcgccttcaatttggaatccagcgctcttaaataagtt

SEQ ID NO: 1543 - protein, 350 aa, Staphylococcus warneri
MKAKHKWLLITVVIILIVGTSTGLLLKKYYDHEHRQQQNKEKVQINNKNVKVLQNISYGQGIPNSKLDIIMPSDMNKDSKLPVIFWMHGGGFIAGDKQYKNPLLSKIAEQGYIVVNVNYALAPQYKYPTPIEQMNKAVKFIKTNEHDLPIDFDQVIIGGDSAGAQLTSQYVAMQTNQSLRDEMKFEPEFKPSQIKAAIFFGGFYDMKTVKATEFPRIQLFMRSYTGTTNWESNFKNLSQMSTINQITKDYPPTFLSVGDADPFYSQNIDFYKKLKEKDVPAETLFYDGSHHLHHQYQFHLNKPESKENIKRVLLFLSRNTSSSGVERNNQSNHNENNNLNQDVQLDPFSE

SEQ ID NO: 1544 - DNA, 1251 bp, BACILLUS SP. 12
atgaaatgctgtcggattatgtttgtgttgctcggattatggtttgtgttcggcctatcggtcccgggagggcggacggaagcggcatccctacgcgccaatgatgcaccgattgtgcttctccatgggtttaccggatggggacgagaggaaatgtttggattcaagtattggggcggcgtgcgcggcgatatcgaacaatggctgaacgacaacggttatcgaacgtatacgctggcggtcggaccgctctcgagcaactgggaccgggcgtgtgaagcgtatgctcagcttgtcggcgggacggtcgattatggggcagcccatgcggcaaagcacggccatgcgcggtttggccgcacttatcccggcctgttgccggaattgaaaaggggtggccgcatccatatcatcgcccacagccaaggggggcagacggcccgcatgcttgtctcgctcctagagaacggaagccaagaagagcgggagtacgccaaggcgcataacgtgtcgttgtcaccgttgtttgaaggtggacatcattttgtgttgagtgtgacgaccatcgccactcctcatgacgggacgacgcttgtcaacatggttgatttcaccgatcgcttttttgacttgcaaaaagcggtgttggaagcggcggctgtcgccagcaacgtgccgtacacgagtcaagtatacgattttaagctcgaccaatggggactgcgccgccagccgggtgaatcgttcgaccattattttgaacggctcaagcgctcccctgtttggacgtccacagataccgcccgctacgatttatccgtttccggagctgagaagttgaatcaatgggtgcaagcaagcccgaatacgtattatttgagtttctctacagaacggacgtatcgcggagcgctcacaggcaaccattatcccgaactcggaatgaatgcattcagcgcggtcgtatgcgctccgtttctcggttcgtaccgcaatccgacgctcggcattgacgaccgatggttggagaacgatggcattgtcaatacggtttccatgaacggtccaaagcgtggatcaagcgatcggatcgtgccgtatgacgggacgttgaaaaaaggggtttggaatgatatgggaacgtacaacgtcgaccatttggaaatcatcggcgttgacccgaatccgtcatttgatattcgcgccttttatttgcggcttgccgagcagttggcaagcttgctcccttaa

SEQ ID NO: 1545 - protein, 416 aa, BACILLUS SP. 12
MKCCRIMFVLLGLWFVFGLSVPGGRTEAASLRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNVPYTSQVYDFKLDQWGLRRQPGESFDHYFERLKRSPVWTSTDTARYDLSVSGAEKLNQWVQASPNTYYLSFSTERTYRGALTGNHYPELGMNAFSAVVCAPFLGSYRNPTLGIDDRWLENDGIVNTVSMNGPKRGSSDRIVPYDGTLKKGVWNDMGTYNVDHLEIIGVDPNPSFDIRAFYLRLAEQLASLLP

SEQ ID NO: 1546 - DNA, 1547 bp, Bacillus megaterium
atataaacaataatcatcggtgtgcctcctttgtacgtatttatatttatataggtgagaataaaatatatacgaatatcatcctctttatttaattgttatacccatttttaatcaaaacaaacaaaagcctgccgagaagacaatatattggattttttctgaaatttcattcatcattacatatagagttaccttgaaaggagagagaagaagaatgccgttagatccgcatattcaaatatttctaaatcaatataatgaaatgccccgtccttctttagaggacgttacacccccacagctgagggaaatggaaaagatgtccttaactccttctaaagaagcagttaaaaaagtatataatgaagaaattgaattaaatgaacgtacgctcactctacgagtgtatgaacctgaaggaacagggccatttcccgctcttgtttattatcacggaggaggatgggtattaggcagcctggatactcatgactccatatgcaggtcgtatgcaaatgaaacaaactgtattgtagtgtctgttgattaccgtcttgctcctgagagtaaatttcccgctgcagtaaacgatgcctatgacgccttggattggatttcagctcatgcgtctcaattaaatatcgattcaaacaaaattgccgtcggtggcgacagtgccggtggtaaccttgctgcggttgtaagcattttagcaaaacaaagacaaggtccatccattgttcatcagctgcttatttatccgtctgtaggatttaaaaatcaacaccctgcctctatgaaagaaaacgccgaaggatatcttctttcaaaagatctcatggattggtttcgccttcagtacttaaataataaagaagaagaacagcacccctataacgctccagtattactagaagatttatcgagtctaccgagcgctaccattattacagcacaatatgatcctttaagagatagcggaaaagactacgcggacgcattaaaaaatcacggtgtccccgtcacctatgaaaattatgaaacaatgattcacgggtttttagggtttcatgaattcgtcccactcgctcagcaggcgatcaataaaagcgcagctcaactgcgtcaagtatttgattctatttaaggcgcaaagatatatagtgtcataaaatatttaattaaaaaaatactaaaaatatagtaaaagttaaaaagttctttccttaattggattgggcttttttacttttcaattttctcgtataattcatccattttaacattcaaaacgtcagctaacttaagtactttatccatgctagaacaaactgaaaaagaagaaaagaaattcttgaggttatggaaagtacgataatggattatagagaagaagatatgggcaatattagcgattttaacggaaatttattggaaaataaaaaagaaatataattgaaaaaataacaaaaataacctatttcatggtattatttactcgttgaagggctgagtactgtgacagagcaattgtaggggttaag

SEQ ID NO: 1547 - protein, 310 aa, Bacillus megaterium
MPLDPHIQIFLNQYNEMPRPSLEDVTPPQLREMEKMSLTPSKEAVKKVYNEEIELNERTLTLRVYEPEGTGPFPALVYYHGGGWVLGSLDTHDSICRSYANETNCIVVSVDYRLAPESKFPAAVNDAYDALDWISAHASQLNIDSNKIAVGGDSAGGNLAAVVSILAKQRQGPSIVHQLLIYPSVGFKNQHPASMKENAEGYLLSKDLMDWFRLQYLNNKEEEQHPYNAPVLLEDLSSLPSATIITAQYDPLRDSGKDYADALKNHGVPVTYENYETMIHGFLGFHEFVPLAQQAINKSAAQLRQVFDSI

SEQ ID NO: 1548 - DNA, 2506 bp, Pseudomonas aeruginosa
gatctcggccaggatgcgccggctgcgctcgaggaacaggctgccttcggcggtcagggtgatgctgcgggtgctgcggtggaacaggcgcacgccgagtttctcttccaggcgggcgacccgcttgcccaccgccgaggcgctgacgccgagggtccgggcggcgccgacgatgctgcgggtctcggcgacgcggacgaagacggtgaaaccgctgaggctgtccatgcaaggctccgattacggacatgatggtccggatagaacggaactctatccgtctttttccgcttttgcagcgctcttagcctgtccgcatccttcatctgcggagagtcccgcatgtccagtttcgaacgagagccaggctgcggcctggcggaaaatgtcgatcaggtgatcgaggcggcattcgccgaccagcgcctggtgggggcggtggtgctggtggcacaccgggggcagtggctctatcgacgggctgccggcctggccgaccgcgaagccggccggataatgggcgaggacagcctgttccgcctggcctcggtgagcaagccgatcgtcagcgtcgcggccctgagcctggtggacgagggccggctggccctcgatgagccgatcgccgactggttgccggcgttccgtccgcgcctggccgacggccgcgaggcgcgcatcacgccgcggcagttgctgagccacagcgccggcctcggctatcgcttcctcgaagccgacgcagacggcccctatgcccgcgccgggatttccgatggcatggacctgccgggtttcgacctggccgagaatctccgtcgcctggcctccgtgcccttgctctacgaacccggccgcgcctggggctattcgctggccaccgacgtgctcggcgcgctggtggagcgggtcgacgggcggccgctggcggaagcgctgcggcagcgggtcgggattccagccggcatgcgcgacagcggcttcctctgcgccgacgcgtgccgactggcggcggtctacgtcagcgaccggccacgcccgcgccgaatggccgggcgggagaccgtggcgccgttcgaggactgcgtcggcattcgcttcgagccgagtcgggctttcgaaccgtctgcctatgcgtccggcggggcggggatgatcggcagcgccggcgacgtgctgcgccttttggaaatccttcgccagggcggcgcgccgttgctgacgcctggcctggtggaggagatgggtcgcgaccaggtacccggcctggaactgccggccaatcccggtttcggcttcggcctgggtttctccgtgctgcgcgacccggctatcgcgcaatcgccggaggctcccggcacctggcgctggggtggcgcctacgggcattcctggttcgtcgaccgggcccgcgaactgtcggtggtggcgcttaccaacaccctgttcgagggaatgtcgggacgcttcgtcaacgacctgcgcgacgccgtctaccgttccgcggacgtgcgctgatgggacgccgcgaagcatttccggagaacgccggggccgctgcgtcggccgtggcgccgcggctgccgctgagtgcgctgctggcgatggcgatgtccggcttcgtcgccattctcagcgaaaccctgccggccggcctgctgccgcaaatcggcgcggggctggcggtcagcgaggcgctggccgggcaactggtcagcgtctacgccttgggttcgctactggccgcgctgccggcggcgagcctgacccagggctggcggcggcgccgggtgctgctgctggcgctgctgatcttcttcgtctgcaacagcctaaccgccgtttcctcggattaccgcctgaccctgctggcgcgcttcggcagcggcgtcgccgccggcctcgcctggggcctgctggcggctacgcgcggcgcctggtgccgccggagcagcaggggcgggcgctggcggtggccatgctcggtgcgccgctggcgctgtcgctcggcgttccgctgggcacctggctgggcggcctgctcggctggcgctgggccttcggcctgttgtcgctgaccgcgctgctgctggtcggctgggtgctgcgcagcgtgccggacttccctggccagccggccgggcggcgcctgcgcctgctcggggtgctgcgcacgccgggcgtgcgtccggtattgctggtgatcgtcgcctgggtgctggcgcacaacatcctctacacctatatcgcgccgttcctcgccaaggtcggcctgggcgcctcggtggacctggccctgctggtattcggcagcgccgcggtggcgggaatctggctggtcggcgtgctggtcgaccggcacctgcggcggatggtcctggccagcctggcgctgttcgccgtggcggcgctggcgctgtgcctgggcgctcgctggagctggctggcgttcgccgggctggccctctgggggctgacgttcggtggcgcggcgacgctgctgcag

SEQ ID NO: 1549 - protein, 391 aa, Pseudomonas aeruginosa
MSSFEREPGCGLAENVDQVIEAAFADQRLVGAVVLVAHRGQWLYRRAAGLADREAGRIMGEDSLFRLASVSKPIVSVAALSLVDEGRLALDEPIADWLPAFRPRLADGREARITPRQLLSHSAGLGYRFLEADADGPYARAGISDGMDLPGFDLAENLRRLASVPLLYEPGRAWGYSLATDVLGALVERVDGRPLAEALRQRVGIPAGMRDSGFLCADACRLAAVYVSDRPRPRRMAGRETVAPFEDCVGIRFEPSRAFEPSAYASGGAGMIGSAGDVLRLLEILRQGGAPLLTPGLVEEMGRDQVPGLELPANPGFGFGLGFSVLRDPAIAQSPEAPGTWRWGGAYGHSWFVDRARELSVVALTNTLFEGMSGRFVNDLRDAVYRSADVR

SEQ ID NO: 1550 - DNA, 1251 bp, BACILLUS SP. 42
atgaaatgctgtcggattatgtttgtgttgctcggattatggtttgtgttcggcctatcggtcccgggagggcggacggaagcggcatccctacgcgccaatgatgcaccgattgtgcttctccatgggtttaccggatggggacgagaggaaatgtttggattcaagtattggggcggcgtgcgcggcgatatcgaacaatggctgaacgacaacggttatcgaacgtatacgctggcggtcggaccgctctcgagcaactgggaccgggcgtgtgaagcgtatgctcagcttgtcggcgggacggtcgattatggggcagcccatgcggcaaagcacggccatgcgcggtttggccgcacttatcccggcctgttgccggaattgaaaaggggtggccgcatccatatcatcgcccacagccaaggggggcagacggcccgcatgcttgtctcgctcctagagaacggaagccaagaagagcgggagtacgccaaggcgcataacgtgtcgttgtcaccgtggtttgaaggtggacatcattttgtgttgagtgtgacgaccatcgccactcctcatgacgggacgacgcttgtcaacatggttgatttcaccgatcgcttttttgacttgcaaaaagcggtgttggaagcggcggctgtcgccagcaacgtgccgtacacgagtcaagtatacgattttaagctcgaccaatggggactgcgccgccagccgggtgaatcgttcgaccattattttgaacggctcaagcgctcccctgtttggacgtccacagataccgcccgctacgatttatccgtttccggagctgagaagttgaatcaatgggtgcaagcaagcccgaatacgtattatttgagtttctctacagaacggacgtatcgcggagcgctcacaggcaaccattatcccgaactcggaatgaatgcattcagcgcggtcgtatgcgctccgtttctcggttcgtaccgcaatccgacgctcggcattgacgaccgatggttggagaacgatggcattgtcaatacggtttccatgaacggtccaaagcgtggatcaagcgatcggatcgtgccgtatgacgggacgttgaaaaaaggggtttggaatgatatgggaacgtacaacgtcgaccatttggaaatcatcggcgttgacccgaatccgtcatttgatattcgcgccttttatttgcggcttgccgagcagttggcgagcttgcggccttaa

SEQ ID NO: 1551 - protein, 416 aa, BACILLUS SP. 42
MKCCRIMFVLLGLWFVFGLSVPGGRTEAASLRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPWFEGGHHFVLSVTTIATPHDGTTLVNMVDFTDRFFDLQKAVLEAAAVASNVPYTSQVYDFKLDQWGLRRQPGESFDHYFERLKRSPVWTSTDTARYDLSVSGAEKLNQWVQASPNTYYLSFSTERTYRGALTGNHYPELGMNAFSAVVCAPFLGSYRNPTLGIDDRWLENDGIVNTVSMNGPKRGSSDRIVPYDGTLKKGVWNDMGTYNVDHLEIIGVDPNPSFDIRAFYLRLAEQLASLRP

SEQ ID NO: 1552 - DNA, 1851 bp, Pseudomonas fluorescens
atgggtgtgtatgactacaagaacttcggtacggcggaatccaaggcgctgttcagcgatgccatggccattacgctgtattcctaccacaacctcgataacggctttgccgtcggttatcagcacaacggcttcggcctcggtttgccggccacgctggtgaccgcgctgatcggcggtacggattcccagggggtgatccccggcattccgtggaaccccgattcggaaaaagccgcactcgacgcggtgaaaaaagccggctggaccccgatcaccgccgcgcaactgggttacgagggcaagaccgatgcgcgcggcacctttttcggcgaaaaagccggctacaccagcgctcaggtagaaatcctcggcaaatacgacgctcagggccatctgacggaaatcggcattgcctttcgcggcaccagtggcccacgggaaatcctgattggcgactccatcggtgacgtgatcaacgacttgctcgccgcattcgggcccaaggattacgccaagaactacgtcggcgaggcctttggcaacctgatgaacgatgtggtggcgttcgccaaggccaacggcctgagcggcaaggacatgctggtcagcggtcacagcctcggcgggctggcggtcaacagcatggcggacttgagcaccagcaaatggagcgggttcttccaggattccaactacatcgcctacgcctcgccgacccagagcagcaccgacaaggtgctcaacgtcggctatgaaaacgacccggtgttccgcgccctcgacggctcgaccttcaccggtgcatccctcggcgtgcacgacgcgcccaaggagtcggcgaccgacaacatcgtcagcttcaacgaccactacgcctcggcggcgtggaacgtgctgccgttctcgatcgtcaacattccgacctggatctcgcacctgccgaccgcctatggcgacggcatgaaccgggtgatcgagtcgaagttttacgacctgaccagcaaggactcgacgatcatcgtcgccaactgtcggatccggcgcgggcaacactgggtgcaagacctgaaccgcaacgccgaaacccacaagggcagcaccttcatcatcggcagcgacggcaatgacctgatccagggcggcaacggcaacgattacctggagggccgcgccggcaacgatacgttccgcgatggcgggggttacaacatcctgctcggcggctcgggcaacaacaccctggagttgcagaagtcagtcaatagcttcgacttcgccaacgacggcgccggcaacctgtacatccgcgatgccaacggcgggatcagcatcacccgcgacatcggcagcatcgtcaccaaggagccgggctttctctggggcctgttcaaggacgacgtgacccacagcgtcacggcggccggtcttaaggtcggcaacaacgtcacccagtacgaatcgagcgtgaagggcaccggcggtgccgacaccctcaaggccaaggccagcggagactggctgttcggcctggacggcaacgaccatctgatcggcggggcgggcaatgacgtgttcgtcggcggtgctggcaatgatctgctggagtcgggcggcggggcggataccttcctgttcagcggcgcgttcggccaggatcgcgtggtgggttacaccgccaacgacaagctggtgttcctcggcgtgcagggcgtattgcccaacgacgacttccgcgcccatgccacggcggtgggacaggacacggtgctgaagttcggcgctgattcggtgacgctggtcggggtcgcgttgaacagcctgagtgcggatggaattgtgatcgcctga

SEQ ID NO: 1553 - protein, 616 aa, Pseudomonas fluorescens
MGVYDYKNFGTAESKALFSDAMAITLYSYHNLDNGFAVGYQHNGFGLGLPATLVTALIGGTDSQGVIPGIPWNPDSEKAALDAVKKAGWTPITAAQLGYEGKTDARGTFFGEKAGYTSAQVEILGKYDAQGHLTEIGIAFRGTSGPREILIGDSIGDVINDLLAAFGPKDYAKNYVGEAFGNLMNDVVAFAKANGLSGKDMLVSGHSLGGLAVNSMADLSTSKWSGFFQDSNYIAYASPTQSSTDKVLNVGYENDPVFRALDGSTFTGASLGVHDAPKESATDNIVSFNDHYASAAWNVLPFSIVNIPTWISHLPTAYGDGMNRVIESKFYDLTSKDSTIIVANCRIRRGQHWVQDLNRNAETHKGSTFIIGSDGNDLIQGGNGNDYLEGRAGNDTFRDGGGYNILLGGSGNNTLELQKSVNSFDFANDGAGNLYIRDANGGISITRDIGSIVTKEPGFLWGLFKDDVTHSVTAAGLKVGNNVTQYESSVKGTGGADTLKAKASGDWLFGLDGNDHLIGGAGNDVFVGGAGNDLLESGGGADTFLFSGAFGQDRVVGYTANDKLVFLGVQGVLPNDDFRAHATAVGQDTVLKFGADSVTLVGVALNSLSADGIVIA

SEQ ID NO: 1554 - DNA, 2241 bp, Burkholderia cepacia
tcattcgcaccggcagcacaataatcaggagaacatgcatggccaggacgatgcgttccagggtggtggcaggggcagtggcatgcgcgatgagcatcgcgccgttcgcggggacgaccgcggtgatgacgctcgcaacgacgcacgcggcaatggcggccaccgcgcccgccgctggctacgcggcgacgcgttacccgatcatcctcgtgcacgggctctcgggtaccgacaagtacgccggcgtgctcgagtattggtacggcatccaggaggacctgcaacagaacggtgcgaccgtctacgtcgcgaacctgtcgggtttccagagcgacgacggcccgaacgggcgcggcgaacagttgctcgcttacgtgaagacggtgctcgcggcgacgggggcgaccaaggtcaatctcgtcggtcacagccagggcggcctctcgtcgcgctatgttgctgccgtcgcgcccgatctcgttgcgtcggtgacgacgatcggcacgccgcatcgcggctccgaattcgccgacttcgtgcaggacgtgctcgcgtacgatccgaccgggctttcgtcatcggtgatcgcagcgttcgtcaatgtgttcgggatcctgacgagcagcagccacaacaccaaccaggacgcgctcgccgcactgcagacgctgaccaccgcacgggccgccacgtacaaccagaactatccgagcgcgggcctgggtgcgccgggcagttgccagaccggtgcgccgaccgaaaccgtcggcggcaacacgcacctgctgtattcgtgggccggcacggcgatccagccgacgctctccgtgttcggcgtcacgggcgcgacggacacgagcacccttccgctcgtcgatccggcgaacgtgctcgatctgtcgacgcttgcgctgttcggcaccggcacggtgatgatcaaccgcggctccgggcagaacgacgggctcgtgtcgaaatgcagtgcgctgttcggcaaggtgctgagcacgaactacaagtggaaccacctcgacgagatcaaccagctgctcggcgtgcgcggcgcgtatgcggaagatccggtcgcggtgatccgcacgcatgcgaaccggctgaagctggcgggcgtgtaatcgatgacggcacgaggaggacgcgcgccgctggcgcgccgcgccgtggtctatggtgccgtggggctggcggcggttgccggcgtggcgatgtggagcggcgcgggccggcatggcgggacgggcgcatccggcgagccgccggatgcgtcggcggcacgcggaccggctgccgcaccgccgcaggccgccgtgccggcaagcacgagcctgccgccgtcgctcgccggctccagcgcgcctcgcttgccgctcgatgcgggcggccatctcgcgaagtcgcgcgcggtgcgggatttcttcgactactgcctgaccgcgcagagcgacctgagtgcggccgggctcgatgcgttcgtcgtgcgcgagattgccgcacagctcgacggtaccgttgcgcaggccgaggcgctcgacgtgtggcaccggtatcgcgcgtatctcgacgcactcgcgaaattgcgcgatgccggcgcggtcgacaagtcggacctgggtgcattgcagctcgcgctcgaccagcgcgcgtcgatcgcgtaccgcacgctcggcgactggagccagccgttcttcggtgcggagcaatggcggcagcgctacgacctcgcacggctgaagatcgcgcaggaccccgcgctgacggatgcgcagaaggccgaacggctcgcggcgctcgaacagcagatgccggccgacgaacgcgccgcgcagcagcgcgtcgaccggcagcgcgcggcgatcgaccagatcgcgcaattgcagaagagcggggcgacgcccgatgcgatgcgcgcacaactgacgcagacgctcggccctgaagcggccgtgcgcgtcgcgcagatgcagcaggacgacgcatcgtggcagagccgctacgcggactatgcggcgcagcgtgcgcagatcgagtcggccggcctgtcgccgcaggatcgcgacgcgcagatcgccgcgctgcggcagcgcatgttcacgaagcccggcgaagccgtgcgcgcggcttcgctcgatcgcggggcgggcagcgcgcggtaacacgggcggcgctggcggcccggcgcatgacggtcgttatgccgcgcgcgtgagatcgcgaggcaggtgt

SEQ ID NO: 1555 - protein, 364 aa, Burkholderia cepacia
MARTMRSRVVAGAVACAMSIAPFAGTTAVMTLATTHAAMAATAPAAGYAATRYPIILVHGLSGTDKYAGVLEYWYGIQEDLQQNGATVYVANLSGFQSDDGPNGRGEQLLAYVKTVLAATGATKVNLVGHSQGGLSSRYVAAVAPDLVASVTTIGTPHRGSEFADFVQDVLAYDPTGLSSSVIAAFVNVFGILTSSSHNTNQDALAALQTLTTARAATYNQNYPSAGLGAPGSCQTGAPTETVGGNTHLLYSWAGTAIQPTLSVFGVTGATDTSTLPLVDPANVLDLSTLALFGTGTVMINRGSGQNDGLVSKCSALFGKVLSTNYKWNHLDEINQLLGVRGAYAEDPVAVIRTHANRLKLAGV

SEQ ID NO: 1556 - protein, 344 aa, Burkholderia cepacia
MTARGGRAPLARRAVVYGAVGLAAVAGVAMWSGAGRHGGTGASGEPPDASAARGPAAAPPQAAVPASTSLPPSLAGSSAPRLPLDAGGHLAKSRAVRDFFDYCLTAQSDLSAAGLDAFVVREIAAQLDGTVAQAEALDVWHRYRAYLDALAKLRDAGAVDKSDLGALQLALDQRASIAYRTLGDWSQPFFGAEQWRQRYDLARLKIAQDPALTDAQKAERLAALEQQMPADERAAQQRVDRQRAAIDQIAQLQKSGATPDAMRAQLTQTLGPEAAVRVAQMQQDDASWQSRYADYAAQRAQIESAGLSPQDRDAQIAALRQRMFTKPGEAVRAASLDRGAGSAR

SEQ ID NO: 1557 - DNA, 2092 bp, Pseudomonas aeruginosa
tcggccccatcaacctgagatgagaacaacatgaagaagaagtctctgctccccctcggcctggccatcggtctcgcctctctcgctgccagccctctgatccaggccagcacctacacccagaccaaataccccatcgtgctggcccacggcatgctcggcttcgacaacatcctcggggtcgactactggttcggcattcccagcgccttgcgccgtgacggtgcccaggtctacgtcaccgaagtcagccagttggacacctcggaagtccgcggcgagcagttgctgcaacaggtggaggaaatcgtcgccctcagcggccagcccaaggtcaacctgatcggccacagccacggcgggccgaccatccgctacgtcgccgccgtacgtcccgacctgatcgcttccgccaccagcgtcggcgccccgcacaagggttcggacaccgccgacttcctgcgccagatcccaccgggttcggccggcgaggcagtcctctccgggctggtcaacagcctcggcgcgctgatcagcttcctttccagcggcagcaccggtacgcagaattcactgggctcgctggagtcgctgaacagcgagggtgccgcgcgcttcaacgccaagtacccgcagggcatccccacctcggcctgcggcgaaggcgcctacaaggtcaacggcgtgagctattactcctggagcggttcctcgccgctgaccaacttcctcgatccgagcgacgccttcctcggcgcctcgtcgctgaccttcaagaacggcaccgccaacgacggcctggtcggcacctgcagttcgcacctgggcatggtgatccgcgacaactaccggatgaaccacctggacgaggtgaaccaggtcttcggcctcaccagcctgttcgagaccagcccggtcagcgtctaccgccagcacgccaaccgcctgaagaacgccagcctgtaggaccccggccggggcctcggccccggccctttcccggaagccccctcgcgtgaagaaaatcctcctgctgattccactggcgttcgccgccagcctggcctggttcgtctggctggaaccttcccccgcacccgagacggcgcccccggccagcccgcaggcgggcgcagtccacgccccgccagcagcctccgcgggagaagcggtgccggcccctcaggtcatgccggccaaggtcgcgccgctgccaacctccttcaggggcaccagcgtcgatggcagtttcagtgtcgacgccagcggcaacctgctgatcacccgcgacatccgcaacctgttcgactacttcctcagcgccgtcggcgaagagcccctgcagcaaagcctggaccgcctgcgcgcctacatcgccgccgaactccaggagccggcgcgcggccaggcgttggcgctgatgcagcaatacatcgactacaagaaggaactggtgctgctcgaacgcgacctgccgcgcctggccgacctcgacgccctgcgccagcgggaagccgcggtgaaagccctgcgcgcgcggatcttcagcaacgaagcgcacgtggcgttcttcgccgacgaggaaacctacaaccagttcaccctggagcgcctggcgatccgccaggacggcaagctcagcgccgaggaaaaggccgccgccatcgaccgcctgcgcgccagcctgccggaagaccagcaggaaagcgtgctgccgcaactgcaaagcgaactgcagcagcagaccgccgccctccaggccgctggcgccggcccggaagccatccgccagatgcgtcagcaactggtgggcgccgaagccaccacccgcctggagcaactcgatcggcaacgctcggcctggaagggccggctggacgactatttcgccgagaagagccggatcgaaggcaataccgggctgagcgaagccgaccgccgcgcggcggtcgaacgcctggccgaggagcgcttcagcgaacaggaacgcttgcgcctgggcgcgctggaacagatgcgccaggccgagcagcgctgaccggcacggaaacgccgagaacgcggcgaagggcgcttcggcggataacgctac

SEQ ID NO: 1558 - protein, 311 aa, Pseudomonas aeruginosa
MKKKSLLPLGLAIGLASLAASPLIQASTYTQTKYPIVLAHGMLGFDNILGVDYWFGIPSALRRDGAQVYVTEVSQLDTSEVRGEQLLQQVEEIVALSGQPKVNLIGHSHGGPTIRYVAAVRPDLIASATSVGAPHKGSDTADFLRQIPPGSAGEAVLSGLVNSLGALISFLSSGSTGTQNSLGSLESLNSEGAARFNAKYPQGIPTSACGEGAYKVNGVSYYSWSGSSPLTNFLDPSDAFLGASSLTFKNGTANDGLVGTCSSHLGMVIRDNYRMNHLDEVNQVFGLTSLFETSPVSVYRQHANRLKNASL

SEQ ID NO: 1559 - protein, 340 aa, Pseudomonas aeruginosa
MKKILLLIPLAFAASLAWFVWLEPSPAPETAPPASPQAGAVHAPPAASAGEAVPAPQVMPAKVAPLPTSFRGTSVDGSFSVDASGNLLITRDIRNLFDYFLSAVGEEPLQQSLDRLRAYIAAELQEPARGQALALMQQYIDYKKELVLLERDLPRLADLDALRQREAAVKALRARIFSNEAHVAFFADEETYNQFTLERLAIRQDGKLSAEEKAAAIDRLRASLPEDQQESVLPQLQSELQQQTAALQAAGAGPEAIRQMRQQLVGAEATTRLEQLDRQRSAWKGRLDDYFAEKSRIEGNTGLSEADRRAAVERLAEERFSEQERLRLGALEQMRQAEQR

SEQ ID NO: 1560 - DNA, 2323 bp, Vibrio vulnificus
ctaacgttcctcggtatcgcagcgaaacagcgctacgtgattgacgaatacatcgacgacgctgttggaatcatggaagagaatgagcagggcagaatgtgggtggccaaagtggttttgcgaccgaccatccgtttttccggtgacaagcagcctgatcgacacgctttggaaaaactgcatcatttagcacaccagcactgctttattgcgaactccgtgaagagtgaagtggttaccgaaatttagcaaacactaataaaaacaaaaccttactttatgcggtatcgtacaatgttcaccattcttgttgaactgcaagacatgctcacgaatgttaaattaatgttactcgtcaatgccgctttcgctgaatttcccttctacttttaattggctcctcagaggtccgattagtagaaggaaaataactatgaaacggaaaatattgttcgctgctctctggtgtatgagtgctgctgccctcgcagggaccagcacctcatccctcaatcaaacggggtatacgcaaacgcgttaccctatcgtgttagtccatggtttgtttggctttgataagttagctggcgtggattatttctatggtattcctgaatccttaaccaaagatggtgccaaggtgtatgtcgcgcaagtctctgctaccaacagcagtgaagtgcgtggcgagcagcttctatcacaagtagaaatgctgttggctgccacaggggcctcaaaggtcaatttgattggtcacagccatggtgggccgaccgctcgttatgttgcgtctgttcggcctgatctcgtggcgtcggtcaccagcattggtggggtcaacaagggctctaaagtggcagacttagtccgaggtcatgtttctgaaggctcgcttaccgaagcactggcagtgaagctcgcggaggggcttagcggtctaattggtctactatccggtggcagtggtttggatcaagatccgctagcgtcactggatgcacttacaacgcaagggtcattgcgctttaaccaattctacccagagggactgcctcaaaccgagtgcggcgagggagagatgttggctggcaatggcgtctattactactcgtggacgggttcgagcacctataccaacgttttggatcccgccgatgcaccaatggccattcttggtttagcgtttgccggtgaagcgaatgatggccttgttggtgcgtgcagtacccatttgggtaaagtgattcgtgacgactataaaatgaatcacttagatgagatcaatggtctgttgggtattcatcatttgtttgaaacggatcccgtcaccctttatcgccagcacgccaatcgtctgaaactacaagggctgtagcctcaaagggaacgttatgaaaaagaccgcactgaccattatcacgatcgccttggggagcctcggtgcggtctattttttaccttcggagcccgctgcgcaaaaagacattcgcgccacctctcagcacgatacctcggttgataacacatcgcccaaggcctttttggactactcactctccacgctaggtgaaaaacctttgcagacaataacgcaagatgtggttagcgaagagagggcgttaggcgaattgcagttggatgagcagctattcgcactttaccttcgctacaagcaagctcttgctgatttagatattgaaataacggggtcagacatcacctcattagaaaccttgcatcaagcgatactcgatttacagcgagagtacttttcagcgcaacaaatcgacctgatttttggcgaggagaaccaattaagggcgcttgctctggaaaaagcgcgcttgagtgaacagggctattcagcagaagagcagaaacaactctggcgtgatcatttggcactgcaaccggaatacgttcaagaaagtgacgccaaccgccgattgatgagtgaattagcgcaaggagaagatgcacaaaccacctatctcaagcgagtggaactcgtgggtgaggctggagcacagcgactggaagtgttggaccaaaatcgcgccgagtttgatcgcgtttttcaacattacttagtgcaacgcagtgcgattcttgatgacctcggcttgagcgatgagcaaaagcacaagcaaatcacaatgttgagagaaaccagcttcgacgcaaaacagtggcgaagaattgaagcacttgaacgcattgcagatggtggataatcgctttcgcagcaaatgagtttaaagcgagaaaagctgcgaaatttactcagttggcgtcgagaaacttccactttatccccact

SEQ ID NO: 1561 - protein, 302 aa, Vibrio vulnificus
MSAAALAGTSTSSLNQTGYTQTRYPIVLVHGLFGFDKLAGVDYFYGIPESLTKDGAKVYVAQVSATNSSEVRGEQLLSQVEMLLAATGASKVNLIGHSHGGPTARYVASVRPDLVASVTSIGGVNKGSKVADLVRGHVSEGSLTEALAVKLAEGLSGLIGLLSGGSGLDQDPLASLDALTTQGSLRFNQFYPEGLPQTECGEGEMLAGNGVYYYSWTGSSTYTNVLDPADAPMAILGLAFAGEANDGLVGACSTHLGKVIRDDYKMNHLDEINGLLGIHHLFETDPVTLYRQHANRLKLQGL

SEQ ID NO: 1562 - protein, 280 aa, Vibrio vulnificus
MKKTALTIITIALGSLGAVYFLPSEPAAQKDIRATSQHDTSVDNTSPKAFLDYSLSTLGEKPLQTITQDVVSEERALGELQLDEQLFALYLRYKQALADLDIEITGSDITSLETLHQAILDLQREYFSAQQIDLIFGEENQLRALALEKARLSEQGYSAEEQKQLWRDHLALQPEYVQESDANRRLMSELAQGEDAQTTYLKRVELVGEAGAQRLEVLDQNRAEFDRVFQHYLVQRSAILDDLGLSDEQKHKQITMLRETSFDAKQWRRIEALERIADGG

SEQ ID NO: 1563 - DNA, 1237 bp, UNCULTURED BACTERIUM PLASMID
gatcaccctgggcgccggcgccacgttcttctaggcaccgggcaaggcgggtatgcgcgagtagcacacactccatctcttgtacttccactcacgagccagcgggacttctcgctggcttgtttctattttcggcgggcgtccaggaagctcgccaacacattcaggctcgacgagagcccgccagtgagaagcgcttgacgatttcgcgaggcccgttttagggtggccccgtatcgctgagcggaatcttgttttgcattgcagaacatccacacagcggtgcttccatcgaagatgtgcagttctgtacgagagagagagggagagaccatgcaagcttcgcaatcgcttctgagcctgttcaccatcgccgcgtgttccaccgccctgatgggctgcctcgaagccgccgaccagggcggcctcgacgaggagctcgagctgggctccgccgagcaggaggccggcaccttcccgccggtctccgacttcgcggccaccggtccgttctcgacgacgtcggggagcctcgggctctcctgcaccgtctaccgcccgagcaacctcggccagggcggcgtcacccacccggtgatcctgtggggcaacggcaccggctcctcgccgtccacctacgccggcctgctccgccacctggccagccacggcttcatcgtcgccgccgcggatacctcgaacgccggcaacggctccgagatgatcagctgcctcaactcgctggtcagcgccaacggcagcgtgctgagcccgttctatcagaaggtcgacaccgcgcgcgtcggcgccagcggccactcgcagggcggcgccggcaccatcatggccggccgcgactcgcgcgtcaccgccaccgcgccgctgcagccgtacatcggcttcatcccgttcggcggactcttcctcgactcgtcgatccgccagcagcgcggcccgatgttcctggtctccggctcgtcggacaccatcgccgtccccaccatcaatcagctgcccgtctacaacggcgtcaaccagccggtctggtgggccacccgcagcggcgcctcgcacttcgagcccgtcggcagcgcggcgccttccgcggcccggtcaccgcgtggttccgcgctcgcttcatgaacgacgccaacgccgaccgcgtgttcaataacccctgcacgctgtgctcggcctccggctggacggtccgccgccgctaactacccagcgatcg

SEQ ID NO: 1564 - protein, 281 aa, UNCULTURED BACTERIUM PLASMID
MCSSVREREGETMQASQSLLSLFTIAACSTALMGCLEAADQGGLDEELELGSAEQEAGTFPPVSDFAATGPFSTTSGSLGLSCTVYRPSNLGQGGVTHPVILWGNGTGSSPSTYAGLLRHLASHGFIVAAADTSNAGNGSEMISCLNSLVSANGSVLSPFYQKVDTARVGASGHSQGGAGTIMAGRDSRVTATAPLQPYIGFIPFGGLFLDSSIRQQRGPMFLVSGSSDTIAVPTINQLPVYNGVNQPVWWATRSGASHFEPVGSAAPSAARSPRGSALAS

SEQ ID NO: 1565 - DNA, 1212 bp, THERMOANAEROBACTER TENGCONGENSIS
atgaggaagctaagagtatttcctctattggtaataatgtcgttgttattatttcaaggacattataaagcaacatcatattttgatccaacaccagtaaaaacctttaccgactctaaatactgggctaaagtggaacttttgagagatagcaatcctaatataggacaagaaaaatttataacagataatcaacaaaaagatccagaaattatcaaagaatttaacaacaatcctcaaccaaattcacaatattttttgctccactatgcacccggttgggatacaggcacaaagccatatcctgtaattcttgttcacggtgctgggtccgatgcaaacttttttgcagatcctaaaagggatggttcgattactggtttgatgcaatatctttcgcaaagaggttataaagtctttgctgttacatttgcgcatcctcatggggacaattacattcaaagagagattcttgctgatgtgattcagaaggttaaggctgtaacaggagcaagtaaagttgatattgtagcacatagtaaaggcaatatgtccgcaagaatgtacgtgtcaaatgtcaaagaatcatggggagttgattttggaaaagatgtgagaagatatatccagctgggagctccaaatggtggaattgactttacttttaggaatccaaatatggcatggggtataatgacaactggaggatttggacctgttccttatacttatatgttgatttatggattatggtataataccacctatcacagtatatatacagaaggtggtgcctatccaggacaacttcagatgctagcaagatgggatagtgtatatcctctaaatacaacgcagcaagattggtatacaacttattatggagggtggggatttgctagttattcctatggaataaattatgcaattaaagaaggcggaaatcttgttaatacattacagaattcccctgtagatccttctgtagaaatagctgtgttggctggagattataattatataaatggtgttccgtgggagaccacagggcccagtgatggattagtatttgtaaaaagtgctactgatacatcggcaatgacaaaatcaggggcaaaacttttagcgaaagacgtataccatttaaatcaccttgagctggcatatgataaatcagctatggattggatagatgcacaattgtcaaaatga

SEQ ID NO: 1566 - protein, 403 aa, THERMOANAEROBACTER TENGCONGENSIS
MRKLRVFPLLVIMSLLLFQGHYKATSYFDPTPVKTFTDSKYWAKVELLRDSNPNIGQEKFITDNQQKDPEIIKEFNNNPQPNSQYFLLHYAPGWDTGTKPYPVILVHGAGSDANFFADPKRDGSITGLMQYLSQRGYKVFAVTFAHPHGDNYIQREILADVIQKVKAVTGASKVDIVAHSKGNMSARMYVSNVKESWGVDFGKDVRRYIQLGAPNGGIDFTFRNPNMAWGIMTTGGFGPVPYTYMLIYGLWYNTTYHSIYTEGGAYPGQLQMLARWDSVYPLNTTQQDWYTTYYGGWGFASYSYGINYAIKEGGNLVNTLQNSPVDPSVEIAVLAGDYNYINGVPWETTGPSDGLVFVKSATDTSAMTKSGAKLLAKDVYHLNHLELAYDKSAMDWIDAQLSK

SEQ ID NO: 1567 - DNA, 2358 bp, Pseudomonas aeruginosa
cgacccggcggatgaactgccgtccttaggttcggcgccgaccaccggcagcacgcctagactcgtcacaaggcttgcgacagcgggccggcacggctagcgttcagcgctggccccttttttcctgaagccttcggacacccatgaaacgattcctcctcggtctggttctgctgctggcggtcgccgccggcgtcctctacttcgtcccggctaccctcctcgccagcgtacgcaccgtcgagcgcggtctcgccggtctcagcgagcacagcgtgcaggtcgacaacctggagatcgcctacctggaaggtggctcggagaagaacccgaccctgttgctgatccacggcttcggcgccgacaaggacaactggctgcgcttcgcccggccgctgaccgagcgctaccatgtggtcgccctcgacctgcccggcttcggcgacagcagcaagccgcaacaggccagctacgacgtcggcacccaggccgagcgagtcgccaatttcgccgccgccatcggcgtgcgccgcctgcacctggccggcaactccatgggcgggcacatcgccgcgctctacgcggcgcgccatccggaacaggtgctatcgctggcgctgatcgacaacgccggggtgatgccggcgcgcaagagcgaactgttcgaggacctggagcgcggcgagaatcccctggtggtgcgccagccggaagacttccagaagctgctcgacttcgtgttcgtccagcaaccgccgctgccggcgccgctcaagcgctacctcggcgagcgcgcggtagccgcgtcggcgttcaacgcgcagatattcgaacaactgcgccagcgctacatcccgctggagccggaactgccgaagatcgaggcaccgaccctgctgctatggggcgaccgcgaccgcgtgctggacgtctccagcatcgaggtgatgcgtccgctgctgaagcggcccagcgtggtgatcatggaaaactgcggacacgtgccgatggtcgaacgcccggaggaaaccgcgcagcactaccaggccttcctcgacggcgtacggaacgcccaggtggccggtcgctgaaaacgcgaaccggcgcctgggcgccggtgcgggggagcgggagccgtcgcgaggacggctcggatccaggcctcaggcctggatcaggttggcgatctgcacgtccgggttgacgtcctgctcgtagtcgaccccagcgacctcgaaaccgaacaggttgaggaactcgctcttgtagccggcgaagtcggtcaactcgtaaaggttctcgttggttaccttgtcccacagctcctcgacacgggactgcacttccggctgcagttccttgtagtcggcacgcaggcggccttcctcgtcgaggcgcggctcggcgccgtacaggctctcccggtacaggccgtcgacctgctcgatgcaaccttcgtgggtgccctgctccttcatcaccttgaacagcagcgacaggtacagcggcatcattgggatcgccgagctggcctgggtcaccaccgccttgagcaccgacacgcgcgcatcgccgcccagcgtggcgagcttgtcgcggataccgaggaccttctggtcgagatccttcttggccgcgccgatggaaccgttccagtagatgtcgtgggtgatcttctcgcccaggtaggtgaacgcggtggtcttcgcgccgtcggccagcacgtcggcttccagcagcgcgtcgatccacatctgccagtcctcgccgcccatcaccgcaacggtatcggcgacctcctggtcgctggccgcctccaggaccacgtccttgatcacttccttgtcggtgtccaggccacggaagctgaccgacttgccgatcggcttgagggtcgaggagaacacttcgccgctcttcggatgggtacggcgcggcgcggccaggctgtagaccaccaggtcgaccttgccgagatcgcgcttgatggtctcgatggtcagccgcttcacctcgtcggagaaagcgtcgccattgatgctgcgggcatacaggcctttctcgtgggcgaacttctcgaaggccgccgagttgtaccagccggcggtgcccggcttgctctcgctgcccggacgctcgaagaacaccccgagggtatcggcgccggaaccgaacgcggcggtgatgcgggcagccaggccatagccggtggaggaaccgatgaccaggaccttcttcggtccgttgacgacggggcccttggcctcgacgtagtcgatctgttgcttgacgttggcctcgcagcctgccggatgggtagtgacgcagatgaagccacgcacgcgcggtttgatgatc

SEQ ID NO: 1568 - protein, 315 aa, Pseudomonas aeruginosa
MKRFLLGLVLLLAVAAGVLYFVPATLLASVRTVERGLAGLSEHSVQVDNLEIAYLEGGSEKNPTLLLIHGFGADKDNWLRFARPLTERYHVVALDLPGFGDSSKPQQASYDVGTQAERVANFAAAIGVRRLHLAGNSMGGHIAALYAARHPEQVLSLALIDNAGVMPARKSELFEDLERGENPLVVRQPEDFQKLLDFVFVQQPPLPAPLKRYLGERAVAASAFNAQIFEQLRQRYIPLEPELPKIEAPTLLLWGDRDRVLDVSSIEVMRPLLKRPSVVIMENCGHVPMVERPEETAQHYQAFLDGVRNAQVAGR

SEQ ID NO: 1569 - DNA, 2318 bp, Staphylococcus epidermidis
cacgactatgaagcaaatgtttataattatcacttctaattattatcaagtgttcatgcttcttcatcatgtgtaatgaaaaacattttcaatatgttatcaatcatttttaatattgtgtatacacataataattatatgtaagtattgattatttttaataattcaaaatgtaaagtttacaaagttttaataaataaactaaagtaatttatatttttatgttaatatatatacataacagttatattttcatcttttataggggaaaaaacttatagaggtgatttttttgaaaaataataatgaaacaagaagatttagcattaggaagtacacggtgggagtcgtgtcaatcattactgggattacaatatttgtcagtggtcagcatgctcaagctgctgaaatgacacaatcatcatcagattttaacgaacagtcacaacaaacagaacaagttgaacacaaagaagatacaactcatttatcatacgaattgaatcaagagggtgacacagctagccaatcaaagactaatcaagagaaccaatctgatggcaatgtacaaaaaaagagtaatcaaatacaacaagattcaacacaaacgtcaccattaaatgaccaaaaacaaacttcaatggaacaacaatcaaaagacaatcatgttaccccaaattcacgtcaggatacatatccaaaaggccaaaatcaagatgataaaggcaaacaacagtttaaagataatcaacactcacaaacaggacatcaacctaatactcaaaatcaaaataatgatcaagattcatcagataaaaagcaacacccatctgatcaaactcaagactcatcttcaaaaggaacacaacctaaacaatcacagtctatagaagatagagataaaacagtaaaacaaccatcttctaaagtacacaaaataggtaacacaaaaactgataaaacagttaaaacaaatcaaaaaaagcaaacatcattaacttcaccacgcgttgtgaaatcaaaacaaactaaacatatcaatcaacttactgcgcaagcgcaatataaaaatcaatatccagtcgtgtttgtacatggatttgtaggtttagtcggtgaagatgcattcagcatgtacccaaattattggggtggtattaaatataacgtgaaaaaagaacttacaaaattaggttaccgagttcacgaagccaatgtaggggcatttagcagcaattatgaccgtgctgttgaactgtattattatattaaaggtggacgagtagattatggtgcagcacatgctgcaaaatatggtcacaagcgttatggcagaacatatgaaggcatcatgcctgattgggaaccaggtaaaaagatacatcttgttggacatagtatgggtggccaaacgatacgcttgatggaacattttttaagaaatggaaatcaagaagaaatagactaccaacgtcaatatggtggtacggtatctgatttgtttaagggtggacaagataacatggtgtctacgattactacattaggaacacctcataatggcacacctgctgcagataaactagggtcgactaaatttatcaaagatacaattaatagaattggaaaaattggtggaactaaagcgctcgatttagaactaggtttttctcaatggggcttcaaacagcaacctaatgaatcatatgctgaatatgcaaaacgtatagcgaatagtaaagtttgggagactgaagatcaggctgtaaatgatttaacaactgctggagcagaaaagttaaaccaaatgacgacattgaatcctaatatcgtctatacatcatacacaggtgctgcaacacatactggaccattaggcaatgaagtaccgaatattagacaattcccgctattcgatttaacaagtcgtgtgataggtggagatgacaataaaaatgttagagtaaatgatggcatagtacctgtgtcttcttcactacatccaagtgatgaagcatttaagaaggtaggtatgatgaacctagcaactgacaagggtatttggcaagtgagacccgtacaatatgattgggatcatctagatttagtcggcttagatactactgattataagcgaactggagaagaattaggtcaattctatatgagtatgataaataatatgttgaaagtcgaagagttagatggtatcacacgtaagtagtgattaaaagaacgataacatcctcattaaatatatgattacggtacatttaatgaggttttttgattgtttcgtcgaaaaaaatatataaata

SEQ ID NO: 1570 - protein, 643 aa, Staphylococcus epidermidis
MKNNNETRRFSIRKYTVGVVSIITGITIFVSGQHAQAAEMTQSSSDFNEQSQQTEQVEHKEDTTHLSYELNQEGDTASQSKTNQENQSDGNVQKKSNQIQQDSTQTSPLNDQKQTSMEQQSKDNHVTPNSRQDTYPKGQNQDDKGKQQFKDNQHSQTGHQPNTQNQNNDQDSSDKKQHPSDQTQDSSSKGTQPKQSQSIEDRDKTVKQPSSKVHKIGNTKTDKTVKTNQKKQTSLTSPRVVKSKQTKHINQLTAQAQYKNQYPVVFVHGFVGLVGEDAFSMYPNYWGGIKYNVKKELTKLGYRVHEANVGAFSSNYDRAVELYYYIKGGRVDYGAAHAAKYGHKRYGRTYEGIMPDWEPGKKIHLVGHSMGGQTIRLMEHFLRNGNQEEIDYQRQYGGTVSDLFKGGQDNMVSTITTLGTPHNGTPAADKLGSTKFIKDTINRIGKIGGTKALDLELGFSQWGFKQQPNESYAEYAKRIANSKVWETEDQAVNDLTTAGAEKLNQMTTLNPNIVYTSYTGAATHTGPLGNEVPNIRQFPLFDLTSRVIGGDDNKNVRVNDGIVPVSSSLHPSDEAFKKVGMMNLATDKGIWQVRPVQYDWDHLDLVGLDTTDYKRTGEELGQFYMSMINNMLKVEELDGITRK

SEQ ID NO: 1571 - DNA, 2741 bp, Pseudomonas fluorescens
ctgcagaaaccgttgcagaacttcagttttgccaacgacggtgacggcacgctgtacgtgcgcgacgcctacggcggcatcagcatgacccgcgacatcggcgcactggtgagcaaggagtcggggtcgtggtggggcagcaaggaaatcacctggggcgtcacggccaagggtttgaccaatggcaacgaactgacccagtacaaccattcgctgagcggcgatggctacggcaatgcgttgcacgccagcgccgacggtgactggttgttcggcttgggtggcgacgacaaactgatcagcgacaaaggtcacgtgaccttcgtcggtggcgccggcaacgacgtgatgacggcggtgggtggcaacaacactttcctgttcagcggcgcgttcggtttcgatgccatcaacggttatcagggcagcgacaaactggtgttcatgggcgtcgaaggcgcggggcagggttacgactacaagcaacatgcttcgcagtcgggtggcgataccgtgctgaaggttggcgactttgccgtgacgctgatcggggttggtgtggctaacctgtcggacgcgagtttcgtcttcgcttagatccaatgtgggagcgggcttgctcgcgaagggagcgcgtcagtcaacattgctgtagctgacacaccgctttcgcgagcaagcccgctcccacagggggagatttgcaacaacaagtagtactgaaatgctccggggcgtctcgcgaggggcgctctggctgtgagctatctctgacaattccaacaaaagagaggcaatagcaatgggtgtgtatgactacaaaaacttcggcacggcggattccaaggcgttgttcagcgatgccatggcgatcacgctgtattcctaccacaacctcgataacggttttgccgccggttatcagcacaacggttttggccttggcctgccggcgacgctggtcacggcgttgctcggcggtaccgattcccagggcgtcatccccggcattccgtggaatcccgattcggaaaaactcgccctcgaagccgtgaaaaaggccggctggacgccgatcacggcctcgcaactgggctacgacggcaagaccgacgcacgcggaaccttctttggcgagaaggccggttactcgacagcgcaggtcgagattctcggcaagtacgacgcccagggccatctcacagaaatcggcatcgcctttcgcggcaccagcggcccgcgcgagaacctgatccttgattccatcggcgacgtgatcaacgacttgctcgccgcgttcggccccaaggattacgccaagaactacgtcggcgaagcgttcggcaacctgctcaatgacgtggtcgcctttgccaaggccaatggcctcagcggcaaggacgtgctggtcagcggccacagcctcggcgggctggcggtcaacagcatggcggatttgagcggcggcaagtggggcgggttcttcgccgactccaactacatcgcctatgcctcgccgacccagagcagcaccgacaaagtgctcaacgtcggctacgagaacgacccggtgttccgcgccctcgacggttcgaatttcaccggcgcctcgattggcgtgcacgacgcgccgaaggaatcggccaccgacaacatcgtcagcttcaacgatcactacgcctcgacggcgtggaatctgctgccgttctccatcctcaacatcccgacctggatctcgcacctgccaaccgcttacggcgacggcatgaaccgggtgatcgagtcgaagttctacgacctgaccagcaaggactcgacgatcatcgtcgccaacctgtcggatccggcgcgggccaacacctgggtgcaggatctcaaccgcaacgccgaaacccacaagggcagcaccttcatcatcggcagcgacgccaacgatctgattcagggtggcagcggcaatgactatctggaaggtcgcgccggcaacgacacctttcgcgacagcggcggctacaacatcatcctgggcgggcagggcagcaatacgctggacttgcagaagtcggtgaataccttcgacttcgccaacgacggcgccggcaatctgtacattcgcgatgccaacggcgggatcagcatcacccgcgacatcggcgccatcgtcaccaaagagccgggcttcctctggggtctgttcaaggacgacgtgacccacagcgtcacggccagtggcttgaaggtcggcaacaacctgaccgcctacgagtcgagcgtgaagggcagcaacggcgccgacacgctcaaggcgcatgccggcggcgactggttgttcggcctcgacggcaacgatcatctgatcggcggggcgggcaacgatgtgtttgttggcggcgccggtaacgatctgatggagtccgggggcggggcggatacgttcctgttcaacggcgcgttcggccaggatcgggtggtgggattcacgtccaacgacaaactggtgtttctcggcgtgcagggtgtgttgcctggcgatgacttccgagcgcatgcctcggcagccgggcaggataccgtgctgaagttcggcggcgattcggtgacattggttggcgtttcgctggggagtttgagtggcgatggaattgtgatcgcctgatgttgtggtggtgcctgtaagggcctcttcgggagcaagcccccttccacagtttgatcgcatgccttccggtcaacctgtggga

SEQ ID NO: 1572 - protein, 617 aa, Pseudomonas fluorescens
MGVYDYKNFGTADSKALFSDAMAITLYSYHNLDNGFAAGYQHNGFGLGLPATLVTALLGGTDSQGVIPGIPWNPDSEKLALEAVKKAGWTPITASQLGYDGKTDARGTFFGEKAGYSTAQVEILGKYDAQGHLTEIGIAFRGTSGPRENLILDSIGDVINDLLAAFGPKDYAKNYVGEAFGNLLNDVVAFAKANGLSGKDVLVSGHSLGGLAVNSMADLSGGKWGGFFADSNYIAYASPTQSSTDKVLNVGYENDPVFRALDGSNFTGASIGVHDAPKESATDNIVSFNDHYASTAWNLLPFSILNIPTWISHLPTAYGDGMNRVIESKFYDLTSKDSTIIVANLSDPARANTWVQDLNRNAETHKGSTFIIGSDANDLIQGGSGNDYLEGRAGNDTFRDSGGYNIILGGQGSNTLDLQKSVNTFDFANDGAGNLYIRDANGGISITRDIGAIVTKEPGFLWGLFKDDVTHSVTASGLKVGNNLTAYESSVKGSNGADTLKAHAGGDWLFGLDGNDHLIGGAGNDVFVGGAGNDLMESGGGADTFLFNGAFGQDRVVGFTSNDKLVFLGVQGVLPGDDFRAHASAAGQDTVLKFGGDSVTLVGVSLGSLSGDGIVIA

SEQ ID NO: 1573 - DNA, 1892 bp, Pseudomonas fluorescens
gaattccaacaaaagagaggcaatagcaatgggtgtgtatgactacaaaaacttcggcacggcggattccaaggcgttgttcagcgatgccatggcgatcacgctgtattcctaccacaacctcgataacggttttgccgccggttatcagcacaacggttttggccttggcctgccggcgacgctggtcacggcgttgctcggcggtaccgattcccagggcgtcatccccggcattccgtggaatcccgattcggaaaaactcgccctcgaagccgtgaaaaaggccggctggacgccgatcacggcctcgcaactgggctacgacggcaagaccgacgcacgcggaaccttctttggcgagaaggccggttactcgacagcgcaggtcgagattctcggcaagtacgacgcccagggccatctcacagaaatcggcatcgcctttcgcggcaccagcggcccgcgcgagaacctgatccttgattccatcggcgacgtgatcaacgacttgctcgccgcgttcggccccaaggattacgccaagaactacgtcggcgaagcgttcggcaacctgctcaatgacgtggtcgcctttgccaaggccaatggcctcagcggcaaggacgtgctggtcagcggccacagcctcggcgggctggcggtcaacagcatggcggatttgagcggcggcaagtggggcgggttcttcgccgactccaactacatcgcctatgcctcgccgacccagagcagcaccgacaaagtgctcaacgtcggctacgagaacgacccggtgttccgcgccctcgacggttcgaatttcaccggcgcctcgattggcgtgcacgacgcgccgaaggaatcggccaccgacaacatcgtcagcttcaacgatcactacgcctcgacggcgtggaatctgctgccgttctccatcctcaacatcccgacctggatctcgcacctgccaaccgcttacggcgacggcatgaaccgggtgatcgagtcgaagttctacgacctgaccagcaaggactcgacgatcatcgtcgccaacctgtcggatccggcgcgggccaacacctgggtgcaggatctcaaccgcaacgccgaaacccacaagggcagcaccttcatcatcggcagcgacgccaacgatctgattcagggtggcagcggcaatgactatctggaaggtcgcgccggcaacgacacctttcgcgacagcggcggctacaacatcatcctgggcgggcagggcagcaatacgctggacttgcagaagtcggtgaataccttcgacttcgccaacgacggcgccggcaatctgtacattcgcgatgccaacggcgggatcagcatcacccgcgacatcggcgccatcgtcaccaaagagccgggcttcctctggggtctgttcaaggacgacgtgacccacagcgtcacggccagtggcttgaaggtcggcaacaacctgaccgcctacgagtcgagcgtgaagggcagcaacggcgccgacacgctcaaggcgcatgccggcggcgactggttgttcggcctcgacggcaacgatcatctgatcggcggggcgggcaacgatgtgtttgttggcggcgccggtaacgatctgatggagtccgggggcggggcggatacgttcctgttcaacggcgcgttcggccaggatcgggtggtgggattcacgtccaacgacaaactggtgtttctcggcgtgcagggtgtgttgcctggcgatgacttccgagcgcatgcctcggcagccgggcaggataccgtgctgaagttcggcggcgattcggtgacattggttggcgtttcgctggggagtttgagtggcgatggaattgtgatcgcctgatgtcgacgtg

SEQ ID NO: 1574 - protein, 617 aa, Pseudomonas fluorescens; identical to SEQ ID NO: 1572

SEQ ID NO: 1575 - DNA, 1478 bp, Pseudomonas fluorescens
gaattccaacaaaagagaggcaatagcaatgggtgtgtatgactacaaaaacttcggcacggcggattccaaggcgttgttcagcgatgccatggcgatcacgctgtattcctaccacaacctcgataacggttttgccgccggttatcagcacaacggttttggccttggcctgccggcgacgctggtcacggcgttgctcggcggtaccgattcccagggcgtcatccccggcattccgtggaatcccgattcggaaaaactcgccctcgaagccgtgaaaaaggccggctggacgccgatcacggcctcgcaactgggctacgacggcaagaccgacgcacgcggaaccttctttggcgagaaggccggttactcgacagcgcaggtcgagattctcggcaagtacgacgcccagggccatctcacagaaatcggcatcgcctttcgcggcaccagcggcccgcgcgagaacctgatccttgattccatcggcgacgtgatcaacgacttgctcgccgcgttcggccccaaggattacgccaagaactacgtcggcgaagcgttcggcaacctgctcaatgacgtggtcgcctttgccaaggccaatggcctcagcggcaaggacgtgctggtcagcggccacagcctcggcgggctggcggtcaacagcatggcggatttgagcggcggcaagtggggcgggttcttcgccgactccaactacatcgcctatgcctcgccgacccagagcagcaccgacaaagtgctcaacgtcggctacgagaacgacccggtgttccgcgccctcgacggttcgaatttcaccggcgcctcgattggcgtgcacgacgcgccgaaggaatcggccaccgacaacatcgtcagcttcaacgatcactacgcctcgacggcgtggaatctgctgccgttctccatcctcaacatcccgacctggatctcgcacctgccaaccgcttacggcgacggcatgaaccgggtgatcgagtcgaagttctacgacctgaccagcaaggactcgacgatcatcgtcgccaacctgtcggatccggcgcgggccaacacctgggtgcaggatctcaaccgcaacgccgaaacccacaagggcagcaccttcatcatcggcagcgacgccaacgatctgattcagggtggcagcggcaatgactatctggaaggtcgcgccggcaacgacacctttcgcgacagcggcggctacaatactttcctgttcaacggcgcgttcggccaggatcgggtggtgggattcacgtccaacgacaaactggtgtttctcggcgtgcagggtgtgttgcctggcgatgacttccgagcgcatgcctcggcagccgggcaggataccgtgctgaagttcggcggcgattcggtgacattggttggcgtttcgctggggagtttgagtggcgatggaattgtgatcgcctgatgtcgacgtg

SEQ ID NO: 1576 - protein, 479 aa, Pseudomonas fluorescens
MGVYDYKNFGTADSKALFSDAMAITLYSYHNLDNGFAAGYQHNGFGLGLPATLVTALLGGTDSQGVIPGIPWNPDSEKLALEAVKKAGWTPITASQLGYDGKTDARGTFFGEKAGYSTAQVEILGKYDAQGHLTEIGIAFRGTSGPRENLILDSIGDVINDLLAAFGPKDYAKNYVGEAFGNLLNDVVAFAKANGLSGKDVLVSGHSLGGLAVNSMADLSGGKWGGFFADSNYIAYASPTQSSTDKVLNVGYENDPVFRALDGSNFTGASIGVHDAPKESATDNIVSFNDHYASTAWNLLPFSILNIPTWISHLPTAYGDGMNRVIESKFYDLTSKDSTIIVANLSDPARANTWVQDLNRNAETHKGSTFIIGSDANDLIQGGSGNDYLEGRAGNDTFRDSGGYNTFLFNGAFGQDRVVGFTSNDKLVFLGVQGVLPGDDFRAHASAAGQDTVLKFGGDSVTLVGVSLGSLSGDGIVIA

SEQ ID NO: 1577 - DNA, 3456 bp, Pseudomonas fluorescens
ctgcagaaaccgttgcagaacttcagttttgccaacgacggtgacggcacgctgtacgtgcgcgacgcctacggcggcatcagcatgacccgcgacatcggcgcactggtgagcaaggagtcggggtcgtggtggggcagcaaggaaatcacctggggcgtcacggccaagggtttgaccaatggcaacgaactgacccagtacaaccattcgctgagcggcgatggctacggcaatgcgttgcacgccagcgccgacggtgactggttgttcggcttgggtggcgacgacaaactgatcagcgacaaaggtcacgtgaccttcgtcggtggcgccggcaacgacgtgatgacggcggtgggtggcaacaacactttcctgttcagcggcgcgttcggtttcgatgccatcaacggttatcagggcagcgacaaactggtgttcatgggcgtcgaaggcgcggggcagggttacgactacaagcaacatgcttcgcagtcgggtggcgataccgtgctgaaggttggcgactttgccgtgacgctgatcggggttggtgtggctaacctgtcggacgcgagtttcgtcttcgcttagatccaatgtgggagcgggcttgctcgcgaagggagcgcgtcagtcaacattgctgtagctgacacaccgctttcgcgagcaagcccgctcccacagggggagatttgcaacaacaagtagtactgaaatgctccggggcgtctcgcgaggggcgctctggctgtgagctatctctgacaattccaacaaaagagaggcaatagcaatgggtgtgtatgactacaaaaacttcggcacggcggattccaaggcgttgttcagcgatgccatggcgatcacgctgtattcctaccacaacctcgataacggttttgccgccggttatcagcacaacggttttggccttggcctgccggcgacgctggtcacggcgttgctcggcggtaccgattcccagggcgtcatccccggcattccgtggaatcccgattcggaaaaactcgccctcgaagccgtgaaaaaggccggctggacgccgatcacggcctcgcaactgggctacgacggcaagaccgacgcacgcggaaccttctttggcgagaaggccggttactcgacagcgcaggtcgagattctcggcaagtacgacgcccagggccatctcacagaaatcggcatcgcctttcgcggcaccagcggcccgcgcgagaacctgatccttgattccatcggcgacgtgatcaacgacttgctcgccgcgttcggccccaaggattacgccaagaactacgtcggcgaagcgttcggcaacctgctcaatgacgtggtcgcctttgccaaggccaatggcctcagcggcaaggacgtgctggtcagcggccacagcctcggcgggctggcggtcaacagcatggcggatttgagcggcggcaagtggggcgggttcttcgccgactccaactacatcgcctatgcctcgccgacccagagcagcaccgacaaagtgctcaacgtcggctacgagaacgacccggtgttccgcgccctcgacggttcgaatttcaccggcgcctcgattggcgtgcacgacgcgccgaaggaatcggccaccgacaacatcgtcagcttcaacgatcactacgcctcgacggcgtggaatctgctgccgttctccatcctcaacatcccgacctggatctcgcacctgccaaccgcttacggcgacggcatgaaccgggtgatcgagtcgaagttctacgacctgaccagcaaggactcgacgatcatcgtcgccaacctgtcggatccggcgcgggccaacacctgggtgcaggatctcaaccgcaacgccgaaacccacaagggcagcaccttcatcatcggcagcgacgccaacgatctgattcagggtggcagcggcaatgactatctggaaggtcgcgccggcaacgacacctttcgcgacagcggcggctacaacatcatcctgggcgggcagggcagcaatacgctggacttgcagaagtcggtgaataccttcgacttcgccaacgacggcgccggcaatctgtacattcgcgatgccaacggcgggatcagcatcacccgcgacatcggcgccatcgtcaccaaagagccgggcttcctctggggtctgttcaaggacgacgtgacccacagcgtcacggccagtggcttgaaggtcggcaacaacctgaccgcctacgagtcgagcgtgaagggcagcaacggcgccgacacgctcaaggcgcatgccggcggcgactggttgttcggcctcgacggcaacgatcatctgatcggcggggcgggcaacgatgtgtttgttggcggcgccggtaacgatctgatggagtccgggggcggggcggatacgttcctgttcaacggcgcgttcggccaggatcgggtggtgggattcacgtccaacgacaaactggtgtttctcggcgtgcagggtgtgttgcctggcgatgacttccgagcgcatgcctcggcagccgggcaggataccgtgctgaagttcggcggcgattcggtgacattggttggcgtttcgctggggagtttgagtggcgatggaattgtgatcgcctgatgttgtggtggtgcctgtaagggcctcttcgggagcaagcccccttccacagtttgatcgcatgccttccggtcaacctgtgggagggggcttgctcccgaagaacgataacgcggtattaaaagtgactcacaagccactctccgactccaaccctgtgcaaacaggaaaagcggcctaaagccagcacgtgggcacacgttctatagctagccgccatcgagtacaggagatccaaacgtgaaaggtttcaaggggtatgtcgccatcgtaggtttggcgctgtgtgcggccaatgcctgtgccgatctgcctcaaagttcgattctgagccgatacggcatcaccaccgatcaattgccaggcccggtcaagaccgagacgcagagccggtcgaagagaaaagccgttttcagatccagcctgaacagccgttcgtgacgattcgcctgggcgacggtaaacaaccgcaaaccaccggcaacctgagcattgaaccgcatggcgcagcaggatctggagcgttgccagcgtctgcaaggtgaagtggccagacgtggcgggcaatacatgagttgcgacaacagcattccgggcattacgctgccggaataaccctctcgggagtgccgcgccggcagctccgttccagcgatcagtcttcctcgcgcacggttgccacttcatcggcgcgcactttcactttggcgccggaaatatcctcgaactcatagaaaccgtccttggttttggttttcggcatatctttggtcaggtattgcgtaccgttcgggctgcag

SEQ ID NO: 1578 - protein, 617 aa, Pseudomonas fluorescens; identical to SEQ ID NO: 1572

SEQ ID NO: 1579 - DNA, 1215 bp, MICROCOCCUS SP. HL-2003
atggtgtttatcgtcaatcttttctcctgcaccttatctgaaaccacggttagctcaataaaatctgaagctacggttagctcaacatttactgccgtcacggccctgcaattggtggctgagggtaagttgcagtcggcgaagggtttcggtggtggtacgattcactacccaaccctcgcggccgaagcaccctggtggacgccgggccaaggccatggttacgaggcgatcacctacggctggctggtcggcgaactgctgcgccgcgccgatgggcgtgggcctggtctgttaggcgctattgccgtggttcctggttacgtttcttacgagaactctatcaagtggtggggaccgcgtctggcttcttggggctttgtcgttgcacggccgttgggcctggactttcatgtgggcctggcggatgaagagttttatcgtgttgcccatatagcgcgcagcaaagccaatgcagcactagataacattgctgatgacaccgtcggcagtatagatcctaagcggttgggcgctattggctggtcaggtggcggcggcgcgcttaaactggcaacggagcgcagcacagtacgagccattttgaccagtactaataaacctgaatggcgacgcttcgataaattcttatgtgcctgcgaggatgaccggattgctgagactaagaaatatgccaacgcgttttataaaaatgccgacatgctcgaagagttgacccgtgaacacagtatcgggccggataaaacattattgacacaaactcggtttggcttggggtgcttggatcaaccgcaagcaggggttaaaattcattttgaagagtaccttgatcaaacccatggatttatcaatttgacgccagtttcacataaggcgagagcaaatctgattcagatgcctaatgccacattcggccttggcccgcgtgcttttgggcatcctggtgcaggtggatcggtaggttttgccgaccccgaacacgatgtagcgtttggtttcgtgactaatacattggggccttatgtagttgagtttaaaagccgtcatccctcattttatgcatataaagatggattggtgctgactggaaatgacgtcgactatgtgactgattactatgcaacaaagcatgctgtacatttagatgatccacgtgcacagaagttggtcggaatattggccggttgtctgtaa

SEQ ID NO: 1580 - protein, 404 aa, MICROCOCCUS SP. HL-2003
MVFIVNLFSCTLSETTVSSIKSEATVSSTFTAVTALQLVAEGKLQSAKGFGGGTIHYPTLAAEAPWWTPGQGHGYEAITYGWLVGELLRRADGRGPGLLGAIAVVPGYVSYENSIKWWGPRLASWGFVVARPLGLDFHVGLADEEFYRVAHIARSKANAALDNIADDTVGSIDPKRLGAIGWSGGGGALKLATERSTVRAILTSTNKPEWRRFDKFLCACEDDRIAETKKYANAFYKNADMLEELTREHSIGPDKTLLTQTRFGLGCLDQPQAGVKIHFEEYLDQTHGFINLTPVSHKARANLIQMPNATFGLGPRAFGHPGAGGSVGFADPEHDVAFGFVTNTLGPYVVEFKSRHPSFYAYKDGLVLTGNDVDYVTDYYATKHAVHLDDPRAQKLVGILAGCL

SEQ ID NO: 1581 - DNA, 1854 bp, PSEUDOMONAS SP. JZ-2003
atgggtgtctttgactacaagaacttcaccgcagccgattccaaggcgctgttttccgatgcgctggcgatcacgctgtactcctatcacaacctcgacaacggcttcgccgtgggttaccagcaccatggcttcggcctgggcctgccggcgaccctgatcaccgcgctgatcggcagcagcgattcccagggcgtcatccccggtattccctggaacccggactcggagcaggccgccaaggacgcgttgcaccaggccgggtggtccaccctcagtgcccagcaactgggctacagcggcaaggtggatgcccggggcacattcttcggcgagaaggacggctacggcacggcccaggtggagatcctcggcaagtacgatgcccagggccacctgagttccatcggcatcgcctttcgcggcaccagcggccctcgggaatcggtgatcggcgacaccatcggtgacgtcatcagtgacctgctggccgccctgggacccaaggactatgcgaagaactacgccggtgaggccttcggcaaactgttcgccgatgtggcggcttttgcccaggccaatggcctgtcgggcaaggacattctggtcagtggccacagcctgggcgggctgggggtcaacagcctggcggacctgagtgccgatcgctggtccgggttctacaaggatgccaactacatcgcctatgcctcaccgacccagagcagcagcgacaaggtgttgaacatcggttatgaaaacgacccggtgttccgcgccctggacggttacaacttcaacctgtcgtccctgggggtgcacgatgcccagcaggactcggccaccaacaacatcgtcaacttcaacgaccattacgcctcgaccctgtggaacgtgctgccgttctcgatcctcaacatccccacctggatttctcacttgcccaccggctacggcgatggcctgacccgggtgctgcagtcgcagttctatgacttcaccagcaaggactccaccattgtcgtcgccaacctgtcggacccggcccggggtagcacctgggtccaggatctgaaccgcaacgccgatacccacaagggcagcaccttcatcatcggcagcgacggtaacgacctgatccagggtgggggcggcaacgactacctggaaggccgcgacggcaacgacaccttccgtgatgacggcggctacaacatcatcctcggcggcaagggcagcaacaccctggacctgcagcactcggtgaaggactacagcttcgccagcgacggcgccgggaccctgtacgtgcgcgacgccagcggcgggatcagcatgacccgcgacatcggcgccattcagagcaaggagccggggtttctctggggcctgttcaaggatgatgtggtccaccaggtcaccgaccaggggttgaaggtgggcagccaactgacccagtacgcgtcttcggtgaagggggacggcggcgacaacctgctcaaggcccatgccggcggcgattggctgttcggcctggatggcaacgatcacctgatcggcggcaagggcaacgatgtcttcgtcggtggcgccggcaatgacctgatggagtcgggtgggggcaacaacaccttcctgttcaccggtcatttcggccaggaccgcatcctcggctaccagagtggcgacaagctggtgttcatgggggtgagcggcgtgctgccggaccaggactatcgggcccacgccagtagcagcggcaatgacaccgtgctgaccttcggccatgactcggtgaccctggtgggtgtcagcctcgcgcacctcaacggctcgggcatcaccctcgcctga

SEQ ID NO: 1582 - protein, 617 aa, PSEUDOMONAS SP. JZ-2003
MGVFDYKNFTAADSKALFSDALAITLYSYHNLDNGFAVGYQHHGFGLGLPATLITALIGSSDSQGVIPGIPWNPDSEQAAKDALHQAGWSTLSAQQLGYSGKVDARGTFFGEKDGYGTAQVEILGKYDAQGHLSSIGIAFRGTSGPRESVIGDTIGDVISDLLAALGPKDYAKNYAGEAFGKLFADVAAFAQANGLSGKDILVSGHSLGGLGVNSLADLSADRWSGFYKDANYIAYASPTQSSSDKVLNIGYENDPVFRALDGYNFNLSSLGVHDAQQDSATNNIVNFNDHYASTLWNVLPFSILNIPTWISHLPTGYGDGLTRVLQSQFYDFTSKDSTIVVANLSDPARGSTWVQDLNRNADTHKGSTFIIGSDGNDLIQGGGGNDYLEGRDGNDTFRDDGGYNIILGGKGSNTLDLQHSVKDYSFASDGAGTLYVRDASGGISMTRDIGAIQSKEPGFLWGLFKDDVVHQVTDQGLKVGSQLTQYASSVKGDGGDNLLKAHAGGDWLFGLDGNDHLIGGKGNDVFVGGAGNDLMESGGGNNTFLFTGHFGQDRILGYQSGDKLVFMGVSGVLPDQDYRAHASSSGNDTVLTFGHDSVTLVGVSLAHLNGSGITLA

SEQ ID NO: 1583 - DNA, 1650 bp, Vibrio harveyi
atgaaaaatacactttatatctcgattaccagctcgcttttggctcttagttcttcagcaattgcttccccaacggcggaaattgaaggcgccacacttcaaggcctcatcaattcaccggctgattattctgcacaagttgatgcatttcttggcgtaaaatacgcatctgctgagcgatttagtgcaccacagcgtcatcactttattactggcgagcagtatgacgcgacggttgcgggagatatttgtccacaagtgccgcatacaatggaagctaatggtgttgtacaagaagcacaaagcgaagattgtttgaatgcaaacatctggcgtccatctgacattgctaacgatgaaaaactgcctgtttatgtgtttattcacggtggcgcatttgagctaggttctagcaccgttaagcagtttgatggcgctaaactggttgcaaaaaacgctgatgaaggaaatccatttattctcgtcagcattaactatcgtcttggcattcttggtagtttctacagcagcgagcactcgggtaactatggcatccaagaccaaaaatcagcgttaagttggattcatgacaacattggtaactttggtggtgatgctgagaatattactttgtttggcgaaagcgccggtgcgatgtcaatcggcatccagttaatggatgagaaacaaaatgcgcacctatatcaacgcgctatcatggaaagcaacccatatggtgtgaaatacaaagatgccaaatcggcgcaatggctagctgagcaggtaaaagacaaactcagtaatgatcaagatattcaaacggtaccttttgaagagatcatcaatatacagtctcaaatgaaggcggcgacaacgcaaatgaataacttgatgacaattacgccaagtacatctggcctgttggcttgggcgccgtatgtcgatggagagaccatcccatatcagccgattgacctacaaaaagtagatggggtagatgtgactctaggctttaacaaagatgaatccaacatctttgtcgctcctttcgatgtgatactcaacgcgcctggtagctataatcttttggttgatgcattctttggttcagacaaaggagagcagttgcgcaatttgcctgcattccacttaaactggtggaacagcacgcctgaaaagcgaaaaaacaacgcccgaaaattgatgaatcaagttttatttatgtgttcatcccaacatgttgcgcaaaacttgtcgtcaaaccaaacaacaacctcgctgtaccaatttaactatcaaccagactttgccttatggccggattactacgtggagagctttacaaaaacatgctcaccgtcagaaacatcttgtcatggtgctggacaatctttcatcttyggaaatgaggtgaacgcagtatctggccctaccgttttttctgaaaaggatctccaagcgaaagacgttcttatgtccaactggctgaagtcgaagacattcgaaccatattcgcaagagacagacaatattacggtatttaacgaagaagcttactttaatgtaagtggtgattgggataatacgaaaaatggtaatgtgtgttctcaagttaatgaaataatgaacagtaatactaagctttactaa

SEQ ID NO: 1584 - protein, 549 aa, Vibrio harveyi
MKNTLYISITSSLLALSSSAIASPTAEIEGATLQGLINSPADYSAQVDAFLGVKYASAERFSAPQRHHFITGEQYDATVAGDICPQVPHTMEANGVVQEAQSEDCLNANIWRPSDIANDEKLPVYVFIHGGAFELGSSTVKQFDGAKLVAKNADEGNPFILVSINYRLGILGSFYSSEHSGNYGIQDQKSALSWIHDNIGNFGGDAENITLFGESAGAMSIGIQLMDEKQNAHLYQRAIMESNPYGVKYKDAKSAQWLAEQVKDKLSNDQDIQTVPFEEIINIQSQMKAATTQMNNLMTITPSTSGLLAWAPYVDGETIPYQPIDLQKVDGVDVTLGFNKDESNIFVAPFDVILNAPGSYNLLVDAFFGSDKGEQLRNLPAFHLNWWNSTPEKRKNNARKLMNQVLFMCSSQHVAQNLSSNQTTTSLYQFNYQPDFALWPDYYVESFTKTCSPSETSCHGAGQSFIFGNEVNAVSGPTVFSEKDLQAKDVLMSNWLKSKTFEPYSQETDNITVFNEEAYFNVSGDWDNTKNGNVCSQVNEIMNSNTKLY

SEQ ID NO: 1585 - DNA, 1425 bp, Pseudomonas fluorescens
atgggtgtattcgactataaaaacctgggcgccgaaggctccaaagcgttgttcgccgatgccatggcgatcacgctgtacacctaccacaacctggataacggctttgccgtgggttatcagcacaacggtctgggctttggcttgccggctaccctggtcggcgcgctgttgggcagcagtgattcccagggcgtgatccccggcattccctggaaccccgactcggaaaaagccgccctggaggccgtgcaacaagccggctggacacctatcagcgccagcgccctgggctataccggcaaggtcgacgccaggggcaccttctttggcgaaaaaccgggctacaccacggcccaggtcgaagtgctcggcaagtacgatgacgccggcaaactgctggaaatcggcatcggttttcgtggtacttcaggcccacgggaaagcctgatcagcgactccatcggcgatctggtcagcgatctgctcgcggccctggggcccaaggattacgcgaaaaactacgccggcgaagccttcggcggtttgctcaagaacatcgccgactacgccagtgcccacggcctcagcggccacgacgtggtagtcagcggccacagcctgggcggcctggcggtgaacagcatggctgacttgagcaacggcaaatgggcgggcttcttcaaggacgccaactatgtggcctacgcctcgccgacccagagcagcggcgacaaggtgctcaatgtcggctatgaaaacgatccggttttccgtgcgctggacggctcatccgtcaactggtcgtcgttgggcgtgcatgacaagccccatgaatcgaccaccgacaatatcgtcagcttcaacgaccattacgcctcgacgctgtggaatgtgctgccgttttccatcaccaacctgccgacctggatctcccatttgcccaccggatatggcgacggcatgacgcgtgttctggcgtccgggttctatgaggtgatgactcgcgactcgacgattattgtcgccaacctgtcggaccctgcgcgggccaacacgtgggtgcaggacctcaaccgcaacgccgagccccacaaaggcgacaccttcatcattggcagcgctggcaatgacttgatccagggcggcaagggcgcggactttatagaggccggcaagggtaacgacacgatccgcgacagcagcgggcacaacacgtttttattcagcgggcagtttggccaggaccggattattggctatcagccgacggacaaattggtgtttacggacgtgcagagcagtggcgattatcgtgatcacgccaaggtggtgggcggggataccgtgatcagttttggcggggattcagtgacgctggtgggagtggttgggttgtcgggggaggggattgtcatcagttaa

SEQ ID NO: 1586 - protein, 474 aa, Pseudomonas fluorescens
MGVFDYKNLGAEGSKALFADAMAITLYTYHNLDNGFAVGYQHNGLGFGLPATLVGALLGSSDSQGVIPGIPWNPDSEKAALEAVQQAGWTPISASALGYTGKVDARGTFFGEKPGYTTAQVEVLGKYDDAGKLLEIGIGFRGTSGPRESLISDSIGDLVSDLLAALGPKDYAKNYAGEAFGGLLKNIADYASAHGLSGHDVVVSGHSLGGLAVNSMADLSNGKWAGFFKDANYVAYASPTQSSGDKVLNVGYENDPVFRALDGSSVNWSSLGVHDKPHESTTDNIVSFNDHYASTLWNVLPFSITNLPTWISHLPTGYGDGMTRVLASGFYEVMTRDSTIIVANLSDPARANTWVQDLNRNAEPHKGDTFIIGSAGNDLIQGGKGADFIEAGKGNDTIRDSSGHNTFLFSGQFGQDRIIGYQPTDKLVFTDVQSSGDYRDHAKVVGGDTVISFGGDSVTLVGVVGLSGEGIVIS

SEQ ID NO: 1587 - DNA, 1560 bp, Bacillus sphaericus
gtgaccaccccgtagctatgattaatggttgcgggtattttttgtaatattaagtgtgatttgtgcgagtagaagtaacatatggtgacaaaattgaaactactagatgaactttgggctgcatttttaaatgggaatgataataacatatcgtatgtgttaaaccgtcgaacgggtgaagttttttgaaataaaggaggtattaaaaagatgaatcagataacaaattggcgacctagaggttttcttcagtggctactcacaatcctctctgtgatcgtatgttttataatcattatagtggcatactatatttttaatccaagtaatatggataaaataatgagtctccttgcatgggggacttctatatttccgattatgctagtagttacagcattcataataatcgttttactagctctttctttttggaagaaaacattcattgctcttacagtgttatttcctattttgttgttattaatgtttttaactgtgcagccaattagtactatgaaaagctatgctaaaagcgagaatgtatcggttgctcttagctcacattttttctataaccaaaatatctcaacaaaacctagtgtagatgtggtgtatgggaaaactacggacggcattgaactaaagcttgatgtgtggccagcaaagaaaaaatcagaggatgttttaacacctgtcattgttcaagtgcatgggggtggttgggtaagtggagataaaggccaagtgcaagactggaatcagtggatgaatgatcaagggtacactgtttttgatgtccaataccgtatgcctcctgtagcaggctggaaagatgaagtgggggatgttaaatcagcgattggttggattgtgcaacatgcagatacgtataagattgatccgaacagaatcattttaatgggagagtctgctgggggaaatctagctatgcttgctgcctatagtttgggagataagcatttaccgccatcaacggatgttccggatgtaccgatcaaggcagtgattaacatgtatgggccgtcagatatgactgcgttttacaagaacaatccaagtaagcgttatgtccaagatgttctggatcagtacattggaggttcaccatccgattaccctgcgcgttataagaagctttcccctataagctatatccaggaacatacgccaccaactattatgtttttagggacgggtgatcgtattgttcctgtagagcaggcaaacgtattggatgacaaactgacgacaagcggtgtagcgcatgaactttatcttcttccaaaggtcgatcatggctttgatgcaaatccaggtagtttgagcacgcaatttgccaaggagaaagtaaaagcatttcttcaaaaatataataaataatcattatgcaatagaaaaacctttgaagacattaaccttcaaaggctttttttagcaagtacatgtagaatttattatccgtcccaaagtatatatgaaaatgcttactgcaatttggattggaaagagtatgacaatgcttacagtttttactat

SEQ ID NO: 1588 - protein, 397 aa, Bacillus sphaericus
MNQITNWRPRGFLQWLLTILSVIVCFIIIIVAYYIFNPSNMDKIMSLLAWGTSIFPIMLVVTAFIIIVLLALSFWKKTFIALTVLFPILLLLMFLTVQPISTMKSYAKSENVSVALSSHFFYNQNISTKPSVDVVYGKTTDGIELKLDVWPAKKKSEDVLTPVIVQVHGGGWVSGDKGQVQDWNQWMNDQGYTVFDVQYRMPPVAGWKDEVGDVKSAIGWIVQHADTYKIDPNRIILMGESAGGNLAMLAAYSLGDKHLPPSTDVPDVPIKAVINMYGPSDMTAFYKNNPSKRYVQDVLDQYIGGSPSDYPARYKKLSPISYIQEHTPPTIMFLGTGDRIVPVEQANVLDDKLTTSGVAHELYLLPKVDHGFDANPGSLSTQFAKEKVKAFLQKYNK

SEQ ID NO: 1589 - DNA, 636 bp, Bacillus subtilis
atgaaatttataaaaagacggatcgttgcacttgtaacaattttgatgctgtctgttacatcgctgtttgcgttgcagccgtcagcaaaagccgctgaacacaatccagtcgttatggttcacggttttggaggagcaatattcaattctgcgggaattaagagctatctactcagagagggctggtcgcgggacaagccgtatgcagttgatttttgggccaagacaggcacaaattataacaatggcccggtgatatcacgatatgagcaaaaggttttagatgaaacgggtgcgaaaaaagtggatattgtcgctcacagcatgggaggcgcgaacacacttacgcacatactcaatctggacggcggaactaaagttgcatatgtcgtgacgagcggcggcgcgaactgtttgacgacaggcaaggcgctgcagggaacagatccaaatcaaaagattttatacacatccatttacagcagctgcgatatgattgtcatgaattatttatcaagattagacggtgcgaggcccgttcaaatccatggcccagcacacatcggccttctacgcagcagccaagtcaacagccatcttaaagaagggctgaataccgggggccagaatacgaat

SEQ ID NO: 1590 - protein, 212 aa, Bacillus subtilis
MKFIKRRIVALVTILMLSVTSLFALQPSAKAAEHNPVVMVHGFGGAIFNSAGIKSYLLREGWSRDKPYAVDFWAKTGTNYNNGPVISRYEQKVLDETGAKKVDIVAHSMGGANTLTHILNLDGGTKVAYVVTSGGANCLTTGKALQGTDPNQKILYTSIYSSCDMIVMNYLSRLDGARPVQIHGPAHIGLLRSSQVNSHLKEGLNTGGQNTN

SEQ ID NO: 1591 - DNA, 1058 bp, SYNTHETIC CONSTRUCT
gcggattcaagcttgccgccgccatgaagatcaacgcacgattcgccgtcatggccgcgagtgtggccgtcctgatggctgccgcgccgattgcgcaggctgctacttcgccgggggatatccatcccttggtccaggcagcccacagccccgacggtattcccggtaacggcgtcgggccggaattccatacgtcgtcgatggcgcgttcctacagcgagaagcacctgggcgtggcgccgcggggtgtgaacgacttctcctgcaaggtcaagcccggcgaccgaccggtcatcctgattcccggtactggcggcaatgcgttcgccacatggtccttctacggaccccatctggcccatgaggggtactgtgtctacaccttcaccaccaatgtccccgtggggatcctcgacgagggctggggcttcaccggtgacgtgcgcgcctccgcgcaggcgctgggtgcctttgtggatcgggtccggaaagcgacgggctctgagaaggtcgacttcgtcggacattcgcagggtggcggcatcctgccgaacgcctacatcaagatgtatggcggagcgtccaaggtcgacaagctgatcggactggtggccgccaaccacggcaccaccgccgtcggtctctacaagcttgtcgacggcctgcccgaggctgtgaaggatttccttagcacgtggagctacgaccacaacatggaggcctacggccagcagctcaagggatcagcgttgatgcaacaggtttaccgtgacggcgacaccgtcccgggtatcgcctacaccgtcatctccacccggctcgacatgacggtcacgccctacacgcaagccttcctcaagggcgccaagaacatgaccgtgcaggacgcctgccctctggatgcctatggccacggccgcctaccctatgatcccgtcgcctaccagatggtgctcaacgccctcgatccgaaccacccacgagagatctcctgcacgtggcggccccgggttctgcccgtatccaccacggatgctgcatgatagctcgagcgggcg

SEQ ID NO: 1592 - protein, 339 aa, SYNTHETIC CONSTRUCT
MKINARFAVMAASVAVLMAAAPIAQAATSPGDIHPLVQAAHSPDGIPGNGVGPEFHTSSMARSYSEKHLGVAPRGVNDFSCKVKPGDRPVILIPGTGGNAFATWSFYGPHLAHEGYCVYTFTTNVPVGILDEGWGFTGDVRASAQALGAFVDRVRKATGSEKVDFVGHSQGGGILPNAYIKMYGGASKVDKLIGLVAANHGTTAVGLYKLVDGLPEAVKDFLSTWSYDHNMEAYGQQLKGSALMQQVYRDGDTVPGIAYTVISTRLDMTVTPYTQAFLKGAKNMTVQDACPLDAYGHGRLPYDPVAYQMVLNALDPNHPREISCTWRPRVLPVSTTDAA

SEQ ID NO: 1593 - DNA, 2582 bp, Serratia marcescens
gtcgaccgtcgccgcctgagcggccccgcaggccatcaggccaagcgccgcataccaataacgtttcatcaatcagtctccttaatgactctatcgagttatcagtataggagagtcagcgccaacactgttaaccaacgcacaatctcgccaatttgattcgcgggcctaatatttagcaccaataataattctaccgatgttggtcctctgaccagctgtcgttcggctaacgttgtttccctgtttccaccgccgacgcgcgagagttcacttcccggccaggcggcatacttcataaggaactgatatgggcatctttagctataaggatctggacgaaaacgcgtcaaaggcgctgttttccgacgccttggccatctctacctacgcttaccacaatatcgataacggcttcgatgaaggctatcaccagaccggtttcggcctcggtctgccgctgacgctgatcacggcgctcatcggcagcacccagtcgcagggcggcctgcccggtcttccctggaaccccgactccgaacaggccgcgcaggacgcggtgaacaatgccggctggtcagtgatcgacgccgcgcaattgggatacgccggcaaaaccgatgcgcgcggcacctactacggcgaaaccgccggttacaccaccgctcaggccgaggtgctgggcaaatatgacagcgaaggcaatctcaccgccattggcatctcatttcgcggtaccagcggcccgcgcgagtcgctgatcggcgataccatcggcgatgtgattaacgatctgttggccgggttcgggccgaaagctatgcgacgctatacgctgaaggccttcggcaatttgctgggggacgtggcgaaattcgcgcaggcccacgggctgagcggcgaagacgtggtgatcagcggccacagcctcggcgggctggcggtcaacagcatggcggcgcagagcgacgcaacctggggcggcttctacgcgcagtccaactatgtcgccttcgcctcgccgacccagtacgaagccggcggcaaggtgatcaacatcggctatgagaacgatccggtgtttcgcgcgctcgacggcacctcgctgaccctgccgtcattgggcgttcacgatgcgccgcatacctccgccaccaacaatatcgtcaacttcaacgaccactacgcgtcggacgcctggaatctgttgccgttctccattctcaacattccgacctggctatcccacctgccgttcttctatcaggatggtctgatgcgggtgctgaactccgagttttattcgctgaccgacaaagactcgaccatcatcgtctccaacctgtcgaacgtcacgcgcggcagtacctgggtggaagatctgaaccgcaacgcggaaacgcacagcgggccgacgtttatcatcggcagcgacggcaatgatttgatcaagggcggcaaaggcaacgactatctcgagggccgcgacggtgacgatatcttccgcgacgccggcggctataacctgatcgccggcggcaaaggccacaatatcttcgatacccagcaggcgttgaaaaacaccgaggtcgcctacgacggcaatacgctttacctgcgcgacgccaaaggcggcattacgctggcggacgacatcagcaccctgcgcagcaaagaaacctcctggctgattttcagcaaagaggtggatcatcaggtgaccgccgccggattgaaatcggattcgggcctcaaagcctatgcggccgccaccaccggcggcgacggcgatgacgtcctgcaggctcgcagccacgacgcctggctgttcggcaacgccggcaacgacacgcttatcggccatgccggcggcaacctgaccttcgtcggcggcagcggcgatgacatcctgaagggggtcggcaacggcaataccttcctgttcagcggcgatttcggccgcgaccagctgtatggcttcaacgccaccgacaaactggtatttatcggcaccgagggcgccagcgggaatatccgcgactatgccacgcagcaaaacgacgatctggtgctggccttcggccacagccaggtcacgctgatcggcgtctcgctcgatcatttcaaccccgatcaggtggtgttggcctaaagaccaacgtaaaaaaagccgggcgctttcgccgcccggctttcctctttctaccccgtctcagggcacgtcataccccaacgccgccttgcgaaggcggaaccactgctggcggttcagcgccagtttctgcgccttcaacgccgaacgcacccgctcgatcttgccggagccgataatcggcagcggcgaagacggcaggcgcatcacccaggcgtaaaccacctgttcaatggtctcggcgccgatctcttgcgccacccgctgcagctcgtcgcgcagcggctggaactcggcgtcgttgaacaagcggccgccgcccaggcaggaccaggccatcggtttgatgcgcagctgctggcactggtcgagcgtgccgtccaggatcgccggttggtgaatcggcgaaatttccacctgattggtgacc

SEQ ID NO: 1594 - protein, 613 aa, Serratia marcescens
MGIFSYKDLDENASKALFSDALAISTYAYHNIDNGFDEGYHQTGFGLGLPLTLITALIGSTQSQGGLPGLPWNPDSEQAAQDAVNNAGWSVIDAAQLGYAGKTDARGTYYGETAGYTTAQAEVLGKYDSEGNLTAIGISFRGTSGPRESLIGDTIGDVINDLLAGFGPKAMRRYTLKAFGNLLGDVAKFAQAHGLSGEDVVISGHSLGGLAVNSMAAQSDATWGGFYAQSNYVAFASPTQYEAGGKVINIGYENDPVFRALDGTSLTLPSLGVHDAPHTSATNNIVNFNDHYASDAWNLLPFSILNIPTWLSHLPFFYQDGLMRVLNSEFYSLTDKDSTIIVSNLSNVTRGSTWVEDLNRNAETHSGPTFIIGSDGNDLIKGGKGNDYLEGRDGDDIFRDAGGYNLIAGGKGHNIFDTQQALKNTEVAYDGNTLYLRDAKGGITLADDISTLRSKETSWLIFSKEVDHQVTAAGLKSDSGLKAYAAATTGGDGDDVLQARSHDAWLFGNAGNDTLIGHAGGNLTFVGGSGDDILKGVGNGNTFLFSGDFGRDQLYGFNATDKLVFIGTEGASGNIRDYATQQNDDLVLAFGHSQVTLIGVSLDHFNPDQVVLA

SEQ ID NO: 1595 - DNA, 1251 bp, GEOBACILLUS THERMOLEOVORANS
atgaaatgctgtcgggttatgtttgtgttgctcggattatggcttgtgttcggcctatcggtctcgggaggacgggctgaagcggcagcttcacgcgccaacgatgcgccgattgtacttctccatggctttactggctggggaagagaagaaatgtttgggttcaagtactggggcggcgtgcgcggcgatatcgaacaatggctgaacgacaacggttatcgaacttatacgctggcggtcggaccgctctcgagcaactgggaccgggcgtgtgaagcgtatgctcaacttgtcggcgggacggtcgattatggggcagcccatgcggcaaagcacggccatgcgcggtttggccgcacttatcccggcctgttgccggaattgaaaaggggtggccgcatccatatcatcgcccacagccaaggggggcagacggcccgcatgcttgtctcgctcctagagaacggaagccaagaagagcgggagtacgccaaggcgcacaacgtgtcgttgtcaccgttgtttgaaggtggacatcattttgtgttgagtgtgacgaccatcgccactcctcatgacgggacgacgcttgtcaacatggttgatttcaccgatcgcttttttgacttgcaaaaagcggtgttggaagcggcggctgtcgccagcaacgtgccgtacacgagtcaagtatacgattttaagcttgaccaatggggactgcgccgccagccgggtgaatcgttcgaccattattttgaacggctcaagcgctcccctgtttggacgtccacagataccgcccgctacgatttatccgtttccggagctgagaagttgaatcaatgggtgcaagcaagcccgaatacgtattatttgagctttgccacagaacggacgtatcgcggagcgctcacaggcaactattatcccgaactcggaatgaatgcattcagcgcggtcgtatgcgctccgtttctcggttcgtaccgcaatccgacgctcggcattgacgaccgctggcttgaaaacgatggcattgtcaatacggtttccatgaacggtccaaagcgtggatcaagcgatcggatcgtaccgtatgacggggcgttgaaaaaaggggtttggaatgacatgggaacgtacaatgtcgaccatttggaaatcatcggcgttgacccgaatccgtcatttgatattcgcgccttttatttgcgacttgccgagcagttggcgagtttgcggccttaa

SEQ ID NO: 1596 - protein, 416 aa, GEOBACILLUS THERMOLEOVORANS
MKCCRVMFVLLGLWLVFGLSVSGGRAEAAASRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNVPYTSQVYDFKLDQWGLRRQPGESFDHYFERLKRSPVWTSTDTARYDLSVSGAEKLNQWVQASPNTYYLSFATERTYRGALTGNYYPELGMNAFSAVVCAPFLGSYRNPTLGIDDRWLENDGIVNTVSMNGPKRGSSDRIVPYDGALKKGVWNDMGTYNVDHLEIIGVDPNPSFDIRAFYLRLAEQLASLRP

SEQ ID NO: 1597 - DNA, 1068 bp, Streptomyces rimosus
ttcatcacaacgatgtcacaacaccggccatccgggtcatccctgatcgtgggaatgggtgacaagccttcccgtgacgaaagggtcctgctacatcagaaatgacagaaatcctgctcagggaggttccatgagactgtcccgacgcgcggccacggcgtccgcgctcctcctcaccccggcgctcgcgctcttcggcgcgagcgccgccgtgtccgcgccgcgaatccaggccaccgactacgtggccctcggcgactcctactcctcgggggtcggcgcgggcagctacgacagcagcagtggctcctgtaagcgcagcaccaagtcctacccggccctgtgggccgcctcgcacaccggtacgcggttcaacttcaccgcctgttcgggcgcccgcacaggagacgtgctggccaagcagctgaccccggtcaactccggcaccgacctggtcagcattaccatcggcggcaacgacgcgggcttcgccgacaccatgaccacctgcaacctccagggcgagagcgcgtgcctggcgcggatcgccaaggcgcgcgcctacatccagcagacgctgcccgcccagctggaccaggtctacgacgccatcgacagccgggcccccgcagcccaggtcgtcgtcctgggctacccgcgcttctacaagctgggcggcagctgcgccgtcggtctctcggagaagtcccgcgcggccatcaacgccgccgccgacgacatcaacgccgtcaccgccaagcgcgccgccgaccacggcttcgccttcggggacgtcaacacgaccttcgccgggcacgagctgtgctccggcgccccctggctgcacagcgtcacccttcccgtggagaactcctaccaccccacggccaacggacagtccaagggctacctgcccgtcctgaactccgccacctgatctcgcggctactccgcccctgacgaagtcccgcccccgggcggggcttcgccgtaggtgcgcgtaccgccgtcgcccgtcgcgccggtggccccgccgtacgtgccgccgcccccggacgcggtcggttc

SEQ ID NO: 1598 - protein, 268 aa, Streptomyces rimosus
MRLSRRAATASALLLTPALALFGASAAVSAPRIQATDYVALGDSYSSGVGAGSYDSSSGSCKRSTKSYPALWAASHTGTRFNFTACSGARTGDVLAKQLTPVNSGTDLVSITIGGNDAGFADTMTTCNLQGESACLARIAKARAYIQQTLPAQLDQVYDAIDSRAPAAQVVVLGYPRFYKLGGSCAVGLSEKSRAAINAAADDINAVTAKRAADHGFAFGDVNTTFAGHELCSGAPWLHSVTLPVENSYHPTANGQSKGYLPVLNSAT

SEQ ID NO: 1599 - DNA, 1083 bp, Pseudomonas luteola
atgcgttccagggtggtggcaggggcagtggcatgcgcgatgagcgtcgcgccgttcgcgggcagcgccgcgttgatgatggcggcgacgacacacgtcgcgatggcggcgaccgcgcccgccgacaactatgcgacgacgcgttatccgatcatcctcgtacacgggctcacgggcaccgacaagtacgcgggcgtgctcgagtactggtacggcatccaggaagacctgcagcagcatggcgcgaccgtctacgtcgcgaacctgtcgggcttccagagcgacgacggtccgaaggggcgcgacgaacagttgctcgcgtacgtgaagacggtgctcgcggcgacgggcgcgaccaaggtcaatctcgtcggtcacagccagggcgggctcacgtcgcgttatgttcctgctgtcgcgcccgatctcgtcgcgtcggtgacgacgatcggcgctgccgatcgcggctccgaattcgccgatttcgtgcagggcgtgctcgcatacgatccgaccgggctttcgtcgtcggtgatcgcggcgttcgtcaatgtgttcggaatcctcacgagcagcagtaacaacgcgaaccaggatgcgctcgccggactgaagacgctgacgaccgcacaggccgccacgtacaaccagaactatccgagcgcgggccttgggcggccgggcagttgccagaccggccgaccgacggaaaccgtcggcggcaacacgcatctgctgtattcgtgggccggcacggcgatccagccgacgctctccgtgttcggcgtcacgggcgcgacggacacgagcaccattccgctcatcgatccggcgaacgtgctcgacccgtcgacgctcgcgctgttcggcacgggcacggtgatgatcaaccgcgcctcgggacagaacgacgggctcgtgtcgaagtgcagtgcgctgtacggcaaggtgctgagcacgagctacaagtggaaccatatcgacgagatcaaccagttgctcggcgtgcgcggcgcgaatgcggaagatccggtcgcggtgatccgcacgcatgcgaaccggctgaagctggcgggcgtgtaa

SEQ ID NO: 1600 - protein, 360 aa, Pseudomonas luteola
MRSRVVAGAVACAMSVAPFAGSAALMMAATTHVAMAATAPADNYATTRYPIILVHGLTGTDKYAGVLEYWYGIQEDLQQHGATVYVANLSGFQSDDGPKGRDEQLLAYVKTVLAATGATKVNLVGHSQGGLTSRYVPAVAPDLVASVTTIGAADRGSEFADFVQGVLAYDPTGLSSSVIAAFVNVFGILTSSSNNANQDALAGLKTLTTAQAATYNQNYPSAGLGRPGSCQTGRPTETVGGNTHLLYSWAGTAIQPTLSVFGVTGATDTSTIPLIDPANVLDPSTLALFGTGTVMINRASGQNDGLVSKCSALYGKVLSTSYKWNHIDEINQLLGVRGANAEDPVAVIRTHANRLKLAGV

SEQ ID NO: 1601 - DNA, 1251 bp, GEOBACILLUS THERMOLEOVORANS; identical to SEQ ID NO: 1477

SEQ ID NO: 1602 - protein, 416 aa, GEOBACILLUS THERMOLEOVORANS; identical to SEQ ID NO: 1478

SEQ ID NO: 1603 - DNA, 801 bp, Mycoplasma hyopneumoniae
atggtagtaaatcgaaaaattaaaattgacaatgaagaaattttctactttttagaagataataatcgaccaaaagtactttttctccatggttttaactcaagccataattttacttttcaacttcggcaaaacaaaaaacgcaaatatgatattgttgcctttgattttccaggctgtggtaaaagtagtaataatcaaaaaattagtgttgaaaattaccaaaaaattgctgtaaattttataaaaacacttgatttaaaagtaaaaattgttgtagcccactcacttggggccgcgattggactgcatattctaaaagaaaatcttgtcgaaaaagcaattttagccggacctttaaacccgtttatttttgattcaagctttaaaaaacaaatggaaagattaggcttctgacttctaccacgaaatttatatgaggcaaaagaaacagttacaaatttattttataaggataaacctaattctgaggctagtttatttaaaagtgcgattgcttttttcaaacttgttgaggaaaaaaaggaacttttttcagatatggtttttgatcaaattcttaatttagattgacacaaaaatgtgcttttaccgctttatgagcaaaaaaatgaatattttttaatcggggctgaaatggataaatttgtcccgttaagaagtgttgaaaaagttggagctacttttggcaaaaaggtggtaaaatttgaaaaaactggccatgcaattttttatgaaaaaagtgacctaattaatgctgaaattgaaaaaatactataa

SEQ ID NO: 1604 - protein, 266 aa, Mycoplasma hyopneumoniae
MVVNRKIKIDNEEIFYFLEDNNRPKVLFLHGFNSSHNFTFQLRQNKKRKYDIVAFDFPGCGKSSNNQKISVENYQKIAVNFIKTLDLKVKIVVAHSLGAAIGLHILKENLVEKAILAGPLNPFIFDSSFKKQMERLGFWLLPRNLYEAKETVTNLFYKDKPNSEASLFKSAIAFFKLVEEKKELFSDMVFDQILNLDWHKNVLLPLYEQKNEYFLIGAEMDKFVPLRSVEKVGATFGKKVVKFEKTGHAIFYEKSDLINAEIEKIL

SEQ ID NO: 1605 - DNA, 2076 bp, Staphylococcus aureus
atgttaagaggacaagaagaaagaaagtatagtattagaaagtattcaataggcgtggtgtcagtgttagcggctacaatgtttgttgtgtcatcacatgaagcacaagcctcggaaaaaacaccaacgtccaatgcagcggcacaaaaagaaacactaaatcaaccgggagaacaagggaacgcgataacgtcacatcaaatgcagtcaggaaagcaattagacgatatgcataaagagaatggtaaaagtggaacagtgacagaaggtaaagacacgcttcaatcatcgaagcatcaatcaacacaaaatagtaaaacaatcagaacgcaaaatgataatcaagtaaagcaagattctgaacgacaaggttctaaacagtcacaccaaaataatgcgactaataatactgaacgtcaaaatgatcaggttcaaaatacccatcatgctgaacgtaatggatcacaatcgacaacgtcacaatcgaatgatgttgataaatcacaaccatccattccggcacaaaaggtattacccaatcatgataaagcagcaccaacttcaactacacccccgtctaatgataaaactgcacctaaatcaacaaaagcacaagatgcaaccacggacaaacatccaaatcaacaagatacacatcaacccgcgcatcaaatcatagatgcaaagcaagatgatactgttcgccaaagtgaacagaaaccacaagttggcgatttaagtaaacatatcgatggtcaaaattccccagagaaaccgacagataaaaatactgataataaacaactaatcaaagatgcgcttcaagcgcctaaaacacgttcgactacaaatgcagcagcagatgctaaaaaggttcgaccacttaaagcgaatcaagtacaaccacttaacaaatatccagttgtttttgtacatggatttttaggattagtaggcgataatgcacctgctttatatccaaattattggggtggaaataaatttaaagttatcgaggaattgagaaagcaaggctataatgtacatcaagcaagtgtaagtgcatttggtagtaactatgatcgcgctgtagaactttattattacattaaaggtggtcgcgtagattatggcgcagcacatgcagctaaatacggacatgagcgctatggtaagacttataaaggaatcatgcctaattgggaacctggtaaaaaggtacatcttgtagggcatagtatgggtggtcaaacaattcgtttaatggaagagtttttaagaaatggtaacaaagaagaaattgcctatcataaagcgcatggtggagaaatatcaccattattcactggtggtcataacaatatggttgcatcaatcacaacattagcaacaccacataatggttcacaagcagctgataagtttggaaatacagaagctgttagaaaaatcatgttcgctttaaatcgatttatgggtaacaagtattcgaatatcgatttaggattaacgcaatggggctttaaacaattaccaaatgagagttacattgactatataaaacgcgttagtaaaagcaaaatttggacatcagacgataatgctgcctatgatttaacgttagatggctctgcaaaattgaacaacatgacaagtatgaatcctaatattacgtatacgacttatacaggtgtgtcttcacatactggtccattaggttatgaaaatcctgatttaggtacatttttcttaatggatacaacgagtagaattattggtcatgatgcaagagaagaatggcgtaaaaatgatggtgtcgtaccagtgatttcgtcgttacatccatccaatcaaccatttattaatgttacgaatgatgaacctgccacacgcagaggtatctggcaagttaaaccaatcatacaaggatgggatcatgtcgattttatcggtgtggacttcctggatttcaaacgtaaaggtgcagaacttgccaacttctatacaggtattataaatgacttgttgcgtgtggaagcgactgaaagtaaaggaacacaattgaaagcaagttaa

SEQ ID NO: 1606 - protein, 691 aa, Staphylococcus aureus
MLRGQEERKYSIRKYSIGVVSVLAATMFVVSSHEAQASEKTPTSNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKVLPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFINVTNDEPATRRGIWQVKPIIQGWDHVDFIGVDFLDFKRKGAELANFYTGIINDLLRVEATESKGTQLKAS

SEQ ID NO: 1607 - DNA, 1000 bp, BACILLUS SP. B26
ttgagtaaacagcatctagcagaacctcctttgtctattgatattatatatgaaagaaagaaggtctcgtagtctttttgttttaatttaaaaaagtccaaggtgctttatgattatttatatttctgtaaaatcatctcataaacattaccttgttcacttttctgacatatttttcttgtataaaatagagtcgaataagatgaataagggggaatgaaagtgattcgatttaagaaaaagagtttgcaaattcttgttgcccttgccttagtgctaggttcaatagccttcatccagccgaaagaagccaaagcggctgagcataatccggttgtaatggtacacggcatgggcggtgcatcttataactttgcttcaatcaaacgttacttggtatcacagggatgggatcaaaaccaactttttgcaatcgatttcatagacaaaacaggcaataacctgaacaatggcccgaggctctctagattcgtcaaagatgtactagccaaaacgggcgccaaaaaagtagatattgtggctcatagtatgggcggtgcgaacacgttatactatattaagaacctagacggcggagataaaattgaaaacgtcgtcacacttggtggagcgaacggactcgtttcactcagagcattaccaggcaccgatccaaatcaaaaaattctttacacatctgtctatagctcagccgatctcatcgtcgtcaacagcctctctcgcttaattggcgcaagaaacgtcctgatccacggcgttggacatatcggtctattaacctcaagccaagtcaaaggctatgtgaaagaaggattgaatggcggaggacagaatacgaattaaaaaatcaaaaagacagcgatttgtgctgtcttttttgatgtcatggttatatgggtgctgctaggtgttgaagaagatttttaggaggataaaagatgacgcaaaaactcaaatatgctttcttgggctactttct

SEQ ID NO: 1608 - protein, 215 aa, BACILLUS SP. B26
MKVIRFKKKSLQILVALALVLGSIAFIQPKEAKAAEHNPVVMVHGMGGASYNFASIKRYLVSQGWDQNQLFAIDFIDKTGNNLNNGPRLSRFVKDVLAKTGAKKVDIVAHSMGGANTLYYIKNLDGGDKIENVVTLGGANGLVSLRALPGTDPNQKILYTSVYSSADLIVVNSLSRLIGARNVLIHGVGHIGLLTSSQVKGYVKEGLNGGGQNTN

SEQ ID NO: 1609 - DNA, 2428 bp, Pseudomonas aeruginosa
gaaccgggtgtacttcggcgcctgggtgaccctggaagacgaagacggcgagcaggcccgctatcgcatcgtcggccccgacgaactggacctgcgcaacaaccagatcagcatcgactcgccgctcgcccgcgcactggtcggcaaggagctggacgccgaggtgctggtgcgcaccccggccggggaaaagctctggttcgtcgtcgagatcgagtatccgccggcgccctgagaggccacgcgctcagcgcaggatgcggcgggtgatcaggccctggcgggcgacccggatcagttgccggaccaccaggtccaggtctgccgcctcgggggcctggaccacggcgaagtcgaacgcgtcgctggggaagcgcgccaggtccttgcctgcctgggcgaactggataaggaaggtacgcgaaccgttccagcgcttcggccagccttcgaggtaacggacgagggtcggctggtgcgggccgctgaggagaatcctcgggttccgccggaccaggccggtggtgatgggtgccaggcgcaattgcgtgctgggacaggtcatgacgtcatgtctccgcctcttcggtcccgctggacagcggtgagaggcaacaccgagccagcgctttagcggtatttcggctgctgccgggcgccccgcaagttgctgtttaaatcggcgcacgcgcatcctagaaaagccgcatggagactgtcaagaaacacgcggaggcgcccatgcccgatcgctttcttcgcctgttcttcgccctgccctgcccacctcccctcgccgagcggatcggccggtggcgcgatgaccggacactgcccggacgccaggtggcgacggcgaacctgcacctgaccctggccttcctcgggcaggtcccgtccgctcggctcgaggccctgctggacatggccgcggtcatcgaaggccgcgccctttcgacctgtgtcttcgaccgcctgctgcgcttggaggaaccgggcattctgcttgcttggcccccagccaaccgcccggcgccctcctgcgcttgcgccgcgccctgcgctccggccttgccgaactggagctgccgtggaaacccgcccattcagcgcccatctgaccctggctcgcgatgccgcgccgctggaggacgtcccgccacccccaaccttcgtatggcaggtcgaccatttcagcctgttttgctcgcaaaacgacgccgcgggcgtgcgctaccgcacactcggtcgctgggcgttgtgcggggaagattcaaacgagcgtttcgcgccgtaacaacccgcctcttccgctctgccacgcaggttatgaccggccgccaggaagccgcggatttcctggcctggaggaaaaaagccgaagctggcacggttcctgcgcaagggacagcgaagcggttctcccggaaggattcgggcgatggctggcaggacgcgcccctcggccccatcaacctgagatgagaacaacatgaagaagaagtctctgctccccctcggcctggccatcggcctcgcctctctcgctgccagccctctgatccaggccagcacctacacccagaccaaataccccatcgtgctggcccacggcatgctcggcttcgacaacatcctcggggtcgactactggttcggcattcccagcgccttgcgccgtgacggtgcccaggtctacgtcaccgaagtcagccagttggacacctcggaagtccgcggcgagcagttgctgcaacaggtggaggaaatcgtcgccctcagcggtcagcccaaggtcaacctgatcggccacagccacggcgggccgaccatccgctacgtcgccgccgtacgtcccgacctgatcgcttccgccaccagcgtcggcgccccgcacaagggttcggacaccgccgacttcctgcgccagatcccaccgggttcggccggcgaggcaatcctctccgggctggtcaacagcctcggcgcgctgatcagcttcctttccagcggcagcaccggtacgcagaattcactgggctcgctggagtcgctgaacagcgagggggccgcgcgcttcaacgccaagtacccacagggcatccccacctcggcctgcggcgaaggcgcctacaaggtcaacggcgtgagctattactcctggagcggttcctcgccgctgaccaacttcctcgatccgagcgacgccttcctcggcgcctcgtcgctgaccttcaagaacggcaccgccaacgacggcctggtcggcacctgcagttcgcacctgggcatggtgatccgcgacaactaccggatgaaccacctggaccaggtgaaccaggtcttcggcctcaccagcctgttcgagaccagcccggtcagcgtctaccgccagcacgccaaccgcctgaagaacgccagcctgtag

SEQ ID NO: 1610 - protein, 311 aa, Pseudomonas aeruginosa
MKKKSLLPLGLAIGLASLAASPLIQASTYTQTKYPIVLAHGMLGFDNILGVDYWFGIPSALRRDGAQVYVTEVSQLDTSEVRGEQLLQQVEEIVALSGQPKVNLIGHSHGGPTIRYVAAVRPDLIASATSVGAPHKGSDTADFLRQIPPGSAGEAILSGLVNSLGALISFLSSGSTGTQNSLGSLESLNSEGAARFNAKYPQGIPTSACGEGAYKVNGVSYYSWSGSSPLTNFLDPSDAFLGASSLTFKNGTANDGLVGTCSSHLGMVIRDNYRMNHLDQVNQVFGLTSLFETSPVSVYRQHANRLKNASL

SEQ ID NO: 1611 - DNA, 1440 bp, Bacillus stearothermophilus
tttcttttcatataggaaccccgacaattgaaggggttgaagggccttggtcttatgtataaaatattctggtaattcagaatgaaaagatttcggcctattgaaggaaaggagagggagaacatgatgaaatgctgtcggcgtgttgcccttgtgttgctcggattatggtttgtgttctgcatatctgttctgggagggcgagctgaagcggcggcttcgcgagccaacgatgcgccgattgtacttctccacgggtttaccggctggggaagagaagaaatgtttgggttcaagtactggggcggcgtgcgcggtgatatcgaacaatggctgaacgacaacggttatcgaacttatacgctggcggtcggcccgctctcgagcaactgggatcgggcgtgcgaagcgtatgcccagcttgtcggcgggacggtcgattatggggcagcccatgcggcaaagcacggccatgcgcggtttggccgcacctatcccggcctgttgccggaattgaaaaggggcggtcgcatccatatcatcgcccacagccaaggagggcagacggcccgcatgcttgtatcgctcctagagaatggaagccaagaagagcgggagtacgctaaggcgcataacgtgtctttgtcgccgttgtttgaaggcggacatcattttgtgttgagcgtgacaaccattgccacccctcatgacgggacgacgcttgtcaacatggttgatttcaccgatcgcttttttgacttgcaaaaagcggtgttgaaagcagcggctgtcgccagcaatgtgccgtacacaagtcaagtatacgattttaagctcgaccaatggggactgcgccgccagccaggtgaatcgtttgaccaatattttgaacggctcaaacggtcccctgtttggacgtcgacagataccgctcgctatgatttatccgttcccggggctgagaagttgaatcaatgggtgaaagcaagcccgaatacgtattatttgagctttgccacagaacggacgtatcgcggagcgctcacaggcaactattatcccgaactcggaatgaatgcattcagcgccgtcgtatgcgccccgtttctcggttcgtaccgcaatgcgacgctcggcattgacgaccgctggcttgagaacgatggcatcgtcaatacgttttcgatgaacggaccaaagcgcggatcgaccgatcggatcgtgccgtatgacgggacaataaaaaaaggggtttggaatgatatgggaacgtacaatgtcgatcatttggaagtcatcggcgttgacccgaatccgttgtttgatatccgtgccttttatttgcgccttgccgagcagttggcgagcttgcagccttaaaactagtattttgcgaaaaaagccatctcgatcggatggcgctttttttcgtgaacattc

SEQ ID NO: 1612 - protein, 418 aa, Bacillus stearothermophilus
MMKCCRRVALVLLGLWFVFCISVLGGRAEAAASRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLKAAAVASNVPYTSQVYDFKLDQWGLRRQPGESFDQYFERLKRSPVWTSTDTARYDLSVPGAEKLNQWVKASPNTYYLSFATERTYRGALTGNYYPELGMNAFSAVVCAPFLGSYRNATLGIDDRWLENDGIVNTFSMNGPKRGSTDRIVPYDGTIKKGVWNDMGTYNVDHLEVIGVDPNPLFDIRAFYLRLAEQLASLQP

SEQ ID NO: 1613 - DNA, 1254 bp, Bacillus stearothermophilus
atgatgaaaggctgccgggtgatggttgtgttgctcggattatgctttgtgttcggcctatcggtcccgggagggcggacggaagcggcatccctacgcgccaatgatgcgccgattgtgcttctccatgggtttaccggatggggacgagaggaaatgtttggattcaagtattggggcggcgtgcgcggcgatatcgaacaatggctgaacgacaacggttatcgaacgtatacgctggcggtcggaccgctctcgagcaactgggaccgggcgtgtgaagcgtatgctcagcttgtcggcgggacggtcgattatggggcagcccatgcggcaaagcacggccatgcgcggtttggccgcacttatcccggcctgttgccggaattgaaaaggggtggccgcatccatatcatcgcccacagccaaggggggcagacggcccgcatgcttgtctcgctcctagagaacggaagccaagaagagcgggagtacgccaaggcgcacaacgtgtcgttgtcaccgttgtttgaaggtggacatcattttgtgttgagtgtgacgaccatcgccactcctcatgacgggacgacgcttgtcaacatggttgatttcaccgatcgcttttttgacttgcaaaaagcggtgttggaagcggcggctgtcgccagcaacgtgccgtacacgagtcaagtatacgattttaagctcgaccaatggggactgcgccgtcagccgggcgaatcgttcgaccattattttgaacggctcaagcgctcccctgtctggacatcgaccgataccgcccgctacgatttatccgtttccggagctgagaagttgaatcaatgggtgcaagcaagcccgaatacgtattatttgagtttctctacagaacggacgtatcgcggagcgctcacaggcaaccattatcccgaactcggaatgaacgcattcagcgcggtcgtatgcgctccgtttctcggttcgtaccgcaatccgacgcttggcattgacagtcattggcttgagaacgacggcattgtcaataccatttcgatgaacggtccgaagcgtggatcaaacgatcggatcgtgccgtatgacgggacgttgaaaaaaggggtttggaatgatatgggaacgtacaatgtcgaccatttggaaatcatcggcgttgacccgaatccgtcatttgatattcgcgccttttatttgcggcttgccgagcagttggcgagcttgcagccttaa

SEQ ID NO: 1614 - protein, 417 aa, Bacillus stearothermophilus
MMKGCRVMVVLLGLCFVFGLSVPGGRTEAASLRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNVPYTSQVYDFKLDQWGLRRQPGESFDHYFERLKRSPVWTSTDTARYDLSVSGAEKLNQWVQASPNTYYLSFSTERTYRGALTGNHYPELGMNAFSAVVCAPFLGSYRNPTLGIDSHWLENDGIVNTISMNGPKRGSNDRIVPYDGTLKKGVWNDMGTYNVDHLEIIGVDPNPSFDIRAFYLRLAEQLASLQP

SEQ ID NO: 1615 - DNA, 1719 bp, Bacillus thermoleovorans
ggcggtgatggaacgctgccatgacatagtgcatcaccctctcgctgtcggcgagaaacgaaatatgacggcacaaaagtgcatttttctctttccctcatcagaaaacccgacaattgccgggattgaatagcctgattatttagggtaattcggaataaaggggttcagtcgattcgaggggaggagaaggagagcgtgatgaaatgctgtcgggttatgtttgtgttgctcggattatggcttgtgttcggcctatcggtctcgggaggacgggctgaagcggcagcttcacgcgccaacgatgcgccgattgtacttctccatggctttactggctggggaagagaagaaatgtttgggttcaagtactggggcggcgtgcgcggcgatatcgaacaatggctgaacgacaacggttatcgaacttatacgctggcggtcggaccgctctcgagcaactgggaccgggcgtgtgaagcgtatgctcagcttgtcggcgggacggtcgattatggggcagcccatgcggcaaagcacggccatgcgcggtttggccgcacttatcccggcctgttgccggaattgaaaaggggtggccgcatccatatcatcgcccacagccaaggggggcagacggcccgcatgcttgtctcgctcctagagaacggaagccaagaagagcgggagtacgccaaggcgcacaacgtgtcgttgtcaccgttgtttgaaggtggacatcattttgtgttgagtgtgacgaccatcgccactcctcatgacgggacgacgcttgtcaacatggttgatttcaccgatcgcttttttgacttgcaaaaagcggtgttggaagcggcggctgtcgccagcaacgtgccgtacacgagtcaagtatacgattttaagcttgaccaatggggactgcgccgccagccgggtgaatcgttcgaccattattttgaacggctcaagcgctcccctgtttggacgtccacagataccgcccgctacgatttatccgtttccggagctgagaagttgaatcaatgggtgcaagcaagcccgaatacgtattatttgagctttgccacagaacggacgtatcgcggagcgctcacaggcaactattatcccgaactcggaatgaatgcattcagcgcggtcgtatgcgctccgtttctcggttcgtaccgcaatccgacgctcggcattgacgaccgctggcttgaaaacgatggcattgtcaatacggtttccatgaacggtccaaagcgtggatcaagcgatcggatcgtaccgtatgacggggcgttgaaaaaaggggtttggaatgacatgggaacgtacaatgtcgaccatttggaaatcatcggcgttgacccgaatccgtcatttgatattcgcgccttttatttgcgacttgccgagcagttggcgagcttgcggccttaaaactagtattttgcgaaaaagccatctcgatcggatggctcttttttgaggagcaagctcttgagttgtatgacggccgcggatgtccgatggtataataggggcaaagcaagcgggtgggggaatggacgtgaagccgaccgagcggcaaaaggaacggtatacgtatcaagattatgtcaagtgggacggacggtgggagctgatcaacggcgtgccctacaacatggcatcggccccttcatttgtccgccagtctatcgtcgg

SEQ ID NO: 1616 - protein, 416 aa, Bacillus thermoleovorans; identical to SEQ ID NO: 1596

SEQ ID NO: 1617 - DNA, 1725 bp, Bacillus stearothermophilus
tgatggaacgctgccatgccagagtgcagccaccttccattgtcggcgggaaacgaaatgcgccggcacaaacatgcgcttttctctttctctcacagaaaaacccgacaattgccgggattgaatcagtcggttgatatatatagaatatttaggtaattatgaacaaaaagattccgtttatgtgaggggaggagaaggataggatgatgaaaggctgccgggtgatggttgtgttgctcggattatggtttgtgttcggcctatcggtcccgggagggcggacggaagcggcatctccacgcgccaatgatgcacccatcgtgcttctccatgggtttaccggatgggggcgagaggaaatgcttggattcaagtattggggcggcgtacgcggcgatatcgaacaatggctgaacgacaacggatatcgaacgtatacgctggcggtcggaccgctctcgagcaactgggaccgggcgtgtgaagcgtacgcccagcttgtcggcggaacggtcgattatggcgcggcccatgcggcgaacgacggccatgcgcggtttggccgcacgtatccggggttgctgccggaattgaaaagaggaggccgcgtccatatcatcgcccacagccaaggagggcagacggcccgtatgcttgtctcgctcctggagaacggaagccaagaagagcgggagtacgccaaggagcacaacgtgtcgttgtcgccgttgtttgaaggcggacatcgttttgtgttgagcgtgacgaccatcgccactcctcatgacgggacgacgcttgtcaacatggttgatttcaccgatcgcttttttgacttgcaaaaagcggtgctggaagcggcggctgtcgccagcaacgcgccgtacacaagcgaaatatacgattttaagctcgaccaatgggggctgcgccgcgagccaggcgaatcgttcgaccattattttgaacggctcaagcgctcccctgtctggacatcgaccgataccgcccgctacgatttatccgttcccggggctgagacgttgaatcgatgggtgaaagccagcccgaatacgtattatttgagcttttctaccgaacggacgtatcgaggagctctgacaggcaactattatcccgaacttggaatgaacgcattcagcgcgattgtctgcgccccgtttctcggctcgtaccgcaatgcggcgcttggcattgacagccattggcttgggaacgacggcattgtcaataccatttcgatgaacggtccgaagcgtggatcaaacgatcgaatcgtgccgtatgacgggacgttgaaaaaaggagtttggaatgatatggggacgtacaaggtcgaccatttggaagtcatcggcgttgacccgaatccgtcatttaatattcgcgccttttatttgcggcttgccgagcaactggcgagtttgcggccttaaaacgagtattttgcgaaaaagccatctcgatcggatggctcttttttttgaggagcaagctcttgagttgtatgacggccgcggatgtccgatggtataataagggcaaagcaagcggatgggggaatggacgtgaagccgcctgagcgaaaaggaacggtatacgtatcaagattatgtcaagtgggacggacggtgggagctgatcaacggcgtaccttacaacatggcaccggccccttcatttgtctaccagtcgatcgtc

SEQ ID NO: 1618 - protein, 417 aa, Bacillus stearothermophilus
MMKGCRVMVVLLGLWFVFGLSVPGGRTEAASPRANDAPIVLLHGFTGWGREEMLGFKYWGGVRGDIEQWLNDNGYRTYTLAVGPLSSNWDRACEAYAQLVGGTVDYGAAHAANDGHARFGRTYPGLLPELKRGGRVHIIAHSQGGQTARMLVSLLENGSQEEREYAKEHNVSLSPLFEGGHRFVLSVTTIATPHDGTTLVNMVDFTDRFFDLQKAVLEAAAVASNAPYTSEIYDFKLDQWGLRREPGESFDHYFERLKRSPVWTSTDTARYDLSVPGAETLNRWVKASPNTYYLSFSTERTYRGALTGNYYPELGMNAFSAIVCAPFLGSYRNAALGIDSHWLGNDGIVNTISMNGPKRGSNDRIVPYDGTLKKGVWNDMGTYKVDHLEVIGVDPNPSFNIRAFYLRLAEQLASLRP

SEQ ID NO: 1619 - DNA, 1854 bp, Pseudomonas fluorescens
atgggtgtgtatgactacaagaacttcggtacagccgattccaaggcgctgttcagcgatgccatggcgatcacgctgtattcctatcacaaccttgataacggctttgccgccggttatcagcacaacggtttcggcctcggtctgcccgccacgttggtgaccgcgctgctcggtggcaccgattcgcaaggagtgatccccggtattccgtggaaccccgactcggaaaaactcgccctcgacgcggtgaaaaaggctggctggacaccgatcaccgcctcgcaactgggctacgacggcaagaccgacgcgcgcggaaccttcttcggtgagaaggccggttacaccaccgctcaggtggaaattctgggcaagtacgacgctcagggccatctcaccgaaatcggcatcgcttttcgcggcaccagcggcccgcgggaaaacctgatcctcgactcgatcggcgacgtgatcaacgacctgctggcagctttcggcccccaggattacgccaagaattacgtcggtgaagcgttcggcaatctactgaatgacgtggtggcgttcgccaaggccaatggcctcagcggcaaggacgtgctggtcagcggccacagcctcggcgggctggcggtcaacagcatggctgacctgagtggcggcaagtggggcgggttcttcgccgattccaactacattgcctacgcctcgccgacccagagcaccaccgacaaggtgctcaacgtcggttacgaaacgacccggtgttccgcgcccttgacggctcgaccttcaccggcgcctcggtcgggcgtgcacgacgcgcccaaggaatcggccaccgacaacatcgtcagcttcaacgatcactacgcctcgaccgcgtggaatctgctgccgttctccattctcaacatcccgacctggatctcgcacctgccgactgcgtacggcgacggcatgaaccggatcatcgagtcgaagttctacgacctgaccagcaaggactcgacgatcatcgtcgccaacctgtcggacccggcgcgggccaacacctgggtgcaggatctgaaccgcaacgccgaaacccacaagggcagcacgttcatcatcggcagcgacagcaacgacctgatccagggcggcagcggcaatgactacctcgaagggcgcgccggcaacgacacgttccgtgatgctggcggctacaacgtgattctcggtggcgccggcaacaacaccctcgagttgcagaaatcggtgaacaccttcgacttcgccaacgacggtgccggcaacctgtacatccgcgacgccaacggcgggatcagcatcacccgcgacatcggcagcatcgtcaccaaggagccaggcttcctctgggggctgttcaaggacgacgtgacccacagcgtcacggccagcggtttgaaggtcggcagcaacgtcacccagtacgaatccagtgtcaccggcaccagcggtgccgacacgctcaaggcgcatgccggcggcgactggctgttcggtctggacggcaatgaccacttgattggtggcgcgggtaacgacgtgtttgtcggtggcgccggcaatgacctgatggagtccgggggcggggcggatacgttcctgttcaacggcgcgttcggtcaggatcgggtgctgggttttacggccaacgacaaactggtgttccttggcgtgcagggtgtgttgcctaacgacgacttccgtgcgcatgcctcgacggtggggcaggacacggtgctgaagtttggtggtgattcggtgacgttggttggggtggcgctgaatagcctcagtgccgatggaattgtgatcgcctga

SEQ ID NO: 1620 - protein, 617 aa, Pseudomonas fluorescens
MGVYDYKNFGTADSKALFSDAMAITLYSYHNLDNGFAAGYQHNGFGLGLPATLVTALLGGTDSQGVIPGIPWNPDSEKLALDAVKKAGWTPITASQLGYDGKTDARGTFFGEKAGYTTAQVEILGKYDAQGHLTEIGIAFRGTSGPRENLILDSIGDVINDLLAAFGPQDYAKNYVGEAFGNLLNDVVAFAKANGLSGKDVLVSGHSLGGLAVNSMADLSGGKWGGFFADSNYIAYASPTQSTTDKVLNVGYETTRCSAPLTARPSPAPRSGVHDAPKESATDNIVSFNDHYASTAWNLLPFSILNIPTWISHLPTAYGDGMNRIIESKFYDLTSKDSTIIVANLSDPARANTWVQDLNRNAETHKGSTFIIGSDSNDLIQGGSGNDYLEGRAGNDTFRDAGGYNVILGGAGNNTLELQKSVNTFDFANDGAGNLYIRDANGGISITRDIGSIVTKEPGFLWGLFKDDVTHSVTASGLKVGSNVTQYESSVTGTSGADTLKAHAGGDWLFGLDGNDHLIGGAGNDVFVGGAGNDLMESGGGADTFLFNGAFGQDRVLGFTANDKLVFLGVQGVLPNDDFRAHASTVGQDTVLKFGGDSVTLVGVALNSLSADGIVIA

SEQ ID NO: 1621 - DNA, 1425 bp, Pseudomonas SP. KB700A
atgggtgtgttcgactataaaaacctcgggaccgagggctccaaagcgttgttcgccgatgccatggcgatcacgctgtatacctaccacaacctggataacggctttgccgtgggctaccagcacaacggcctggggctcggtttgcccgccacgctggtgggtgcactgctgggcagcacggattcccagggcgtgattcccggcattccctggaacccggattcggagaaagccgccttggaggccgtgcaacaagccggctggacccccatacgcgccagcaccctgggctataccggcaaggtcgacgcccgcggcacgttcttcggcgaaaaggctggctacaccacggcccaggtcgaggtgctgggcaagtacgatgacgccggcaagctgctggaaatcggtatcggttttcgcggtacgtcgggccctcgggaaacgctggtcagcgactccattggcgatctggtcagcgatctgctcgcggccttggggcccaaggattacgccaataactacgccggcgaagcctttggcggcctgctcaagaacgtcgccgactacgccagtgcccacggcctcagcggccacgacgtggtggtcagcggccacagcctgggcggcctggcggtcaacagcatggccgacttgagcagcagcaaatgggcaggtttctaccaggacgccaactacctggcctacgcctcgccgacccagagcgccggcgacaaggtgctgaatatcggctacgaaaacgacccggtattccgggcgctggacggctcatccttcaattggtcatcgttgggcgtgcatgacaaaccccatgaatcgaccacggacaatatcgtcagcttcaacgaccactacgcctcgacgttgtggaatgtgctgccgttttccatcaccaacctgccgacctggatctcccatttgcctacggggtatggcgacgggatgacgcgcatcctcgagtccgggttctatgggcagatgagccgcgactcgacgattatcgtcgccaacctgtccgacccggcacgcgccaccacctgggtgcaggacctcaaccgcaatgccgaaccgcacaagggcgatacctacatcattggcagcgacggcaatgacctgatccagggcggcaagggcgcggactttatcgagggcggcaagggcaatgacacgatccgcgacagcagcgggcataacacctttttgttcagcgggccgtttggccaggaccggattatcggctatcaagcaacggacaagctggtgttcagggacgtcgacgggagtgcggattaccgtgatcacgccaaggtcgtgggcggggatacggtgatcagttttggcgcggattcggtgacgttggtgggggtggttggcttgtcgggggaggggattgtgatcggttaa

SEQ ID NO: 1622 - protein, 474 aa, Pseudomonas SP. KB700A
MGVFDYKNLGTEGSKALFADAMAITLYTYHNLDNGFAVGYQHNGLGLGLPATLVGALLGSTDSQGVIPGIPWNPDSEKAALEAVQQAGWTPIRASTLGYTGKVDARGTFFGEKAGYTTAQVEVLGKYDDAGKLLEIGIGFRGTSGPRETLVSDSIGDLVSDLLAALGPKDYANNYAGEAFGGLLKNVADYASAHGLSGHDVVVSGHSLGGLAVNSMADLSSSKWAGFYQDANYLAYASPTQSAGDKVLNIGYENDPVFRALDGSSFNWSSLGVHDKPHESTTDNIVSFNDHYASTLWNVLPFSITNLPTWISHLPTGYGDGMTRILESGFYGQMSRDSTIIVANLSDPARATTWVQDLNRNAEPHKGDTYIIGSDGNDLIQGGKGADFIEGGKGNDTIRDSSGHNTFLFSGPFGQDRIIGYQATDKLVFRDVDGSADYRDHAKVVGGDTVISFGADSVTLVGVVGLSGEGIVIG

SEQ ID NO: 1623 - DNA, 1100 bp, MORITELLA MARINA
ttatgtgcttttcctatcctcaacgcgtatcactttgataaatataaaaatggatatatataaatgataaaaaagatgagctttgttttagttagcattgcattactacttacactcctatatgtgatcacgccaatatcaacattatttcaatacatgattaatgcagagaggagtatctcaggactaagattgcataatcttaaaacggatggtctggaaattgagtatcttcgtgggggaagtggaacaccactaattttgcttcatggttttggtgctgataaagataactggaacagagcttcaggatatctcactgagagctttgatgtggtcgcaattgacttacccggattcggaaacagtacggataatattaatcttgattatgatgtgttttcgcaagtttctaggttgaagaaaatcttagacattctacaaattaaagaatttaatctagctggcagctcaatgggagggtatattgctggaaatttttcggctcgataccctgagcgagtaaaaaacctttggctaataagtccattcggtgttgttggttcagaaaagagtgagatgttctctgcaataaaaaatggtcataatccaatggttttacccagaacagagttagagttcattcaattactcgatttcttatttgttgaacgtccttttattccagaacctatagtaaaacatttagcaacgaaagctgaaaaaagaagagaattaaatacaaagatttacgaacaaattcatagaatgaagaatagagaagcacaccccgagtcaccacttgatgaagttttaaaaaactacaaaggacccgttttagtttcatggggtcataaagatcgagttttacatgtctctggagcaaaagtcttaaagaaaattattccacaagcacaaattaacattatggcaagtgttgggcatttacccatgatagagaaccccaagggaactgctaattcttttttaactttcgcattaaaaccataaagcgcataacaagttgctcaaacggaaaagtaacagttggccatcgctgtgcgattatagccaaccattattttccgcttagcaaagcg

SEQ ID NO: 1624 - protein, 315 aa, MORITELLA MARINA
MIKKMSFVLVSIALLLTLLYVITPISTLFQYMINAERSISGLRLHNLKTDGLEIEYLRGGSGTPLILLHGFGADKDNWNRASGYLTESFDVVAIDLPGFGNSTDNINLDYDVFSQVSRLKKILDILQIKEFNLAGSSMGGYIAGNFSARYPERVKNLWLISPFGVVGSEKSEMFSAIKNGHNPMVLPRTELEFIQLLDFLFVERPFIPEPIVKHLATKAEKRRELNTKIYEQIHRMKNREAHPESPLDEVLKNYKGPVLVSWGHKDRVLHVSGAKVLKKIIPQAQINIMASVGHLPMIENPKGTANSFLTFALKP

SEQ ID NO: 1625 - DNA, 2730 bp, Staphylococcus xylosus
aaaatacattttggaaaagatagaaataaattatttatgctatggtactacttaattaaatttattttaccagtagttatcgtgttgatattcatagtgcaacttatatagcattaaaaattctcgttctaaacgctgcgagaattttttaattgtgcgtaatttagttgtaatcggttattgactagaagtagtttttttagtagaatctaattaaattatttattgaaagtttttagttgttaattatagatattttttaataatttactgaaaattcttttgataaataaaatttttctcaatgaatgtaagcgctttctttgggaaggggtgagtggtatgaaagcttttataggtaaattttttgaactattaccgcgttttatcattaactttttcatctagtttttccttttagttaaattgtgttttaaaaatcaagaaaatttagaggtgttgtatatggagaataaacgaaataagtatagtatacgtaaatttgctgtcggcgcttcttcaattttaattggctcgttattatttttgaatgtagagactgtaaaagctgctgaagaaaataatcaaagtgaagtggacacacaagtacaaagtgggaatcatttgggagatgatgaacatcaaaatttagtgaatgacaatacaaatacaccggttaatgatgataaaacacaagtgaatgatgaaaaagacaatcaagcaactcatactagcttacataaagatcaacaagatacgaatactaaagttaacgactcaacagataaagtagatccggaatttaatgaagcagataaagataaagagcaagaccaagcagaagtagatccagaatataatgcaaaagataaagcgaaagaacaagatcagtcagaagtagatccagaatataatgcaaaagataaagcgaaagaacaagatcagtcagaagtagatccagaatataatgcaaaagataaagcgaaagaacaagaccagtcagaagtagatccagaatataacgcaaaagataaagcgaaagaacaagatcagtcagaagtagatccagaatataacgcaaaagataaagcgaaagaacaagatcagtcagaagtagatccagaatataacgcaaaagataaagataaagagcaagaccagtcagaagtagatccggaatataacgcaacagataaagcgaaagaacaagatcagtcagaagtagatccggaatataacgcaacagataaagaacaagaaaatcatgtagatcataaagatgctaatcaaaataaaatgctagaaaacagtcagcccgcattaaatgagcgtgttaaaaatgataataatataaaagagagcacatctttcgataaattaccgaatcaaactgcaaaccacgattctgaacaagatgatgacagtaatcctgacaaagcattaaatacgttgaaagaaaatgctgtagcaacgccgaagaaccaaacgcaacaaaatgtagaaaaagcgaatgaacaacctaataaagctgcaaaacaaggacagtataaaaaccaagatcctatcattttagtgcatggtttcaatggctttactgatgatattaatccagcggtattagctcattattggggtggagataaattgaatatccgccaagatttagaaagtaatggttatgaaacatacgaagcgagcgttggtgcattaagtagtaactacgatcgtgccgttgagctttattactatattaagggtggcacggtagattatggtgcagcccatgctgagaagtacggtcatgaacgttatggtaaaacatatgaaggtgtatataaagattggcaaccaggtaaaaaagttcacttagtggctcatagtatgggtggacaaacagtgagacaacttgaagaattattgcgtaacggtaatcaagaagaaatagaatatcaaaaagaacatggcggtgagatttctccactattccaaggcaataacgataatatggtgaattcaattactactattggtacgcctcataatggtacacatgctgcagatgcattaggtaatgaggcgatagttagacaattagcatttgattacgccaaattcaaaggtaataaaaactcaaaagtagattttggttttggccagtggggtcttaaacagagagaaggagaaacgtacgctcaatacgtacaacgcgttcaaaatagcggattatggaaaacagaagacaacggattttatgatttgactagggaaggtgctgctaaattaaataaaaacacatcgttaaaccctaacattgtctataaaacatacactggagaatcaacaagacctactttgtttggcaatcaaaaatccgatgttaatttgttcctaccatttactgtaacgggtaatgtaattggcaaagctgcagaaaaagaatggcgtgaaaatgacggcttagtctctactatttcatcacaacatccatttaatcaagcctttatagaagctacggacgaagtgaaaaaaggtgtatggcaagtgactccaattaaacacggttgggaccatgtagattttgttggtcaagattctactgactcaaatcatcctactgaggagttacaacagttttggcacaatttagcagaagatttagttcgtaacgagcaatttgatgcttaaataaaaattgaattataataagggaggtaatgattatgactggag

SEQ ID NO: 1626 - protein, 739 aa, Staphylococcus xylosus
MENKRNKYSIRKFAVGASSILIGSLLFLNVETVKAAEENNQSEVDTQVQSGNHLGDDEHQNLVNDNTNTPVNDDKTQVNDEKDNQATHTSLHKDQQDTNTKVNDSTDKVDPEFNEADKDKEQDQAEVDPEYNAKDKAKEQDQSEVDPEYNAKDKAKEQDQSEVDPEYNAKDKAKEQDQSEVDPEYNAKDKAKEQDQSEVDPEYNAKDKAKEQDQSEVDPEYNAKDKDKEQDQSEVDPEYNATDKAKEQDQSEVDPEYNATDKEQENHVDHKDANQNKMLENSQPALNERVKNDNNIKESTSFDKLPNQTANHDSEQDDDSNPDKALNTLKENAVATPKNQTQQNVEKANEQPNKAAKQGQYKNQDPIILVHGFNGFTDDINPAVLAHYWGGDKLNIRQDLESNGYETYEASVGALSSNYDRAVELYYYIKGGTVDYGAAHAEKYGHERYGKTYEGVYKDWQPGKKVHLVAHSMGGQTVRQLEELLRNGNQEEIEYQKEHGGEISPLFQGNNDNMVNSITTIGTPHNGTHAADALGNEAIVRQLAFDYAKFKGNKNSKVDFGFGQWGLKQREGETYAQYVQRVQNSGLWKTEDNGFYDLTREGAAKLNKNTSLNPNIVYKTYTGESTRPTLFGNQKSDVNLFLPFTVTGNVIGKAAEKEWRENDGLVSTISSQHPFNQAFIEATDEVKKGVWQVTPIKHGWDHVDFVGQDSTDSNHPTEELQQFWHNLAEDLVRNEQFDA

SEQ ID NO: 1627 - DNA, 2614 bp, Staphylococcus warneri
actttatctattaaacttctaaaattttttctagctattgagtacgatactattgccataatctgtacctccttttaataaattgtacaaaaacctgtacaataagttgcgtgtattgttgctcacacgtccctttgtttgatggaactttaagaagttgtaaagagaaatttatattacgttcataatcttaatttatgatgggggtgtcgtcggattttctgaaatacattgttaatctgtcggcatttcattttaaatgttgctcataatccagatttaacagatagaggtgctaataacatgaaaaacagaaagaattcttatagtattcgtaagttaagtgtaggtgcatcttccatcatcgttgcatctatgttatttgttggagcggaatctgcacaagcagcagaaactgaatcacaagatcaaactactgtacaaaatgttaaagaaacaactgaatcatctaactctaatcaaacgcaacaacaaccttcagaaccaacaaaagcgaaagattctgatacaaataatacgaatgttgaacgtcctgaatcgaattcgacacaaacatcaaatcaagacactgacaaaatgcaggatacatcaactaatcaaacaaacgaaaattctaaacatattattgataaaactaatgacgtttcacatgaaactacaaagacaaatgatacagatcaaacgtcatctcaagacaattcagaacaatctcttgaagtcgactcaaatgaggcaccagcttcaaatgacaaatcaactccaaccaaacaagaacctactaattcaaagcaagatattgatgaaacatctaaacctaatgaagattcaaaacttgtaccatcaaagtcaaatataacatctaaagcagataaacaagaacagtcttctaaagaacctgttgaggataatgctcaaaaagataaacatgtatcacaagaagattcatctttagaaaagcaaggtacacaagaggtcccgcagactgacacacataaagatgtcaatgtaacaccttcaaagtcatcatcagaacaacaactatctacaacacaacacattacagctaaagattctagtgcttcacaagaggtgccagttcattcactagattcatctaaacaagatcacacaacatcgactgagagccatatcaatttagataacctagataaacaagcgactaaagatcgtacacctacagataatggcgatgatcagtctaaagatggtctaaatacattaactaaaaatgcggtagccatatataacaacaaatccaaagcacaggctactcaacctactaaagatcagacgaataaggtagcgcctcaacaacaatataaaaatcatgaccctattatacttgtacatggatttaatggttttacagctgataatggacctggtttaggagatagtaattattggggtggcgaacgtcttaacatcacacaagaagcacgtgcaaaaggttataacgtgagtgaagctagtgtaagtgcattaggtagtaattatgatcgtgcggttgaattgtactactatatcaaaggtggcactgtagattatggtgcggcacatgcagctaaatatggtcatgaacgttatggcaagtcttatgcaggggcctatagagattggaaaccaggccagaaaatccatttaattggtcatagtatgggtggacaaactgttcgtttattagaggaaatgttacgtaatggaaatcctgaagaaatcgaatatcaaaagcaacatggtggtgagatttcaccgttatataaaggtggacaagataacatgatttcttccattactacgttagcgtcacctcataacggtacacacgcctctgatttactaggtaatgaagcgattgtaagacaagctgtttatgattttgcgaaatcacaaggtaataaattctctcgtgccgatcttggtttaactcaatggggattaaaacagagacctgatgaaacctatatagactatgtaaaacgcgttgaaaatagtaacttatggaagacaaaagataatggattctatgatttaacaactgaaggtgcacaagagttgaataatcatacgtcactcaacccaaatatagtttataaaacatatactggcgaatcatctgacccagataaaaaaggtatccatcatcgtaatagtcatatgaatattaaatatttaccaactacaaatgtgattggtaaattagacgatcaagcttggcgagaaaatgacggcctagtatcagtagtttcggcacaacatccatctaatcaaaaatatgtcgatgctacagatcaaattcaaaaaggcgtatggcaagtcacacctgtccaacacgattgggaccatggcgactttgtcggaacacaaaaagatgaaaacggcatctcaatcgagcaattccaaggcttttgggataacctattaaacgatgctataagaaacgaaaaagtgactgattagtagtgtgagttgtagaaagtcatcatatataaaacaaatgccaatccacctatcattaaaggtgaattggcatttttactattttgcaaagaggactattctttaatttgat

SEQ ID NO: 1628 - protein, 732 aa, Staphylococcus warneri
MKNRKNSYSIRKLSVGASSIIVASMLFVGAESAQAAETESQDQTTVQNVKETTESSNSNQTQQQPSEPTKAKDSDTNNTNVERPESNSTQTSNQDTDKMQDTSTNQTNENSKHIIDKTNDVSHETTKTNDTDQTSSQDNSEQSLEVDSNEAPASNDKSTPTKQEPTNSKQDIDETSKPNEDSKLVPSKSNITSKADKQEQSSKEPVEDNAQKDKHVSQEDSSLEKQGTQEVPQTDTHKDVNVTPSKSSSEQQLSTTQHITAKDSSASQEVPVHSLDSSKQDHTTSTESHINLDNLDKQATKDRTPTDNGDDQSKDGLNTLTKNAVAIYNNKSKAQATQPTKDQTNKVAPQQQYKNHDPIILVHGFNGFTADNGPGLGDSNYWGGERLNITQEARAKGYNVSEASVSALGSNYDRAVELYYYIKGGTVDYGAAHAAKYGHERYGKSYAGAYRDWKPGQKIHLIGHSMGGQTVRLLEEMLRNGNPEEIEYQKQHGGEISPLYKGGQDNMISSITTLASPHNGTHASDLLGNEAIVRQAVYDFAKSQGNKFSRADLGLTQWGLKQRPDETYIDYVKRVENSNLWKTKDNGFYDLTTEGAQELNNHTSLNPNIVYKTYTGESSDPDKKGIHHRNSHMNIKYLPTTNVIGKLDDQAWRENDGLVSVVSAQHPSNQKYVDATDQIQKGVWQVTPVQHDWDHGDFVGTQKDENGISIEQFQGFWDNLLNDAIRNEKVTD

SEQ ID NO: 1629 - DNA, 1921 bp, PSEUDOMONAS SP. UB48
cgccacaggttacggacgcatcaggcgatcacgattccatcagcactgaggctattgagcgccaccccgaccagcgtcaccgagtcaccgccaaacttcagcaccgtgtcctgccccaccatcgaggcatgcgcgcggaagtcgtcattgggcaacaccccctgcacaccgaggaacaccagtttgtcgttggccgtaaaaccgaccacccggtcctgaccgaacgcgccgttgaacaggaacgtatccgccccgccccccgactccatcaggtcattgccggcgccaccgacaaacacgtcgttaccggcgccgccgatcaagtggtcattgccgtccaggccgaacagccagtcaccgccagcatgtgccttgagcgtgtcggcgccgctgctgcctttgacgctggactcgtactgcgtgacgttattgccgaccttgaggccgccggccgtcacgctgtgggtcacgtcgtccttgaacaggccccagagaaagcccggttccttggtgacgatgctgccgatgtcacgggtaatgctgatcccgccgttggcgtcacgaatgtacagattgccggcgccgtcgttggcgaagtcgaacttgctcaccgattgctgcaagtcgagggtgttgttgccggcgccgccgaggatgacgttgtagccgccaccgtcacggaaggtgtcgttgccggcgcgtccctcgaggtagtcgttgccgctgccgccctgaatcaggtcgttgctgtcgctgccaatgatgaacgtgctgcccttgtgggtttcggcgttgcggttgaggtcctgcacccaggtattggcccgcgccgggtccgacaggttggcgacgatgatcgtcgagtctttgctggtgaggtcgtagaacttcgactcgatgatgcggttcatgccgtcgccgtacgcggtcggcaggtgcgagatccaggtggggatgttgaggatggagaacggcagcagattccacgcggtcgaggcgtagtgatcgttaaagctgacgatgttatcggtggccgattccttgggcgcgtcgtgcacgccgatcgaggcgccggtgaaggtcgagccgtcgagggcgcggaacaccggatcgttttcgtaaccgacgttgagcaccttgtcggtgctgctctgggtgggcgaggcgtaggcgatgtagttggaatcggcgaagaacccgccccacttgccgccgctgaggtcggccatgctgttgaccgccagcccgccgaggctgtggccgctgacgaggacatccttgccgctgaggccgttggccttggcgaacgccaccacatcgctgagcagattgccgaacgcttcaccgacgtagttcttggcgtaatccttgggaccgaaagccgccagcaggtcgttgatcacgtcaccgatggagtcgaggatcaggttttcccgcgggccgctggtgccgcgaaaggcaatgccgatttccgtgagatggccctgggcgtcgtattttccgaggatttccacttgggcggtggtgtaaccggccttctcgccgaagaaggttccccgggcgtcggtcttgccgtcgtagcccagttgcgaggcggtgatcggcgtccagccagcctttttcacggcgtcgagggcgagtttttccgagtcggggttccacggaataccggggatcacgccttgcgaatccgtgccgccgagcagcgctgtcaccagcgtggccggcaggccgaggccgaagccgttgtgctgataaccgctggcaaagccgttatcgaggttgtgatacgaatacagcgtgatcgccatggcatcgctgaacaatgccttggaatcggctgtgccgaagttcttgtagtcatacacacccattgctattgcctctcttttgttggaattgtcagagatagctcacagcc

SEQ ID NO: 1630 - protein, 617 aa, PSEUDOMONAS SP. UB48
MGVYDYKNFGTADSKALFSDAMAITLYSYHNLDNGFASGYQHNGFGLGLPATLVTALLGGTDSQGVIPGIPWNPDSEKLALDAVKKAGWTPITASQLGYDGKTDARGTFFGEKAGYTTAQVEILGKYDAQGHLTEIGIAFRGTSGPRENLILDSIGDVINDLLAAFGPKDYAKNYVGEAFGNLLSDVVAFAKANGLSGKDVLVSGHSLGGLAVNSMADLSGGKWGGFFADSNYIAYASPTQSSTDKVLNVGYENDPVFRALDGSTFTGASIGVHDAPKESATDNIVSFNDHYASTAWNLLPFSILNIPTWISHLPTAYGDGMNRIIESKFYDLTSKDSTIIVANLSDPARANTWVQDLNRNAETHKGSTFIIGSDSNDLIQGGSGNDYLEGRAGNDTFRDGGGYNVILGGAGNNTLDLQQSVSKFDFANDGAGNLYIRDANGGISITRDIGSIVTKEPGFLWGLFKDDVTHSVTAGGLKVGNNVTQYESSVKGSSGADTLKAHAGGDWLFGLDGNDHLIGGAGNDVFVGGAGNDLMESGGGADTFLFNGAFGQDRVVGFTANDKLVFLGVQGVLPNDDFRAHASMVGQDTVLKFGGDSVTLVGVALNSLSADGIVIA

SEQ ID NO: 1631 - DNA, 1318 bp, PSYCHROBACTER SP. STL
tctaaatcaaccgtgttatcaatcaatgcgctattaaataaagcgctgatgacgataaagctcgcatcaacagatcgtatagataatgatataagagaagaaaatggcactcaagagaatcgtttgaccgtcaaacaaaaagtgcttagctataacccgttgacgacttgccagccgcataccttgcactatgccatgaaaggagtcggctatctgcctacgccactattagagagcttggttggttatttgaaaggacctagctcaaaacaatatctgcatgccgatgctcacctgcgtttgattctcgcggtgaatagtaagcttgtgcattgggaagacaaagtgattgccaacgctgatgatggcgatatgaccattcgctgttatcaatcagacgcgagctctcatggcttagggttcaaaaaagcggatactcataattctgatgaaacagtgttgttatattttcatgggggtgggttttgtattggtgatgtcaatacccatcatgaattttgccacgcggtttgtgaacagactggctggccgatagtcagtgttgattatcgcttagcacctgagcatccagcaccagccgcattaaaagactgtatcactgcctatgcttggctggctgagcattgccataccttaggtgctttaccctcgcgaatcgtactagcaggcgatagtgctggcggcggattatccaccttaattgctcaacaactcagtgcgccctcgcaagtcgcatggtcagatctgggcagtgcaggtcaaaaaatgttcgatttattagagcgcttaccaaagccgcttgcacaaatgcctttatatcctgtgacggatatcgaaacggattatccaagttgggaattatatggcgagggattattattggatcatgccgatgtggctgtatttgatgccgcttgtttagataacagccccttgccacgccagcatatccttaactgtccgatgcttggtgataatagtaaagtatgcccgacttatattgtcgctgcagaattagacgtattacgtgatgaagcatttgcttatgcaaagcaattaaaggtgcatgggatagcagtcaagactcataccattcttggtgcgccgcatggttttattcattttatgagtattcatcaaggtatcggacaaaaaacaggcgatattattaaagggtttgcgagctttgtgcgtgacgttatcaatacccagtcacaattagcggcataattatcaacacagttgtataagaaagtgctggttcatttataaaatagaatggcactgccactattta

SEQ ID NO: 1632 - protein, 400 aa, PSYCHROBACTER SP. STL
MTIKLASTDRIDNDIREENGTQENRLTVKQKVLSYNPLTTCQPHTLHYAMKGVGYLPTPLLESLVGYLKGPSSKQYLHADAHLRLILAVNSKLVHWEDKVIANADDGDMTIRCYQSDASSHGLGFKKADTHNSDETVLLYFHGGGFCIGDVNTHHEFCHAVCEQTGWPIVSVDYRLAPEHPAPAALKDCITAYAWLAEHCHTLGALPSRIVLAGDSAGGGLSTLIAQQLSAPSQVAWSDLGSAGQKMFDLLERLPKPLAQMPLYPVTDIETDYPSWELYGEGLLLDHADVAVFDAACLDNSPLPRQHILNCPMLGDNSKVCPTYIVAAELDVLRDEAFAYAKQLKVHGIAVKTHTILGAPHGFIHFMSIHQGIGQKTGDIIKGFASFVRDVINTQSQLAA

SEQ ID NO: 1633 - DNA, 1412 bp, Pseudomonas fluorescens
ggtaccgaggactccaaggcgttgttcgccgatgccatggcgatcacgctgtattcctaccacaacctggataacggctttgccgtcggctaccagaacaatggcctcgggctggggttaccggccaccctggtcagcgcgctgattggcggcagcaatgcccaaggggtcatccccgggatcccctggaaccccgactcggaaaaacccgcccttgaggcggtgcaagcagccggctggacgcccatcagcgccagtaccctgggctatacggcaaggtcgatgcacgcggcacctactttggcgaaaaattcggctacggcacggcgcaggccgaggtgctgggcaagtacgatgacgctggcaactgctggaaatcggcatcagtttccgcggcacttcagggcctcgggaaagtgtgatcaccgactccatcggcgatgtgatcaacgacctgctcgccgccttcgggcccaaggattatgccaagaactacgcgggggaggcttttggcgggttgctcaaagactggcggatacgccactgccaggcctgggcggcaatgacgtagtggtcagcggccacagcctgggcggcatggcggtcaacagcatggccgacttgagcgacagtacttggtcggggttctataaagacgccaattacctggcctacgcatcgccgacccagagcgccggcgacaaggtgcttaacgtcggttatgaaaacgatccagtattccgagccctggatggctcgtcattcaacctgtcgtccctgggcgtgcacgacaaggcccacgaatcgagcactgacaacattgtcagtttgaacgatcactacgcctcatccctgtggaacgtgctgccgttttccatcctcaacctgcccacttgggtttcgcacttgcccaccggttacggtgacggcatgacccgtatcctcgactcggggttctacgaacagatgacccgcgactccacggtgatcgtcgccaacctgtccgacccggcacgggccaccacctgggtgcaagacctcaaccgcaatgccgaggcgcacaagggcaataccttcatcatcggcagcgacggcgacgacttcatcaaaggcggcaggggcgcggactttatagaaggtggcaagggcaatgacaccatccgtgacagcagcgggcacaacacgtttttgttcagcgggcagtttggcaatgaccgggtgattggctaccaggcgacggacaagctggtgttcaacgacgtggcgggcagcaccgattaccgcgatcacgtcaaggtggtgggcggggatacagtcattggctttgggacggattcggtgacgctggtgggtgtgagcagtctgtcgggggaggggatagtcatcagctaacgcattcggtgtgggagccc

SEQ ID NO: 1634 - protein, 451 aa, Pseudomonas fluorescens
MAITLYSYHNLDNGFAVGYQNNGLGLGLPATLVSALIGGSNAQGVIPGIPWNPDSEKPALEAVQAAGWTPISASTLGYTARSMHAAPTLAKNSATARRRPRCWASTMTLATAGNRHQFPRHFRASGKCDHRLHRRCDQRPARRLRAQGLCQELRGGGFWRVAQRLADTPLPGLGGNDVVVSGHSLGGMAVNSMADLSDSTWSGFYKDANYLAYASPTQSAGDKVLNVGYENDPVFRALDGSSFNLSSLGVHDKAHESSTDNIVSLNDHYASSLWNVLPFSILNLPTWVSHLPTGYGDGMTRILDSGFYEQMTRDSTVIVANLSDPARATTWVQDLNRNAEAHKGNTFIIGSDGDDFIKGGRGADFIEGGKGNDTIRDSSGHNTFLFSGQFGNDRVIGYQATDKLVFNDVAGSTDYRDHVKVVGGDTVIGFGTDSVTLVGVSSLSGEGIVIS

SEQ ID NO: 1635 - DNA, 3256 bp, Staphylococcus haemolyticus
catatgaaagacctgttaaagtaagggtcaacacagtagttaaaataacgattgttaagattttttctttaaacgatacaggtttcaatccaataaatacagttaaggtaaagaaaaataaacttgctattaaatagaagataaaaagcttaaatataaaaccacttggattattgaataactcttgatattgatccatgaaaggaactccttaaattagaaagatattttcaatataacaaacataaccattagttatctaatttatcaatctatatagtataaaattaataaaaaactttaccaaaatgtaaataaaaaattaaagatgtttaaggattatatgataaaattaattaacagttatttttttgaatctataagtgagggaaatacttatagaggtgattttttgaaaaataataattctaaaagacagtttagtattcgaaaatttacaataggtgttgtatcaattgtagctggtattacattttttgtttcagaacatgacgttcaagctgctgagcaacaatcctcccacttatcacaagaatcagttctttctcactcaaagccttccgaccaagatgctaatgtgtcttcaaaagaatcggaaatcgacaaaaatattaataaagtagacgacgcgcagtcttattctcaacaaaatgagcaacaatcctcaaaagccgaaaataaggaaatacagaattcaacacaagcagaacaagttgaaaaacaggaacaacctgcttctaatcagacggctaatcactcttcaaaagagtcctccattaataatcaggaaagtcataacaaacagcaacctagtgatgacaaaacacctaatatcaaaccagaaaaaattgaaaaagtagataatcataagcgtattcaagatcagtatcaagataaaaacaagcaggttgataataatcaatctaacaattcgcaattaaaccaaaaagaacatcccaattcatcaaataataaacaacaaaagcaacgtctagatgttaaaccacaaaacgataaccaacaattacaatctcgaaatgatgtaaaagaaaaattagataaccagccaattgagcaaaaagataccaagctgcaaagtaacaataaaagcaaagacaacacaacttctgtaaagtcacacagccaacaacataaaccgcattcattaaagacccaatcccatttaactccaggtcaaaaagttaacacaaatatttctactaacccaacacaacaacaaactacaaatcagaatattaaacctaaaaatacagatgaagctactatcaaaagtaatcaatataaaaacaaatatccggtagtgctagtacatggatttttaggtttagtgggtgacaatgcaccagctttgtatcctaattattggggtggtacgaaattcccagttaagaaacgattagagaaactaggttatgacgtgcatgaagcgagtgtcggtgcttttagtagtaactatgaccgcgctgtagaactgtatcattatattaaaggtggaaaagtagattatggtgcagcacatgctgctaaaacgggacatgatagatatggtaaattttatcaagggattatgccagattgggagccaggtaaaaagattcatttaataggtcacagcatgggcggtcaaacgatacgtctgcttgagcattttttaagacatggtaatcaagaagaaatagattatcaaaaagcacatggtggtgagatttctcctttatttacaggtgggaaagataatatgatttcatcaatcacaactttagcgaccccacataatggcacaccagctgcagataaacttggtaatactgattttgtaaaggtgtatttaataagaataggtcgcttaagtggaaataaatattctcatattgatctcggattttcacaatggggattcaaacaacgtccagatgaaagttacattgattatgtgaaacgagttgcaaatagtaagatttggaagactcaagatagtgcagtctatgatttgacgactgaaggttctgagaagctaaatcagatgacatcaattaatcctaatattgtttatacatcttatacgggactagatacacatacaggaccattaggtaatgagaatcctaatattagacaatttttcttatttgatttaacaagtaggttaattggtagagatgataatgtaaatgtaagaaaaaatgacggtattgtgccagtgtcatcttcattattccctacaaatcaagccgctaagacggtagggatgacttccccaactacagataaaggtatctggcaggtcaaaccagtgatgaatggttgggatcatttagattttgtgggattagatgcaacagattataaacgtataggtgaagaattaagtcaattttatttaggaattatcaataatttaattagaattgaagacatagatggtataaaacattaaaaaaacagtgtgtgctcaatattgggcacacactgttctactttatttattgtttttcatcacgacgttttaagacataggcgccaccaagtaatccgattgggataccggctatcggtgttaaggcgctacttaatactataacgattaacgtcaacataatgacgttgaaaacattaacgtttaaatttttcaaatcctcgtatgattgtttaattaaatctttaaatttcaatgataaatttctccttatattttttatttaaataatgactaaatggcttttttaataactcgactagaatgtaagaatcctattagtgcgaatgcaaagtagacaatcgtgtacacaatcatcacgataatgatggtagtgtatgacacgtttcccattaatttcataaaagcaattgcagcaaataaagcatgtaataatgcgataatgagtggtaggccaaagttgaaaatgatttttaaagttagcccttttaacatgtcacgatgagtaaagcctatgcgatttaatatacggaaatgatcaatttcatcttcagtttcatctatctgtttaacataaataatacaacccgcagcaattaaaaatgataaaccgaggaatgatgtaacaaatactaaaataccattggtcgcatctaagtcctttttaatttcattttgtgattgaatattaggatcaattgatcttgcaatgtgtgtggcttgtttcatatcttgatgatggtcaagactaataccgcatatattgtgtgtgatatc

SEQ ID NO: 1636 - protein, 711 aa, Staphylococcus haemolyticus
MIKLINSYFFESISEGNTYRGDFLKNNNSKRQFSIRKFTIGVVSIVAGITFFVSEHDVQAAEQQSSHLSQESVLSHSKPSDQDANVSSKESEIDKNINKVDDAQSYSQQNEQQSSKAENKEIQNSTQAEQVEKQEQPASNQTANHSSKESSINNQESHNKQQPSDDKTPNIKPEKIEKVDNHKRIQDQYQDKNKQVDNNQSNNSQLNQKEHPNSSNNKQQKQRLDVKPQNDNQQLQSRNDVKEKLDNQPIEQKDTKLQSNNKSKDNTTSVKSHSQQHKPHSLKTQSHLTPGQKVNTNISTNPTQQQTTNQNIKPKNTDEATIKSNQYKNKYPVVLVHGFLGLVGDNAPALYPNYWGGTKFPVKKRLEKLGYDVHEASVGAFSSNYDRAVELYHYIKGGKVDYGAAHAAKTGHDRYGKFYQGIMPDWEPGKKIHLIGHSMGGQTIRLLEHFLRHGNQEEIDYQKAHGGEISPLFTGGKDNMISSITTLATPHNGTPAADKLGNTDFVKVYLIRIGRLSGNKYSHIDLGFSQWGFKQRPDESYIDYVKRVANSKIWKTQDSAVYDLTTEGSEKLNQMTSINPNIVYTSYTGLDTHTGPLGNENPNIRQFFLFDLTSRLIGRDDNVNVRKNDGIVPVSSSLFPTNQAAKTVGMTSPTTDKGIWQVKPVMNGWDHLDFVGLDATDYKRIGEELSQFYLGIINNLIRIEDIDGIKH

SEQ ID NO: 1637 - DNA, 14988 bp, Pseudomonas fluorescens
ggatccattcctcgcaaaaccactttagcggtatttaatatttaaatagttgtctttttataagtcgctactagccagcgtttgcaggaattgttcgccgcgccatgttttgccctgcaaaaatagcgctggacgaatgatttcaagttgtgtcagttttctttcgccttcaaaaggggcgagtgataggacttactcgccagagtgggttctatcggacaaaaactgttccacttgcaaacaaggaagtacgtttatgtcaaaagtaaaagacaaagctattgtatcggcggctcaagcaagtactgcctatacgcaaatcgatagctttagccatcaatatgaccgcggcggtaacctcacggtcaatggcaaaccctcgttcaccgttgaccaggccgcagaccacctgctgcgtgagaacgccgcgtatcgggacgtggatggcaacggcaagatcgacctcacctacaccttcctgacttcggcttccaacgcgaccatgaacaaacatgggatcaccgggttcagccagttcaacacccagcagaaagcacaggccgtactggccatgcaatcctgggcggatgtggccaatgtcaccttcaccgagaaagcctcgggcggtgatttccacatgaccttcggcaactacagcggcggccaggacggcgcagcagcctttgcctacctgccgggcaccaacgccaagtacaacgaaagcggccttgatggcacttcctggtacctgaccaacagcagctacacgccgaacaaaaccccggacttgaacaattatggccggcagaccctgacccacgagatcggccacaccctgggcctggaccaccctggcgactacaacgccgggaccggcaacccttcgtacaaagacgcggactatggacaggacacgcgtggctacagcgtcatgagttactggagcgagagcaacaccaaccagaacttcagcaaaggcggggtagaggcttactcgtccggcccgctgatcgacgacatcgccgcgatccagaagctctacggcgccaactacaacacccgcgccggcgacaccacctacggcttcaactccaacaccgggcgtgatttcctcagcgccacttcatcggccgacaagctggtgttctcggtgtgggacggtggcggcaacgacaccctggacttctccggttttacccaaaaccagaagatcaacctcaatgagacctcgttctccgacgttggcggcctggtgggcaacgtttccatcgccaagggcgtgaccgtggagaacgctttcggcggttcgggcaacgacctgctgatcggtaacgccgccgccaacatcctcaagggcggtgccggcaacgacatcatctacggcggtggcggtgcagaccagttgtggggcggcgcaggttcggacactttcgtgttcggttccagctcggattccaagccgggtgcggccgacaagatcttcgacttcacctcgggttcggacaagatcgacctcaccggcatcaccaaaggtgcaggcctgaccttcgtcaatgccttcaccggtcacgctggcgatgcggtgctgtcctacgcctcgggtactaacctgggcaccttggccgtggacttctccgggcacggagtggcggatttcctcgtcaccaccgtcggccaggcagcggtcagcgacatcgtggcctgatatacgggtaaaggagggcggcgcgcacgcgctgccctctgcccttgcgtccaccccttgaacgggcgatggtgatgacgttatttcgcactacagtggcctggtgtttccaggcaatgcttatgtcggcaggagcctcagcaatggcaagcagtctggttttacctacgtcggcgcaactggccgggcattgggcgctgcaccagcaggaacaggtgtgcgcgctggacttgatcgaacaagccaacgcgctcggcggggatgtagcgtgcgccggacaatggctgggggaagcgcccgttagttggacgccgactcccgacggtatttggttgatgaatgccgaaggcacgggcattacacatttaaatcgccagaaagaaggcgaatatgaagggcgctccaaatctggcgcggtgttgttattacaacgcgcaccttaatagttcgttataacgatataacccgattttaatgtttgcccgccctttaatgaggcgccgggcaaactattgcgcgtcattcggctcagggaagatcaggcaacatggcgaagaccactcccgttgcaccactgtttaaagcactcggtgattacaaaagtattctgatcagtattggctgcttcaccgcattgattaacgtattgatgctggtgccgtcgatttatatgttgcaagtctacgaccgcgtgctgtcgtcccagaacgaaaccaccctggtgatgttgacgctgatggtggtggggttcttcgcgtttatcggcgtgctggaggtgatccgcagctttatcgtgattcgcatcggtagccagttggagcggcgtttcaacctgcgggtgtacaaggccgccttcgagcgcaacctgcaacggggcgagggccacggcggccaatccctgggggatttgacccacatccgccagttcatcaccgggcctgcactgttcgcgtttttcgatgcgccgtggtttccgatttatctgtttgtgatcttcctgttcaacgtgtggctaggggtgttggccagcgccggggccgtgctgctgatcgggctggcgtgcctcaacgagtacctgaccaaaaagcccctgggcgaagccagcgggtattcccagcaatccacccaattggctaccagccacctgcacaacgccgaaaccatccaggccatgggcatgctgggggcgttgcgcaagcgctggttcaaggtgcattcgcagtttctgggcttgcaaaacaaggccagcgacaccggctcgatcatcagttccctgagtaaatccctgcgcctgtgcctgcaatcactggtgctgggcctgggtgcattgctggtgatcaagggcgacatgaccgccgggatgatgatcgccggttcgatcctgatgggtcgggtattgagccccatcgaccagttgattgccgtgtggaagcaatggagctcggccaagctggcctaccagcgcctcgacaacctgatgcgcgagttcccgccccagggcgaacagatggccttgccggcgcccaagggcaatgtgagtttcgagcaggtcagcgccggcccgcccgggcggcgtgtgccgaccttgcatcaggtcagcttcaacctggcggccggtgaagtgctcggcgtgctgggcgcgtcgggctccggcaagtcgaccctggcccgtgtgctggtgggcgtgtggcccaccctggcgggcaccgtgcgcctggacggtgctgacatccatcgctgggaccgtgacgacctcggcccgcatatcggctacctgccccaggacatcgaactgttcagcggcagcatcgccgacaacatcgcacgctttcgtgacgccgacccgcagttagtggtgcaggccgcccagcaagccggcgtgcacgaactgatcctgcgtttgccccacggctacgacaccgtgctcggcgacgaaggcagcggcctgtccggtggccagaaacagcgggtcgccctggctcgcgcgttgtatggcggcccgcggctgatcgtactggatgagcccaactccaacctcgacaccgtgggcgaagccgccctggccagcgcgatcatgcagatgaaggcccagggcagcacggtggtgctggtgacgcaccgctcctcggcgttggcccaggccgacaagctgctggtgctcaacgaaggccgcttgcaggccttcggacccagccaggacgtgctgcgggcactgtccggccagcaggaagcaccgcgagaaaaggccggggtcagcctcagccgtcagtatcaagccggaaggaatccaggcgcatgagcagcgacagcagcattcaaatcaaccgcgattacgaacagactcaccccgaacatggcgcacgtttctttgcccgcatgggctggctgctgacggtggtcggcgccggtggtttcttcctgtgggccagcctggcgccgctggaccagggcattccggtgcagggcaccgtggtggtctcgggcaagcgcaaggccgtgcaaaccctgagccccggagtggtcagccggatcctggtgcgggaaggcgaggcagtgaagcagggccagccgctgttccgcctcgaccagacgcaaaaccaggctgacgtgcactccctgcaagcccagtaccgcatggcctgggccagcgtggcgcggtggcagagcgagcgtgataaccagtcgacgatcacctttccggcggagctgagcggtaacccggatcaagccctggccttggttctggaaggccagcgccaactgttcagcagccgccgcgaagcctttgcccgggaacaggccgggattcgcgcgaacatcgagggcgccaccgcccaactcaacggcatgcgccgcgcccgcagtgacctgactgcccaggcccaatccctgcgcgaccagttgaacaacctgcaacccttggccgacaacggctacataccgcgcaaccggctgatggagtaccagcggcagctgtcccaggtgcaacaggacctggcgcagaacaccggcgaaagcgggcgggtggagcagggcattcttgaatcgcggctcaagctgcaacagcacagcgaggagtatcagaaggaggtccgcagccaactcgccgacgcgcaactgcgcagcctgaccctggagcagcaactgacctccgcggggttcgacctgcagcacagcgaaatcaacgccccggccgatggcatcgcggtcaacctgagcgtgcacaccgaaggtgccgtggtgcgtgccggtgaaaccctgctggaaatcgtgccccaggacactcgcctggaagtggaagggcgcttgccggtgcacctggtggacaaggtcggcacccatttgccagtggacatcctgttcaccgccttcaaccagagccgcacgccccgggtgccgggggaggtgagcctgatttctgccgaccagatgctcgacgaaaaaaccggcatgccgtactacgtgctgcgcaccaccgtcagcagcagcgccctggagaaactccatggcctggtgatcaagccggggatgcccgccgagatgtttatccgcaccggcgagcgctccttgctcaactacctgttcaagccgctgctggaccgcgccggctcggcgttgaccgaggaatgaacatgaaaccgatgttcatcgccttgctactcgcctgcagcagcgcccaggccgccatgggcccgtttgatgtctacgaacaggccctgcgcaacgacccggtgttcctcggcgccatcaaggaacgtgacgccggcctggaaaaccgcaccattggccgcgccggcctgctgcccaagctgtcgtacaactacaacaaggggcgcaacaactcccaggccaccttgcccgacgggcgcggcggtaattatcacgacgaccgcaactacaacagctacggctccaccttcaccctgcaacagccgctgttcgactacgaagcctatgccaactaccgcaagggtgtggcccaggcgctgtttgccgacgagagttttcgcgacaagagccaggcgttgctggtgcgggtgctgacctattacacccaggccttgtttgcccaggaccagatcgacattgcccgcgccaaaaagaaggcgtacgagcagcagttccagcagaaccagcatttgttccaacaaggcgaaggcacccgtaccgatatcctcgaagccgaatcccgttatgagctggccaccgccgaagaaatccaggcgctggatgagcaggacgcctcgctgcgggagctgggtgcgctgatcggcgtgcagagcgtcaacatcaacgacctggcgccactgaacccggggtttgccgccttcaccctgacgccggccaactacgacacctggcacgaactcgccctgaccaacaacccgaccctggcctcgcaacgccaatccctggaagtggcgcgctatgaagtggagcgcaaccgtgccgggcatatgccacgggtgacggcctatgccagttcgcggcagcaggaatccgacagcggcaacacctacaaccagcgctacgacaccaacaccattggcgtggaaatcagcatgccgctgtatgccggtggcggggtctcggcctccacccgccaggccagccgcgccatggaacaggccgagtacgagctggaaggcaagacccgcgaaaccctgatcgaactgcgtcgccagttcagtgcgtgcctgtcgggcgtcagcaagctgcgcgcctaccagaaggccctgacctcggccgaagcgctggtggtgtcgaccaagcaaagcatcctcggcggcgagcgggtcaacctcgatgcgctgaacgccgaacagcagctgtacagcacccgtcgcgacctggcccaggcgcgctacgactacctgatggcctggaccaaattgcattactacgcaggcaacttgcgcgacaccgacctggccaaggtggatgaggcgtttggccccgaacattgagcacacccataaaaacaacaagggacggtttagatgatcaccgattcacctcgcttcaaacccttcaccgcaggctccttgctgctgctgtccgtggcggcccacgggcagtacctcgaagccggcaaaccgggcgatcccgccagttggcgttcgaccgagttccagagcgactggggcctggaccgcatgaaagccaacgaggcctacgcggccggcatcaccggcagtggcgtcaagatcggcgcgctggactcgggttttgaccccaaccatcccgaagcctcaaaagaccgttatcacgcggtcaccgccagcggtacctacgtcgatggcagcccgttcaacaccaccggcgccctcaaccccaacaacgactcccacggcacccatgtgaccggcaccatgggcgcggcccgtgatggcgtgggcatgcacggcgtggcgtacaacgcgcagatctacgtcggcaacaccaatgccaatgacagtttcctgtttggccccacaccggacccccagtacttcaaggcggtgtacagcgccctggtggattccggcgtgcgtgcgatcaacaacagctggggcagccagcccaaggatgtcagctaccagaccctgggcgacctgcacgcggcctatgcccagcactacaaccagaacacctggctcgacgccgccgccgatgtggccaaggccggggtgatcaacgtgttcagcgccggcaacagcggctatgccaatgccagcgtgcgttcggccttgccatattttcagcctgggctggaaggccactggctggcggtgtcgggcctggacaaggcgaataaccagaaatacaaccagtgtggcatcgccaagtactggtgcatttccacgccgggagcgttgatcaacagcaccattcccgagggcggctacggggtgaaatccggcacctcgatgtcggcaccccatgccaccggcgcactggcactggtgatggaacgctacccatacctgaacaacgagcaggccttgcaggtgttgttgaccacggccacccagcttaatggcgcggtcactgacgcacccaccacacaggtcggctggggcgtaccggacctgggccgggcgatgcacgggcctgggcagttgctgggccccatgacggtcacgctggcggccgggcagggcgatgtgtggagtaacgcgatctccgacaaggcgctgatccagcgtcaggccgaagaccgcgccgaaaccctggcctggcagcaaaccctgcgcgacaagggctgggaaaacggcgtgggagccggtgcgagtcagcaggaccagaccgactacgccgttggcaccgcccgggcggcggcagcggcccagcgtatctacgaaggcagcctgaccaaatccggcgcgggcagcctgatcctgacgggtgacaatacctaccgtggccccaccaccgtgaatggcggccggttggcggtgaacggctcactgacctctgcggtgacggtcaatgacagcggcaccttgggcggctccgggcgtattgcggcgttgcaggtgaataacggcggcaccgtggcgccgggcaattccgtgggcaccttgcaggtggccggggatgtgaacctcgccgccggctccacctacgcagtcgaactcacacccacccgcagcgaccagatcgtcgccaccggcaaggctaccctcggcggcggcaccgtgaccctggccctggaaaacagcccgaccctgctcagccagcagcaggccgagagcctggtggggcgccagtacaccatcctgcaggcggcgggcggaatccagggccagttcggtgccgtgttgcccaactacctgttcctgggcggcacgctggactatgccgccaacggcgtgcaactggccattgcccgcagtgacgcgagtttcgccagtgtcggcgccacccgtaaccagcgctcggtggcggccgccgccgagcaactgggcgccggcaacccggtgtatgaaagcatcctgcgctcggactcactggccacagcgcaacagggtttccagcaactgtccggggaaatctacccggccatcggcacgatgttgatcaatgacagccgccaggtacgtgacgccgtgggcgagcgcctgcgccatacgccggtggccggtgaaagcaacgtgtgggtcaaggcgctcggcagctggggcaagaccgacagccgcagcgaaaccgcgggctacaccagctccctgggcggcatgctggccggcgtcgacggcgccctggacgatcagacccgcgttggcctggtggccggttacagcgacagctccctgaacatgggcagcggcacccattcatcggcgtccatcgacagctaccacctcggcgcctatgccgggcatgagctgggcaactggcgcctgagcgtcggtggcgcctacagctggcatcgcggcgacgtgaaacgcgacttgcagtacggcgaggtcagcggcaagcagaaggccaggctggatgcacgcagcgcccaggtatttaccgaggcagcctaccgcttgaacgtgcccgcggtagcgctggagccgttcgccaacctggcttacgtgcacctggacaacgaacgctttcacgagaaaggcgacgccgccgcactggcgcgtgggagtgacagccgcgacgcggtgctgagcactcttggcctgcgggcgtcgaaaaccctggccctcaatgaccggcagcaactggacgtttccggttcgttgggctggcagcacagcctgagcgccgtcgaatccgaggagcacctggcgtttgtcgccggtgggccgtcgttcgcggtgcaaagctcgccgctgatgcgcgatgcggcgctggtaggggtgcaggccagcctggcgttgagcaaaagcacgcgggtcaacctcgactacacgggccagttggctggccgggagaaaatccagggcgtggggttgagcctgaactggcagttctgaacccgatcctgaggccgacgtaattcaaatgtgggagcgggcttgctcgcgaatacggtggctcagttaaaggagcatccactgacacaccgcattcgcgagcaagcccgctcccacattgggtcggcgacgcctggaaggcatgtgatttacacaagtgcaataaaaactaaggaaggtcaccgtgaaaacaacaaaacgagggtttcaatccgccatcccgacaggcccgggctacccgctcaaggccctgagtggcgtgccatacggcgcgttgctgtgttgcctggccagcctgggtaccgcccaggccgcaccctacgtcgaaaccgggaaactgggggacgctgccagttggcgcagcaatgagttcaaggccgattggggcctgggcgccgtgcatgcagacgctgcctacgccgccggctacaccggcaagggcgtgaagctggggatcttcgaccagccggtgtacgcccagcatccggaattcgcgagccccggcaaagtggtcacgattgtgaccgagggcatccgtcaatacaccgacccgtacatcccggtgaaggccggggatgcctttcgctacgacggcacgccgtccctgggctccaacggcaagctcggcaaccacggcacccacgtcggcggcattgcggcgggtaatcgcgatggcgggccgatgcatggcgtggcgttcgatgcgcaaatcatcagcgccgaaaacggtgacccgggccccgaagacgggatcatcctgggcaacgatggcgcggtctacaaagccggttgggacgcgttggtggccagcggtgcgcgcatcatcaacaacagctggggtattgggattggtgaccagtacgccaagggcgggcgtgatccggcgttccccaacttcacggtcaatgaggcgcaggcccagttcaataacatccggccgatcctcgggacgatcgccggcggtgcctatcagggtgcgatcgatgcggcccgcagcggcgtgctgacgatcttcgccgccggtaacgactacaaccgcaacaacccggacgcaatttcgggcctggcgtacttcgtgccggagatcgcacccaactggttgtcggtggcggccttgcagcagaaccccgacaccgccagtgccgacccgtacgtgatcagcaccttctcctcgcgctgcggttatgccgcgagcttttgcgtcgcggcgcccggcaccaagatctacagctcggtgatcaacggcaccaccctggaaaacctgaccaccgactacgccaacttcaacggcacctccatggctgcgccccatgtggccgggagtgcggcggtgttgatggagcgcttcccgtacatgagcggcgaccagatttccacgctgctcaagaccaccgcgaccgacctcggcgcgccgggcatcgactcgctgtacggctggggcatgatcaacctgggcaaggccatcaacggcccggggatgtttgtgacggctgaggatattccggccgagtttcgaatcgacggcgcctacggctccggccaattcgtcgcggacctgccagggatgggcgccgtggtggatgccggtaaaccgacccagcgcctttgcaccgatgtgcattgcgggctggacgtgtggagcaacgacatcgccgggcatggcggcctgaccaagcaaggcattggcgcgctggtgctgaccggcaccaacacctacagcggcccgaccctggtcaaccaggggttgctggcaatcaatggttcgatcacctccgacgtcaccgtaggcagcagcggggtagtgggtggttccgggcacatcggttcactctacgccaacagcggcggtaccgtggcgccgggcaattccattggcaccctgaacgtcgcgggggatgtgagcttcgcagccggctccacctatgcggtggagctgtcggccaccaacagtgatcgcatcgtcgccggtggcaaggccatcctcagcggcggcacggtgaccctggccctggaaaacagcccgacactgctgacccagacccaggccgaaagcctgatcgggcgccagtacaacatccttcaggccgccggcggcattactggcagcttcggttcggtgctgcccaactacctgtttatcggcggcaccctgaactatgccgccaacggtgtgcaactggatgtggcgcgcaacgccaacaccttcgccagcgtggcggtcaccccgaatcaacgctcggtcgcagctgctgccgaacagttgggcgccggtaacgctgtgtatgaaagcctgttgtcggcgccgaatgcggcgtcggcccagggtgcattccagcagctgtccggggaaatctacccggcgctggaaaccgcgctggtcaatgacaaccgctacctgcgcgaagccgtaggcgagcgtttgcagcaaggcgaaatgggcgcatcgaccgagactatcgacagccgcggcaacgtttgggtcaaggcccttggcgcctggggcaagaccgacagccgcagcgacacggcaggctacaccacctccatcggcggcatgctggcgggtgtggacggcgcgctggacgaagacacccgtttgggcctggtggcgggctacagcgacacgtcgctgaatatgggcagtgacacccactcccgcgcatcggtcgacagctatcacctgggtgcctatgccgggcacgagatcggcgccttgcgtttgagcggtggcgcaacctacagctggcaccgcgccgatgtgaagcgcgagctgcaatacggtgaagtcgccggcaagcaaaaagccaaggtcgatgcccgcagtacccaggtgtttaccgaagcggcgtatcgcctgaacttgcaaccccttgccctggaaccgttcgccaacctggcgtatgtgcacctggatgccgacgggtttaccgagaagggcgatgcggcggcgttgaagggcggggatgacagccgcgacctggtgttgagcaccctgggcgtaagggcgctgaaaaccttgaacgtgagcgatcaccagcaactggagctttccggcacgctgggctggcagcacaacctgagcagcatcgactccgagcgccacctggcgtttgcgtcgggcagcccgtcgttctccgtggaaagttcgccgatggtgcgtgatgcggccctggtaggcgcgcgggtcagcctggcgttgagcaaggacgcgaaggtgaatcttgattacaacggcctgctggccagcaaggagaaagtccatggcgtcggcttgagcctcgactgggcgttctgaaataccgttgtttggctttctcgacaattccaacaaaagagaggcaataccatgggtgtctttgactataaaaacctcgggaccgagggctccaaagcgttgttcgccgatgccatggcgatcacgttgtactcctaccacaacctggataacggctttgcagtgggctaccagcacaacggttttggcctgggcctgcccgcaaccctggtgggcgcgttgctgggcagtactgattcccaaggggtgattccggggattccctggaaccccgattcggaaaaggccgccctcgatgcggtgcacaaggccggctggacgcccatcagcgccagcaccctgggctacggtggcaaggtcgacgcccggggcacgttcttcggtgaaaaagccggctataccaccgctcaggtggaagtgctgggcaagtacgatggtgacggcaagttgctggaaatcggcatcggttttcgcggcacctccggcccccgggaaaccctgatcagcgattccatcggcgatttggtcagtgacctgctggccgcgctggggccgaaggattacgcgaaaaactacgcgggcgaagcctttggcaccttgctcaaggatgtcgcggcgtatgccggcagccatgggttgacgggcaaggacgtggtggtcagcggccatagcctgggtggcctggcggtcaacagcatggccgacttgagcggcaataaatggtcgggattctacaaggattccaactacgtggcctacgcctcgccgacccagagtgccggcgacaaggtgctgaacatcgggtatgaaaatgacccggtatttcgtgccctggacggttcgtcgttcaatttctcgtccctgggcgtgcacgacaagccccatgagtcgaccaccgacaatatcgtcagcttcaacgatcactatgcgtcgacgctgtggaatgtcctgccgttttccatcgtcaatgtgccgacctggatctcccatttgcccacggcgtatggggatggcttgacgcgggtgctggactcgcagttctacgacctgaccagccgggactcgacgattatcgtggccaacctgtcggacccggcccgcgccaatacctgggtgcaggaccttaaccgcaacgccgagccccacaagggcaacacgttcatcatcggcagtgacggtaatgacctgattcagggcggcaagggcgtggacttcatcgagggtggcaagggcaatgacacgatccgcgacaacagtgggcataacacctttctgttcggagggcagtttgggcaggaccgggtgatcggctaccagcccaccgacaagctggtgttccgggatgtggagggcagtgctgactggcgcgatcacgccaaggtggtgggtagcgatacggtgctgagttttggcgcggactcggtaacgctggtgggggttggactggccggggtgtggggcgatggaatttccatcagctaaatagcgctgctgttgtggcgagggagcaagctccctcgccacagggttagtcagcgtctggggaggggttatctccagtagtggccgtggttccagtacgggcgatggggttggccgtagccgtagccgtagtaatgaccgcttggccagtagcctcgcgggccgtagccataaccccagtggccgtagtagccgggaggaggcggttgcacgattaccacgcgcgctggcgcctggcggatgatgagggtgtcggcaaacaccggcgtactcgccagcgcagcccacatcacgggaatgagtagcagagcgcgcaccgctcgggacatgaatgccatggccatggttctccgtcgtaccgctttcgaagatgaaggcggttgatcggttaaacgcgggggcggtggaaatcttcggtaaaattttgtttattttgcccatgccaaaaaaaacgcgcatttgcgcggttttttttatttctccttgatcacggtcgcgacgtccgcggccttgacccgtatgtgcttgccggcgatgtcggtgaattc

SEQ ID NO: 1638 - protein, 482 aa, Pseudomonas fluorescens
MSKVKDKAIVSAAQASTAYTQIDSFSHQYDRGGNLTVNGKPSFTVDQAADHLLRENAAYRDVDGNGKIDLTYTFLTSASNATMNKHGITGFSQFNTQQKAQAVLAMQSWADVANVTFTEKASGGDFHMTFGNYSGGQDGAAAFAYLPGTNAKYNESGLDGTSWYLTNSSYTPNKTPDLNNYGRQTLTHEIGHTLGLDHPGDYNAGTGNPSYKDADYGQDTRGYSVMSYWSESNTNQNFSKGGVEAYSSGPLIDDIAAIQKLYGANYNTRAGDTTYGFNSNTGRDFLSATSSADKLVFSVWDGGGNDTLDFSGFTQNQKINLNETSFSDVGGLVGNVSIAKGVTVENAFGGSGNDLLIGNAAANILKGGAGNDIIYGGGGADQLWGGAGSDTFVFGSSSDSKPGAADKIFDFTSGSDKIDLTGITKGAGLTFVNAFTGHAGDAVLSYASGTNLGTLAVDFSGHGVADFLVTTVGQAAVSDIVA

SEQ ID NO: 1639 - protein, 124 aa, Pseudomonas fluorescens
MVMTLFRTTVAWCFQAMLMSAGASAMASSLVLPTSAQLAGHWALHQQEQVCALDLIEQANALGGDVACAGQWLGEAPVSWTPTPDGIWLMNAEGTGITHLNRQKEGEYEGRSKSGAVLLLQRAP

SEQ ID NO: 1640 - protein, 583 aa, Pseudomonas fluorescens
MAKTTPVAPLFKALGDYKSILISIGCFTALINVLMLVPSIYMLQVYDRVLSSQNETTLVMLTLMVVGFFAFIGVLEVIRSFIVIRIGSQLERRFNLRVYKAAFERNLQRGEGHGGQSLGDLTHIRQFITGPALFAFFDAPWFPIYLFVIFLFNVWLGVLASAGAVLLIGLACLNEYLTKKPLGEASGYSQQSTQLATSHLHNAETIQAMGMLGALRKRWFKVHSQFLGLQNKASDTGSIISSLSKSLRLCLQSLVLGLGALLVIKGDMTAGMMIAGSILMGRVLSPIDQLIAVWKQWSSAKLAYQRLDNLMREFPPQGEQMALPAPKGNVSFEQVSAGPPGRRVPTLHQVSFNLAAGEVLGVLGASGSGKSTLARVLVGVWPTLAGTVRLDGADIHRWDRDDLGPHIGYLPQDIELFSGSIADNIARFRDADPQLVVQAAQQAGVHELILRLPHGYDTVLGDEGSGLSGGQKQRVALARALYGGPRLIVLDEPNSNLDTVGEAALASAIMQMKAQGSTVVLVTHRSSALAQADKLLVLNEGRLQAFGPSQDVLRALSGQQEAPREKAGVSLSRQYQAGRNPGA

SEQ ID NO: 1641 - protein, 444 aa, Pseudomonas fluorescens
MSSDSSIQINRDYEQTHPEHGARFFARMGWLLTVVGAGGFFLWASLAPLDQGIPVQGTVVVSGKRKAVQTLSPGVVSRILVREGEAVKQGQPLFRLDQTQNQADVHSLQAQYRMAWASVARWQSERDNQSTITFPAELSGNPDQALALVLEGQRQLFSSRREAFAREQAGIRANIEGATAQLNGMRRARSDLTAQAQSLRDQLNNLQPLADNGYIPRNRLMEYQRQLSQVQQDLAQNTGESGRVEQGILESRLKLQQHSEEYQKEVRSQLADAQLRSLTLEQQLTSAGFDLQHSEINAPADGIAVNLSVHTEGAVVRAGETLLEIVPQDTRLEVEGRLPVHLVDKVGTHLPVDILFTAFNQSRTPRVPGEVSLISADQMLDEKTGMPYYVLRTTVSSSALEKLHGLVIKPGMPAEMFIRTGERSLLNYLFKPLLDRAGSALTEE

SEQ ID NO: 1642 - protein, 444 aa, Pseudomonas fluorescens
MKPMFIALLLACSSAQAAMGPFDVYEQALRNDPVFLGAIKERDAGLENRTIGRAGLLPKLSYNYNKGRNNSQATLPDGRGGNYHDDRNYNSYGSTFTLQQPLFDYEAYANYRKGVAQALFADESFRDKSQALLVRVLTYYTQALFAQDQIDIARAKKKAYEQQFQQNQHLFQQGEGTRTDILEAESRYELATAEEIQALDEQDASLRELGALIGVQSVNINDLAPLNPGFAAFTLTPANYDTWHELALTNNPTLASQRQSLEVARYEVERNRAGHMPRVTAYASSRQQESDSGNTYNQRYDTNTIGVEISMPLYAGGGVSASTRQASRAMEQAEYELEGKTRETLIELRRQFSACLSGVSKLRAYQKALTSAEALVVSTKQSILGGERVNLDALNAEQQLYSTRRDLAQARYDYLMAWTKLHYYAGNLRDTDLAKVDEAFGPEH

SEQ ID NO: 1643 - protein, 985 aa, Pseudomonas fluorescens
MITDSPRFKPFTAGSLLLLSVAAHGQYLEAGKPGDPASWRSTEFQSDWGLDRMKANEAYAAGITGSGVKIGALDSGFDPNHPEASKDRYHAVTASGTYVDGSPFNTTGALNPNNDSHGTHVTGTMGAARDGVGMHGVAYNAQIYVGNTNANDSFLFGPTPDPQYFKAVYSALVDSGVRAINNSWGSQPKDVSYQTLGDLHAAYAQHYNQNTWLDAAADVAKAGVINVFSAGNSGYANASVRSALPYFQPGLEGHWLAVSGLDKANNQKYNQCGIAKYWCISTPGALINSTIPEGGYGVKSGTSMSAPHATGALALVMERYPYLNNEQALQVLLTTATQLNGAVTDAPTTQVGWGVPDLGRAMHGPGQLLGPMTVTLAAGQGDVWSNAISDKALIQRQAEDRAETLAWQQTLRDKGWENGVGAGASQQDQTDYAVGTARAAAAAQRIYEGSLTKSGAGSLILTGDNTYRGPTTVNGGRLAVNGSLTSAVTVNDSGTLGGSGRIAALQVNNGGTVAPGNSVGTLQVAGDVNLAAGSTYAVELTPTRSDQIVATGKATLGGGTVTLALENSPTLLSQQQAESLVGRQYTILQAAGGIQGQFGAVLPNYLFLGGTLDYAANGVQLAIARSDASFASVGATRNQRSVAAAAEQLGAGNPVYESILRSDSLATAQQGFQQLSGEIYPAIGTMLINDSRQVRDAVGERLRHTPVAGESNVWVKALGSWGKTDSRSETAGYTSSLGGMLAGVDGALDDQTRVGLVAGYSDSSLNMGSGTHSSASIDSYHLGAYAGHELGNWRLSVGGAYSWHRGDVKRDLQYGEVSGKQKARLDARSAQVFTEAAYRLNVPAVALEPFANLAYVHLDNERFHEKGDAAALARGSDSRDAVLSTLGLRASKTLALNDRQQLDVSGSLGWQHSLSAVESEEHLAFVAGGPSFAVQSSPLMRDAALVGVQASLALSKSTRVNLDYTGQLAGREKIQGVGLSLNWQF

SEQ ID NO: 1644 - protein, 1036 aa, Pseudomonas fluorescens
MKTTKRGFQSAIPTGPGYPLKALSGVPYGALLCCLASLGTAQAAPYVETGKLGDAASWRSNEFKADWGLGAVHADAAYAAGYTGKGVKLGIFDQPVYAQHPEFASPGKVVTIVTEGIRQYTDPYIPVKAGDAFRYDGTPSLGSNGKLGNHGTHVGGIAAGNRDGGPMHGVAFDAQIISAENGDPGPEDGIILGNDGAVYKAGWDALVASGARIINNSWGIGIGDQYAKGGRDPAFPNFTVNEAQAQFNNIRPILGTIAGGAYQGAIDAARSGVLTIFAAGNDYNRNNPDAISGLAYFVPEIAPNWLSVAALQQNPDTASADPYVISTFSSRCGYAASFCVAAPGTKIYSSVINGTTLENLTTDYANFNGTSMAAPHVAGSAAVLMERFPYMSGDQISTLLKTTATDLGAPGIDSLYGWGMINLGKAINGPGMFVTAEDIPAEFRIDGAYGSGQFVADLPGMGAVVDAGKPTQRLCTDVHCGLDVWSNDIAGHGGLTKQGIGALVLTGTNTYSGPTLVNQGLLAINGSITSDVTVGSSGVVGGSGHIGSLYANSGGTVAPGNSIGTLNVAGDVSFAAGSTYAVELSATNSDRIVAGGKAILSGGTVTLALENSPTLLTQTQAESLIGRQYNILQAAGGITGSFGSVLPNYLFIGGTLNYAANGVQLDVARNANTFASVAVTPNQRSVAAAAEQLGAGNAVYESLLSAPNAASAQGAFQQLSGEIYPALETALVNDNRYLREAVGERLQQGEMGASTETIDSRGNVWVKALGAWGKTDSRSDTAGYTTSIGGMLAGVDGALDEDTRLGLVAGYSDTSLNMGSDTHSRASVDSYHLGAYAGHEIGALRLSGGATYSWHRADVKRELQYGEVAGKQKAKVDARSTQVFTEAAYRLNLQPLALEPFANLAYVHLDADGFTEKGDAAALKGGDDSRDLVLSTLGVRALKTLNVSDHQQLELSGTLGWQHNLSSIDSERHLAFASGSPSFSVESSPMVRDAALVGARVSLALSKDAKVNLDYNGLLASKEKVHGVGLSLDWAF

SEQ ID NO: 1645 - protein, 476 aa, Pseudomonas fluorescens; identical to SEQ ID NO: 1451

SEQ ID NO: 1646 - protein, 89 aa, Pseudomonas fluorescens
MAFMSRAVRALLLIPVMWAALASTPVFADTLIIRQAPARVVIVQPPPPGYYGHWGYGYGPRGYWPSGHYYGYGYGQPHRPYWNHGHYWR

SEQ ID NO: 1647 - DNA, 930 bp, Pseudomonas aeruginosa
atgaacaagaacaagacgttcctcgcggcggcgctggtagcgctggccgcaagccttcccgtgcacgctgcgaccgactacacccgcacgcgctatcccatcgtgctgtcccacggtctgttcggcttcaagagcgtcggcccggtggactactggcacgctatcgtgccggccctggagaaggacggcgcgaaggtcttcgccacctcgcagtcgccggtgaacagcaacgaggtgcgcggcgaacagctactggcgcaggtggaggaagtcctggccctgaccggcgcggagaaagtcaacctgatcggccacagccagggcggcatgaccgtgcgctacgtcgccggggtggcgccgcaactggtggcctcggtcaccaccatgggcacgccgcacaagggcacgccggtagccgacgcggtgaccggcttcagcgagttcctcgggccgatcggcaccgaggtgatcgcctcggcggtggaggcgctgttctcggtggtcgacatcgtcgacggcggcgagtgggtcaagggcgacgcgctggctgccctgaacagtctcaacactcccggcaccgcgcggttcaaccagcgcttcccgcaggcgatcccggccagcgcctgtggccagggcgcggagacggtagccggggtgcgctactactcgatgagcggcaccggctccctgaccaatgcgctcgacccgagctccgccggcctggcggtgaccgggctgctgttcggcgaggccaacgacggtctggtcggccaatgctccagccacctgggcagcgtggtgaaggacaactaccggatggaccatctggacgaagtcaaccagttgctcggcctggtcagcctgttcgagagcgacccgacccaggtctatcggcagcatgccaatcgcctcaggaacgtcggactctga

SEQ ID NO: 1648 - protein, 309 aa, Pseudomonas aeruginosa
MNKNKTFLAAALVALAASLPVHAATDYTRTRYPIVLSHGLFGFKSVGPVDYWHAIVPALEKDGAKVFATSQSPVNSNEVRGEQLLAQVEEVLALTGAEKVNLIGHSQGGMTVRYVAGVAPQLVASVTTMGTPHKGTPVADAVTGFSEFLGPIGTEVIASAVEALFSVVDIVDGGEWVKGDALAALNSLNTPGTARFNQRFPQAIPASACGQGAETVAGVRYYSMSGTGSLTNALDPSSAGLAVTGLLFGEANDGLVGQCSSHLGSVVKDNYRMDHLDEVNQLLGLVSLFESDPTQVYRQHANRLRNVGL

SEQ ID NO: 1649 - DNA, 6286 bp, Streptomyces coelicolor
gcggccgccgccacgcgccgggcgtcaccgagcaccggcagcagcacggacagggcgtgcggccccacgtcccacagggcacccttctcccgccgccacggcgagtcggcgaacggactgtcctcgccgccgaacacggcgcccagccactgcgcccgggccgtgaaccagtcgtcccgggacgactgttcggtgatccacgcctcggtctcgggctggaaccgggtggtgaagaagaccaccgaggcgacgtccgccgtccgcaccgcctccaccaccgcccgcccctgcgccaccgtcgacgcgagcggcttgtcgagcagcagatggcacccggcccgcgccgcccgcaccgccaggccggcctgtacggccgggggcagcgcgacggccacggcctccacgtcggccagcagggcgtcgaggtcggcgtaggcccgtgtgccgtgccgctgcgccagctcctcggcggcgtccgggcggcggccccacacccccgcgaagtccaggtcgtcgtgcccggccagggcgggggcgtgcgccatgtccgcccaggggccggtgccgagcagtccgatgcgcatcccgtcgcctctccacggtgccgacccgatgacgggcggccgacgatcctccttgacgaccggcgtgcgacagcccggccgacgccgagcgtgtcacacctacgggacgtgcggacagtgcggagggcaccgcgggcccggcgcaaccgtgccgggccacgcgcccccgccgtcccgggcccggcgtccgcgccccagggccgtaccgccggagtcgtacgagaccggtgaaattgccgatcccccggcccgttccgcccctcgacagtggcagcgccaacccatcggcgaggtccgcccggcggacggcccgaacgcgaccccacgcgttccgggccgtgtgcgtcgccgggccgggccggtcgccacgaccgagaggacacccccctcgtgcagcagaacccccacacccacgccgccccaggcgccgcgcgccccgtcctccggggcgtccggcggcggctggccgcagtgacggcggccgtggcccgggtcctcgtgctcggcaccctcaccggcccgggagcccaggccgccgacaacccgtacgagcgcggcccggcgcccaccgagtccagcatcgaagccctgcgcggtccctactccgtggccgacaccagcgtctcctcgctcgcggtcaccggattcggcggcggcaccatctactacccgaccagcaccagcgacggcacgttcggcgccgtcgtcatcgcgcccgggttcaccgcgtaccagtcgtccatcgcctggctcggcccgcgcctggcctcccagggcttcgtggtcttcaccatcgacaccaacaccacgctggaccagcccgactcccgcgggcggcaactgctggccgccctggactacctgaccgggcgcagctccgtccgcggccggatcgacagcggccgactcggcgtcatgggccactccatgggcggcggcggcaccctggaggccgccaagtcccggccgtcgctccaggcggcgatccccctcaccccctggaacctggacaagagctggccggaggtcagcacgccgacgctggtcgtcggggccgacggcgacacgatcgcccccgtggcctcgcacgccgaaccgttctactccggcctgccctcgtcgaccgaccgggcctatctggagctgaacaacgcgacccacttctcgcccaacacgtccaacacgacgatcgcgaagtacagcatctcctggctcaagcgcttcatcgacgacgacacccgctacgagcagttcctgtgcccgctgccgcggccgagcctgacgatcgaggagtaccggggcaactgcccgcacggttcctgacaccctccgctgtgccggcgcacgaccgggaccggtgcccgttgggcgccggcacagtgcccgtaccacccacccgggcgcacaaccgcaggtgacagcgacgatgcccgggcgggcgcgggcggatcgacgccttccgcaccgggttacgcgcgcgtaacctcccgggaatgaccggacagacgaccgtacgtacggccgtgcgggtccacggccggagcgcgcaacgcagggcgctgcgcgcgatgctggacgcgctgcccgcccacggcggccggctcctcctggccggcgaaccgggactcggccggaccactctgctccagtgggccgcccgttccttccgggccggtcccgtactccacctcgggcccggccccgacgcgaacgcgcacctcaccgccgggcaactgctcgacaccctgcgggcggccgccgtcgcggcgccggtactggtgtgtgtggacgacgcccaccggtgggatgcgccggcccgcaccgagctcgcccgtgcggcgcggctcctgtccaccgccgaccgggtcggcctgctgctctccgtcgcctcggaccgtgccgtcggcccggagttcgcccggctgcccgtcgtgcacctggacccgctggcaccggcgagggccgccgccctgctcgacgacctgaccgacggcgtcgccgcaccggcggtccgcgagcagctcctggccgaggcggaggggaacccggccctgctcgtcgcccttgtgcgccgcctgtcacccgccgagctgcgcggacaccggccgctgcccagcccgctggccgaagcgggtgtcctcgccgaggccgcgggcggtgtgccgaccggaccgtccgcccatgcgcgggacctgctgctgacggtggcggcggccggagaggcctcggacgggtcggacgccgacgccggcctggtccgcgacgcgctacggcgcctgcggccggcaccgggtcacggtcccggtctcggtcccgatccgggtctcggacccgatccgggtgcggaaccgctgcccgggcagctcgtcctggccggtgaccggctccgtttccgcagcccgctcgtccgtcgaacggtgcacgccaccgccgccgcggaccggcgtcgcgcggtgcaccgcgcgctggccgacgcgctggacggcggcggccaccgcctcacggcgctgttgcaccgctcgtggtccctggacggtccggcacccgcaccggcgtcggcggaccggctggcggcgacggcggccgacggcgcggtgcccgcctcgcaccggctgcgcgcgaccgcgtacgcccgcgccgccgagctgacggccgacggggcacggcgggcggagcgctacaccgccgcggccgaacaggccctgctcgccgggcggcccgaacgggcgcgccccctgctcgccgcggcccgtgaccgcgccgcccccgacgccgtacgcgggcgggccgagctgctgcgcggtatgacggaactgagggacggtccggtcggtgacgcccaccagtccctgctgctggccgcgtccctgctcgccgcggacgatccggccgaggccgcggccgccgcactggccgccgccgacgcggcctgggcggcgggcgacctgccggcgtgcctggccacgctcgcccccgagcccccgctccgcgccgagcacccgtcccccgggtccgacgggcccgccgcggcccgcacggccgccgtcgtgcacgaccaccgcgtcgggatgcgggcgctgctcgaaggacggctcgaccgggccggggcaccgctcgggcaggtggtccggcggagcaggaccggggaccggccggagacactgctgcggtcggcggcggcggcgctgctgctcggggacgtggacgcagcccgcagcggcggggcccgggcgctggccgcggcccggcagctcgggtcggacgcgctggtcccgcaggccctggagtacctcgcctacgccgaactgcgcgccgggcggcacccgcaggcccgtacccacgcggaggaggggctgcgcaccgccctgcgggccgggcagcgcaacacggcggcccaccaccgggcggtactggcgctcgccgcgtcgatcgaggaggagccggacgccgtcgccaggcacgtcgcggccgccctggacacggcccgccggcacgggctcgcccaggcggccgccctcgcccagtgggcggcggcccgcgccgacctcgggcgggggcgccccttcgacgcggccgaccggctcggactcctggtcctgcccgggccggggcggggccacttcgcggtgtggcggctggccgtgccctgcttcgtggaggccgccgtgctcgccggacgcgacgaggacgcccgccgggtcctcacggacttcgccgactgggcggcgttcggcgccgatccgcaggccgccgcccaactcgcccgctgccacgccctcctcgcccccgcggagcacgccgacgccctctaccgccatgccctcgaccggcacgacgaggcgggcggcgacttcgagcgggcccgcaccgcgctgctgtacggcaagtggctgcgccggcggcgcagaccccgggaggcccgcggccgcctcggcaccgcgctggccggcttcgagcgctgcggcgccggcgtctgggccgcgcaggcacgcgacgaactccgcgccctcggggcggccccgcggagccccggcgccggagccggaacaccggcccgcctcggccgcctgaccccgcagcaactgcgcatcgcgcggcaggtcgccgagggcgccaccaatcgcgaggtcgcgctgaccctcggggtgagcacccgcaccgtcgactaccacctccgcaaggtcttcgccgccctcggcgtgcggtcccgcctggagctggcccgcatggtcgggcaggccgagcgggcccaggaggcgcaggcggcccaggacgcgcgtcgagccggacaccaggaaaagaccggtgcacaaccctagggaccgaccggacggtatgccatccttcggggcaggacgagtcagggggcaggcccggcgcggcgggacggcccgtcgcgggaaggcgcctccgcaagccctgccccggggaggaccgcgatgcagcacgccgtacggtcacgagcagcgatccgcaccgggctgacgcccgttccacgcccgcggacacccggagtcacgtcgttgatcgacgccgacgccctgcgtgtcctgcaccgggccgcccgcgccctgctcgacgacctgcccgacctgaccgaccggctgatggcgctgctgcgggagcaggagcccgcctaccgggccgccctcaccaaggaccccaccgccacctggcaggaggccaccgctccctgcggcacagcgtgctcgctgctcgacccgcgcggcgcccgggacgcggcccgccgctgctcctggcggatcggcgccgcccgcgcggagcagggactcccgctggacgccctgctgcacgccttccgcctgggcggctcgctggtgtggcagcggctggtcgaggagacctccagggccgcaccggaggacgtgcggctcctcgtgcacgtggccgcggacgtgtggaacttcgtcgacgagcactgcaccctcgtcgcggacgcctaccggcagaccgagtggcagctcggccggcgccgcgagaaccgggtccggcagctggccgccggcctgctcgacggcaccggtcgcatcgccgacctgcccgaggccgcccgggccctcggcctcccggagcacggccgctacgtcgtcgtcgccgtcgccggcgggccaccggccggcccgacgcgcccgcgccgccgtaccgccgggagcgggtccactggcacgccggggcggagaccgactacggcatcgtctcgctccggcgaccacgacgggctcccggaaccgcaccggccggaggcccgccgcaggacgcccccgtccccggcctccgggtcggtgtcggcagcccggtcgacggactcgccgctgtcggggacgcccgtcggctcgcggacacggccctgaccatctgccccccggccgggggcaccgtgcgactggccgaccagctccccgccgccctggtcgtctccagccccgagctgggccgggccctcgccgagaaggtgctcggtcccctgctccgcctggagtccgccgaccgcgacgtgctcctcgacaccctcaccacctggctcgactgcgacggttcggcccagcgcgccggcgaacgcctctactgccaccgcaacacggtcctcaacgcctccggcgctgcgaacagctcaccggccgctccctggcccgcccggccgacctcgtcgagttcagcctggccctgacggcacgacgcgt

SEQ ID NO: 1650 - protein, 195 aa, Streptomyces coelicolor
MRIGLLGTGPWADMAHAPALAGHDDLDFAGVWGRRPDAAEELAQRHGTRAYADLDALLADVEAVAVALPPAVQAGLAVRAARAGCHLLLDKPLASTVAQGRAVVEAVRTADVASVVFFTTRFQPETEAWITEQSSRDDWFTARAQWLGAVFGGEDSPFADSPWRREKGALWDVGPHALSVLLPVLGDARRVAAAA

SEQ ID NO: 1651 - protein, 310 aa, Streptomyces coelicolor
MQQNPHTHAAPGAARPVLRGVRRRLAAVTAAVARVLVLGTLTGPGAQAADNPYERGPAPTESSIEALRGPYSVADTSVSSLAVTGFGGGTIYYPTSTSDGTFGAVVIAPGFTAYQSSIAWLGPRLASQGFVVFTIDTNTTLDQPDSRGRQLLAALDYLTGRSSVRGRIDSGRLGVMGHSMGGGGTLEAAKSRPSLQAAIPLTPWNLDKSWPEVSTPTLVVGADGDTIAPVASHAEPFYSGLPSSTDRAYLELNNATHFSPNTSNTTIAKYSISWLKRFIDDDTRYEQFLCPLPRPSLTIEEYRGNCPHGS

SEQ ID NO: 1652 - protein, 941 aa, Streptomyces coelicolor
MTGQTTVRTAVRVHGRSAQRRALRAMLDALPAHGGRLLLAGEPGLGRTTLLQWAARSFRAGPVLHLGPGPDANAHLTAGQLLDTLRAAAVAAPVLVCVDDAHRWDAPARTELARAARLLSTADRVGLLLSVASDRAVGPEFARLPVVHLDPLAPARAAALLDDLTDGVAAPAVREQLLAEAEGNPALLVALVRRLSPAELRGHRPLPSPLAEAGVLAEAAGGVPTGPSAHARDLLLTVAAAGEASDGSDADAGLVRDALRRLRPAPGHGPGLGPDPGLGPDPGAEPLPGQLVLAGDRLRFRSPLVRRTVHATAAADRRRAVHRALADALDGGGHRLTALLHRSWSLDGPAPAPASADRLAATAADGAVPASHRLRATAYARAAELTADGARRAERYTAAAEQALLAGRPERARPLLAAARDRAAPDAVRGRAELLRGMTELRDGPVGDAHQSLLLAASLLAADDPAEAAAAALAAADAAWAAGDLPACLATLAPEPPLRAEHPSPGSDGPAAARTAAVVHDHRVGMRALLEGRLDRAGAPLGQVVRRSRTGDRPETLLRSAAAALLLGDVDAARSGGARALAAARQLGSDALVPQALEYLAYAELRAGRHPQARTHAEEGLRTALRAGQRNTAAHHRAVLALAASIEEEPDAVARHVAAALDTARRHGLAQAAALAQWAAARADLGRGRPFDAADRLGLLVLPGPGRGHFAVWRLAVPCFVEAAVLAGRDEDARRVLTDFADWAAFGADPQAAAQLARCHALLAPAEHADALYRHALDRHDEAGGDFERARTALLYGKWLRRRRRPREARGRLGTALAGFERCGAGVWAAQARDELRALGAAPRSPGAGAGTPARLGRLTPQQLRIARQVAEGATNREVALTLGVSTRTVDYHLRKVFAALGVRSRLELARMVGQAERAQEAQAAQDARRAGHQEKTGAQP

SEQ ID NO: 1653 - protein, 310 aa, Streptomyces coelicolor
MQHAVRSRAAIRTGLTPVPRPRTPGVTSLIDADALRVLHRAARALLDDLPDLTDRLMALLREQEPAYRAALTKDPTATWQEATAPCGTACSLLDPRGARDAARRCSWRIGAARAEQGLPLDALLHAFRLGGSLVWQRLVEETSRAAPEDVRLLVHVAADVWNFVDEHCTLVADAYRQTEWQLGRRRENRVRQLAAGLLDGTGRIADLPEAARALGLPEHGRYVVVAVAGGPPAGPTRPRRRTAGSGSTGTPGRRPTTASSRSGDHDGLPEPHRPEARRRTPPSPASGSVSAARSTDSPLSGTPVGSRTRP

SEQ ID NO: 1654 - DNA, 954 bp, PETROLEUM-DEGRADING BACTERIUM HD-1
atgacactcgatgcccaggccaaggccattctcgaccagatcgctcgctcgccgatgcccaagctgcaccaggtgccggccagcgttgcccgccagatgttcgagatcagctgcaagctgaccgaaatcaagaacctgcccatcggccgggtcgaagaccgcgtcattccggggccggacgacacggaactgccgatccgcatctacacgcccgtcgcggcgccgcccgggccgctgcccgtgctggtcttcttccacggcggcggtttcgtcatcggcagcctcgacagccatgacgcgccctgccggctgatcgccaacgaagcgcgctgcctcgtcgtctcggtcgattatcgcctggccccggaaaaccgcttcccggcggcggtcgacgattgcctggccgcggtcacctgggtcgcccgcaacgccgccgagatcaacgccgacccgacccgcatcgccgtcggcggcgattccgccggcggcaacctctcggccgtggtctcccagcagttgcgcgacgcgggcgggccgaagatcgtcttccagttgctgatctatccggcgaccgacgccctgcacgaaggcctgtcgcggacctcgaacgccgaaggctacatgctggacaaggacctgatgtcctggttcttcgcgcagtatctgggcgacggcggcggcgtcgacctcgcggatccgcgcttctcgccgctgcgccatgccaatctcggcaatctgggcacgatccatgtcgtcgtcgccggcttcgacccgctgcgggacgaaggcatcgcctatgccgaggcactgaaggcggcgggcaacaaggtcacgctctccgagttcaagggccagatccacggcttctgctcgatggccggggtgatcgaggctggccgcaccgccctcgtcgaaggcgccgccctgctgaaggaagccttcgcccaggcctga

SEQ ID NO: 1655 - protein, 317 aa, PETROLEUM-DEGRADING BACTERIUM HD-1
MTLDAQAKAILDQIARSPMPKLHQVPASVARQMFEISCKLTEIKNLPIGRVEDRVIPGPDDTELPIRIYTPVAAPPGPLPVLVFFHGGGFVIGSLDSHDAPCRLIANEARCLVVSVDYRLAPENRFPAAVDDCLAAVTWVARNAAEINADPTRIAVGGDSAGGNLSAVVSQQLRDAGGPKIVFQLLIYPATDALHEGLSRTSNAEGYMLDKDLMSWFFAQYLGDGGGVDLADPRFSPLRHANLGNLGTIHVVVAGFDPLRDEGIAYAEALKAAGNKVTLSEFKGQIHGFCSMAGVIEAGRTALVEGAALLKEAFAQA

SEQ ID NO: 1656 - DNA, 504 bp, Pseudomonas fragi
aagcttggctgcaggtcgacggatcaaaaacaccctgcgagattgaacatggacgattcggtaaatacacgctatccgatcttattggtacacggcctttttggattcgaccggataggctcgcatcactactttcatggtatcaagcaagcactcaatgagtgcggtgccagcgtcttcgttccaatcatttcagccgccaacgacaatgaagcccgaggcgatcaactgctcaagcagatccacaacctgcgcaggcaggtcggtgcacagcgtgtcaacctgatcggccacagccagggcgcccttaccgcgcgttatgtggcggccatcgcccctgaactgatcgcctcggtgacgtcagtcagtggccccaaccacggctccgagctggccgatcgttgcgcctggcctttgtcccggggaggcttggcgaaacggtggctgccgccctgaccacctcgttcagcgcatttttatccgccctcagggccacacccgcgc

SEQ ID NO: 1657 - protein, 135 aa, Pseudomonas fragi
MDDSVNTRYPILLVHGLFGFDRIGSHHYFHGIKQALNECGASVFVPIISAANDNEARGDQLLKQIHNLRRQVGAQRVNLIGHSQGALTARYVAAIAPELIASVTSVSGPNHGSELADRCAWPLSRGGLAKRWLPP

SEQ ID NO: 1658 - DNA, 2400 bp, Acinetobacter calcoaceticus
ataattttggcgtctattgttatgaatttggcgcagtttgttttagtctaaaattcacgcaatatttgtagggagtataattttgcagttcatttgtatgtttggaatgaatccgcatacaaatcgcacggactatatagctgtaataaaaacgaaaaatgctaggagcaaaacgtgaagaaaaaatatttaagcgctatgacgttaatggcgggtatgctgatgagcagtggatctgtagtacatgcaggtttattcgacttcttatcaccaaaggcatcatggcaaaattgtaatgtggactcatgttcagtcggcggtagtacttatgttacctctagttatgccaaaacaaagtatccaatcttattagcacatggtatggctggtttctctgctgttgggcctttacagtattggaatggtattacagaggacttggttggtaatggtgcaaatgtgtttgtcgctcaacaagcatcatttaactcatcagaggtacgtggagaacaattacttttacaagcaaaacaagttctggcaattacaggcgctcaaaaggtcaatttgatcggacatagtcatggctcacaatcagttcgttatgtagcgagccttatgccaactaaagttgcctcagtaactgctgtaggtggaccaactaaaggttctgatgttgctgatgtggtttattccatcactcaatcaccagtcggaccgatagcagcacctgttgttgcagccgcagtggatgctttcttttctttagtgggtattgggtctggtcattattatgatcaagatgcaatcgcaggactgaattcacttacaactgctggttcagcaaatttcaatagtcgtttcccagcaggtgttccaacgactgcttgtggttcgggtacagaacttgtcaatggtgttcgctattattcatggggtggtacaggggtgttaactaatgtattagatcctctagactatgctttagttgcaacatcattactcataagtggtgaaaatgatggcttggtgccgcgttgttcaaatcatttaggcacagtcattcgtgataattataattttaaccatttggatgaagtgaatcaggtgttaggcttggttggtttcttacaaaatccagtcactccttatcgaactcaagcaaaccgcttgaagaatcaaggtctataactattcaaatataagggagtatggttttactccctttaccatataacggttcacacaattaattataaatagagcaagggattatgagcggtaaatttataaatcataagacaattgtatttggtgttatcacgagtgtattgctcttgctactgctgatttactatgtatttaaaccagaagctcaaactcaaaaccaaaatataaatacgcagacaatacagccagaaaacacagttttagaaagtgcaactgcaaacaataaacaaggaaaactgccaaccctagcagcatcattacaaggtacagagattgattgcccaattcaggtcgatgcaaatgggaaactcattttaacggttggtattcgtagttgttttgattatttcttttctagcttaggtgaaaaaactgaagcagagcttgttgcagatattcgacaatacttgctcgcaacattgccagagtccgcttcaaactatgcaatttatttgcttgatcaatatgttgcttatatgcatgcactacaaaacttaaaaccaaatgcaggctttaaatctaataatgttgatgctttgcaaaaagtcgtagatcaaatggcaaaagtacaacaacagttttttaatgcggctgaaattaatgctttgtttggtaatgaaagaaatctaaatcaatttaatcttgagcaaatgcgtatccatgccaataaaaatctaacgacacaagaaaaggctacagagcttgcgaagttgattgatgaattacctccagcgttggccgacggagtacgggtttcgatgcaattcgctgaattgcagcaacttacgaaagaaatccaagcaaaaggcggatcagctcaagatttaagaagtatgagggaaagtttacttgggcctgaagctgctgatcgtttggaaaaagttgatcaagaagaagcagtgtggcaaacgcaagttaatcagtatttatctgcgcgggatcaaattttaaaaagtgatgcaaatgatgccagtaaacaacaatccattgctgaattacgtaatagttcatttgggacgaaagaggatttattaagagctcaatcctatgaagtgatgcatgatcaaaaaagtaaaggatcataatcaatcattatttctagctgtaagtgctctccattatatttccctgaaatgacttgtagaaatggaggggaactcacttcaataa

SEQ ID NO: 1659 - protein, 338 aa, Acinetobacter calcoaceticus
MKKKYLSAMTLMAGMLMSSGSVVHAGLFDFLSPKASWQNCNVDSCSVGGSTYVTSSYAKTKYPILLAHGMAGFSAVGPLQYWNGITEDLVGNGANVFVAQQASFNSSEVRGEQLLLQAKQVLAITGAQKVNLIGHSHGSQSVRYVASLMPTKVASVTAVGGPTKGSDVADVVYSITQSPVGPIAAPVVAAAVDAFFSLVGIGSGHYYDQDAIAGLNSLTTAGSANFNSRFPAGVPTTACGSGTELVNGVRYYSWGGTGVLTNVLDPLDYALVATSLLISGENDGLVPRCSNHLGTVIRDNYNFNHLDEVNQVLGLVGFLQNPVTPYRTQANRLKNQGL

SEQ ID NO: 1660 - protein, 346 aa, Acinetobacter calcoaceticus
MSGKFINHKTIVFGVITSVLLLLLLIYYVFKPEAQTQNQNINTQTIQPENTVLESATANNKQGKLPTLAASLQGTEIDCPIQVDANGKLILTVGIRSCFDYFFSSLGEKTEAELVADIRQYLLATLPESASNYAIYLLDQYVAYMHALQNLKPNAGFKSNNVDALQKVVDQMAKVQQQFFNAAEINALFGNERNLNQFNLEQMRIHANKNLTTQEKATELAKLIDELPPALADGVRVSMQFAELQQLTKEIQAKGGSAQDLRSMRESLLGPEAADRLEKVDQEEAVWQTQVNQYLSARDQILKSDANDASKQQSIAELRNSSFGTKEDLLRAQSYEVMHDQKSKGS

SEQ ID NO: 1661 - DNA, 4855 bp, Streptomyces albus
gtcgacgctctccgtcacctacctctccttcatgaccctcgccaccacgctcgccgcctgcggggtggtcctcgacaacgcggtgctgatcgtcggagccatggccatcggccccgacttcggtcccctggccggggtctcggtggccatggtggagcggcgtcaccggctcgtggcgcgctgcctgatctgcctgctggtcgggttcgccgtcgccatcgccgtgaccgtgctgttcagcctcgccatggacgcggccggactcttccacgccgagcagctgaccaggcaccgcccgatcaccgagttcatcgtctcgcccgacgagttctccctgatcgtcggcgtcctcgccggagtcgccggcaccctctccctcacctccgccaagtccggcgccctggtcggcgtcgccatctccgtcaccaccatcccggccgccgccaacgccgccgtcgccctctcctacggcaactacgcccagacccgcgcctccagcgaacagctcctcctcaacctggtcgccatctccgtcgcggggacgctgaccctgctggcgcagaagtggctgtggcggatgcggcggggacggggggccgcgccggcggacgggcgccaggaccggtgattctgccggtggcccgggcgcggtggggcaccgacagtggcagagccaactcgcccgtgaagcggtgtcgtcgggctcgtggcgccctgggcgcccgggtcccggcgggaccgcgccgcggccgggccccacgaccgagaggacgctcgccgtgcactccaccccacgtaccggaaccacccaggcccccggcctgagccgccgcctggccgcctcggccgccgccgtggccgccgtcgtcggcctcaccacgctctccacccccggcgcgcaggccgcggacaacccgtacgagcgcggccccgcgcccacccgggcgagcatcgaggcgccgcgcggcccgtacgccgtctcgcagacctccgtctcctcgctggtcgtctccggcttcggcggcggcaccatctactacccgaccagcaccggcgacggcaccttcggggccgtcgtggtcaccccgggcttcaccgcgaccgagtcctccatggcctggctcgggccgcgcctggcctcgcagggcttcgtcgtcttcaccatcgacacgctgaccaccctcgaccagcccgactcacgcggccgccagatgctcgccgccctcgactacctgacggagcgcagctccgcccgaacacggatcgacggcacccgtctcggcgtcatcggccactcgatgggcggcggcggcacgctggaggcggccaagtcgcggccctcgctgaaggcggcgatcccgctcacgccgtggaacctggacaagacctggcccgaggtgaccaccccgacgctggtcgtcggcgccgacggggacaccgtcgccccggtcgccacccacgcgaagccgttctactccagcctgccgtccagcacggaccgcgcctacctggagctgaacaacgccacccacttcgcgcccaacctctccaacaccaccatcgccaagtacagcgtctcctggctgaagcgcttcatcgacgacgacacccgctacgagcagttcctctgcccgctgccggtgcccgaccgcgacatcgaggagtaccggggcacgtgccccctcggtggctgacggaccgcccctcgcacggccgaagtggcggacggcccgcttccgcaccgggttacgcacgcgtaacctcccggggatgaccggcgaggaacccgccctccccacggtgcggctgcacggccgcgcaccgcagttgagccgtgtccgcgcctggtggcaccagccgcccgcccaccgcaccgccctgctggtggccggggagcccggcctcggccgcaccgccgtgctgcggtgggcggcgcgtgtcctgggcgcgggcagcaccggccacctggtggcgggacccggcgccgggccccgccaccaggagtggacccccgggaccctgctgcacgccgtggagagcggcgagggcagggtcccggcgctggtgtgcgcggacgacgccgaccggtggccgcccgccgcccggcggctcctcggggaggcggcccagcggctgtccgaggcgggtggcggcctcctgctcaccgccgccacccaccgtccgctgcccggggaactggccgcgctgcccgccgtccacctggacccgctggcgccccaggaggccgcggccctgctggcggaggcggcacgggagaccgtggagccgtccgtggccgccgagttgatcgcggagggcgagggcaaccccgccctgctgcgcgccctggtccaccacctgtccccggcggcgctgcgcggacgcgccccgctgccccgccccctcgccgacgcggccaccctggcgagggtcgcgggcccggccctgaccggccacgatccccggacggcggcactggcggtgctggtggccgcgggcacccggccggccggtgccgaccgcgtcgacacccgcctggccctgcgcgccctgaaccgcctcgtccccggcgcccgcccggaccccgcgtgcccacccgccctgctccacgacgccggcgacaccctcggcttccgcagccccctgctgggccgggccctgtacgccgccgcctccccggcccggcgccgggccgcgcaccgcgcactcgccgaggagtacgcggcggacgggcaccggctcaccgccctgctgcaccgctcctggtcggcggcggacggcgcggcggacgccgggctcgcggaccgcctggccgccgaggccacggcggccggggcgaaggagccgcccgccctgcgctccctggcctgcgcccgcgccgccgtcctcgccgggccaggacccgagagcgccggccggcagacccgtgccgccgaactcgccctggacgcgggggacgcgcaccgggcccggctgctcgccgccgccgtccccgagcacctcctgccgttcgggaccggggcgccccgccctcgtacgcggcctggcacgctcgtggacgggccggccggggacgcccaccacgccctcgctcgccgcagccctctgcacgcccgccgcccccgaacgggccgaggccgcccgctcgccgccgccgacgccgcctgggccgccggtgacctcgcggcctgcctcacctccctcggcccggacaccccgggcgggccggaaccggaggcgccgggtgaccagcgggccgggatgcgggccctgctcgaaggccggttcggcccggcagcccggcggctgggccgggtacgggagcagggcaccaccacgccggcggcgccggagacgctgctgcgctccgccaccgccgcgctgctcctgggcgaggtggaggcggcccgccggacgggcgcacgggccctggccggagcccggcaggagggctcggccgcgctggtgccccgcgccctggagtacctcgcctacgccgagttgcgcgccggacgccacgccgaggcacgggcgcacgccgaggaagggctgcgcgccgccctgcggtccgggcagcgcaacacggccgcgcaccaccacgccgtcctggcgctcgccgcctccatcgaggacgagccgcacgtggtcgaggaacatgtcgaggccgcctgcgccaccgcccgcagccacggactggcccaggtgctcaccctcgcccagtgggccgcgggccgggccgacctcgggcgcggccggccgctggaggccgccgaccggctcggcctgctggtcctgccgggcccccggcgcggccacttcgcggtgtggcggctggccgtgccctgcttcgtggaggcggccgtccccgccggacgcgccgccgaggcacgtacgctgctggacgagggcgccggctgggcgagcttcggcgcggacccccaggcggccgcccaactcgcccgctgccaggccctgctggacccgaccgaggaggccgacgccctctaccggctggccctggaccggcacgcggcggcgggcggcggcttcgagcacgcccgtaccacgctgctgcacggcaaatggctgcgacggcgccgccggccccgcgaggcacgcgacaggctcggcgccgccgtcgccggcttcgcccgctgcggggccggcgtgtgggcccgtcaggcccgtgacgagctgcggtcgctggtcacgccgccgtccccgccggacctcaccgccctgtcctctctcaccccgcagcagcgccgcatcgcccggttcgtcgcgcggggtgccaccaaccgcgagaccgccctcgccctctccgtcagcgtccgcaccgtcgactaccacctgcgccggatcttcgcggccctcggcgtccgttcccggctggaactggcgcggctggtggacgaggcggagcagtcggccggagggtgagggcaccgcccgcgccgggcccacacggtcttcacaccccgtgcccggcctcacgccggatcgctatggcgaaaccaacacagccgccggtagcgtcagttcctcagagggaacgtttgtctcacggggagtccatggtgaaccgccgctctttgcccgcagtctcactggcagtggccgccgcgctggcgctgtccgcctgcgggggcggggacgggaagtccggtgaggacgacaagatcgcgggggccgacggcggcggcggttcgagcgccgcgccggagcccggtgcgtcgcccgaggccgagcgccccgcgatcaagctgccgacggacatgaagaacgtcttcgagggcggcggcacgggtgacccggtggccgaggccgtccttgcgggacagcgaggggcgga

SEQ ID NO: 1662 - protein, 208 aa, Streptomyces albus
STLSVTYLSFMTLATTLAACGVVLDNAVLIVGAMAIGPDFGPLAGVSVAMVERRHRLVARCLICLLVGFAVAIAVTVLFSLAMDAAGLFHAEQLTRHRPITEFIVSPDEFSLIVGVLAGVAGTLSLTSAKSGALVGVAISVTTIPAAANAAVALSYGNYAQTRASSEQLLLNLVAISVAGTLTLLAQKWLWRMRRGRGAAPADGRQDR

SEQ ID NO: 1663 - protein, 304 aa, Streptomyces albus
MHSTPRTGTTQAPGLSRRLAASAAAVAAVVGLTTLSTPGAQAADNPYERGPAPTRASIEAPRGPYAVSQTSVSSLVVSGFGGGTIYYPTSTGDGTFGAVVVTPGFTATESSMAWLGPRLASQGFVVFTIDTLTTLDQPDSRGRQMLAALDYLTERSSARTRIDGTRLGVIGHSMGGGGTLEAAKSRPSLKAAIPLTPWNLDKTWPEVTTPTLVVGADGDTVAPVATHAKPFYSSLPSSTDRAYLELNNATHFAPNLSNTTIAKYSVSWLKRFIDDDTRYEQFLCPLPVPDRDIEEYRGTCPLGG

SEQ ID NO: 1664 - protein, 890 aa, Streptomyces albus
MTGEEPALPTVRLHGRAPQLSRVRAWWHQPPAHRTALLVAGEPGLGRTAVLRWAARVLGAGSTGHLVAGPGAGPRHQEWTPGTLLHAVESGEGRVPALVCADDADRWPPAARRLLGEAAQRLSEAGGGLLLTAATHRPLPGELAALPAVHLDPLAPQEAAALLAEAARETVEPSVAAELIAEGEGNPALLRALVHHLSPAALRGRAPLPRPLADAATLARVAGPALTGHDPRTAALAVLVAAGTRPAGADRVDTRLALRALNRLVPGARPDPACPPALLHDAGDTLGFRSPLLGRALYAAASPARRRAAHRALAEEYAADGHRLTALLHRSWSAADGAADAGLADRLAAEATAAGAKEPPALRSLACARAAVLAGPGPESAGRQTRAAELALDAGDAHRARLLAAAVPEHLLPFGTGAPRPRTRPGTLVDGPAGDAHHALARRSPLHARRPRTGRGRPLAAADAAWAAGDLAACLTSLGPDTPGGPEPEAPGDQRAGMRALLEGRFGPAARRLGRVREQGTTTPAAPETLLRSATAALLLGEVEAARRTGARALAGARQEGSAALVPRALEYLAYAELRAGRHAEARAHAEEGLRAALRSGQRNTAAHHHAVLALAASIEDEPHVVEEHVEAACATARSHGLAQVLTLAQWAAGRADLGRGRPLEAADRLGLLVLPGPRRGHFAVWRLAVPCFVEAAVPAGRAAEARTLLDEGAGWASFGADPQAAAQLARCQALLDPTEEADALYRLALDRHAAAGGGFEHARTTLLHGKWLRRRRRPREARDRLGAAVAGFARCGAGVWARQARDELRSLVTPPSPPDLTALSSLTPQQRRIARFVARGATNRETALALSVSVRTVDYHLRRIFAALGVRSRLELARLVDEAEQSAGG

SEQ ID NO: 1665 - DNA, 2338 bp, Staphylococcus epidermidis
tcgagctaaatcgatttctggcccactcttttttatttttagtaaaattttcggatttataccacgtatgattattaatattttcatctaacaaattaccgagaaaaatttcattttaaaataaacaaatagatagaggtgctaattgtgaagacaagacaaaataaatacagtattcgtaaatttagcgtaggtgcatcatccattctgattgcagcattattatttatgggtggaggatcagctcaggcagctgagcaacaacaggataagggaactgttgaaaatagcacaacacaatctattggggatgaaaatgaaaagttaagtgaacaacaatcaacgcaaaataagaatgttaatgagaaaagtaatgttgattctattactgaaaatgaaagcttacataacgaaacaccaaaaaatgaggatttgattcagcaacaaaaagattctcaaaacgacaataaatctgaatctgtagttgaacaaaataaagagaatgaagcatttgttaaaaaacattccgaagagaaaccacaacaagaacaagttgaactggaaaagcatgctagtgaaaacaatcaaactttacactcaaaagcagcacagtccaatgaagatgtgaaaactaaaccttcacaacttgataatacaactgcccaacaagaagactctcaaaaagagaatttgagtaaacaagatacacaatcatctaaaactactgatttactacgagcaacaggtcaaaatcaatcaaaagatagccaatcaacagaagaggtaaacaaagaagtaaaaaacgacactcaacaagtgactgctaagaacgatgacgacaaagttgaaacatttaatttaaatagtaaagaggaacctcttaaagttgacaagcaagcgaatccaactacagataaagataaatcttctaaaaatgataaagggtctcatgatggtctcgctaatttagaaagtaatgctgttgctacaactaataaacagtctaagcaacaagtaagtgaaaaaaatgaggatcaaacaaataaatcagcaaaacaaaaacaatataaaaataatgatccaattattttagtacatggtttcaatggatttacagacgatatcaacccatcagtgctaacgcattattgggggggcgataaaatgaatattcgccaagatttagaagaaaatggatatgaggcttatgaagcaagtataagtgcatttggtagtaactatgaccgtgctgttgagttatactactacatcaaaggtggacgtgttgactatggtgcagcacacgcagctaaatatggtcatgagcgttacggtaaaacctatgaaggtgtgtataaagattggaaaccaggtcaaaaaatacatttagttggtcatagtatgggtggtcaaacaattcgccaattagaagagctattgagacatggtaatccagaagaagttgaatatcaaaaacaacatggtggggaaatttctccattattccaaggtggccacgacaatatggtgtcatctattacaacactcggtacaccacataatggtacgcatgcgtcagacttattaggtaacgaagcaattgtacgtcaacttgcatatgatgtaggtaaaatgtatggtaataaagattcacgtgtagactttgggttagaacactggggattaaaacaaaaaccaaacgagtcatatattcaatatgttaaacgtgttcaaaattcaaaactatggaaatcaaaagatagtggtttacacgatttaacacgcgatggggcaacagatttaaaccgaaaaacatcattaaatcctaatattgtatataaaacttatactggcgagtcaacgcataaaacattggcaggaaaacaaaaagctgatcttaacatgttcttaccatttacaattactggtaatttaattggaaaagctaaagagaaagaatggagagaaaatgatggacttgtttcagtcatttcttcacaacatccatttaatcaaaaatatgttgaagctacagataaaaatcaaaaaggtgtatggcaagtaactccaacaaaacatgactgggatcatgtagactttgtaggacaagacagtacagatacaaaacgtactagagatgaattgcaacagttttggcatggtcttgctgatgatttagtacaaagtgaacaattaacatcaacaaataaataaaatgatatagggtataaacctaacgtaatcttatatagataggagtgagatacatgacaggtgacgcgtgaaggagccgaaaaaattaatcaaaaaacagagttaaacccaaatatttactata

SEQ ID NO: 1666 - protein, 688 aa, Staphylococcus epidermidis
MKTRQNKYSIRKFSVGASSILIAALLFMGGGSAQAAEQQQDKGTVENSTTQSIGDENEKLSEQQSTQNKNVNEKSNVDSITENESLHNETPKNEDLIQQQKDSQNDNKSESVVEQNKENEAFVKKHSEEKPQQEQVELEKHASENNQTLHSKAAQSNEDVKTKPSQLDNTTAQQEDSQKENLSKQDTQSSKTTDLLRATGQNQSKDSQSTEEVNKEVKNDTQQVTAKNDDDKVETFNLNSKEEPLKVDKQANPTTDKDKSSKNDKGSHDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLFQGGHDNMVSSITTLGTPHNGTHASDLLGNEAIVRQLAYDVGKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLADDLVQSEQLTSTNK

SEQ ID NO: 1667 - DNA, 927 bp, PSEUDOMONAS SP. B11-1
atgccgctcgataagcagatcgccgcggtgctccagcaatttagtgagctgccggcacccgatttcagccagctcgacgccgcgcaataccggcaattctgcgacaacctgctgcccgcgatccccggcgatccgatgattgaagtgcgtaacttgcgggttgccgcagcggccggtgagttggatgcacggctgtatcggccgttggaagaggacaatctgccgctgttggtgtttttccatggcggcggttttgtcatgggcaacctcgatacccacgacaacctctgccgctcccttgccagtcaaacggaggcggtggtggtttctgtcgcttatcgactggcgccggaaaaccatttcccggccgcgccgctggattgctatgcggccacttgctggctggtcgagcacgctgccgaactcggcgtcgatggccgtcgcctggcgctggccggagacagcgccgggggcaatctggcgctcgcggtcagtcgcctcgcggcgcaacgccaaggtccgaagatcagttatcagtgtctgttttacccggtcaccgatgctcgctgcgacagtcaatcctatgaggagtttgccgagggctacttcctcactggcgcgatgatgtattggttctggcagcagtatttgcaggataccgggcagggcgatgatcccttggcctcacctttgcgggccgagacgctggcggacttgccgccgaccaccctgatcactgccgagtttgacccgttgcgtgacgagggcgaggcctttgccctgcgtctgcaacaggccggcgtgtcggtgcgcgtgcaacgttgcgaagggatgatccacgggtttatcagcatggcgccgtttgtcgaacgcgctgcacacgcgttgtccgacgcggcggccgacctgcgcagggcactcaattga

SEQ ID NO: 1668 - protein, 308 aa, PSEUDOMONAS SP. B11-1
MPLDKQIAAVLQQFSELPAPDFSQLDAAQYRQFCDNLLPAIPGDPMIEVRNLRVAAAAGELDARLYRPLEEDNLPLLVFFHGGGFVMGNLDTHDNLCRSLASQTEAVVVSVAYRLAPENHFPAAPLDCYAATCWLVEHAAELGVDGRRLALAGDSAGGNLALAVSRLAAQRQGPKISYQCLFYPVTDARCDSQSYEEFAEGYFLTGAMMYWFWQQYLQDTGQGDDPLASPLRAETLADLPPTTLITAEFDPLRDEGEAFALRLQQAGVSVRVQRCEGMIHGFISMAPFVERAAHALSDAAADLRRALN

SEQ ID NO: 1669 - DNA, 2382 bp, Pseudomonas fluorescens
ggatccatgccagcccacggggtgaccgttcgcattcacggcgcctcgcggaaagctttctcagcgcctggcttttgcgccatccgcaggcgcaggtcacccgccgtgaagtcgggcgcgcgctgatcccgccagtcaatgaagcgtttgtcgctgctgcgtttcatcctgagcccgaggcgcgcccactgtcgatgcaagccgatctggcgctcagcgatcaattggtcggcgagttgttcgagcatgacctgctgctgatttccacgccgatgtacaacttcagcgtgcccagcggcctcaaggcctggtcgatcagatcgtgcgcctgggcctgacgttcgaccacaccctcgataacggcgtggcccagtacaccccgctgctgcagggcaagaaagcgttgattgtcaccagtcgcggcgggttcggcttcggccccggcggcgaactggaagcactgaaccacgccgatccgtggttgcgcaccgcgctgggctttatcggtatcaacgacgttacggtggtcgcggccgagggtgaagagtcggccgagcggaccttcgcggtgtcggtggccgaggccgagcagcgtttgctcgacctcgcccgggggttctagatggcctggctgttcctgctgattcgccgccgggttcgaagtcacgtttgccatgggcatgaaatacgccgaaggcttcaacccggttgtggccgtcgctgatcacggtgcttcgcggcgattggcggggtttacttcctgacgctggcgatgcgcgagttgccggtgagcatcgcctacccgatctggaccgcgatcggctcgctgggcacggtgtttctcggctttgccctgctcggcgagagcctgaccctggtcaaactgctgtcggtggggctgattgtggcgggggtggtgggcctgaagtaggctgagggtgcagttgtcatcatcaaggaggaggcttggcgggtgttttgcacgtcaggcctccactcacgaccacaaggatgtttgcccatgtcacaaagtacggcgacacgttatccactggtgctggtgccgggcatgctcgggtttatccggctgctgctgtatccgtactggtacgggatcatcaaggcgctgcgccgtggcggggccacagtgattgcggtacaggtgtcgccgctcaactccaccgaggtgcgcggcgagcaactgctggcgcggatcgacgagattctgcgcgagaccggcgcggccagggtcaatctgttcggtcacagccagggctcgttgaccgcgcgttatgccgcagcgaaacggccggatctggtcgcttcggtcacgtcggtggccgggcccaatcacggttcggaactggccgactatctgcagcaacactacccggcgaacactgccaagggccgtctgctcgaagcgctgctgcgtttgatcggctggctgatggcgcggctggaaaccggttaccacgggccgaaactgccggtggatatccacgcctcgcaccaatcgctgacccgcgagggcgtggcgctgttcaatcagcgttatccacagggcctgcccgaaacctggggcgggcaggggccggaagtggtcaacggcgtgcgttattactcgtggtcgggcacattgcagccgggcaagactgaccgcggtggcaacctgttcgacggcaccaaccgcagctgccggttgttcgcgaaaaccttcgtgcgtgagccggggcagtgtgacgggatggtcgggcgctacagctcgcacctgggcacggtgattggcgacgactatccgctggatcacttcgatatcgtcaaccagtcgctgggactggtgggcaagggcgcggatccggtgcggttgtttgtcgagcatgcggcgcggctgaaggctgcgggattgtgactcgcttttgtggcgaggggatttatccccgatggggcgcgcagcggccccgctttttatctcaaaacaagggctgctgcgcagcccatcggggataaatcccctcaccacagggccagatcaggcgacgctgagtttgcggcctagaacggtggtccagcgctccgacagaatcaccccacccaacgtcaacaccccacccaccaggtgatacatcgccaactcttccttcaacaccaccgccgcaatcagcgcagttatcagcggcagcaagttaaagaacaatgtggtccggctcggccccagacgctgcaccgcctgcatccacgccagcggcgcaagcatcgacgccagcaggcacgcatacagcaccagcggaatattttgcgcggtgaagccggttttcggtgaagcggcatacagcggaaacagcaccacaattgccaccagcacttgcaagttcaacaaca

SEQ ID NO: 1670 - protein, 296 aa, Pseudomonas fluorescens
MSQSTATRYPLVLVPGMLGFIRLLLYPYWYGIIKALRRGGATVIAVQVSPLNSTEVRGEQLLARIDEILRETGAARVNLFGHSQGSLTARYAAAKRPDLVASVTSVAGPNHGSELADYLQQHYPANTAKGRLLEALLRLIGWLMARLETGYHGPKLPVDIHASHQSLTREGVALFNQRYPQGLPETWGGQGPEVVNGVRYYSWSGTLQPGKTDRGGNLFDGTNRSCRLFAKTFVREPGQCDGMVGRYSSHLGTVIGDDYPLDHFDIVNQSLGLVGKGADPVRLFVEHAARLKAAGL

SEQ ID NO: 1671 - DNA, 2658 bp, Pseudomonas aeruginosa
gtcgaccatttcagcctgttttgctcgcaaaacgacgccgcgggcgtgcgcaccgcacactcggtcgctgggcgttgtgcggggaagattcaaacgagcgtttcgcgccgtaacaacccgcctcttccgctctgccacgcaggttatgaccggccgccaggaagccgcggatttcctggcctggaggaaaaaagccgaagctggcacggttcctgcgcaagggacagcgaagcggttctcccggaaggattcgggcgatggctggcaggacgcgcccctcggccccatcaacctgagatgagacaacatgaagaagaagtctctgctccccctcggcctggccatcggcctcgcctctctcgctgccagccctctgatccaggccagcacctacacccagaccaaataccccatcgtgctggcccacggcatgctcggcttcgacaacatcctcggggtcgactactggttcggcattcccagcgccttgcgccgtgacggtgcccaggtctacgtcaccgaagtcagccagttggacacctcggaagtccgcggcgagcagttgctgcaacaggtggaggaaatcgtcgccctcagcggccagcccaaggtcaacctgatcggccacagccacggcgggccgaccatccgctacgtcgccgccgtacgtcccgacctgatcgcttccgccaccagcgtcggcgccccgcacaagggttcggacaccgccgacttcctgcgccagatcccaccgggttcggccggcgaggcaatcctctccgggctggtcaacagcctcggcgcgctgatcagcttcctttccagcggcagcaccggtacgcagaattcactgggctcgctggagtcgctgaacagcgagggggccgcgcgcttcaacgccaagtacccgcatggcgtccccacctcggcctgcggcgagggcgcctacaaggtcaacggcgtgagctattactcctggagcggttcctcgccgctgaccaacttcctcgatccgagcgacgccttcctcggcgcctcgtcgctgaccttcaagaacggcaccgccaacgacggcctggtcggcacctgcagttcgcacctgggcatggtgatccgcgacaactaccggatgaaccacctggacgaggtgaaccaggtcttcggcctcaccagcctgttcgagaccagcccggtcagcgtctaccgccagcacgccaaccgcctgaagaacgccagcctgtaggaccccggccggggcctcggccccggccctttcccggaagccccctcgcgtgaagaaaatcctcctgctgattccactggcgttcgccgccagcctggcctggttcgtctggctggaaccttcccccgcccccgagacggcgcccccggccagcccgcaggcgggcgcagaccgcgccccgccagcagcctccgcgggagaagcggtgccggccccccaggtcatgccggccaaggtcgcgccgctgccaacctccttcaggggcaccagcgtcgatggcagtttcagtgtcgacgccagcggcaacctgctgatcacccgcgacatccgcaacctgttcgactacttcctcagcgccgtcggcgaagagcccctgcagcaaagcctggaccgcctgcgcgcctacatcgccgccgaactccaggagccggcgcgcggccaggcgttggcgctgatgcagcaatacatcgactacaagaaggaactggtgctgctcgaacgcgacctgccgcgcctggccgacctcgacgccctgcgccagcgggaagccgcggtgaaagccctgcgcgcgcggatcttcagcaacgaagcgcacgtggcgttcttcgccgacgaggaaacctacaaccagttcaccctggagcgcctggcgatccgccaggatggcaagctcagcaccgaggaaaaggccgccgccatcgaccgcctgcgcgccagcctgccggaagaccagcaggaaagcgtgctgccgcaactgcaaagcgaactgcagcagcagaccgccgccctccaggccgctggcgccggcccggaagccatccgccagatgcgtcagcaactggtgggcgccgaagccaccacccgcctggagcaactcgatcggcaacgctcggcctggaagggccggctggacgactatttcgccgagaagagccggatcgaaggcaatgccgggctgagcgaagccgaccgccgcgcggcggtcgaacgcctggccgaggagcgcttcagcgaacaggaacgcttgcgcctgggcgcgctggaacagatgcgccaggccgagcagcgctgaccggcacggaaacgccgagaacgcggcgaagggcgcttcggcggataacgctaccctcaggggtgcagccctggcgtggccggcgaggcggaaacctgtgctgcgcgccgcaacgaaaaagggcggccacccgaaggtgtccgccctttttcgtcgccagcccggttcagcgggacagcttgccgtccagcgagaacttgccggcgccatcgatcagcagcgccacgctgatcatcagcagggtcagggcatattcatagccgttgtcggtgatgaagaagccattgccgatgtgcacgctgaagatcgccacgatccgttgacctgcaggtcgacccagatc

SEQ ID NO: 1672 - protein, 311 aa, Pseudomonas aeruginosa
MKKKSLLPLGLAIGLASLAASPLIQASTYTQTKYPIVLAHGMLGFDNILGVDYWFGIPSALRRDGAQVYVTEVSQLDTSEVRGEQLLQQVEEIVALSGQPKVNLIGHSHGGPTIRYVAAVRPDLIASATSVGAPHKGSDTADFLRQIPPGSAGEAILSGLVNSLGALISFLSSGSTGTQNSLGSLESLNSEGAARFNAKYPHGVPTSACGEGAYKVNGVSYYSWSGSSPLTNFLDPSDAFLGASSLTFKNGTANDGLVGTCSSHLGMVIRDNYRMNHLDEVNQVFGLTSLFETSPVSVYRQHANRLKNASL

SEQ ID NO: 1673 - protein, 340 aa, Pseudomonas aeruginosa; identical to SEQ ID NO: 1490

SEQ ID NO: 1674 - DNA, 3130 bp, Pseudomonas wisconsinensis
ctgcagttgggcatcggtatctgctaggttctgcacgataagtgcctgcgctcgttgatgctgcgttaaagacgggctggaacgccagcccggtcgaatgctcatttacaactcgtaaactcgaatgcgagcccagtccgttcctcacccgtttttgtggggccgccatcggtatcgcctgaccttcgctcgacgacttttcgtacagacccgagttgcttgcgtctgggcctgcgagtagcgtggtggaatcgcgtcattgcccgaggtcactgccatgtctattcgtcgtcttgcctgttcacttttgctctccagcctggcgttgccggtgcttgccgcagagtgtccggccatgctccagggcgaactgcccaagctgcgcgccaaaggtgaaaacatcgagctctgtcagtacgcgggcaagccgctggtggtggtcaataccgccagcttttgcggcttcaccccgcaattcaaagggcttgaagcgctttaccagcggtacaaggatcaggaactggaggtattgggcgtgccgtccgacgacttccgccaggaatccgccgatagcaaggaaacggccaccgtctgctacgtcaactacggcgtgaccttcgccatgaccgaaccgcagccggtttccggtgccaatgccatcccgttgttcaagggcctggccgagcagagccggcagccgcgctggaacttcttcaagtacgtggtcgaccgtcagggcaaggtggtggcgagtttctccagcctgaccaagcctgacgatcccgagctgattgccgcccgtagagaaggcgatcgcctcgcaaccctgattccgtcccgcttcacggcccttcacccatctgggcgatgggccttgtccgtctgcctgcctagactggccaggcgccggacgcagttcacccggcgtgccctacaagaacaataaggaggcacccatgcgtcgcgtctataccgctgccctggcaacactcgctctgcttggcgccgtcgaggcccaggccaactacaccaagaccaagtatccgatcgtgctggtacacggcgtgaccgggttcaataccatcggcgggctggtcaattacttccataccattccctggaacctagagcgcgatggcgcccgggtgcacgtcgccagtgtcgctgccttcaatgacagcgagcagcgcggcgccgagctggcccggcagatcgtgccctgggccgcaggcggaggcggcaaggtcaacctgatcggccacagtcagggctcgccgacctcgcgcgtggcggcttcgttgcggccggatctggtggcatcggtgacctcgatcaacggcgtcaacaagggctccaaggtcgccgatgtggtgcgcggcgtgctgccaccgggtagcggtatcgaaggcggcgccaatgccatcgccaacgccctcggtgcggtgatcaatctgctgtctggctcaagcaacccgcaaaacggtatcaacgcgctaggcaccctgaccaccgcgggcaccagtgcgctgaacagtcgccacccgtggggcgtcaacaccagcagctactgcgccaagtccaccgaagtgcacaatgtgcgcggtcacagcatccgctactactcctggaccggtaatgccgcctataccaacgtgctcgatgcggccgatcccttcctggccttcaccggcctggtgttcggcagcgagaagaacgacggtctggtgggcgtatgttccacctatctggggcaggtgatcgacgacagctacaacatgaaccacgtcgatgcgatcaaccacctgttcggcattcgtggctggaccgaaccggtgtcgctgtatcgccagcacgccaaccgcctgaagaacaagggcgtctgatcccggtgaacgcggcggggcaactcgccgcagtgaggtcgcatgtccaaattcttcagtctttccctggttgccgtggtggtcgctggcggccttaccctgtactggcgctggccggcagcagtgcctgaagcgcagcctgctaccactgtcgccgtgccgtcacggcagtcgttgatcgagcaggcttcgacttcccccgccaaggcgcccgccgaggcgcaaccgtcaatagccgtgaccttgcccagcctggccggtaccgaggtggatggccagctgcgtaccgacgcggccggcaatctgctgctggatctggcggttcgcgattacttcgattacttcctgagcgcggtcgatcattccgggctcgatgcggtgatcgaggccctgctggccgatgccggccggcgcctgccggagcccgcactcgggcagatgatcagcctgctcggtgattaccttgactacaagcgcgccagcatggcgctgatgcagcaaccactggatgcaaggcagcaggtcgagccgcaggcgcagctacaggctctgcagtcggctttcgcgcgcctggacgagctgcgccgcgcacatttctctgcaactgcgcaggaagcgctgttcggcgccgaacaggcctatgcccgttacaccctcgatagcctggcagtgcagcagcgtgatgacctcggcgaggcgcagcgcacgcaactgctcgaacagttgcgtgagcgtctgcccgatgcgctgcgcgaaagtgagcagcgccagcaactggcccaggagcaactgcagcgcagcgagcaactctggcgtgatggtgcggacgagcaacaggtgcgcgagttcctggcgatgacctatgatccggacaccgtgcagcgtctgcttgatgagcagcgtcgcgagcgcgactggcagcagcactaccaggcctatcgcaatgagttggccagcctgcaaggtcgggggctgagcgaggcagatggcgagcaactgcagcgccagctgcgcgagcggctgttcagcagtgaagaccgacaccgtgtggaaacctatgacgccattgccgcgaagcagccggagccgctcgacccctgacggatgtcgcccatgagcgagcgcctgctgttggcccagcagcgccgaggctatcgctcgctgcgtttcgtcgccgagctggaggcgggttttgccgggcatcgggtgcagcgcattcgtcggcgtctgccctgatcgccctacgc

SEQ ID NO: 1675 - protein, 222 aa, Pseudomonas wisconsinensis
MSIRRLACSLLLSSLALPVLAAECPAMLQGELPKLRAKGENIELCQYAGKPLVVVNTASFCGFTPQFKGLEALYQRYKDQELEVLGVPSDDFRQESADSKETATVCYVNYGVTFAMTEPQPVSGANAIPLFKGLAEQSRQPRWNFFKYVVDRQGKVVASFSSLTKPDDPELIAARREGDRLATLIPSRFTALHPSGRWALSVCLPRLARRRTQFTRRALQEQ

SEQ ID NO: 1676 - protein, 308 aa, Pseudomonas wisconsinensis
MRRVYTAALATLALLGAVEAQANYTKTKYPIVLVHGVTGFNTIGGLVNYFHTIPWNLERDGARVHVASVAAFNDSEQRGAELARQIVPWAAGGGGKVNLIGHSQGSPTSRVAASLRPDLVASVTSINGVNKGSKVADVVRGVLPPGSGIEGGANAIANALGAVINLLSGSSNPQNGINALGTLTTAGTSALNSRHPWGVNTSSYCAKSTEVHNVRGHSIRYYSWTGNAAYTNVLDAADPFLAFTGLVFGSEKNDGLVGVCSTYLGQVIDDSYNMNHVDAINHLFGIRGWTEPVSLYRQHANRLKNKGV

SEQ ID NO: 1677 - protein, 352 aa, Pseudomonas wisconsinensis
MSKFFSLSLVAVVVAGGLTLYWRWPAAVPEAQPATTVAVPSRQSLIEQASTSPAKAPAEAQPSIAVTLPSLAGTEVDGQLRTDAAGNLLLDLAVRDYFDYFLSAVDHSGLDAVIEALLADAGRRLPEPALGQMISLLGDYLDYKRASMALMQQPLDARQQVEPQAQLQALQSAFARLDELRRAHFSATAQEALFGAEQAYARYTLDSLAVQQRDDLGEAQRTQLLEQLRERLPDALRESEQRQQLAQEQLQRSEQLWRDGADEQQVREFLAMTYDPDTVQRLLDEQRRERDWQQHYQAYRNELASLQGRGLSEADGEQLQRQLRERLFSSEDRHRVETYDAIAAKQPEPLDP

SEQ ID NO: 1678 - DNA, 2874 bp, Aeromonas hydrophila
acgtcggtcagcttctcccgggtgcgcacggcaccttggtctgcacgtcgaactcctcgcggctcaccagatccagcttgttgagctgggcctgcaagacctgacgggtctttttctccacctcttcacccatgctgcgaatgccggggggcagggcgttgtgtatctgtttggcgatctcttccagttttttcgggtcgatcatgggggtctccttaagcaatggcgccattctaccgacaaatcgtctcctttgccgagatcggagcggctttttgcgccatggatcccatcgggctctggtcgggtctggttgatgcaccctggctgccaccctgtgacgccggggatcaattccaattccttgatggtgtacacaaaaaaatcagatcagatgactgaccagaggcttattaattgttgcgttgctgttaatatgattcggtcgggtttgaaccctaccccgtcagctcatcatggataacaacataaaagagataaggatatgaagaaaaagctaatttacgcggccgtcgtcagtgcgctgctgagcggttgtggtggcagtgacgacaacacaggcgatacctcaagctatctcgattatctgctgagcggctccaatgcagtccgacccagcgccctggcagcccgtgcgaccgacggtaccctgaaattctccacggagacggcggatctctccaacccggtgtccgccctctccaccctggatggctggtcgactacccaggcgatccagattgtgccggtgacgtccggcatccaggtaaaggcgccggccgctgctgaattcacagcctccgtggcacccctctacctgatggagctggagtttgacagtgcggccctgcgtccgagcggcgtgaaaaaggtgctgacctacggggtggacttcgtggtggccgagacgacccggcaagctgaatctggtgccgctcaagccgctcaacccctcttcctactacatgatagtggcgaccgataccctcaaagacagcacgggcgccccctgcgaccgggtagcgactacagcaactacaagaccagcaccggcagcaacgcccaggagcagaccatcagcggcctgattgcgctgcaggaagggctgttcaaggcagccaccggcatcaccagcgaccacgtgatcttctccgactggttcggtacccagtccggcgcggacgtgctggtggcggtgaaaggggcggccgcatccgtgctcaagagcccgaccctggacgccgccgccctgtggaagcaggacgctcctgggcaataccagcctgcctggcacctataccctgtcggtgagcggcggcagccccttcctgacccagctggatgccgagaacttcctgcccaggagcagaaggatgcgattgccgccgcttttggtgacgcactccactccacaatctggccttgggtaccaccgtctacagcggcaccgtcaagctgccctacttcctctcctcggccaccgccggctcctgggacaaggcgaagacccagtcctggcacggtgccatcccagcctctacgccatcgcgaacgccctgaaggcccaggatgccgaagtgatcggcggcctggtgggggcgggtatggatcccgagatgaacatcgggcgcttcaacccgctgccggcactggaagaggtgcagtccgtcccgatgcggatcttcgccgccgcaccgctggcgaacatcaccgacgtgatcatctatcagcacggcgtcacctcggtgaaggaaaacgcttatgcgctggcccttggccgaattggtgccggtgcccaggcgagcaagaacgtggccgtggtggtgatcgatcatcgttgcacgtgaacgcgttcgccctgaccggcagcatggactcggtgaccacctccgacaacccgaccccctacctgaacctgagctacctgaccgtggcccgcgacaacctgaaacagagcgtggcgatctgctgggcctgcgtctggcagtggggctggccaatgccaagggcgatcggcaccgcaggcagcctcaaggtgcacttcctgggtcactccctgggtgcctcgcgggggccaacctgttggcggtggccaaccagtctgttggcaacccgacgcagacgccctgttcaagttcgacactggcggcctggccatgccggtcggcatagcgccgctgttgctgaactcgcagccttcggtccgaccatccagatgagcgtgctgaccgctggcagtgcggccctgaaggcagctttcaccgcctacgccccgaactgcaagacggccagtaccgacctgcttcgtcaacgagttcctgccgagccaggatgcggccacccaggccacggcggccagcaccctgcagagctacagcttcgcgcgcagtcggtgctggattcggcagaccccatcaacctggggagcggtatccgcggacttcccgctgtttgccaccgaaatcgtcggcgaggcgccctgagcctgtcggatcgagtgatcccgaacagcatcgccaccgccccccctgggtggcaccgagccgctgttcaaggtcctggccctgcaaccgctgaccgccacgggccgccaaccacagagcggcccgtttcgtggccgggggtcacagctcgctgctggcaccggacgagaacttcgatccgaccggcgccgtcaccaccgagatgcagacccagttcggcagcttcttcgcaagcggcggtaccgcggtcaaggtgaccgacgccagcctgctaagcagtaagctggccgaccaataaaaacgcaaggggcggcgtttttatatggcaaatcggctcaggctggccggtggtgcctgtccagccagcaac

SEQ ID NO: 1679 - protein, 751 aa, Aeromonas hydrophila
MKKKLIYAAVVSALLSGCGGSDDNTGDTSSYLDYLLSGSNAVRPSALAARATDGTLKFSTETADLSNPVSALSTLDGWSTTQAIQIVPVTSGIQVKAPAAAEFTASVAPLYLMELEFDSAALRPSGVKKVLTYGVDFVVAETTRQAESGAAQAAQPLFLLHDSGDRYPQRQHGRPLRPGSDYSNYKTSTGSNAQEQTISGLIALQEGLFKAATGITSDHVIFSDWFGTQSGADVLVAVKGAAASVLKSPTLDAAALWKQDAPGQYQPAWHLYPVGERRQPLPDPAGCRELPAQEQKDAIAAAFGDALHSTIWPWVPPSTAAPSSCPTSSPRPPPAPGTRRRPSPGTVPSQPLRHRERPEGPGCRSDRRPGGGGYGSRDEHRALQPAAGTGRGAVRPDADLRRRTAGEHHRRDHLSARRHLGEGKRLCAGPWPNWCRCPGEQERGRGGDRSSLHVNAFALTGSMDSVTTSDNPTPYLNLSYLTVARDNLKQSVAICWACVWQWGWPMPRAIGTAGSLKVHFLGHSLGASRGPTCWRWPTSLLATRRRRPVQVRHWRPGHAGRHSAAVAELAAFGPTIQMSVLTAGSAALKAAFTAYAPNCKTASTDLLRQRVPAEPGCGHPGHGGQHPAELQLRAQSVLDSADPINLGSGIRGLPAVCHRNRRRGALSLSDRVIPNSIATAPPGWHRAAVQGPGPATADRHGPPTTERPVSWPGVTARCWHRTRTSIRPAPSPPRCRPSSAASSQAAVPRSR

SEQ ID NO: 1680 - DNA, 6117 bp, STREPTOMYCES SP.
gatctccgaggtcaagggcgcgctgcgggaggcgggccacccggtccgctgaggaccccgatccctttcggcggtatcgccggtccgtcaagaccggtgataccgccgatgcgcgtccacgggccgcaccgtgagagtggcgaccgccgacgaaacgacgacggcagccacgcggcgcgccccgaccgcccccggacgacgggcccctgggcctcgcgtggtgtggttcccgcccaccgagaggatcccccgtgccccagcacctcctccccgcacgccgacaggccgcgcgcccgagccgcccccgtacgctgacgggtctgctggccgccgcggcggccacggccggcctcctgctcagcggcctggcccctggcgcccaggcggccgcggccgccgccaacccctacgagcgcggtccggcccccaccaacgcctccatcgaggcgagccgcggcccgtacgccacctcccagacctccgtctcctcgctcgtcgcgagcggcttcggcggcggcaccatctactacccgacctccaccgccgacggtaccttcggcgcggtcgtcatctcgcccggcttcaccgcctaccagtcctccatcgcctggctcggcccgcgtctggcgtcccagggcttcgtggtcttcaccatcgacaccaacaccacactcgaccagccggacagccggggccgccaactcctgtccgcgctggactacctgacccagcgcagttcggtacggacccgggtggacgcgacccggctcggggtgatgggccactcgatgggcggcggtggctccctcgaagccgccaagagccgtacgtcgctcaaggcggcgatcccgctgaccggctggaacaccgacaagacctggcccgaactgcgcacgcccacgctggtggtgggagcggacggcgacacggtcgccccggtcgccacgcactcgaaaccgttctacgagtcgctgcccggctcgctggacaaggcgtacctggaactgcggggcgcctcgcacttcacgcccaacacgtccgacacgacgatcgcgaagtacagcatctcgtggctgaagcgcttcatcgacagtgacacccgctacgagcagttcctctgcccgatcccgcggccgagcctcaccatcgcggagtaccggggcacctgcccgcacacgtcgtagaacgccccgtccgggcgcctcggctggggctctggcttcagcctcggctcccggccccggccccggttctggcttcgccccggttcccggctccggcactgtgcccgcgcacagcgccggagccgtccggctgggagtccgcaccgctcgggcggggtgaccggacgtgcgccttccacggtcgcccggccgaccgtacggtgccgacgtgacctcatcgacgaccgtgcgcagtccgcaccggctgtacggccgtggcggtgaactggccatcatccaggggctgttgacccggctgcggcagggcgacggcggtgcgctcgtcctggcggcaccgccggcctcggccgtacggcgctgctgcgcgaggcggcgtccgcgcatcggtcgtgggggccggtgctgtacgggacggcgtccgctgccgggaccgccgccactgcctcggccgactccgccgggttgcccgaccctgttgggccggccgcctacacagggccggccgcccgcgccgcctcggccggccgtgccgggtcggccgatcgcggcgggcgcgccacccacgccgcaccggccgaccgcgccgggccggtcccggcgcccgagcccttcacccccgaacccctcacccccgaggaactgctcgcccggctcagggacgggagcaccgaccggccgctgctggtctgcgccgacgacgcgcacgcctgggacccggcctgccgcaccgccctcgccgccgcagcccgccgcctcggcccgggcagcggggtcgggatcctcatcgccgccgacgacggccccgccttcgccgggctgcccacccgccgtctcggcccgctggacgaggacgcgtcggccgcgctcctggaccggctggcgggagccggagccggagccaccacggacccgctcgacccggtcgtccgcgccgagctgctgcgggagggggccgggaacccccgcctgctcaccgcgctcctgggccacctcacccccggccggctcaccggccgcaccccgctgccctctccgctgcccggggccgaaggggtgctggaggcgtacgcgtaccgcctggacgccctccccgcgcccgcccgggccctgctcctgctggccgccgcggcccaggagcacgagcccgccggggcgggtacggacgcgctgctcctgctgcgcgcgggcacccgggccgggctgccccgggacttcctggacgacgccctgttcggtccggccgcgaccgaggggctgctgcaacgggcggggagccgggtccacttcagcccgcccctggccgcccgagcggtcctgcaccacacgcccccggcccgccgccgcgccgcccacgaactgctcgccgcgctgctgggggaggcgggcggccgggccggaacgctcgccgccctcgcccagcgggcctgtgccgcgccgggccccgaccacgcgctcgccgcccggctggaggcggcggccaccgccccgtactcccacgccgaacgctcctccgccctggcccgcgccgccgcgctcacccccgatccgccgctgcgctcggcccggttcgccgcagccgccgaacaggcggcccacgcgggcgacccggaccgggcccgcgccctcctggcccgcacggccgccccggcggaaacggggtccggcctcgcgcctacgacgggtgggccggggctcgccccctacgtccacggcctgctcgccctgcgttccggccccgccgtcgacgcccacgaagctctcctggccgccgcagcgctgctcgggccgcacgattccggccgggccctccacgcgctgctcggggccgccgatgccgcctgggtgcggggggacgcgggcgggtacctggaggccatggggcgcgtcgaccccaccccgtacggcgacgccttcgcctcctaccgggcgggcatgtgcgccgtgctcgccgggcggaccgccgagggccacgccctgctccggcggtgcctcgacccggacgggagcgccgaggggcaccccgtcctccgccggtgccccgaccccgccggtctcctccgggccggagtcgccgcgctcgtgctcggggaggtggccgccgcctgccggatcggggcgcgggcgctcggggccgtacggaccagggggcccgaggtgttgctgccgcaggccctggagtacctcgcctacgccgagctgcgggccgggctgcacgcggcggcccgggcccacgccctggaggggctgcacgccgcacggcggaccgggcagcccaacagctccgcccgtctgcacgccgtcctggccctcgccgcctccgtggaagggcccggcgaggcgtgcgccgcccactgcgatgccgcgctggccggtgccgtaccgcacgggctcgcccagcccgcgaccctcgccacctgggcccggggccgcgccgacctggccgccgggcgccccgaggaggccgccgcccggctggggccgctcgtgcgccccggacccgggcaggggcacttcgccgtccggacgctcgccgtgccctgttacgtcgaggccgtcgtcctcggcgggcggggcggtgaactctcctccgtcgttgacgagttcgctgcctgggccgaccggaccgccgatccccaggcccccgcccagctcgcccgctgccgcgccctgacggcccccgccgacgaggccgacgcccggtatgcggaagccctcgcccaccacgaccgggcgggcggcgacttcgagcgggcccgcaccctgctcctttacgggcagtggctgcgccgccgtcgccgtacccgtgaggcccgcaccccgctgcgcgacgccctcgtcgccttccagcgctgttcggcccgcgcctgggccgagcgggcgggcggggagttacgggcggcgggggagccggtcgccggggcggtacgggacacgggcggcgacggggtgctctccgcgctcaccccgcaacagcagcgcatcgcccgctgcgtcgccgaaggggccaccaaccgcgaggtcgcgctccggctctcgctcagcccgcgcacggtcgaccaccacctccgcaacgtcttcgccgccctctccgtccgctcccgcaccgaactggcccggctgctcggcccccagacgtccccgatgcctcggacgtcccggagtccccagagtccccagagtccccagagtccgcaggggccgtgacgggcaggtggacgggtggttgcgagaccgtgatgacaagttccgggcagacccctaggtaccgaccgggcggtatgccattctgcgggcgtcaggatcgcccggccgatctccggtggaggccgccatgccccagctcgtccgtccgcggttcgcggtgctgcacggcacgcaccccgcggcgccgttgccccagcgcttccgttccctggccgaccgcgaggccgtcgaggtgctgcaccgggccgcccgggtcctcgtggcctcgctcccggccctcaccgaccggctcgtggaggccctgtacgagcaggagcccggctaccgggcggccatcgacgcggaccggtccgaggtctggcaggaggtccaccactccctgcgccacaacgtcggctcgctgctccagcccaaggagttccgcgacgccgcccaccgcacgtcccgctggatcggtgagatccgcgccggacagggcgtcccgctcgacgccgtcctgcacgccttccggatgggcggggcgatggtctggcaggacctggtcgacgagacggcccgccgcggccccgacgacgtacggctgctcgtccacgtcgccgccgacgtgtggaacttcgtcgacgagcactgcggcatcgtcgcggacgcctaccggcaggccgagcgccggctgacctggcagcgcgagaaccggcagcggctggtgatcgcggcgctgctcgacgggaccgcccggatcgcggacctcagcgacgcggcggccatgctgggcctgccggaacaggggcggtacgcggtgctcgcggtggcctccgtacggcgcggcgaccccggccccgtacggcagtcccagccggaacccgtccggccgctgctgaacctgccgtccgccctgccgccgccgggcgagccccggtacggccgggaggaggcgggggtggcgaccccggccccgctcccgggcaccgctccggaggagccgcccggaccggacgtccgggtggccgaggccccggccccgtacgccggacctgccgggccaccgggcaccgccgcccccctctggcacaccggcctcgacgccgagttcgccatcctccggctcaccggcgaaccgggcgaccccggcgagctgcatgccatcgccgccgccctggacgcccccgacgggacccgggccgggatcggctccgccgtcgacgggctggccgcgctcggggacgcccggcggctggcggagaccgcgctgcgggcctgcccggcctccgggggcacggtcgtgctcgacgagcacctcccggacgccctcgtcgtctcctccccggccctcggatcggaggccgaggtggtgatcgaggacaacggcggcggcatggaccccgaacggctgcgccgcatcctgcgcggcgaggccaccaccccctccaccggcatcggcctgctcaacgtggacgagcggctgcgccaggtgtacggggacgggtacgggctcgtcatcgagaccggggtcggcgcgggcatgaagatcacgctccggctgcccaagtaccgcgcgggcgtgcacggctcatgagccccgggccccgtccgggcccggctttctcagcagagatggacggccaggtgccccagtggcagccccagttgccacgccggggtccacacctggacctccccctcggtgtcgtgcccgcccccggccaccggctcccggggcgtggtcacgatc

SEQ ID NO: 1681 - protein, 310 aa, STREPTOMYCES SP.
MPQHLLPARRQAARPSRPRTLTGLLAAAAATAGLLLSGLAPGAQAAAAAANPYERGPAPTNASIEASRGPYATSQTSVSSLVASGFGGGTIYYPTSTADGTFGAVVISPGFTAYQSSIAWLGPRLASQGFVVFTIDTNTTLDQPDSRGRQLLSALDYLTQRSSVRTRVDATRLGVMGHSMGGGGSLEAAKSRTSLKAAIPLTGWNTDKTWPELRTPTLVVGADGDTVAPVATHSKPFYESLPGSLDKAYLELRGASHFTPNTSDTTIAKYSISWLKRFIDSDTRYEQFLCPIPRPSLTIAEYRGTCPHTS

SEQ ID NO: 1682 - protein, 934 aa, STREPTOMYCES SP.
MLYGTASAAGTAATASADSAGLPDPVGPAAYTGPAARAASAGRAGSADRGGRATHAAPADRAGPVPAPEPFTPEPLTPEELLARLRDGSTDRPLLVCADDAHAWDPACRTALAAAARRLGPGSGVGILIAADDGPAFAGLPTRRLGPLDEDASAALLDRLAGAGAGATTDPLDPVVRAELLREGAGNPRLLTALLGHLTPGRLTGRTPLPSPLPGAEGVLEAYAYRLDALPAPARALLLLAAAAQEHEPAGAGTDALLLLRAGTRAGLPRDFLDDALFGPAATEGLLQRAGSRVHFSPPLAARAVLHHTPPARRRAAHELLAALLGEAGGRAGTLAALAQRACAAPGPDHALAARLEAAATAPYSHAERSSALARAAALTPDPPLRSARFAAAAEQAAHAGDPDRARALLARTAAPAETGSGLAPTTGGPGLAPYVHGLLALRSGPAVDAHEALLAAAALLGPHDSGRALHALLGAADAAWVRGDAGGYLEAMGRVDPTPYGDAFASYRAGMCAVLAGRTAEGHALLRRCLDPDGSAEGHPVLRRCPDPAGLLRAGVAALVLGEVAAACRIGARALGAVRTRGPEVLLPQALEYLAYAELRAGLHAAARAHALEGLHAARRTGQPNSSARLHAVLALAASVEGPGEACAAHCDAALAGAVPHGLAQPATLATWARGRADLAAGRPEEAAARLGPLVRPGPGQGHFAVRTLAVPCYVEAVVLGGRGGELSSVVDEFAAWADRTADPQAPAQLARCRALTAPADEADARYAEALAHHDRAGGDFERARTLLLYGQWLRRRRRTREARTPLRDALVAFQRCSARAWAERAGGELRAAGEPVAGAVRDTGGDGVLSALTPQQQRIARCVAEGATNREVALRLSLSPRTVDHHLRNVFAALSVRSRTELARLLGPQTSPMPRTSRSPQSPQSPQSPQGP

SEQ ID NO: 1683 - protein, 481 aa, STREPTOMYCES SP.
MPQLVRPRFAVLHGTHPAAPLPQRFRSLADREAVEVLHRAARVLVASLPALTDRLVEALYEQEPGYRAAIDADRSEVWQEVHHSLRHNVGSLLQPKEFRDAAHRTSRWIGEIRAGQGVPLDAVLHAFRMGGAMVWQDLVDETARRGPDDVRLLVHVAADVWNFVDEHCGIVADAYRQAERRLTWQRENRQRLVIAALLDGTARIADLSDAAAMLGLPEQGRYAVLAVASVRRGDPGPVRQSQPEPVRPLLNLPSALPPPGEPRYGREEAGVATPAPLPGTAPEEPPGPDVRVAEAPAPYAGPAGPPGTAAPLWHTGLDAEFAILRLTGEPGDPGELHAIAAALDAPDGTRAGIGSAVDGLAALGDARRLAETALRACPASGGTVVLDEHLPDALVVSSPALGSEAEVVIEDNGGGMDPERLRRILRGEATTPSTGIGLLNVDERLRQVYGDGYGLVIETGVGAGMKITLRLPKYRAGVHGS

SEQ ID NO: 1684 - DNA, 2027 bp, Proteus vulgaris
aagcttaaagtcatggatatagcgtagtgagagaatactgtgggcatggaataggaagagaaatgcatgaggcgccacaagtactacattatggtattagagggcaaggcgttgaattaaaagaaggtatgacttttacgattgaaccaatgataaatcaaaataaaataaaaaccaaaaaaagatggttggactgttgtgacaagagatattatctctcaatcagagcatactattttagtcacagcaacagggtatgaagtactcactttacgtccggaagaagtattaccataattgctactgtcttatatttatagccattttaagaaaaaatgttttttataatctaaaaaaattgaatttttaattaaagtggctacttaatatcctttatttttatttatatcaataaattaagtcctcagctcaatagttttataaatctgagttgtaaattatactttgaacactatattaatattgatactcattatgtatttaacgagtcatcattaaatgattgcaggatcggattattacctataaaaaataaggatgttaatatggaaaatatttcaagaactttagaagcgtggggatcatggattgccaatgatcaagatgctattaatttattgaatcacaataaaaaagaagttattccagagcgtataaaactgagaagaaaatgcactcatcataatgcaaatattatcaatgatttaatgaaaagattgatgatgcacaataaagaagattatcagttacttattaattattatgtttttggtaaaacatttatcagcttgcaaaatatgatcatgttcggatacgtatattggaaaaaaactgaaaaaagcagaaggtatgattgaaggtatcctggttttctctgtgcttaattaaggctatcaataaaaaattaaaactgattaaaataatgctttacgatcgtaaaatagagattatgctaataatacttagaacaaataaggtgtcaaaatgcgatgtttactataatttttgcacttcaaagattgtattttaaatattgtattccatctattgctttaagtattgctaataggatgtttagtaaattaatttaaatccaaggagtggaaaatatgtcaactacatatccaattgttttagttcatggtttatctggttttgatgatatcgtcggttatccttatttttatggtatccgtgacgcattagaaaaagatggtcataaagttttcaccgcatctctttctgcatttaactctaacgaagttcgtggagaacaactttgggaatttgtgcaaaaagttctcaaagaaaccaaagcaaaaaaagtaaatttaatcggtcatagccaaggtccattagcttgtcgttatgttgctgcaaaacatgctaaaaacatcgcttctgttacctctgttaatggtgtaaaccacggatcagagattgcggatctagtgcgacgtattatgcgcaaagatagtgtgcctgaatatattgctgatgcagttatgaaagctattggtactattatttctacattttcaggtaatcgtggtaatccacaagatgctattgctgcattagaagcattaacaactgaaaatgtgatggaatttaataaaaagtatccacaagggctgccagccattcgtggtggtgaaggtaaagaagtcgtaaatggtgttcattactattcatttggtagttatatccaaggtctgattgccggcgaaaaaggtaatttattggaccctactcatgctgcaatgcgtgtattaagtgcattctttactgaacgtgaaaatgacggtttggtgggtcgtacaagtatgcgattaggtaaactaattaaagatgattatgctgaagatcatctggacatggtaaaccaggttgcaggtctagtagggcctggtgaagatattgtagctatttataccaaccatgcgaatttcttagcaagtaaaaagctgtaattagtctgcatacttgttgtgaaataatctaga

SEQ ID NO: 1685 - protein, 290 aa, Proteus vulgaris
MENMSTTYPIVLVHGLSGFDDIVGYPYFYGIRDALEKDGHKVFTASLSAFNSNEVRGEQLWEFVQKVLKETKAKKVNLIGHSQGPLACRYVAAKHAKNIASVTSVNGVNHGSEIADLVRRIMRKDSVPEYIADAVMKAIGTIISTFSGNRGNPQDAIAALEALTTENVMEFNKKYPQGLPAIRGGEGKEVVNGVHYYSFGSYIQGLIAGEKGNLLDPTHAAMRVLSAFFTERENDGLVGRTSMRLGKLIKDDYAEDHLDMVNQVAGLVGPGEDIVAIYTNHANFLASKKL

SEQ ID NO: 1686 - DNA, 2190 bp, MORAXELLA SP.
gaattcgagatcgacgttcggacctataaacatcaagatgttgccgttcgccgtcgctgccagcgcttcttcacccaaaaaccggcctacccaaacggcattgatcgagccgtttaacgactgtagtgccgatgatccaagtgttggcaatgcaaacagcagcatcgttttggcaatcgacccttcggtgaggtcacgccgttttttaatggggatacttgtgtcgctcaatgtctttccttttgcgccatccaagttggctttagttggttagctttgtttgatggtaagaacgcgtctacaaaagatgctggataattaacttagaattaatgaaataggtattaatggaataagtgctaagggtataaaaacgcctattataaatgagaatgctcgtgccctctttattagagtggtaaacacataacgtaccgatacaatctgttgtagctaataaatgctctgataactcactgacctgttcttatttcactcatgcaacactttgtgccactcacagtgacagacactctacaacatcattttttccagcattcgctcacatcgtagcagtcatggtttacgcttgtaatgcgcttgtactaggattatgatttttaatttattctgccagatattaacaaggatttttcgatgctattaaaacgcttaggtcttgctgcgctattcagtctttcaatggtcggctgcactaccgcgcccaatacgttagcggtcaatactactcaaaaaatcattcaatatgagcgttcaaaatctgatttagaagtcaaatcattgacgttagcctctggcgataagatggtttatgccgaaaatgataatgtgacgggcgagcctttacttcttattcatggttttggcggtaacaaagataactttacccgtattgcagataagctagaaggttatcatctgattattcctgatctgcttggttttggtaactctagtaagcctatgactgcggattatcgtgctgatgcccaagccacgcgtttgcatgagctgatgcaagctaagggtttagcatccaatactcatgttggtggtaactcgatgggcggcgctattagtgtggcctatgcggcaaaatatcccaaagaaattaaaagtttatggctagtcgatacggcaggattttggtcagcaggtgttccaaaatcgttagaaggtgcgaccttagaaaataacccattgcttattaatagcaaggaagacttctacaaaatgtatgattttgtcatgtacaagccgccttatattccaaagtcagtaaaagcagtttttgcgcaagagagaatcaataataaagcattagataccaaaattctggagcaaatcgtcaccgataatgtcgaggagcgtgccaaaatcatcgccaaatacaatattccgacgctcgtggtgtggggagataaggatcaggtcatcaagcctgaaacgactgagctgataaaagaaattattccgcaagcgcaagttattatgatgaatgacgtcgggcatgtgccgatggtagaggcggtaaaggataccgcgaatgattataaggcgtttcgtgacgggctaaagaagtaataatcttgattaaataagttggtttacattaaaaaagaaacatcagatgctctggtgtttcttttttttggctacaagatgttaacgacgttgatcaaactaacactcttttaccagtctctctaataattcaaccgtcctttcctgtctgactaaagcgaccccttgtcctgcccataaagactgatgttccgaatcaaggttcttttttgcatcagcacgcaagaccttggtcatagcgtttaattgcgggtaaggtggtagctcatgagcgctctcatattgagcaaagtcacgcaaataatcatttaataaacgcgtgcctgcttacctgagaacagtcgagttaagcgtgtctcagcattgcgtttattctcgctagcatctagcaatgcttgtttataaatatcattgatactgcacttatcggtggtcaaaaatgccgtaccaatttgcgccagctcagcccctgcggtttgtaccgctttgatagcttgccccgtcataatgccaccagccgcgattaacggaatatcagtacaagcgcgcgtttgactaatcagcgtcaataaacccaatggatcc

SEQ ID NO: 1687 - protein, 315 aa, MORAXELLA SP.
MLLKRLGLAALFSLSMVGCTTAPNTLAVNTTQKIIQYERSKSDLEVKSLTLASGDKMVYAENDNVTGEPLLLIHGFGGNKDNFTRIADKLEGYHLIIPDLLGFGNSSKPMTADYRADAQATRLHELMQAKGLASNTHVGGNSMGGAISVAYAAKYPKEIKSLWLVDTAGFWSAGVPKSLEGATLENNPLLINSKEDFYKMYDFVMYKPPYIPKSVKAVFAQERINNKALDTKILEQIVTDNVEERAKIIAKYNIPTLVVWGDKDQVIKPETTELIKEIIPQAQVIMMNDVGHVPMVEAVKDTANDYKAFRDGLKK

SEQ ID NO: 1688 - DNA, 2643 bp, Serratia marcescens
gtcgaccgtcgccgcctgagcggccccgcaggccatcaggccaagcgccgcataccaataacgtttcatcaatcagtctccttaatgactatatcgagttatcagtataggagagccaacgccagcactgttaaccaacgcacaatctcgccaatttgattcgcgggcctaatatttagcaccaataataattctaccgatgttggtcctctgaccagctgtcgttcggctaacgttgtttccctgtttccaccgccgacgcgcgagagttcacttcccggccaggcggcatacttcataaggaactgatatgggcatctttagctataaggatctggacgaaaacgcgtcaaaggcgctgttttccgacgccttggccatctctacctacgcttaccacaatatcgataacggcttcgatgaaggctatcaccagaccggtttcgggctcggtctgccgctgacgctgatcacggcgctcatcggcagcacccagtcgcagggcggcctgcccggccttccctggaaccccgactccgaacaggccgcgcaggaagcggtgaacaatgccggctggtcggtgatcagcgccacgcagttgggttacgccggcaaaaccgatgcgcgcggcacctactacggcgagaccgccggttacaccaccgcgcaggccgaggtgctgggaaaatatgacagcgaaggcaatctcaccgccattggcatctcatttcgcggcaccagcggcccgcgcgagtcgttgatcggcgataccatcggcgatgtgattaacgatctgctggccgggttcgggccgaaaggctacgccgacggctacacgctgaaggcgttcggcaacttgctgggcgacgtggcgaaattcgcgcaggcccacgggctgagcggcgaggacgtggtggtcagcggccacagcctcggcgggctggcggtcaacagcatggcggcgcagagcgacgccaactggggcggcttctacgcgcagtccaactatgtcgccttcgcctcgccgacccagtacgaagccggcggcaaggtgatcaacatcggctatgagaacgatccggtgtttcgcgcgctcgacggcacctcgctgaccctgccgtcattgggcgttcacgatgcgccgcatacctccgccaccaacaatatcgtcaacttcaacgatcactacgcgtcggacgcctggaatctgttgccgttctccattctcaacattccgacctggctatcccacctgccgttcttctatcaggatggcctgatgcgggtgctgaactccgagttttattcgctgaccgacaaagactcgaccatcatcgtctccaacctgtcgaacgtgacgcgcggcaatacctgggtggaagacctgaaccgcaacgcggaaacgcacagcgggccgacgtttatcatcggcagcgacggcaatgatttgatcaagggcggcaaaggcaatgactatctcgagggccgcgacggcgacgatatcttccgcgacgccggcggctataacctgatcgccggcggcaaaggccacaatatcttcgatacccagcaggcgttgaagaataccgaggtcgcctacgacggcaacacgctttacctgcgcgacgccaagggcggcattacgctggcagacgacatcagcaccctgcgcagcaaagaaacctcctggcttatcttcaacaaagaagtggatcatcaggtaaccgccgccggattgaaatcggactcaggcctcaaagcctatgccgccgccaccggcggcgacggcgatgacgtcctgcaggctcgcagccacgacgcctggctgttcggcaacgccggcaacgacacgctgatcggccacgccggcggcaacctgaccttcgtcggcggcagcggcgatgacatcctgaagggcgtcggcaacggcaacaccttcctgttcagcggcgatttcggccgcgaccagctgtatggcttcaacgccagcgataaactggtgtttatcggcaccgaaggtgccagcggcaatatccgcgactacgccacgcagcaaaacgacgatctggtgctggccttcggccacagccaggtcacgctgatcggcgtctcgctcgatcacatcagcaccgatcaggtggtgttggcctaaagatcggcataaaaaaagccgggcgctttcgccgcccggctttcctctttctgcccgccttaagggcacgtcataccccagcgccgccttgcgaatgcggaaccactgctggcggctcagcaccagtttctgcgccttcagcgcgaacgcaccgctcaatcttgccggagccgatgattggcaacggcgacgacggcaggcgcatcacccaggcgtacaccacctgctcgatggtctccgcgccgatctcttgcgccacccgctgcaactcgtcgcgcagcggctgaaactcggcgtcgttgaacagcgcccgccgcccaggcaggaccaggccatcggcttgatgcgcagttgctggcactggtcgagcgtgccgtcgagaatggccggttggtgaatcggcgagatcaccgaagcgctctccattccggtcatcggcatcggcgccggcaacggcaccgacggccagatccgttgacctgcaggtcgac

SEQ ID NO: 1689 - protein, 613 aa, Serratia marcescens
MGIFSYKDLDENASKALFSDALAISTYAYHNIDNGFDEGYHQTGFGLGLPLTLITALIGSTQSQGGLPGLPWNPDSEQAAQEAVNNAGWSVISATQLGYAGKTDARGTYYGETAGYTTAQAEVLGKYDSEGNLTAIGISFRGTSGPRESLIGDTIGDVINDLLAGFGPKGYADGYTLKAFGNLLGDVAKFAQAHGLSGEDVVVSGHSLGGLAVNSMAAQSDANWGGFYAQSNYVAFASPTQYEAGGKVINIGYENDPVFRALDGTSLTLPSLGVHDAPHTSATNNIVNFNDHYASDAWNLLPFSILNIPTWLSHLPFFYQDGLMRVLNSEFYSLTDKDSTIIVSNLSNVTRGNTWVEDLNRNAETHSGPTFIIGSDGNDLIKGGKGNDYLEGRDGDDIFRDAGGYNLIAGGKGHNIFDTQQALKNTEVAYDGNTLYLRDAKGGITLADDISTLRSKETSWLIFNKEVDHQVTAAGLKSDSGLKAYAAATGGDGDDVLQARSHDAWLFGNAGNDTLIGHAGGNLTFVGGSGDDILKGVGNGNTFLFSGDFGRDQLYGFNASDKLVFIGTEGASGNIRDYATQQNDDLVLAFGHSQVTLIGVSLDHISTDQVVLA

SEQ ID NO: 1690 - DNA, 2968 bp, Staphylococcus aureus
gatcattgcacctgcaactttaaataatgtaatgaccaagtttgtgattgaagtcataaaagtacgtctcactattggtaacgctgtaccaattaaaatcataatcagtgcaacatagggcataagtggacctatgattgagcgaatggctagatgaacatgatcgacgaaaatagtgttgttaccattaatcgtaaaaggaataaagaaacatagtatgcccactaaactatagacaaaaaaacgccatgcacttggttgttgtgcattagaatgatattgattcattaaagcaacccctttgtttaaatgaatacacaaaactgtatgatgcatcttccccttaatgagatgaatcattattttaatttagaaaaatctgaaaacttactataattgtatagtttgaattattttcataccaatacaaattaactaattatatatagattgaaactatattacttaataaaatatttatcttaaatgttgttgtgttgattcaacaccacaactaaaagtgtttataaattatttggaaatacacatatttgtaaatgattagtatcgatttaatatcgtattattaaatttttattaattttgtagtcttaatcaaaaaataatatatgtcatgttatattgaaggtgcagttgtttttcattctcaagagggggtcaaaaaaatacttttgaggtgattatatgttaagaggacaagaagaaagaaagtatagtattagaaagtattcaataggcgtggtgtcagtgttagcggctacaatgtttgttgtgtcatcacatgaagcacaagcctcggaaaaaacatcaactaatgcagcggcacaaaaagaaacactaaatcaaccgggagaacaagggaatgcgataacgtcacatcaaatgcagtcaggaaagcaattagacgatatgcataaagagaatggtaaaagtggaacagtgacagaaggtaaagatacgcttcaatcatcgaagcatcaatcaacacaaaatagtaaaacaatcagaacgcaaaatgataatcaagtaaagcaagattctgaacgacaaggttctaaacagtcacaccaaaataatgcgactaataatactgaacgtcaaaatgatcaggttcaaaatacccatcatgctgaacgtaatggatcacaatcgacaacgtcacaatcgaatgatgttgataaatcacaaccatccattccggcacaaaaggtaatacccaatcatgataaagcagcaccaacttcaactacacccccgtctaatgataaaactgcacctaaatcaacaaaagcacaagatgcaaccacggacaaacatccaaatcaacaagatacacatcaacctgcgcatcaaatcatagatgcaaagcaagatgatactgttcgccaaagtgaacagaaaccacaagttggcgatttaagtaaacatatcgatggtcaaaattccccagagaaaccgacagataaaaatactgataataaacaactaatcaaagatgcgcttcaagcgcctaaaacacgttcgactacaaatgcagcagcagatgctaaaaaggttcgaccacttaaagcgaatcaagtacaaccacttaacaaatatccagttgtttttgtacatggatttttaggattagtaggcgataatgcacctgctttatatccaaattattggggtggaaataaatttaaagttatcgaagaattgagaaagcaaggctataatgtacatcaagcaagtgtaagtgcatttggtagtaactatgatcgcgctgtagaactttattattacattaaaggtggtcgcgtagattatggcgcagcacatgcagctaaatacggacatgagcgctatggtaagacttataaaggaatcatgcctaattgggaacctggtaaaaaggtacatcttgtagggcatagtatgggtggtcaaacaattcgtttaatggaagagtttttaagaaatggtaacaaagaagaaattgcctatcataaagcgcatggtggagaaatatcaccattattcactggtggtcataacaatatggttgcatcaatcacaacattagcaacaccacataatggttcacaagcagctgataagtttggaaatacagaagctgttagaaaaatcatgttcgctttaaatcgatttatgggtaacaagtattcgaatatcgatttaggattaacgcaatggggctttaaacaattaccaaatgagagttacattgactatataaaacgcgttagtaaaagcaaaatttggacatcagacgacaatgctgcctatgatttaacgttagatggctctgcaaaattgaacaacatgacaagtatgaatcctaatattacgtatacgacttatacaggtgtatcatctcatactggtccattaggttatgaaaatcctgatttaggtacatttttcttaatggctacaacgagtagaattattggtcatgatgcaagagaagaatggcgtaaaaatgatggtgtcgtaccagtgatttcgtcattacatccgtccaatcaaccatttgttaatgttacgaatgatgaacctgccacacgcagaggtatctggcaagttaaaccaatcatacaaggatgggatcatgtcgattttatcggtgtggacttcctggatttcaaacgtaaaggtgcagaacttgccaacttctatacaggtattataaatgacttgttgcgtgttgaagcgactgaaagtaaaggaacacaattgaaagcaagttaaattcatcttctgaatttaatatgctatgtaaatcgtgctgttatcatggcacatcagatataagtagcatcacagtgttgaatttaaaaatagtaaagtgaaataaagcgcctgtctcattagcgaaaactaaagggacaggcgtatctgtttatgagcttaataaattgtatgaataatatggttgatc

SEQ ID NO: 1691 - protein, 690 aa, Staphylococcus aureus
MLRGQEERKYSIRKYSIGVVSVLAATMFVVSSHEAQASEKTSTNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKVIPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMATTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 1692 - DNA, 1700 bp, Pseudomonas fluorescens
gggtgcatgccagctcccaccggacacctggcccgtcgctgaaacgtgttttcgctttctctacaaatccaacaacagagaggcactaccatgggtatctttgactataaaaaccttggcaccgagggttccaaaacgttgttcgccgatgccatggcgatcacgttgtattcctatcacaacctggataacggctttgccgtgggctaccagcacaacgggttgggcttggggctaccggccacgctggtcggtgcgctgctcggcagcacggattcccagggcgtgatccctggcatcccgtggaacccggattcagaaaaagccgcccttgaggcggtgcagaaagccggttggacaccgatcagcgccagtgccctgggctacgccggcaaggtcgatgcacgtggcaccttctttggggaaaaagccggctacaccacggcccaggtcgaggtactcggcaaatacgatgacgccggcaagctgctcgaaatcggcatcggttttcgtggcacttcggggccacgggaaaccttgatcagcgactcgatcggcgacttgatcagcgatctgctcgcggccctggggcccaaggattacgcgaaaaactacgccggcgaagccttcggcggcttgctcaagaatgttgccgactacgccggtgcccatggcctgaccggcaaggacgtggtggtcagcggccacagcctgggcgggctggcggtcaacagcatggcggacttgagcaactacaaatgggcggggttctacaaggacgccaactatgttgcctatgcctcgccgacccagagtgccggcgacaaggtgctcaatatcggttacgaaaacgacccggtgttccgcgcgctggacggctcgtcgtttaacctgtcgtcgctgggcgtgcacgacaaaccccacgagtccaccaccgataacatcgtcagcttcaacgaccactacgcctcgacgctgtggaatgtgctgccgttttccatcgtcaacctgcccacctgggtctcgcatttgccgacggcgtacggcgatggcatgacgcgcatcctcgagtccggcttctacgaccagatgacccgtgactccacggtgattgttgccaacctgtccgatccggcgcgggccaacacctgggtgcaggacctcaaccgcaatgccgagccccacaagggcaacacgttcatcatcggcagcgacggcaacgacctgatccagggcggcaacggtgcggactttatcgagggtggcaaaggcaacgacacgatccgcgacaacagcgggcacaacacctttttgttcagcggccactttggcaatgatcgcgtgattggctaccagcccaccgacaaactggtgttcaaggacgtgcaaggaagcaccgacctgcgtgaccacgcgaaggtggtcggcgccgatacggtgcttacgtttggggccgactcggtgacgctggtcggcgtggggcatggcgggctgtggacggagggcgtggtgatcggctgattactcacgcaaccgatcagtgccagtgctgcccccgccagccaccgccccaattgggccggtgggggtagccatagccataaccgtaatagtgatgtgggtagtagtaagggcgtggcgcgtagccccaatgcccgtaataaaccggtggcggtggttgcaccacgatcacccgcggt

SEQ ID NO: 1693 - protein, 476 aa, Pseudomonas fluorescens
MGIFDYKNLGTEGSKTLFADAMAITLYSYHNLDNGFAVGYQHNGLGLGLPATLVGALLGSTDSQGVIPGIPWNPDSEKAALEAVQKAGWTPISASALGYAGKVDARGTFFGEKAGYTTAQVEVLGKYDDAGKLLEIGIGFRGTSGPRETLISDSIGDLISDLLAALGPKDYAKNYAGEAFGGLLKNVADYAGAHGLTGKDVVVSGHSLGGLAVNSMADLSNYKWAGFYKDANYVAYASPTQSAGDKVLNIGYENDPVFRALDGSSFNLSSLGVHDKPHESTTDNIVSFNDHYASTLWNVLPFSIVNLPTWVSHLPTAYGDGMTRILESGFYDQMTRDSTVIVANLSDPARANTWVQDLNRNAEPHKGNTFIIGSDGNDLIQGGNGADFIEGGKGNDTIRDNSGHNTFLFSGHFGNDRVIGYQPTDKLVFKDVQGSTDLRDHAKVVGADTVLTFGADSVTLVGVGHGGLWTEGVVIG

SEQ ID NO: 1694 - DNA, 1495 bp, Bacillus subtilis
gtccaaatgacggaagctacctgttgacgctgctgtaaaaccggagcaaaggggattgtatttgccggttctgggaacgggtctttatctgatgcagccgaaaaaggggcggacagcgcagtcaaaaaaggcgttacagtggtgcgctctacccgcacgggaaatggtgtcgtcacaccaaaccaagactatgcggaaaaggacttgctggcatcgaactctttaaacccccaaaaagcacggatgttgctgatcgttgctcttaccaaaacaaatgatcctcaaaaaatccaagcttatttcaatgagtattgaagaaaagaaggcgaataagccttcttttttttggctttttaggaccaataatgacctctgaatcttaaaatttctttaaaaataagccaaaattaccctttacttaattaatttggtaacgtaatataattggagaatttgttacaaaaaaaggaggatattatgaaatttgtaaaaagaaggatcattgcacttgtaacaattttgatgctgtctgttacatcgctgtttgcgttgcagccgtcagcaaaagccgctgaacacaatccagtcgttatggttcacggtattggaggggcatcattcaattttgcgggaattaagagctatctcgtatctcagggctggtcgcgggacaagctgtatgcagttgatttttgggacaagacaggcacaaattataacaatggaccggtattatcacgatttgtgcaaaaggttttagatgaaacgggtgcgaaaaaagtggatattgtcgctcacagcatggggggcgcgaacacactttactacataaaaaatctggacggcggaaataaagttgcaaacgtcgtgacggttggcggcgcgaaccgtttgacgacaggcaaggcgcttccgggaacagatccaaatcaaaagattttatacacatccatttacagcagtgccgatatgattgtcatgaattacttatcaagattagatggtgctagaaacgttcaaatccatggcgttggacacatcggccttctgtacagcagccaagtcaacagcctgattaaagaagggctgaacggcgggggccagaatacgaattaatgaaaaacaaaaccttgaagaatgctattcttcaaggttattctgctttcagcacaatggttttcgcagccatatcatgaacggtttgttttttcttcgtaaatgcggcagtcaaatagatcaggcgggagaacacatgcacccacgctatcaggtaacggacaatggcttgcgggaaggatatttttttatatgtttcgtccctcacgatttgcagcccgatgctttttttgcccagtgtgcccttccaatttgtcagcggcatcagcaaaaaatacacaatcagcatcaatatggcgacaataatgacaccggcggacccatcgccaaacgtaaatccggctgccaaaatcactgctgcgcaatgattacatcaagt

SEQ ID NO: 1695 - protein, 212 aa, Bacillus subtilis
MKFVKRRIIALVTILMLSVTSLFALQPSAKAAEHNPVVMVHGIGGASFNFAGIKSYLVSQGWSRDKLYAVDFWDKTGTNYNNGPVLSRFVQKVLDETGAKKVDIVAHSMGGANTLYYIKNLDGGNKVANVVTVGGANRLTTGKALPGTDPNQKILYTSIYSSADMIVMNYLSRLDGARNVQIHGVGHIGLLYSSQVNSLIKEGLNGGGQNTN

SEQ ID NO: 1696 - DNA, 2250 bp, Staphylococcus epidermidis
caaacccatttttagtaaaatttttggatttataccacgtataattattaatattttcatctaacaaattatcgagaaaaatttcattttaaaataaacaaatagatagaggtgctaattgtgaagacaagacaaaacaaatacagtattcgtaaatttagcgtaggtgcatcatccattctgattgcagcattattatttatgggtggaggatcagctcaggcagctgagcaacaacaggataagggaactgttgaaaatagcacaacacaatctattggggatggaaatgaaaagttaagtgaacaacaatcaacgcaaaataagaatgttaatgagaaaagtaatgttaattctattactgaaaatgaaagcttacataacgaaacaccaaaaaacgaggatttgattcagcaacaaaaagattctcaaaatgacaataaatctgaatctgtagttgaacaaaataaagagaatggagcatttgttcaaaatcattccgaagagaaaccacaacaagaacaagttgaactggaaaagcatgctagtgaaaacaatcaaactttacactcaaaagcagcacagtccaatgaagatgtgaaaactaaaccttcacaactcgataatacagctgccaaacaagaagactctcaaaaagagaatttgagtaaacaagatacacaatcatctaaaactactgatttactacgagcaacagctcaaaatcaatcaaaagatagccaatcaacagaagagataaataaagaagtaaataacgacactcaacaagtgactgctaagaacgatgacgccaaagttgaatcatttaatttaaatagtaaagaggaaccccttaaagttgacaagcaagcgaatccaactacagataaagataaatcttctaaaaatgataaagggtctcaagatggtctcgctaatttagaaagtaatgctgttgctacaactaataaacagtctaagcaacaagtgagtgaaaaaaatgaggatcaaacaaataaatcagcaaaacaaaaacaatataaaaataatgatccaattattttagtacatggtttcaatggatttacagacgatatcaacccatcagtgctaacgcattattggggtggcgataaaatgaatattcgccaagatttggaagaaaatggatatgaggcttatgaagcaagtataagtgcatttggtagtaactatgaccgtgctgttgagttatactactacatcaaaggtggacgtgttgactatggtgcagcacacgcagctaaatatggtcatgagcgttacggtaaaacctatgaaggtgtttataaagattggaaaccaggtcaaaaaatacatttagttggtcatagtatgggtggtcaaacaattcgtcaattagaagagctattgagacatggtaatccagaagaagttgaatatcaaaaacaacatggtggggaaatttctccattataccaaggtggccacgacaatatggtgtcatctattacaacactcggtacaccacataatggtacacatgcgtcagacttattaggtaacgaagcgattgtacgccaacttgcatatgacgtaggtaaaatgtatggtaataaagattcacgtgtagactttgggttagaacactggggattaaaacaaaaaccaaacgaatcatatattcaatatgttaaacgtgttcaaaattcaaaactgtggaaatcaaaagatagtggtttacacgatttaacacgcgatggcgcaacagatttaaaccgaaaaacatcattaaatcctaatattgtatataaaacttatactggcgagtcaacacataaaacattggcaggaaaacaaaaagctgatcttaacatgttcttaccatttacaattactggtaatttaattggaaaagctaaagagaaagaatggagagaaaatgatggacttgtttcagtcatttcttcacaacatccatttaatcaaaaatatgttgaagctacagataaaaatcaaaaaggtgtatggcaagtaactccaacaaaacatgactgggatcatgtagactttgtaggccaagacagtacagatacaaaacgtactagagatgaattgcaacagttctggcatggtcttgctgaagatttagtacaaagtgaacaattaacatcaacaaataaataaaatgatataaggtataaacctaacgtaattttatatagataggagtgagatacatgacaggtg

SEQ ID NO: 1697 - protein, 688 aa, Staphylococcus epidermidis
MKTRQNKYSIRKFSVGASSILIAALLFMGGGSAQAAEQQQDKGTVENSTTQSIGDGNEKLSEQQSTQNKNVNEKSNVNSITENESLHNETPKNEDLIQQQKDSQNDNKSESVVEQNKENGAFVQNHSEEKPQQEQVELEKHASENNQTLHSKAAQSNEDVKTKPSQLDNTAAKQEDSQKENLSKQDTQSSKTTDLLRATAQNQSKDSQSTEEINKEVNNDTQQVTAKNDDAKVESFNLNSKEEPLKVDKQANPTTDKDKSSKNDKGSQDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLYQGGHDNMVSSITTLGTPHNGTHASDLLGNEAIVRQLAYDVGKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLAEDLVQSEQLTSTNK

SEQ ID NO: 1698 - DNA, 2245 bp, Bacillus amyloliquefaciens
agagcgataaaagaaataaaaaagaaatcatcttgacaggtggtttctttttttgtttgaaagcgggaagtctttttaattgataggaatatagatttgaattcactctgccgcgttgctttgatagagagagtatgataagttgaaatgtaagcgttaacagaattctccagtcttcacaacagttgaaaggagctgaagaaagagtaagaggaatttttgactccgcagtcagtcttcaaaaatgaaataaggagtgtcaaaaatgtttgaaaaacgattcaaaacctctttactgccgttattcgccggatttttattgctgtttcatttggttttgtcaggtccggcggctgcaaacgctgaaactgcaaacaaatcgaatgaggtggccgcgtcatcggtcaaaaacgggaccatccttcatgcctggaattggtcgttcaatacgttaacacaaaatatgaaagagattcgtgatgcgggctatgcagccattcagacgtctccgattaaccaagtaaaggaagggaaccaaggagataaaagcatgaggaactggtactggctgtatcagccgacatcgtaccaaatcggcaaccgttacttaggcactgaacaagaatttaaggacatgtgtgcagccgcggaaaaatatggcgtaaaagtcattgttgatgcggttatcaatcataccaccagcgattacgccgcgatttctgacgagattaagcgtattccaaactggacccatggaaacacacaaattaaaaattggtcggacaggtgggacgtcactcaaaattcattgcttgggctgtatgattggaatacacagaatactgaggtgcaaacctatctgaaacgtttcttggaaagagcattgaatgacggagcggacgggttccgctatgatgccgccaagcatatagagcttccggatgatgggaattacggcagccgattttggccgaatatcacaaatacatcggcggagttccaatacggagaaatcctgcaagacagcgcgtccagagatactgcttatgcgaattatatgaatgtgacggcttctaactatgggcattccatcagatccgctttaaagaaccgtaatctgagtgtgtcgaatatctcccattatgcatctgacgtgtctgcggacaagttagtcacatgggtggaatcacatgatacgtatgccaatgatgaggaagagtccacatggatgagtgatgacgatatccgtttaggctgggcagtgattggttcccgctcaggaagcacgcctcttttcttttccagacctgagggcggaggaaatggggtgcgatttcccggaaaaagtcaaataggagatcgagggagcgccttatttaaagatcaggcgatcactgcggtcaatcaatttcacaatgtaatggccgggcagcctgaggaactctcgaatccgaatgggaacaatcaaatattgatgaatcagcgcggctcaaaaggcgttgtgctggctaatgcgggatcgtcttctgtcaccgtcaatacttcaacgaaattgcctgacggcaggtatgataatagggccggcgccggttcatttcaagtagcgaacggcaaactgacaggtacgatcaatgccagatccgcggctgttctttattctgatgatattggaaatgcgcctcaggtctttcttgagaattaccaaacgggggcagtccattctttcaatgatcagctgacggtcaccctgcgtgcaaatgcgaaaacaacaaaagccgtttaccaaatcaataatgggcagcagacagcatttaaggatggagaccgattaacgatcgggaaaggagatccaatcggcacgacatacaacatcaggttaaccggaacgaacggcgagggtgcagagagaactcaagaatacacgtttgtcaaaaaagacccggcccaaaccaacatcattggctatcaaaatccggatcattggggccaggtaaatgcttatatttacaaacatgatggaggcagggccatagaattaaccggatcgtggccggggaaagcaatgactaagaatgcaaatggaatttacacgctgacgctgcctgcgaatgcggatacggccaatgccaaagtgatttttaacaatggcagcgcccaagtgcccggacagaaccagcccggctttgattatgtgcagaatggtttgtataacaactccggtttagacggttatcttccgcattaa

SEQ ID NO: 1699 - protein, 659 aa, Bacillus amyloliquefaciens
MFEKRFKTSLLPLFAGFLLLFHLVLSGPAAANAETANKSNEVAASSVKNGTILHAWNWSFNTLTQNMKEIRDAGYAAIQTSPINQVKEGNQGDKSMRNWYWLYQPTSYQIGNRYLGTEQEFKDMCAAAEKYGVKVIVDAVINHTTSDYAAISDEIKRIPNWTHGNTQIKNWSDRWDVTQNSLLGLYDWNTQNTEVQTYLKRFLERALNDGADGFRYDAAKHIELPDDGNYGSRFWPNITNTSAEFQYGEILQDSASRDTAYANYMNVTASNYGHSIRSALKNRNLSVSNISHYASDVSADKLVTWVESHDTYANDEEESTWMSDDDIRLGWAVIGSRSGSTPLFFSRPEGGGNGVRFPGKSQIGDRGSALFKDQAITAVNQFHNVMAGQPEELSNPNGNNQILMNQRGSKGVVLANAGSSSVTVNTSTKLPDGRYDNRAGAGSFQVANGKLTGTINARSAAVLYSDDIGNAPQVFLENYQTGAVHSFNDQLTVTLRANAKTTKAVYQINNGQQTAFKDGDRLTIGKGDPIGTTYNIRLTGTNGEGAERTQEYTFVKKDPAQTNIIGYQNPDHWGQVNAYIYKHDGGRAIELTGSWPGKAMTKNANGIYTLTLPANADTANAKVIFNNGSAQVPGQNQPGFDYVQNGLYNNSGLDGYLPH

SEQ ID NO: 1700 - DNA, 2604 bp, Bacillus amyloliquefaciens
aagcttcaagcggtcaatcggaatgtgcatctcgcttcatacttaggttttcacccgcatattaagcaggcgtttttgaaccgtgtgacagaagctgttcgaaaccccggcgggcggtttgattttaaggggggacagtatgctgcctcttcacattaatctcagcggaaaaagaatcatcattgctggcgggggcaatgttgcattaagaaggctgaaacggtgtttccggaaggcgctgatattaccgtgatcagtctgagcctgcctgaaattaaaaagctggcggatgaaggacgcatccgctggattccccggagaattgaaatgaaagatctcaagcccgcttttttcattattgccgcgacaaatgaccgaggcgtgaatcaggagatagccgcaaacgcttctgaaacgcagctggtcaactgtgtaagcaaggctgaacaaggcagcgtatatatgccgaagatcatccgcaaagggcgcattcaagtatcagtatcaacaagcggggcaagccccgcacatacgaaaagactggctgaaaacattgagcctttgatgactgatgatttggctgaagaagtggatcgattgtttgagaaaagaagaagaccataaaaataccttgtctgtcatcagacagggtattttttatgctgtccagactgtccgctgtgtaaaaaataggaataaaggggggttgttattattttactgatatgtaaaatataatttgtataagaaaatgagagggagaggaaacatgattcaaaaacgaaagcggacagtttcgttcagacttgtgcttatgtgcacgctgttatttgtcagtttgccgattacaaaaacatcagccgtaaatggcacgctgatgcagtattttgaatggtatacgccgaacgacggccagcattggaaacgattgcagaatgatgcggaacatttatcggatatcggaatcactgccgtctggattcctcccgcatacaaaggattgagccaatccgataacggatacggaccttatgatttgtatgatttaggagaattccagcaaaaagggacggtcagaacgaaatacggcacaaaatcagagcttcaagatgcgatcggctcactgcattcccggaacgtccaagtatacggagatgtggttttgaatcataaggctggtgctgatgcaacagaagatgtaactgccgtcgaagtcaatccggccaatagaaatcaggaaacttcggaggaatatcaaatcaaagcgtggacggattttcgttttccgggccgtggaaacacgtacagtgattttaaatggcattggtatcatttcgacggagcggactgggatgaatcccggaagatcagccgcatctttaagtttcgtggggaaggaaaagcgtgggattgggaagtatcaagtgaaaacggcaactatgactatttaatgtatgctgatgttgactacgaccaccctgatgtcgtggcagagacaaaaaaatggggtatctggtatgcgaatgaactgtcattagacggcttccgtattgatgccgccaaacatattaaattttcatttctgcgtgattgggttcaggcggtcagacaggcgacgggaaaagaaatgtttacggttgcggagtattggcagaataatgccgggaaactcgaaaactacttgaataaaacaagctttaatcaatccgtgtttgatgttccgcttcatttcaatttacaggcggcttcctcacaaggaggcggatatgatatgaggcgtttgctggacggtaccgttgtgtccaggcatccggaaaaggcggttacatttgttgaaaatcatgacacacagccgggacagtcattggaatcgacagtccaaacttggtttaaaccgcttgcatacgcctttattttgacaagagaatccggttatcctcaggtgttctatggggatatgtacgggacaaaagggacatcgccaaaggaaattccctcactgaaagataatatagagccgattttaaaagcgcgtaaggagtacgcatacgggccccagcacgattatattgaccacccggatgtgatcggatggacgagggaaggtgacagctccgccgccaaatcaggtttggccgctttaatcacggacggacccggcggatcaaagcggatgtatgccggcctgaaaaatgccggcgagacatggtatgacataacgggcaaccgttcagatactgtaaaaatcggatctgacggctggggagagtttcatgtaaacgatgggtccgtctccatttatgttcagaaataaggtaataaaaaaacacctccaagctgagtgcgggtatcagcttggaggtgcgtttattttttcagccgtatgacaaggtcggcatcaggtgtgacaaatacggtatgctggctgtcataggtgacaaatccgggttttgcgccgtttggctttttcacatgtctgatttttgtataatcaacaggcacggagccggaatctttcgccttggaaaaataagcggcgatcgtagctgcttccaatatggattgttcatcgggatcgctgcttttaatcacaacgtgggatcc

SEQ ID NO: 1701 - DNA, 1452 bp, Bacillus amyloliquefaciens
gtaaatggcacgctgatgcagtattttgaatggtatacgccgaacgacggccagcattggaaacgattgcagaatgatgcggaacatttatcggatatcggaatcactgccgtctggattcctcccgcatacaaaggattgagccaatccgataacggatacggaccttatgatttgtatgatttaggagaattccagcaaaaagggacggtcagaacgaaatacggcacaaaatcagagcttcaagatgcgatcggctcactgcattcccggaacgtccaagtatacggagatgtggttttgaatcataaggctggtgctgatgcaacagaagatgtaactgccgtcgaagtcaatccggccaatagaaatcaggaaacttcggaggaatatcaaatcaaagcgtggacggattttcgttttccgggccgtggaaacacgtacagtgattttaaatggcattggtatcatttcgacggagcggactgggatgaatcccggaagatcagccgcatctttaagtttcgtggggaaggaaaagcgtgggattgggaagtatcaagtgaaaacggcaactatgactatttaatgtatgctgatgttgactacgaccaccctgatgtcgtggcagagacaaaaaaatggggtatctggtatgcgaatgaactgtcattagacggcttccgtattgatgccgccaaacatattaaattttcatttctgcgtgattgggttcaggcggtcagacaggcgacgggaaaagaaatgtttacggttgcggagtattggcagaataatgccgggaaactcgaaaactacttgaataaaacaagctttaatcaatccgtgtttgatgttccgcttcatttcaatttacaggcggcttcctcacaaggaggcggatatgatatgaggcgtttgctggacggtaccgttgtgtccaggcatccggaaaaggcggttacatttgttgaaaatcatgacacacagccgggacagtcattggaatcgacagtccaaacttggtttaaaccgcttgcatacgcctttattttgacaagagaatccggttatcctcaggtgttctatggggatatgtacgggacaaaagggacatcgccaaaggaaattccctcactgaaagataatatagagccgattttaaaagcgcgtaaggagtacgcatacgggccccagcacgattatattgaccacccggatgtgatcggatggacgagggaaggtgacagctccgccgccaaatcaggtttggccgctttaatcacggacggacccggcggatcaaagcggatgtatgccggcctgaaaaatgccggcgagacatggtatgacataacgggcaaccgttcagatactgtaaaaatcggatctgacggctggggagagtttcatgtaaacgatgggtccgtctccatttatgttcagaaataa

SEQ ID NO: 1702 - DNA, 2084 bp, Bacillus amyloliquefaciens
gccccgcacatacgaaaagactggctgaaaacattgagcctttgatgactgatgatttggctgaagaagtggatcgattgtttgagaaaagaagaagaccataaaaataccttgtctgtcatcagacagggtattttttatgctgtccagactgtccgctgtgtaaaaataaggaataaaggggggttgttattattttactgatatgtaaaatataatttgtataagaaaatgagagggagaggaaacatgattcaaaaacgaaagcggacagtttcgttcagacttgtgcttatgtgcacgctgttatttgtcagtttgccgattacaaaaacatcagccgtaaatggcacgctgatgcagtattttgaatggtatacgccgaacgacggccagcattggaaacgattgcagaatgatgcggaacatttatcggatatcggaatcactgccgtctggattcctcccgcatacaaaggattgagccaatccgataacggatacggaccttatgatttgtatgatttaggagaattccagcaaaaagggacggtcagaacgaaatacggcacaaaatcagagcttcaagatgcgatcggctcactgcattcccggaacgtccaagtatacggagatgtggttttgaatcataaggctggtgctgatgcaacagaagatgtaactgccgtcgaagtcaatccggccaatagaaatcaggaaacttcggaggaatatcaaatcaaagcgtggacggattttcgttttccgggccgtggaaacacgtacagtgattttaaatggcattggtatcatttcgacggagcggactgggatgaatcccggaagatcagccgcatctttaagtttcgtggggaaggaaaagcgtgggattgggaagtatcaagtgaaaacggcaactatgactatttaatgtatgctgatgttgactacgaccaccctgatgtcgtggcagagacaaaaaaatggggtatctggtatgcgaatgaactgtcattagacggcttccgtattgatgccgccaaacatattaaattttcatttctgcgtgattgggttcaggcggtcagacaggcgacgggaaaagaaatgtttacggttgcggagtattggcagaataatgccgggaaactcgaaaactacttgaataaaacaagctttaatcaatccgtgtttgatgttccgcttcatttcaatttacaggcggcttcctcacaaggaggcggatatgatatgaggcgtttgctggacggtaccgttgtgtccaggcatccggaaaaggcggttacatttgttgaaaatcatgacacacagccgggacagtcattggaatcgacagtccaaacttggtttaaaccgcttgcatacgcctttattttgacaagagaatccggttatcctcaggtgttctatggggatatgtacgggacaaaagggacatcgccaaaggaaattccctcactgaaagataatatagagccgattttaaaagcgcgtaaggagtacgcatacgggccccagcacgattatattgaccacccggatgtgatcggatggacgagggaaggtgacagctccgccgccaaatcaggtttggccgctttaatcacggacggacccggcggatcaaagcggatgtatgccggcctgaaaaatgccggcgagacatggtatgacataacgggcaaccgttcagatactgtaaaaatcggatctgacggctggggagagtttcatgtaaacgatgggtccgtctccatttatgttcagaaataaggtaataaaaaaacacctccaagctgagtgcgggtatcagcttggaggtgcgtttattttttcagccgtatgacaaggtcggcatcaggtgtgacaaatacggtatgctggctgtcataggtgacaaatccgggttttgcgccgtttggctttttcacatgtctgatttttgtataatcaacaggcacggagccggaatctttcgccttggaaaaataagcggcgatcgtagctgcttccaatatggattgttcatcgggatcgctgcttttaatcacaacgtgggatcc

SEQ ID NO: 1703 - DNA, 537 bp, Bacillus amyloliquefaciens
gccccgcacatacgaaaagactggctgaaaacattgagcctttgatgactgatgatttggctgaagaagtggatcgattgtttgagaaaagaagaagaccataaaaataccttgtctgtcatcagacagggtattttttatgctgtccagactgtccgctgtgtaaaaataaggaataaaggggggttgttattattttactgatatgtaaaatataatttgtataagaaaatgagagggagaggaaacatgattcaaaaacgaaagcggacagtttcgttcagacttgtgcttatgtgcacgctgttatttgtcagtttgccgattacaaaaacatcagccgtaaatggcacgctgatgcagtattttgaatggtatacgccgaacgacggccagcattggaaacgattgcagaatgatgcggaacatttatcggatatcggaatcactgccgtctggattcctcccgcatacaaaggattgagccaatccgataacggatacggaccttatgatttgtatgatttaggagaattc

SEQ ID NO: 1704 - DNA, 143 bp, Bacillus amyloliquefaciens
aatcaaggaattccgggagaggaaacatgattcaaaaacgaaagcggacagtttcgttcagacttgtgcttatgtgcacgctgttatttgtcagtttgccgattacaaaaacatcagccgtaaatggcacgctgatgcagtat

SEQ ID NO: 1705 - DNA, 2084 bp, Bacillus amyloliquefaciens; identical to SEQ ID NO: 1702

SEQ ID NO: 1706 - protein, 514 aa, Bacillus amyloliquefaciens
MIQKRKRTVSFRLVLMCTLLFVSLPITKTSAVNGTLMQYFEWYTPNDGQHWKRLQNDAEHLSDIGITAVWIPPAYKGLSQSDNGYGPYDLYDLGEFQQKGTVRTKYGTKSELQDAIGSLHSRNVQVYGDVVLNHKAGADATEDVTAVEVNPANRNQETSEEYQIKAWTDFRFPGRGNTYSDFKWHWYHFDGADWDESRKISRIFKFRGEGKAWDWEVSSENGNYDYLMYADVDYDHPDVVAETKKWGIWYANELSLDGFRIDAAKHIKFSFLRDWVQAVRQATGKEMFTVAEYWQNNAGKLENYLNKTSFNQSVFDVPLHFNLQAASSQGGGYDMRRLLDGTVVSRHPEKAVTFVENHDTQPGQSLESTVQTWFKPLAYAFILTRESGYPQVFYGDMYGTKGTSPKEIPSLKDNIEPILKARKEYAYGPQHDYIDHPDVIGWTREGDSSAAKSGLAALITDGPGGSKRMYAGLKNAGETWYDITGNRSDTVKIGSDGWGEFHVNDGSVSIYVQK

SEQ ID NO: 1707 - DNA, 1801 bp, Bacillus subtilis
ttcttctttttatcgtctgcggcggcgttctgtttctgcttcggtatgtgattgtgaagctggcttacagaagagcggtaaaagaagaaataaaaaagaaatcatcttgaaaaatagatggtttctttttttgtttggaaagcgagggaagcgtacacagtctcgggcagtttttttataggaacattgatttgtattcactctgccaagttgttttgatagagtgattgtgataatttaaaatgtaagtgttaacaaaattctccagtcttcacatcagtttgaaaggaggaagcggaagaatgaagtaagagggatttttgactccgaagtaagtcttcaaaaaatcaaataaggagtgtcaagaatgtttgcaaaacgattcaaaacctctttactgccgttattcgctggatttttattgctgttttatttggttctggcaggaccggcggctgcgagtgctgaaacggcgaacaaatcgaatgagcttacagcaccgtcgatcaaaagcggaaccattcttcatgcatggaattggtcgttcaatacgttaaaactcaatatgaaggatattcatgatgcaggatatacagccattcagacatctccgattaaccaagtaaaggaagggaatcaaggagataaaagcatgtcgaactggtactggctgtatcagccgacatcgtatcaaattggcaaccgttacttaggtactgaacaagaatttaaagaaatgtgtgcagccgctgaagaatatggcataaaggtcattgttgacgcggtcatcaatcataccaccagtgattatgccgcgatttccaatgaggttaagagtattccaaactggacacatggaaacacacaaattaaaaactggtctgatcgatgggatgtcacgcagaattcattgctcgggctgtatgactggaatacacaaaatacacaagtacagtcctatctgaaacggttcttagaaagggcattgaatgacggggcagacggttttcgatttgatgcagccaaacatatagagcttccggatgatgggagttacggcagtcaattttggccgaatatcacaaatacatctgcagagttccaatacggagaaatcctgcaggatagtgcctccagagatgctgcatatgcgaattatatggatgtgacagcgtctaactatgggcattccataaggtccgctttaaagaatcgtaatctgggcgtgtcgaatatctcccactatgcatctgatgtgtctgcggacaagctggtgacatgggtggagtcgcatgatacgtatgccaatgatgatgaagagtcgacatggatgagcgatgatgatatccgtttaggctgggcggtgatagcttctcgttcaggcagtacgcctcttttcttttccagacctgagggaggcggaaatggtgtgagattcccggggaaaagccaaataggcgatcgcgggagtgctttatttgaagatcaggctatcactgcggtcaatagatttcacaatgtgatggctggacagcatgaggaactctcgaacccgaatggaaacaaccagatatttatgaatcagcgcggctcacatggcgttgtgctggcaaatgcaggttcatcctctgtctctatcaatacggcaacaaaattgcctgatggcaggtatgacaataaagctggagcgggttcatttcaagtgaacgatggtaaactgacaggcacgatcaatgccaggtctgtagctgtgctttatcctgatgatattgaaatcaggtgtaacacattctttcaatga

SEQ ID NO: 1708 - protein, 477 aa, Bacillus subtilis
MFAKRFKTSLLPLFAGFLLLFYLVLAGPAAASAETANKSNELTAPSIKSGTILHAWNWSFNTLKLNMKDIHDAGYTAIQTSPINQVKEGNQGDKSMSNWYWLYQPTSYQIGNRYLGTEQEFKEMCAAAEEYGIKVIVDAVINHTTSDYAAISNEVKSIPNWTHGNTQIKNWSDRWDVTQNSLLGLYDWNTQNTQVQSYLKRFLERALNDGADGFRFDAAKHIELPDDGSYGSQFWPNITNTSAEFQYGEILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQHEELSNPNGNNQIFMNQRGSHGVVLANAGSSSVSINTATKLPDGRYDNKAGAGSFQVNDGKLTGTINARSVAVLYPDDIEIRCNTFFQ

SEQ ID NO: 1709 - DNA, 1557 bp, Bacillus subtilis
ggaaacatgattcaaaaacgaaagcggacagtttcgttcagacttgtgcttatgtgcacgctgttatttgtcagtttgccgattacaaaaacatcagccgtaaatggcacgctgatgcagtattttgaatggtatacgccgaacgacggccagcattggaaacgattgcagaatgatgcggaacatttatcggatatcggaatcactgccgtctggattcctcccgcatacaaaggattgagccaatccgataacggatacggaccttatgatttgtatgatttaggagaattccagcaaaaagggacggtcagaacgaaatacggcacaaaatcagagcttcaagatgcgatcggctcactgcattcccggaacgtccaagtatacggagatgtggttttgaatcataaggctggtgctgatgcaacagaagatgtaactgccgtcgaagtcaatccggccaatagaaatcaggaaacttcggaggaatatcaaatcaaagcgtggacggattttcgttttccgggccgtggaaacacgtacagtgattttaaatggcattggtatcatttcgacggagcggactgggatgaatcccggaagatcagccgcatctttaagtttcgtggggaaggaaaagcgtgggattgggaagtatcaagtgaaaacggcaactatgactatttaatgtatgctgatgttgactacgacaaccctgatgtcgtggcagagacaaaaaaatggggtaactggtatgcgaatgaactgtcattagacggcttccgtattgatgccgccaaacatattaaattttcatttctgcgtgattgggttcaggcggtcagacaggcgacgggaaaagaaatgtttacggttgcggagtattggcagaataatgccgggaaactcgaaaactacttgaataaaacaagctttaatcaatccgtgtttgatgttccgcttcatttcaatttacaggcggcttcctcacaaggaggcggatatgatatgaggcgtttgctggacggtaccgttgtgtccaggcatccggaaaaggcggttacatttgttgaaaatcatgacacacagccgggacagtcattggaatcgacagtccaaacttggtttaaaccgcttgcatacgcctttattttgacaagagaatccggttatcctcaggtgttctatggggatatgtacgggacaaaagggacatcgccaaaggaaattccctcactgaaagataatatagagccgattttaaaagcgcgtaaggagtacgcatacgggccccagcacgattatattgaccacccggatgtgatcggatggacgagggaaggtgacagctccgccgccaaatcaggtttggccgctttaatcacggacggacccggcggatcaaagcggatgtatgccggcctgaaaaatgccggcgagacatggtatgacataacgggcaaccgttcagatactgtaaaaatcggatctgacggctggggagagtttcatgtaaacgatgggtccgtctccatttatgttcagaaataaggtaat

SEQ ID NO: 1710 - protein, 514 aa, Bacillus subtilis
MIQKRKRTVSFRLVLMCTLLFVSLPITKTSAVNGTLMQYFEWYTPNDGQHWKRLQNDAEHLSDIGITAVWIPPAYKGLSQSDNGYGPYDLYDLGEFQQKGTVRTKYGTKSELQDAIGSLHSRNVQVYGDVVLNHKAGADATEDVTAVEVNPANRNQETSEEYQIKAWTDFRFPGRGNTYSDFKWHWYHFDGADWDESRKISRIFKFRGEGKAWDWEVSSENGNYDYLMYADVDYDNPDVVAETKKWGNWYANELSLDGFRIDAAKHIKFSFLRDWVQAVRQATGKEMFTVAEYWQNNAGKLENYLNKTSFNQSVFDVPLHFNLQAASSQGGGYDMRRLLDGTVVSRHPEKAVTFVENHDTQPGQSLESTVQTWFKPLAYAFILTRESGYPQVFYGDMYGTKGTSPKEIPSLKDNIEPILKARKEYAYGPQHDYIDHPDVIGWTREGDSSAAKSGLAALITDGPGGSKRMYAGLKNAGETWYDITGNRSDTVKIGSDGWGEFHVNDGSVSIYVQK

SEQ ID NO: 1711 - DNA, 736 bp, Bacillus subtilis
agttttttttataggaacattgatttgtattcactctgccaagttgttttgatagagtgattgtgataatttaaaatgtaagcgttaacaaaattctccagtcttcacatcagcttgaaaggaggaagcggaagaatgaagtaagagggatttttgactccgaagtaagtcttcaaaaaatcaaataaggagtgtcaagaatgtttgcaaaacgattcaaaacctctttactgccgttattcgctggatttttattgctgttttatttggttctggcaggaccggcggctgcgagtgctgaaacggcgaacaaatcgaatgagcttacagcaccgtcgatcaaaagcggaaccattcttcatgcatggaattggtcgttcaatacgttaaaacacaatatgaaggatattcatgatgcaggatatacagccattcagacatctccgattaaccaagtaaaggaagggaatcaaggagataaaagcatgtcgaactggtacctcgggcttaagcggttctcttccccattgaggacaaggctagacgggacttaccgaaagaaaccatctatgatggtttctttttgttcataaatcagacaaaacttttcccttgcaaaagtttgtgaagcgttgcacaatataaatgtgaaatacttcacaaagaaaaagacatcaaagagaaacataccctggaaggtgattaatgatgaacaacatgtaataagtagcttacg

SEQ ID NO: 1712 - DNA, 2241 bp, Bacillus subtilis 2633
gatcatccgcggcattatgtttgaatttccgtttaaagaatgggctgcaagcttgttcatcattatcttatattactgcatcagggctgcggcatccggaatgctcatgccgagaatagacaccaaagaagaactgcaaaaacgggtgaagcagcagcgaatagaatcagttgcggtcgcctttgcggtagtggtgcttacgatgtacgacagggggattccccatacattcttcgcttggctgaaaatgattcttctttttatcgtctgcggcggcgttctgtttctgcttcggtatgtgattgtgaagctggcttacagaagagcggtaaaagaagaaataaaaaagaaatcatcttttttgtttggaaagcgagggaagcgtacacagtctcgggcagtttttttataggaacattgatttgtattcactctgccaagttgttttgatagagtgattgtgataatttaaaatgtaagtgttaacaaaattctccagtcttcacatcagtttgaaaggaggaagcggaagaatgaagtaagagggatttttgactccgaagtaagtcttcaaaaaatcaaataaggagtgtcaagaatgtttgcaaaacgattcaaaacctctttactgccgttattcgctggatttttattgctgttttatttggttctggcaggaccggcggctgcgagtgctgaaacggcgaacaaatcgaatgagcttacagcaccgtcgatcaaaagcggaaccattcttcatgcatggaattggtcgttcaatacgttaaaacacaatatgaaggatattcatgatgcaggatatacagccattcagacatctccgattaaccaagtaaaggaagggaatcaaggagataaaagcatgtcgaactggtactggctgtatcagccgacatcgtatcaaattggcaaccgttacttaggtactgaacaagaatttaaagaaatgtgtgcagccgctgaagaatatggcataaaggtcattgttgacgcggtcatcaatcataccaccagtgattatgccgcgatttcgaatgaggttaagagtattccaaactggacacatggaaacacacaaattaaaaactggtctgatcgatgggatgtcacgcagaattcattgctcgggctgtatgactggaatacacaaaatacacaagtacagtcctatctgaaacggttcttagaaagggcattgaatgacggggcagacggttttcgatttgatgcagccaaacatatagagcttccggatgatgggagttacggcagtcaattttggccgaatatcacaaatacatctgcagagttccaatacggagaaatcctgcaggatagtgcctccagagatgctgcatatgcgaattatatggatgtgacagcgtctaactatgggcattccataaggtccgctttaaagaatcgtaatctgggcgtgtcgaatatctcccactatgcatctgatgtgtctgcggacaagctggtgacatgggtggagtcgcatgatacgtatgccaatgatgatgaagagtcgacatggatgagcgatgatgatatccgtttaggctgggcggtgatagcttctcgttcaggcagtacgcctcttttcttttccagacctgagggaggcggaaatggtgtgagattcccggggaaaagccaaataggcgatcgcgggagtgctttatttgaagatcaggctatcactgcggtcaatagatttcacaatgtgatggctggacagcatgaggaactctcgaacccgaatggaaacaaccagatatttatgaatcagcgcggctcacatggcgttgtgctggcaaatgcaggttcatcctctgtctctatcaatacggcaaccaaattgcctgatggcaggtatgacaataaagctggagcgggttcatttcaagtgaacgatggtaaactgacaggcacgatcaatgccaggtctgtagctgtgctttatcctgatgatattgaaatcaggtgtaacacattctttcaatgatcaactgacgattaccttgcgtgcaaatgcgaatacaacaaaagccgtttatcaaatcaataatggaccagagacggcgtttaaggatggagatcaattcacaatcggaaaaggagatccatttggcaaaacatacaccatcatgttaaaaggaacgaacagtgatggtgtaacgagggccgaggaatacagctttgttaaaagagatc

SEQ ID NO: 1713 - protein, 477 aa, Bacillus subtilis 2633
MFAKRFKTSLLPLFAGFLLLFYLVLAGPAAASAETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDYAAISNEVKSIPNWTHGNTQIKNWSDRWDVTQNSLLGLYDWNTQNTQVQSYLKRFLERALNDGADGFRFDAAKHIELPDDGSYGSQFWPNITNTSAEFQYGEILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQHEELSNPNGNNQIFMNQRGSHGVVLANAGSSSVSINTATKLPDGRYDNKAGAGSFQVNDGKLTGTINARSVAVLYPDDIEIRCNTFFQ

SEQ ID NO: 1714 - DNA, 1980 bp, Bacillus subtilis strain HA 401
atgtttgcaaaacgattcaaaacctctttactgccgttattcgctggatttttattgctgtttcatttggttctggcaggaccggcggctgcgagtgctgaaacggcgaacaaatcgaatgagcttacagcaccgtcgatcaaaagcggaaccattcttcatgcatggaattggtcgttcaatacgttaaaacacaatatgaaggatattcatgatgcaggatatacagccattcagacatctccgattaaccaagtaaaggaagggaatcaaggagataaaagcatgtcgaactggtactggctgtatcagccgacatcgtatcaaattggcaaccgttacttaggtactgaacaagaatttaaagaaatgtgtgcagccgctgaagaatatggcataaaggtcattgttgacgcggtcatcaatcataccaccagtgattatgccgcgatttccaatgaggttaagagtattccaaactggacacatggaaacacacaaattaaaaactggtctgatcgatgggatgtcacgcagaattcattgctcgggctgtatgactggaatacacaaaatacacaagtacagtcctatctgaaacggttcttagaaagggcattgaatgacggggcagacggttttcgatttgatgccgccaaacatatagagcttccagatgatggcagttacggcagtcaattttggccgaatatcacaaatacatctgcagagttccaatacggagaaatcctgcaggatagtgcctccagagatgctgcatatgcgaattatatggatgtgacagcgtctaactatgggcattccataaggtccgctttaaagaatcgtaatctgggcgtgtcgaatatctcccactatgcatctgatgtgtctgcggacaagctagtgacatgggtagagtcgcatgatacgtatgccaatgatgatgaagagtcgacatggatgagcgatgatgatatccgtttaggctgggcggtgatagcttctcgttcaggcagtacgcctcttttcttttccagacctgagggaggcggaaatggtgtgaggttcccggggaaaagccaaataggcgatcgcgggagtgctttatttgaagatcaggctatcactgcggtcaatagatttcacaatgtgatggctggacagcctgaggaactctcgaacccgaatggaaacaaccagatatttatgaatcagcgcggctcacatggcgttgtgctggcaaatgcaggttcatcctctgtttctatcaatacgccaacaaaattgcctgatggcaggtatgacaataaagctggggcaggttcatttcaagtgaatgatggtaaactgacaggcacgatcaatgccaggtctgtggctgtgctttatcctgatgatattgcacaagcgcctcatgttttccttgagaattacaaaacaggtgtaacacattctttcaatgatcaactgacgattaccttgcgtgcagatgcgaatacaacaaaagccgtttatcaaatcaataatggaccagagacggcgtttaaggatggagatcaattcacaatcggaaaaggagatccatttggcaaaacatacaccatcatgttaaaaggaacgaacagtgatggtgtaacgaggaccgaggaatacagttttattaaaagagatccagcttcggccaaaaccatcggctatcaaaatccgaatcattggagccaggtaaatgcttatatctataaacatgatgggggccaggcaattgaattgaccggatcttggcctggaaaaccaatgactaaaaatgcagacggaatttacacgctgactctgcctgcggacacggatacaaccaacgcaaaagtgatttttaataatggcagcgcccaagtgcctggccagaatcagcctggctttgattacgtgcaaaatggtttatataatgactcgggcttaagcggttctcttccttattga

SEQ ID NO: 1715 - protein, 659 aa, Bacillus subtilis strain HA 401
MFAKRFKTSLLPLFAGFLLLFHLVLAGPAAASAETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDYAAISNEVKSIPNWTHGNTQIKNWSDRWDVTQNSLLGLYDWNTQNTQVQSYLKRFLERALNDGADGFRFDAAKHIELPDDGSYGSQFWPNITNTSAEFQYGEILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTPTKLPDGRYDNKAGAGSFQVNDGKLTGTINARSVAVLYPDDIAQAPHVFLENYKTGVTHSFNDQLTITLRADANTTKAVYQINNGPETAFKDGDQFTIGKGDPFGKTYTIMLKGTNSDGVTRTEEYSFIKRDPASAKTIGYQNPNHWSQVNAYIYKHDGGQAIELTGSWPGKPMTKNADGIYTLTLPADTDTTNAKVIFNNGSAQVPGQNQPGFDYVQNGLYNDSGLSGSLPY

SEQ ID NO: 1716 - DNA, 2001 bp, Bacillus subtilis
  misc_feature (1553)..(1553): n is a, c, g, or t
  misc_feature (1556)..(1557): n is a, c, g, or t
  misc_feature (1665)..(1665): n is a, c, g, or t
aataaggagtgtcaagaatgtttgcaaaacgattcaaaacctctttactgccgttattcgctggatttttattgctgttttatttggttctggcaggaccggcggctgcgagtgctgaaacggcgaacaaatcgattgagcttacagcaccgtcgatcaaaagcggaaccattcttcatgcatggaattggtcgttcaatacgttaaaacacaatatgaaggatattcatgatgcaggatatacagccattcagacatctccgattaaccaagtaaaggaagggaatcaaggagataaaagcatgtcgaactggtactggctgtatcagccgacatcgtatcaaattggcaaccgttacttaggtactgaacaagaatttaaagaaatgtgtgcagccgctgaagaatatggcataaaggtcattgttgacgcggtcatcaatcataccaccagtgattatgccgcgatttccaatgaggttaagagtattccaaactggacacatggaaacacacaaattaaaaactggtctgatcgatgggatgtcacgcagaattcattgctcgggctgtatgactggaatacacaaaatacacaagtacagtcctatctgaaacggttcttagacagggcattgaatgacggggcagacggttttcgatttgatgccgccaaacatatagagcttccagatgatggcagttacggcagtcaattttggccgaatatcactaatacatctgcagagttccaatacggagaaatcctgcaggatagtgcctccagagatgctgcatatgcgaattatatggatgtgacagcgtctaactatgggcattccataagatccgctttaaagaatcgtaatctgggcgtgtcgaatatctcccactatgcatctgatgtgtctgcggacaagctagtgacatgggtagagtcgcatgatacgtatgccaatgatgatgaagagtcgacatggatgagcgatgatgatatccgtttaggctgggcggtgatagcttctcgttcaggcagtacgcctcttttcttttccagacctgagggaggcggaaatggtgtgaggttcccggggaaaagccaaataggcgatcgcgggagtgctttatttgaagatcaggctatcactgcggtcaatagatttcacaatgtgatggctggacagcctgaggaactctcgaacccgaatggaaacaaccagatatttatgaatcagcgcatctcacatggcgttgtgctggcaaatgcaggttcatcctctgtctctatcaatacggcaacaaaattgcctgatggcaggtatgacaataaagctggagcgggttcatttcaagtgaacgatggtaaactgacaggcacgatcaatgccaggtctgtagctgtgctttatcctgatgatattgcaaaagcgcctcatgttttccttgagaattacaaaacaggtgtaacacattctttcaatgatcaactgacgattaccttgcgtgcagatgcgaatacatttatcaaatcaataatggaccagatcaattgncgnntcaggcgtttaaggatggagatcaattcacaatcggaaaaggagatccaatttggcaaaacatacaccatcatgttaaaaggaacgaacagtgatggtgttacgaggnccgagaaatacagtttgcctaaaagagatccagcgtcggccaaaaccatcggctatcaaaatccgaatcattggagccaggtaaatgcttatatctataaacatgatgggagccgcgaaattgaattgaccggatcttggcctggaaaaccaatgactaaaaatgcagacggaatttacacgctgacgctgcctgcggacacggatacaaccaacgcaaaagtgatttttaataatgggtacgcccaagtgcccggtcagaatcagcctggctttgattacgtgctaaatggtttatactaatgactcgggcttaagcggttctcttccccattga

SEQ ID NO: 1717 - protein, 649 aa, Bacillus subtilis
  misc_feature (512)..(512): Xaa can be any naturally occurring amino acid
  misc_feature (514)..(514): Xaa can be any naturally occurring amino acid
  misc_feature (550)..(550): Xaa can be any naturally occurring amino acid
MFAKRFKTSLLPLFAGFLLLFYLVLAGPAAASAETANKSIELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDYAAISNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGEILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRISHGVVLANAGSSSVSINTATKLPDGRYDNKAGAGSFQVNDGKLTGTINARSVAVLYPDDIAKAPHVFLENYKTGVTHSFNDQLTITLRADANTFIKSIMDQINXRXRRLRMEINSQSEKEIQFGKTYTIMLKGTNSDGVTRXEKYSLPKRDPASAKTIGYQNPNHWSQVNAYIYKHDGSREIELTGSWPGKPMTKNADGIYTLTLPADTDTTNAKVIFNNGYAQVPGQNQPGFDYVLNGLY

SEQ ID NO: 1718 - DNA, 2680 bp, Bacillus subtilis
gctcatgccgagaatagacaccaaagaagaactgtaaaaacgggtgaagcagcagcgaatagaatcaattgcttgcgcctttgcggtagtggtgcttacgatgtacgacagggggattccccatacattcttcgcttggctgaaaatgattcttctttttatcgtctgcggcggcgttctgtttctgcttcggtatgtgattgtgaagctggcttacagaagagcggtaaaagaagaaataaaaaagaaatcatcttttttgtttggaaagcgagggaagcgttcacagtttcgggcagctttttttataggaacattgatttgtattcactctgccaagttgttttgatagagtgattgtgataattttaaatgtaagcgttaacaaaattctccagtcttcacatcggtttgaaaggaggaagcggaagaatgaagtaagagggatttttgactccgaagtaagtcttcaaaaaatcaaataaggagtgtcaagaatgtttgcaaaacgattcaaaacctctttactgccgttattcgctggatttttattgctgtttcatttggttctggcaggaccggcggctgcgagtgctgaaacggcgaacaaatcgaatgagcttacagcaccgtcgatcaaaagcggaaccattcttcatgcatggaattggtcgttcaatacgttaaaacacaatatgaaggatattcatgatgcaggatatacagccattcagacatctccgattaaccaagtaaaggaagggaatcaaggagataaaagcatgtcgaactggtactggctgtatcagccgacatcgtatcaaattggcaaccgttacttaggtactgaacaagaatttaaagaaatgtgtgcagccgctgaagaatatggcataaaggtcattgttgacgcggtcatcaatcataccaccagtgattatgccgcgatttccaatgaggttaagagtattccaaactggacacatggaaacacacaaattaaaaactggtctgatcgatgggatgtcacgcagaattcattgctcgggctgtatgactggaatacacaaaatacacaagtacagtcctatctgaaacggttcttagacagggcattgaatgacggggcagacggttttcgatttgatgccgccaaacatatagagcttccagatgatggcagttacggcagtcaattttggccgaatatcacaaatacatctgcagagttccaatacggagaaatcctgcaggatagtgcctccagagatgctgcatatgcgaattatatggatgtgacagcgtctaactatgggcattccataaggtccgctttaaagaatcgtaatctgggcgtgtcgaatatctcccactatgcatctgatgtgtctgcggacaagctagtgacatgggtagagtcgcatgatacgtatgccaatgatgatgaagagtcgacatggatgagcgatgatgatatccgtttaggctgggcggtgatagcttctcgttcaggcagtacgcctcttttcttttccagacctgagggaggcggaaatggtgtgaggttcccggggaaaagccaaataggcgatcgcgggagtgctttatttgaagatcaggctatcactgcggtcaatagatttcacaatgtgatggctggacagcctgaggaactctcgaacccgaatggaaacaaccagatatttatgaatcagcgcggctcacatggcgttgtgctggcaaatgcaggttcatcctctgtctctatcaatacggcaacaaaattgcctgatggcaggtatgacaataaagctggagcgggttcatttcaagtgaacgatggtaaactgacaggcacgatcaatgccaggtctgtagctgtgctttatcctgatgatattgcaaaagcgcctcatgttttccttgagaattacaaaacaggtgtaacacattctttcaatgatcaactgacgattaccttgcgtgcagatgcgaatacaacaaaagccgtttatcaaatcaataatggaccagacgacaggcgtttaaggatggagatcaattcacaatcggaaaaggagatccaatttggcaaaacatacaccatcatgttaaaaggaacgaacagtgatggtgtaacgaggaccgagaaatacagttttgttaaaagagatccagcgtcggccaaaaccatcggctatcaaaatccgaatcattggagccaggtaaatgcttatatctataaacatgatgggagccgagtaattgaattgaccggatcttggcctggaaaaccaatgactaaaaatgcagacggaatttacacgctgacgctgcctgcggacacggatacaaccaacgcaaaagtgatttttaataatggcagcgcccaagtgcccggtcagaatcagcctggctttgattacgtgctaaatggtttatataatgactcgggcttaagcggttctcttccccattgagggcaaggctagacgggacttaccgaaagaaaccatcaatgatggtttcttttttgttcataaatcagacaaaacttttctcttgcaaaagtttgtgaagtgttgcacaatataaatgtgaaatacttcacaaacaaaaagacatcaaagagaaacataccctgcaaggatgctgatattgtctgcatttgcgccggagc

SEQ ID NO: 1719 - protein, 660 aa, Bacillus subtilis
MFAKRFKTSLLPLFAGFLLLFHLVLAGPAAASAETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDYAAISNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGEILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITLRADANTTKAVYQINNGPDDRRLRMEINSQSEKEIQFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 1720 - DNA, 2166 bp, Bacillus subtilis
tgacggtgtgtttcttgatcgcatctcctcgccgcgcttgactacggtcagacagcctgttgttgaaatgggggaagcctgtgcgaaaatgttgctgaaaaaaatgaatgaagacggcgctgcacaaggaagtctattttttgaaccagagttaattgtacgagaatcaacgctgtaagccctttattctgttatcggtaacagggtgaaaaggattgttcccacaatttcatcatgatactttcaaactatgagccggcttcaataaaacggaaatcaaagggggaaacatgatggaatatgcagcgattcatcaccagccattcagcacagatgcttattcttatgatgggcggactgtgcatatcaagattcggacgaaaaaaggtgatgcagatcacattcgattcatttggggtgatccctatgagtacaacgacggcaaatggtcggcaaacgagcagccgatgagaaaaattgctgcaacagaaatgcatgactattggtttgctgaagtggtgcccccatttaggcgtttacaatatgcgtttgttgtaacagacgatcatgaagacatctttttcggaagttcgggtgtatgcccttataacgaaaaaacactggaaacgattcattattactttaaatttccgtttgttcacgaggctgatacatttcaagcgcctgaatgggtcaagtcaacggtttggtatcaaatttttccggagcgttttgcaaatggaagagaagacttgtcaccgaagaatgcattgccgtgggggagcaaggacccgggcgtcaatgatttttttggaggagatttgcaagggattgttgacaagcttgattatttagaggatttaggggtgaacggcatttatctgacgccgatcttttccgcgccttctaatcataaatacgacacgctggattacttttctattgatccgcatttcggggatccagagatttttcgtacattggtcagccagctgcatcagcgggggatgagaattatgcttgatgcggtttttaaccatataggaagcgcgtctccgcaatggcaggatgtcgtcaaaaacggagatcaatcccgctataaggactggttccatattcactcttttcccgtcacagacgacaattatgacagatttgcttttacagctgatatgccgaagctaaacacggctaatcccgaggtgcagaaatatttgcttgatattgctttgtactggattcgcgaatttgacattgacggctggcgtttggatgtcgcaaatgaagtggatcacgtgttttggaagacatttaggcaggctgtatctactgaaaagcctgacgtttatattttaggtgagatctggcattctgccgaaccctggcttagaggggatgaatttcatgcggcgatgaattacccttttacagagcctatgattgaatactttgctgaccagacgatctcagcttcacgtatggctcaccgtgtcaatgcacatttgatgaatgggatgaagcaggccaatgaggtgatgtttaatttactggatagccatgatacaaagcgccttttgaccagatgccgcaatgatgagaagaaagcacgcgcgttgctggcctttatgtttgcccagacaggctcaccatgcatctattacgggacggaaatcgggctggacggcgaaaatgatccattatgccggaaatgtatggtttgggaaaaggagaagcaaaaccaagacatgctgcaatttatgaaacggttaattgctttacgcaagcaggaaaacactttattgactgaaggacatcttgagtggaatctgctggacgacaaaaatgatttcattagcttttcgcggactcttgatgaaaaaatactgatttatttctttaatcaagggaatgtggttcaacacatcagtttacgagagttgaatattgataggaataacaaaatctgtgatgcatggacagagcagccgcttcattatcacgatgtcattgccgttcagccgggagaatttttgattttgagtgctgccgcccctgtataacattctgttatcggtaacaaatcaaaagttgttgtaaccgctttctataggacaatacaattgttatagtttcgtaaatagaagggggaaaagagatggttctttt

SEQ ID NO: 1721 - protein, 589 aa, Bacillus subtilis
MMEYAAIHHQPFSTDAYSYDGRTVHIKIRTKKGDADHIRFIWGDPYEYNDGKWSANEQPMRKIAATEMHDYWFAEVVPPFRRLQYAFVVTDDHEDIFFGSSGVCPYNEKTLETIHYYFKFPFVHEADTFQAPEWVKSTVWYQIFPERFANGREDLSPKNALPWGSKDPGVNDFFGGDLQGIVDKLDYLEDLGVNGIYLTPIFSAPSNHKYDTLDYFSIDPHFGDPEIFRTLVSQLHQRGMRIMLDAVFNHIGSASPQWQDVVKNGDQSRYKDWFHIHSFPVTDDNYDRFAFTADMPKLNTANPEVQKYLLDIALYWIREFDIDGWRLDVANEVDHVFWKTFRQAVSTEKPDVYILGEIWHSAEPWLRGDEFHAAMNYPFTEPMIEYFADQTISASRMAHRVNAHLMNGMKQANEVMFNLLDSHDTKRLLTRCRNDEKKARALLAFMFAQTGSPCIYYGTEIGLDGENDPLCRKCMVWEKEKQNQDMLQFMKRLIALRKQENTLLTEGHLEWNLLDDKNDFISFSRTLDEKILIYFFNQGNVVQHISLRELNIDRNNKICDAWTEQPLHYHDVIAVQPGEFLILSAAAPV

SEQ ID NO: 1722 - DNA, 2991 bp, Bacillus subtilis
  misc_feature (2265)..(2265): n is a, c, g, or t
ggatcctccgccattatgtttgaatttccgtttaaagaatgggctgcaagccttgtgtttttgttcatcattatcttatattactgcatcagggctgcggcatctggaatgctcatgccgagaatggacaccaaagaagaactgcaaaaacgggtgaagcagcagcgaatagaatcaattgcggtcgcctttgcggtagtggtgcttacgatgtacgacagggggattccccatacattcttcgcttggctgaaaatgattcttctttttatcgtctgcggcggcgttctgtttctgcttcggtatgtaattgtgaagctggcttacagaagagcggtaaaagaagaaataaaaaagaaatcatcttgaaaaatagatggtttctttttttgtttggaaagcgagggaagcgttcacagtttcgggcagctttttttataggaacattgatttgtattcactctgccaagttgttttgatagagtgattgtgataatttaaaatgtaagcgttaacaaaattctccagtcttcacatcagtttgaaaggaggaagcggaagaatgaagtaagagggatttttgactccgaagtaagtcttcaaaaaatcaaataaggagtgtcaagaatgtttgcaaaacgattcaaaacctctttactgccgttattcgctggatttttattgctgtttcatttggttctggcaggaccggcggctgcgagtgctgaaacggcgaacaaatcgaatgagcttacagcaccgtcgatcaaaagtggaaccattcttcatgcatggaattggtcgttcaatacgttaaaacataatatgaaggatattcatgatgcaggatatacagccattcagacatctccgattaaccaagtaaaggaagggaaccaaggagataaaagcatgtcgaactggtactggctgtatcagccgacatcgtaccaaattggcaaccgttacttaggtactgagcaagaatttaaagaaatgtgtgcagccgctgaagaatatggcataaaggtcattgttgacgcggtcataaatcataccaccagtgactatgccgcgatttccaatgagattaagagtattccaaactggacacatggaaacacacaaattaaaaactggtcggatcgatgggatgtcacgcagaattcattgctcgggctgtatgactggaatacacaaaatacacaagtacagtcctatctgaaacggttcttagaaagagcattgaatgacggggcagacggttttcgctttgatgccgccaaacatatagaacttccagatgatgggagttacggcagtcaattttggccgactatcacaaatacatctgcagagttccaatacggagaaatcctgcaggatagtgcctccagagatgctgcatatgcgaattatatggatgtgacagcgtctaactatgggcattccataaggtccgctttaaagaatcgtaatctgggcgtgtcgaatctctcccactatgcatctgatgtgtctgcggacaagctagtgacatgggtagagtcgcatgatacgtatgccaatgatgatgaagagtcgacatggatgagcgatgatgatatccgcttaggctgggcggtgatagcttctcgttcaggcagtacgcctcttttcttttccagacctgagggaggcggaaatggtgtgaggttcccggggaaaagccaaataggcgatcgcgggagtgctttatttgaagatcaggctatcactgcggtcaatagatttcacaatgtgatggctggacagcctgaggaactctcgaacccgaatggaaacaaccagatatttatgaatcagcgcggctcacatggcgttgtgctggcaaatgcaggttcatcctctgtctctatcaatacggcaacaaaattgcctgatggcaggtatgacaataaagctggagcgggttcatttcaagtgaacgatggtaaactgacaggcacgatcaatgccaggtctgtagctgtgctttatcctgatgatattgcaaaagcgcctcatgttttccttgagaattacaaaacaggtgtaacacattctttcaatgatcaactgacgattaccttgcgtgcagatgcgaatacaacaaaagccgtttatcaaatcaataatggaccagagacagcgtttaaggatggagatcaattcacaatcggaaaaggagatccatttggcaaaacatacaccatcatgttaaaaggaacgaacagtgatggtgtnacgagggccgaggaatacagctttgttaaaagagatccagcttcggccaaaaccatcggctatcaaaatccgaatcattggagccaggtaaatgcttatatctataaacatgatgggggccgggcaattgaattgaccggatcttggcctggaaaaccaatgactaaaaatgcagatggaatttacacgctgacgctgcctgcggacacggatacaaccaacgccaaagtgatttttaataatggcagcgcccaagtgcccggccagaatcagcctggctttgattacgtgcaaaatggtttatataatgactcgggcttaagcggttctcttcctcattgagggcaatgctagacgggacttaccgaaagaaaccatctgtgatggtttcttttttgttcataaatcagacaaaacttttccctggcaaaagtttgtgaagtattgcacaatataaatgtgaaatacttcacaaataaaaagacatcaaagagaaacataccctggaaggatgattaatgatgaacaaacatgtaaataaagtagctttaatcggagcgggttttgttggaagcagttatgcatttgcgttaattaaccaagggatcacagatgagcttgtggtcattgatgtaaataaagaaaaagcaatgggcgatgtgatggatttaaaccacggaaaggccgttgcgccacaaccggtcaaaacatcttacggaatctaga

SEQ ID NO: 1723 - protein, 659 aa, Bacillus subtilis
MFAKRFKTSLLPLFAGFLLLFHLVLAGPAAASAETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDYAAISNEIKSIPNWTHGNTQIKNWSDRWDVTQNSLLGLYDWNTQNTQVQSYLKRFLERALNDGADGFRFDAAKHIELPDDGSYGSQFWPTITNTSAEFQYGEILQDSASRDAAYANYMDVTASNYGHSIRSALKNRNLGVSNLSHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITLRADANTTKAVYQINNGPETAFKDGDQFTIGKGDPFGKTYTIMLKGTNSDGVTRAEEYSFVKRDPASAKTIGYQNPNHWSQVNAYIYKHDGGRAIELTGSWPGKPMTKNADGIYTLTLPADTDTTNAKVIFNNGSAQVPGQNQPGFDYVQNGLYNDSGLSGSLPH

SEQ ID NO: 1724 - DNA, 2294 bp, Bacillus subtilis
gatcatccgcggcattatgtttgaatttccgtttaaagaatgagctgcaagccttgtgtttttgttcatcattatcttatattactgcatcagggctgcggcatccggaatgctcatgccgagaatagacaccaaagaagaactgcaaaaacgggtgaagcagcagcgaatagaatcaattgcggtcgcctttgcggtagtggtgcttacgatgtacgacagggggattccccatacattcttcgcttggctgaaaatgattcttctttttatcgtctgcggcggcgttctgtttctgcttcggtatgtgattgtgaagctggcttacagaagagcggtaaaagaagaaataaaaaagaaatcatcttgaaaaatagatggtttttttttttgtttggaaagcgagggaaacagtctcgggcagttttttataggaccattgatttgtattcactctgccaagttgttttgatagagtgattgtgataatttaaaatgtaagcgtaaacaaaattctccagtcttcgcatcagtttgaaaggaggaagcggaagaatgaagtaagagggatttttgactccgaagtaagtcttcaaaaaatcaaataaggagtgtcaagaatgtttgcaaaacgattcaaaacctctttactgccgttattcgctggatttttattgctgttttatttggttctggcaggaccggcggctgcgagtgctgaaacggcgaacaaatcgaatgagcttacagcaccgtcgatcaaaagcggaaccattcttcatgcatggaattggtcgttcaatacgttaaaacacaatatgaaggatattcatgatgcaggatatacagccattcagacatctccgattaaccaagtaaaggaagggaatcaaggagataaaagcatgtcgaactggtactggctgtatcagccgacatcgtatcaaattggcaaccgttacttaggaactgaacaagaatttaaagaaatgtgtgcagccgctgaagaatatggcataaaggtcattgttgacgcggtcatcaatcataccacctttgattatgccgcgatttccaatgaggttaagagtattccaaactggacacatggaaacacacaaattaaaaactggtctgatcgatgggatgtcacgcagaattcattgctcgggctgtatgactggaatacacaaaatacacaagtacagtcctatctgaaacggttcttagaaagggcattgaatgacggggcagacggttttcgatttgatgccgccaaacatatagagcttccggatgatgggagttacggcagtcaattttggccgaatatcacaaatacatctgcagagttccaatacggagaaatcctgcaggatagtgcctccagagatgctgcatatgcgaattatatggatgtgacagcgtctaactatgggcattccataaggtccgctttaaagaatcgtaatctgggcgtgtcgaatatctcccactatgcatctgatgtgtctgcggacaagctagtgacatgggtagagtcgcatgatacgtatgccaatgatgatgaagagtcgacatggatgagcgatgatgatatccgtttaggctggtcggtgatagcttctcgttcaggcagtacgcctcttttcttttccagacctgagggaggcggaaatggtgtgaggttcccggggaaaagccaaataggcgatcgcgggagtgctttatttgaagatcaggctatcactgcggtcaatagatttcacaatgtgatggctggacagcctgaggaactctcgaacccgaatggaaacaaccagatatttatgaatcagcgcggctcacatggcgttgtgctggcaaatgcaggttcatcctctgtctctatcaatacggcaacaaaattgcctgatggcaggtatgacaataaagctggagcgggttcatttcaagtgaacgatggtaaactgacaggcacgatcaatgccaggtctgtagctgtgctttatcctgatgatattgcaaaagcgcctcatgttttccttgagaattacaaaacaggtgtaacacattctttcaatgatcaactgacgattaccttgcgtgcagatgcgaatacaacaaaagccgtttatcaaatcaataatggaccagacgacaggcgtttaaggatggagatcaattcacaatcggaaaaggagatccaatttggcaaaacatacaccatcatgttaaaaggaacgaacagtgatggtgtaacgaggaccgagaaatacagttttgttaaaaga

SEQ ID NO: 1725 - protein, 558 aa, Bacillus subtilis
MFAKRFKTSLLPLFAGFLLLFYLVLAGPAAASAETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTFDYAAISNEVKSIPNWTHGNTQIKNWSDRWDVTQNSLLGLYDWNTQNTQVQSYLKRFLERALNDGADGFRFDAAKHIELPDDGSYGSQFWPNITNTSAEFQYGEILQDSASRDAAYANYMDVTASNYGHSIRSALKNRNLGVSNISHYASDVSADKLVTWVESHDTYANDDEESTWMSDDDIRLGWSVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITLRADANTTKAVYQINNGPDDRRLRMEINSQSEKEIQFGKTYTIMLKGTNSDGVTRTEKYSFVKR

SEQ ID NO: 1726 - DNA, 1959 bp, Bacillus subtilis
atgtgattgtgaagctggcttacagaagagcggtaaaagaagaaataaaaaagaaatcatcttgaaaaatagatggtttctttttttgtttggaaagcgagggaaacagtctcgggcagttttttataggaacattgatttgtattcactctgccaagttgttttgatagagtgattgtgataatttaaaatgtaagcgtgaacaaaattctccagtcttcacatcagtttgaaaggaggaagcggaagaatgaagtaagagggatttttgactccgaagtaagtcttcaaaaaatcaaataaggagtgtcaagaatgtttgcaaaacgattcaaaacctctttactgccgttattcgctggatttttattgctgttttatttggttctggcaggaccggcggctgcgagtgctgaaacggcgaacaaatcgaatgagcttacagcaccgtcgatcaaaagcggaaccattcttcatgcatggaattggtcgttcaatacgttaaaacacaatatgaaggatattcatgatgcaggatatacagccattcagacatctccgattaaccaagtaaaggaagggaatcaaggagataaaagcatgtcgaactggtactggctgtatcagccgacatcgtatcaaattggcaaccgttacttaggtactgaacaagaatttaaagaaatgtgtgcagccgctgaagaatatggcataaaggtcattgttgacgcggtcatcaatcataccacctttgattatgccgcgatttccaatgaggttaagagtattccaaactggacacatggaaacacacaaattaaaaactggtctgatcgatgggatgtcacgcagaattcattgctcgggctgtatgactggaatacacaaaatacacaagtacagtcctatctgaaacggttcttagaaagggcattgaatgacggggcagacggttttcgatttgatgccgccaaacatatagagcttccggatgatgggagttacggcagtcaattttggccgaatatcacaaatacatctgcagagttccaatacggagaaatcctgcaggatagtgcctccagagatgctgcatatgcgaattatatggatgtgacagcgtctaactatgggcattccataaggtccgctttaaagaatcgtaatctgggcgtgtcgaatatctcccactatgcatatgatgtgtctgcggacaagctggtgacatgggtggagtcgcatgatacgtatgccaatgatgatgaagagtcgacatggatgagcgatgatgatatccgtttaggctgggcggtgatagcttctcgttcaggcagtacgcctcttttcttttccagacctgagggaggcggaaatggtgtgagattcccggggaaaagccaaataggcgatcgcgggagtgctttatttgaagatcagtctatcactgcggtcaatagatttcacaatgtgatggctggacagcctgaggaactctcgaacccgaatggaaacaaccagatatttatgaatcagcgcggctcacatggcgttgtgctggcaaatgcaggttcatcctctgtttctatcaatacgccaacaaaattgcctgatggcaggtatgacaataaagctggagcgggttcatttcaagtgaacgatggtaaactgacaggcacgatcaatgccaggtctgtagctgtgctttatcctgatgatattgaaatcaggtgtaacacattctttcaatgatcaactgacgattaccttgcgtgcagatgcgaatacaacaaaagccgtttatcaaatcaataatggaccagagacggcgtttaaggatggagatcaattcacaatcggaaaaggagatccatttggcaaaacatacaccatctagttaaaaggaacgaacagtgatggtgtaacgagggccgaggaaatacagctttgttaaaagagatc

SEQ ID NO: 1727 - protein, 477 aa, Bacillus subtilis
MFAKRFKTSLLPLFAGFLLLFYLVLAGPAAASAETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTFDYAAISNEVKSIPNWTHGNTQIKNWSDRWDVTQNSLLGLYDWNTQNTQVQSYLKRFLERALNDGADGFRFDAAKHIELPDDGSYGSQFWPNITNTSAEFQYGEILQDSASRDAAYANYMDVTASNYGHSIRSALKNRNLGVSNISHYAYDVSADKLVTWVESHDTYANDDEESTWMSDDDIRLGWAVIASRSGSTPLFFSRPEGGGNGVRFPGKSQIGDRGSALFEDQSITAVNRFHNVMAGQPEELSNPNGNNQIFMNQRGSHGVVLANAGSSSVSINTPTKLPDGRYDNKAGAGSFQVNDGKLTGTINARSVAVLYPDDIEIRCNTFFQ

SEQ ID NO: 1728 - DNA, 1650 bp, GEOBACILLUS STEAROTHERMOPHILUS
gtgctaacgtttcaccgcatcattcgaaaaggatggatgttcctgctcgcgtttttgctcactgccttgctgttctgcccaaccggacagcccgccaaggctgccgcaccgtttaacggcaccatgatgcagtattttgaatggtacttgccggatgatggcacgttatggaccaaagtggccaatgaagccaacaacttatccagccttggcatcaccgctctttggctgccgcccgcttacaaaggaacaagccgcagcgacgtagggtacggagtatacgacttgtatgacctcggtgaattcaatcaaaaaggggccgtccgcacaaaatacggaacaaaagctcaatatcttcaagccattcaagccgcccacgccgctggaatgcaagtgtacgccgatgtcgtgttcgaccataaaggcggcgccgacggcacggaatgggtggacgccgtcgaagtcaatccgtccgaccgcaaccaagaaatctcgggcacctatcaaatccaagcatggacgaaatttgattttcccgggcggggcaacacctactccagctttaagtggcgctggtaccattttgatggcgttgattgggacgaaagccgaaaattgagccgcatttacaaattccgcggcatcggcaaagcgtgggattgggaagtagacacggaaaacggaaactatgactacttaatgtatgccgaccttgatatggatcatccccaagtcgtgactgagctgaaaagctgggggaaatggtatgtcaacacaacgaacattgatgggttcccgcttgatgccgtcaagcatattaagttcagttttttccctgattgggtgtcggacgtgcgttctcagacggccaagccgttatttaccgtcggggagtatgggagttatgacatcaacaaatttcacaattactttatgaaaacaaacggaacgatgtctttgtttgatgccccgttacacaacaaattttataacgctcccaaatcagggggcacatttgatatgcgcacgttaatgaccaatactctcatgaaagatcaaccaacattggccgtcaccttcgttgataatcatgacaccgaacccgcccaagctccgcaatcatgggtcgtcccatggttcaaaccgttggcttacgcctttattctaactcggcaggaaggatatccgtgcgtcttttatggggactattatggcattccccaatataacattccttcgctgaaaagcaaaatcgatccgctcctcatcgcgcgcagggattatgcttacggaactcaacatgattatcttgatcactccgacatcatcgggtggacaagggaaggggtcactgaaaaaccaggatccggactggccgcattgatcaccgatgggccgggaggaagcaaatggatgtacgttggcaaacaacacgccggaaaagtgttctatgaccttaccggcaaccggagtgacaccgtcaccatcaacagtgatggatggggggaattcaaagtcaatggcggttcggtttcggtctgggttcctagaaaaacgaccgtttctaccatcactcggccgatcacaacccgaccgtggactggtgaattcgtccgttggaccgaaccacggttggtggcatggccttga

SEQ ID NO: 1729 - protein, 549 aa, GEOBACILLUS STEAROTHERMOPHILUS
MLTFHRIIRKGWMFLLAFLLTALLFCPTGQPAKAAAPFNGTMMQYFEWYLPDDGTLWTKVANEANNLSSLGITALWLPPAYKGTSRSDVGYGVYDLYDLGEFNQKGAVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPQVVTELKSWGKWYVNTTNIDGFPLDAVKHIKFSFFPDWVSDVRSQTAKPLFTVGEYGSYDINKFHNYFMKTNGTMSLFDAPLHNKFYNAPKSGGTFDMRTLMTNTLMKDQPTLAVTFVDNHDTEPAQAPQSWVVPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTITRPITTRPWTGEFVRWTEPRLVAWP

SEQ ID NO: 1730 - DNA, 1680 bp, GEOBACILLUS STEAROTHERMOPHILUS
atgtttgcaaaacgattcaaaacctctttactgccgttattcgctggatttttattgctgttttatttggttctggcaggaccggcggctgcgagtgctgaaacggcgaacaaatcgaatgagcaagcttgtgccgcaccgtttaacggcaccatgatgcagtattttgaatggtacttgccggatgatggcacgttatggaccaaagtggccaatgaagccaacaacttatccagccttggcatcaccgctctttggctgccgcccgcttataaaggaacaagccgcagcgacgtagggtacggagtatacgacttgtatgacctcggtgaattcaatcaaaaaggggccgtccgcacaaaatacggaacaaaagctcaatatcttcaagccattcaagccgcccacgccgctggaatgcaagtgtacgccgatgtcgtgttcgaccataaaggcggcgccgacggcacggaatgggtggacgccgtcgaagtcaatccgtccgaccgcaaccaagaaatctcgggcacctatcaaatccaagcatggacgaaatttgattttcccgggcggggcaacacctactccagctttaagtggcgctggtaccattttgatggcgttgattgggacgaaagccgaaaattgagccgcatttacaaattccgcggcatcggcaaagcgtgggattgggaagtagacacggaaaacggaaactatgactacttaatgtatgccgaccttgatatggatcatcccgaagtcgtgactgagctgaaaagctgggggaaatggtatgtcaacacaacgaacattgatgggttccggcttgatgccgtcaagcatattaagttcagtttttttcctgattggttgtcgaatgtgcgttctcagactggcaagccgctatttaccgttggggaatattggagctatgacatcaacaagttgcacaattacattatgaaaacaaacggaacgatgtctttgtttgatgccccgttacacaacaaattttataccgcttccaaatcagggggcacatttgatatgcgcacgttaatgaccaatactctcatgaaagatcaaccaacattggccgtcaccttcgttgataatcatgacaccgaacccggccaagcgctgcagtcatgggtcgacccatggttcaaaccgttggcttacgcctttattctaactcggcaggaaggatacccgtgcgtcttttatggtgactattatggcattccacaatataacattccttcgctgaaaagcaaaatcgatccgctcctcatcgcgcgcagggattatgcttacggaacgcaacatgattatcttgatcactccgacatcatcgggtggacaagggaaggggtcactgaaaaaccaggatccggactggccgcattgatcaccgatgggccgggaggacgcaaatggatgtacgttggcaaacaacacgccggaaaagtgttctatgaccttaccggcaaccggagtgacaccgtcaccatcaacagtgatggatggggggaattcaaagtcaatggcggttcggtttcggtttgggttcctagaaaaacgaccgtctctactatcgcttggtcgatcacaacccgaccgtggactgatgaattcgtccgttggaccgaaccacggttggtggcatggccttga

SEQ ID NO: 1731 - DNA, 1719 bp, GEOBACILLUS STEAROTHERMOPHILUS
atgtttgcaaaacgattcaaaacctctttactgccgttattcgctggatttttattgctgttttatttggttctggcaggaccggcggctgcgagtgctgaaacggcgaacaaatcgaatgagcacaagcttgccttgctgttctgcccaaccggacagcccgccaaggctgccgcaccgtttaacggcaccatgatgcagtattttgaatggtacttgccggatgatggcacgttatggaccaaagtggccaatgaagccaacaacttatccagccttggcatcaccgctctttggctgccgcccgcttataaaggaacaagccgcagcgacgtagggtacggagtatacgacttgtatgacctcggtgaattcaatcaaaaaggggccgtccgcacaaaatacggaacaaaagctcaatatcttcaagccattcaagccgcccacgccgctggaatgcaagtgtacgccgatgtcgtgttcgaccataaaggcggcgccgacggcacggaatgggtggacgccgtcgaagtcaatccgtccgaccgcaaccaagaaatctcgggcacctatcaaatccaagcatggacgaaatttgattttcccgggcggggcaacacctactccagctttaagtggcgctggtaccattttgatggcgttgattgggacgaaagccgaaaattgagccgcatttacaaattccgcggcatcggcaaagcgtgggattgggaagtagacacggaaaacggaaactatgactacttaatgtatgccgaccttgatatggatcatcccgaagtcgtgactgagctgaaaagctgggggaaatggtatgtcaacacaacgaacattgatgggttccggcttgatgccgtcaagcatattaagttcagtttttttcctgattggttgtcgaatgtgcgttctcagactggcaagccgctatttaccgttggggaatattggagctatgacatcaacaagttgcacaattacattatgaaaacaaacggaacgatgtctttgtttgatgccccgttacacaacaaattttataccgcttccaaatcagggggcacatttgatatgcgcacgttaatgaccaatactctcatgaaagatcaaccaacattggccgtcaccttcgttgataatcatgacaccgaacccggccaagcgctgcagtcatgggtcgacccatggttcaaaccgttggcttacgcctttattctaactcggcaggaaggatacccgtgcgtcttttatggtgactattatggcattccacaatataacattccttcgctgaaaagcaaaatcgatccgctcctcatcgcgcgcagggattatgcttacggaacgcaacatgattatcttgatcactccgacatcatcgggtggacaagggaaggggtcactgaaaaaccaggatccggactggccgcattgatcaccgatgggccgggaggacgcaaatggatgtacgttggcaaacaacacgccggaaaagtgttctatgaccttaccggcaaccggagtgacaccgtcaccatcaacagtgatggatggggggaattcaaagtcaatggcggttcggtttcggtttgggttcctagaaaaacgaccgtctctactatcgcttggtcgatcacaacccgaccgtggactgatgaattcgtccgttggaccgaaccacggttggtggcatggccttga

SEQ ID NO: 1732 - DNA, 1650 bp, Geobacillus (Bacillus) Stearothermophilus
gtgctaacgtttcaccgcatcattcgaaaagggtgggtgttcctgctcgcgttttggctcactgcctcgctgttctgcccgacaggacagcccgccaaggctgccgcaccgtttaacggcaccatgatgcagtattttgaatggtacttgccggatgatggcacgttatggaccaaagtggccaatgaagccaacaacttatccagccttggcatcaccgctctttggctgccgcccgcttataaaggaacaagccgcagcgacgtagggtacggagtatacgacttgtatgacctcggcgaattcaatcaaaaagggaccgtccgcacaaaatacggaacaaaagctcaatatcttcaagccattcaagccgcccacgccgctggaatgcaagtgtacgccgatgtcgtgttcgaccataaaggcggcgccgacggcacggaatgggtggacgccgtcgaagtcaatccgtccgaccgcaaccaagaaatctcgggcacctatcaaatccaagcatggacgaaatttgattttaacgggcggggcaacacctactccagctttaagtggcgctggtaccattttgacggcgttgactgggacgaaagccgaaaattaagccgcatttacaaattccgcggcatcggcaaagcgtgggattgggaagtagacacggaaaacggaaactatgactacttaatgtatgccgaccttgatatggatcatcccgaagtcgtgaccgagctgaaaaactgggggaaatggtatgtcaacacaacgaacattgatgggttccggcttgatgctgtcaagcatattaagttcagtttttttcctgattggttgtcgtatgtgcgttctcagactggcaagccgctatttaccgtcggggaatattggagctatgacatcaacaagttgcacaattacattacgaaaacaaacggaacgatgtctttgtttgatgccccgttacacaacaaattttatactgcttccaaatcggggggcgcatttgatatgagcacgttaatgaacaatactctcatgaaagatcaaccgacattggccgtcaccttcgttgataatcatgacaccgaacccggccaagcgctgcagtcatgggtcgacccatggttcaaaccgttggcttacgcctttattctaactcggcaggaaggatacccgtgcgtcttttatggtgactattatggcattccacaatataacattccttcactgaaaagcaaaatcgatccgctcctcatcgcgcgcagggattatgcttatggaacgcaacatgattatcttgatcactccgacatcatcgggtggacaagggaaggcgttaccgaaaaaccaggatccggactggccgcactgatcaccgatgggccgggaggaagcaaatggatgtacgttggcaaacaacacgccggaaaagtgttctatgaccttaccggcaaccggagtgacaccgtcaccatcaacagtgatggatggggggaattcaaagtcaatggcggttcggtttcggtttgggttcctagaaaaacgaccgtctctactatcgcttggccgatcacaacccgaccgtggactggtgaattcgtccgttggaccgaaccacggttggtggcatggccttga

SEQ ID NO: 1733 - DNA, 4292 bp, Bacillus stearothermophilus
ccgttgttctattttcgattcatgtcaaactcaaaattgtttaaattcgatattgaaaacgattacaaataaaaattataatagacgtaaacgttcgagggtttgctccctttttactctttttatgcaatcgtttcccttaattttttggaagccaaaccgtcgaatgtaacatttgattaagggggaagggcattgtgctaacgtttcaccgcatcattcgaaaaggatggatgttcctgctcgcgtttttgctcactgcctcgctgttctgcccaacaggacagcccgccaaggctgccgcaccgtttaacggcaccatgatgcagtattttgaatggtacttgccggatgatggcacgttatggaccaaagtggccaatgaagccaacaacttatccagccttggcatcaccgctctttggctgccgcccgcttacaaaggaacaagccgcagcgacgtagggtacggagtatacgacttgtatgacctcggcgaattcaatcaaaaagggaccgtccgcacaaaatacggaacaaaagctcaatatcttcaagccattcaagccgcccacgccgctggaatgcaagtgtacgccgatgtcgtgttcgaccataaaggcggcgccgacggcacggaatgggtggacgccgtcgaagtcaatccgtccgaccgcaaccaagaaatctcgggcacctatcaaatccaagcatggacgaaatttgattttcccgggcggggcaacacctactccagctttaagtggcgctggtaccattttgacggcgttgattgggacgaaagccgaaaattgagccgcatttacaaattccgcggcatcggcaaagcgtgggattgggaagtagacacggaaaacggaaactatgactacttaatgtatgccgaccttgatatggatcatcccgaagtcgtgaccgagctgaaaaactgggggaaatggtatgtcaacacaacgaacattgatgggttccggcttgatgccgtcaagcatattaagttcagtttttttcctgattggttgtcgtatgtgcgttctcagactggcaagccgctatttaccgtcggggaatattggagctatgacatcaacaagttgcacaattacattacgaaaacaaacggaacgatgtctttgtttgatgccccgttacacaacaaattttataccgcttccaaatcagggggcgcatttgatatgcgcacgttaatgaccaatactctcatgaaagatcaaccgacattggccgtcaccttcgttgataatcatgacaccgaacccggccaagcgctgcagtcatgggtcgacccatggttcaaaccgttggcttacgcctttattctaactcggcaggaaggatacccgggcgtcttttatggtgactattatggcattccacaatataacattccttcgctgaaaagcaaaatcgatccgctcctcatcgcgcgcagggattatgcttacggaacgcaacatgattatcttgatcactccgacatcatcgggtggacaagggaaggggtcactgaaaaaccaggatccggactggccgcactgatcaccgatgggccgggaggaagcaaatggatgtacgttggcaaacaacacgccggaaaagtgttctatgaccttaccggcaaccggagtgacaccgtcaccatcaccagtgatggatggggggaattcaaagtcaatggcggttcggtttcggtttgggttcctagaaaaacgaccgtttctaccatcactcggccgatcacaacccgaccgtggactggtgaattcgtccgttggaccgaaccacggttggtggcatggccttgatgcctgcgatcgcgttgtaaagatattccgctctatcattgagacaaaaaacacggccttgcgcccatgaatggcggcacaaggccgtgtttgatgttaccatccatttgcttgcttcaacttctcctttgacggcgtttcgtagcggatgtgcgtgtcgatgtcggtcacgtaatacccgccgccgaccgcgtactgcccgccgaagcgcgcatcatacccgtagacgcggtacacttccccaggctgtaagatgcggacgaacacaaggcgcccatccttcgtccgtttccatagatccgttgttctattttcgattcatgtcaaactcaaaattgtttaaattcgatattgaaaacgattacaaataaaaattataatagacgtaaacgttcgagggtttgctccctttttactctttttatgcaatcgtttcccttaattttttggaagccaaaccgtcgaatgtaacatttgattaagggggaagggcattgtgctaacgtttcaccgcatcattcgaaaaggatggatgttcctgctcgcgtttttgctcactgcctcgctgttctgcccaacaggacagcccgccaaggctgccgcaccgtttaacggcaccatgatgcagtattttgaatggtacttgccggatgatggcacgttatggaccaaagtggccaatgaagccaacaacttatccagccttggcatcaccgctctttggctgccgcccgcttacaaaggaacaagccgcagcgacgtagggtacggagtatacgacttgtatgacctcggcgaattcaatcaaaaagggaccgtccgcacaaaatacggaacaaaagctcaatatcttcaagccattcaagccgcccacgccgctggaatgcaagtgtacgccgatgtcgtgttcgaccataaaggcggcgccgacggcacggaatgggtggacgccgtcgaagtcaatccgtccgaccgcaaccaagaaatctcgggcacctatcaaatccaagcatggacgaaatttgattttcccgggcggggcaacacctactccagctttaagtggcgctggtaccattttgacggcgttgattgggacgaaagccgaaaattgagccgcatttacaaattccgcggcatcggcaaagcgtgggattgggaagtagacacggaaaacggaaactatgactacttaatgtatgccgaccttgatatggatcatcccgaagtcgtgaccgagctgaaaaactgggggaaatggtatgtcaacacaacgaacattgatgggttccggcttgatgccgtcaagcatattaagttcagtttttttcctgattggttgtcgtatgtgcgttctcagactggcaagccgctatttaccgtcggggaatattggagctatgacatcaacaagttgcacaattacattacgaaaacaaacggaacgatgtctttgtttgatgccccgttacacaacaaattttataccgcttccaaatcagggggcgcatttgatatgcgcacgttaatgaccaatactctcatgaaagatcaaccgacattggccgtcaccttcgttgataatcatgacaccgaacccggccaagcgctgcagtcatgggtcgacccatggttcaaaccgttggcttacgcctttattctaactcggcaggaaggatacccgggcgtcttttatggtgactattatggcattccacaatataacattccttcgctgaaaagcaaaatcgatccgctcctcatcgcgcgcagggattatgcttacggaacgcaacatgattatcttgatcactccgacatcatcgggtggacaagggaaggggtcactgaaaaaccaggatccggactggccgcactgatcaccgatgggccgggaggaagcaaatggatgtacgttggcaaacaacacgccggaaaagtgttctatgaccttaccggcaaccggagtgacaccgtcaccatcaccagtgatggatggggggaattcaaagtcaatggcggttcggtttcggtttgggttcctagaaaaacgaccgtttctaccatcactcggccgatcacaacccgaccgtggactggtgaattcgtccgttggaccgaaccacggttggtggcatggccttgatgcctgcgatcgcgttgtaaagatattccgctctatcattgagacaaaaaacacggccttgcgcccatgaatggcggcacaaggccgtgtttgatgttaccatccatttgcttgcttcaacttctcctttgacggcgtttcgtagcggatgtgcgtgtcgatgtcggtcacgtaatacccgccgccgaccgcgtactgcccgccgaagcgcgcatcatacccgtagacgcggtacacttccccaggctgtaagatgcggacgaacacaaggcgcccatccttcgtccgtttccatagat

SEQ ID NO: 1734 - protein, 549 aa, Bacillus stearothermophilus
MLTFHRIIRKGWMFLLAFLLTASLFCPTGQPAKAAAPFNGTMMQYFEWYLPDDGTLWTKVANEANNLSSLGITALWLPPAYKGTSRSDVGYGVYDLYDLGEFNQKGTVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKNWGKWYVNTTNIDGFRLDAVKHIKFSFFPDWLSYVRSQTGKPLFTVGEYWSYDINKLHNYITKTNGTMSLFDAPLHNKFYTASKSGGAFDMRTLMTNTLMKDQPTLAVTFVDNHDTEPGQALQSWVDPWFKPLAYAFILTRQEGYPGVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTITSDGWGEFKVNGGSVSVWVPRKTTVSTITRPITTRPWTGEFVRWTEPRLVAWP

SEQ ID NO: 1735 - DNA, 1990 bp, Bacillus stearothermophilus
tgcaggcatgcaagcttgaataaaaattataatagacgtaaacgttcgagggtttgctccctttttactctttttatgcaatcgtttcccttaattttttggaagccaaaccgtcgaatgtaacatttgattaagggggaagggcattgtgctaacgtttcaccgcatcattcgaaaaggatggatgttcctgctcgcgtttttgctcactgcctcgctgttctgcccaacaggacagcacgccaaggctgccgcaccgtttaacggcaccatgatgcagtattttgaatggtacttgccggatgatggcacgttatggaccaaagtggccaatgaagccaacaacttatccagccttggcatcaccgctctttggctgccgcccgcttacaaaggaacaagccgcagcgacgtagggtacggagtatacgacttgtatgacctcggcgaattcaatcaaaaagggaccgtccgcacaaaatatggaacaaaagctcaatatcttcaagccattcaagccgcccacgccgctggaatgcaagtgtacgccgatgtcgtgttcgaccataaaggcggcgctgacggcacggaatgggtggacgccgtcgaagtcaatccgtccgaccgcaaccaagaaatctcgggcacctatcaaatccaagcatggacgaaatttgattttcccgggcggggcaacacctactccagctttaagtggcgctggtaccattttgacggcgttgattgggacgaaagccgaaaattaagccgcatttacaaattccgcggcatcggcaaagcgtgggattgggaagtagacacagaaaacggaaactatgactacttaatgtatgccgaccttgatatggatcatcccgaagtcgtgaccgagctgaaaaactgggggaaatggtatgtcaacacaacgaacattgatgggttccggcttgatgccgtcaagcatattaagttcagtttttttcctgattggttgtcgtatgtgcgttctcagactggcaagccgctatttaccgtcggggaatattggagctatgacatcaacaagttgcacaattacattacgaaaacaaacggaacgatgtctttgtttgatgccccgttacacaacaaattttataccgcttccaaatcagggggcgcatttgatatgcgcacgttaatgaccaatactctcatgaaagatcaaccgacattggccgtcaccttcgttgataatcatgacaccgaacccggccaagcgctgcagtcatgggtcgacccatggttcaaaccgttggcttacgcctttattctaactcggcaggaaggatacccgtgcgtcttttatggtgactattatggcattccacaatataacattccttcgctgaaaagcaaaatcgatccgctcctcatcgcgcgcagggattatgcttacggaacgcaacatgattatcttgatcactccgacatcatcgggtggacaagggaaggggtcactgaaaaaccaggatccgggctggccgcactgatcaccgatgggccgggaggaagcaaatggatgtacgttggcaaacaacacgctggaaaagtgttctatgaccttaccggcaaccggagtgacaccgtcaccatcaacagtgatggatggggggaattcaaagtcaatggcggttcggtttcggtttgggttcctagaaaaacgaccgtttctaccatcgctcggccgatcacaacccgaccgtggactggtgaattcgtccgttggaccgaaccacggttggtggcatggccttgatgcctgcgatcgcgttgtaaagacattccgctctatcattgaggcaaaaaacacggccttgcccgccatgaatggcggcacaaggccgtgtttgatgttatcatccatttgcttgcttcaacttctccccgagttcgacagtcactaggcaaacaaaatgcctctcgccccttgatacaaaagggcaagctt

SEQ ID NO: 1736 - protein, 549 aa, Bacillus stearothermophilus
MLTFHRIIRKGWMFLLAFLLTASLFCPTGQHAKAAAPFNGTMMQYFEWYLPDDGTLWTKVANEANNLSSLGITALWLPPAYKGTSRSDVGYGVYDLYDLGEFNQKGTVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKNWGKWYVNTTNIDGFRLDAVKHIKFSFFPDWLSYVRSQTGKPLFTVGEYWSYDINKLHNYITKTNGTMSLFDAPLHNKFYTASKSGGAFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTIARPITTRPWTGEFVRWTEPRLVAWP

SEQ ID NO: 1737 - DNA, 2100 bp, Bacillus stearothermophilus
ggtttcataatgattaattaggaaaacggttgcacaaattatcactttattatacaatcattttgaattttgacaactcttttttacatcttttacaattggtttagcgattgattgattttttatatagtgatcaattactcttaaaacatacggaatgaatacgtttcctttttgtttggcaaaataacaaacaagctatcatattcatcttgtcactgtgtaaccaaatgcgaactggttgcacttaatcttttttaaaggagctgattccatgttcaaagaagccatttatcatcgtccaaaagacaactttgcttatgcatatgacgagcaaacactacatatacgattgcggacaaaaaaaaatgacgtcgagcatgtccgccttatttacggcgatccatacgaatgggaaaacggccattggcaggtaagctatcaatctatgcaaaaaagcggaacagatgaactgtttgattattggtttatcgccttaactcctccatatcgtcgcctccgttacggtttcgaactgacaagcaacaacgagcaaatcgtttatacagaaaaaggattttacagaacggcaccgatggatgataccgcttattatttttgttttccttttttaaacaaaatcgatgtgttccaagcacctgagtgggtaaaagatacgatttggtatcaaattttcccagagcgctttgccaatggcaatgaagcattgaatcctgctggaacattgccgtggggaagcgctgatcctacgccgaccagctttttcggtggagattttgagggcattattcagaaactggatcatctcgttgatctaggagttaatggaatttatttcacgcctatctttaaagcatcatccaatcataaatatgatacgatcgattattttgaaattgatccgcaatttggagataaacagacatttaaaaggcttgtggagctttgccatcaaaaagcgattcgcgtcatgcttgatgcggtttttaatcatagcggttacgaatttcctccatttcaagacgtgctgaaatatggagaaaattctaagtataaacattggtttcatattcgcgaattcccactgcaaaccgtgccgcgtccaaactatgatacatttgcttttactccgaatatgccaaagctgaatacagaaaaccaagaggtgaaaaactatttattagatgtggcgacttattggattcgtgaatttgatattgatggctggcgcttagatgtcgctaatgaggtcgatcatcaattttggcgcgagtttcgccaagcggtgaaaacgatcaaaccagacgcctatattcttggagaaatttggcatgatgctatgccttggctgcgcggcgaccaattcgacgctgtgatgaattatccttttacaaatgggacccttcgtttctttgctcaacatgagattcgcgcttcacaatttgtcggaatgatgacacatgtgctccattcctatccaacgaatgtaaatgaagtagcatttaatttactcggcagtcacgatacgcctcgtctgctgactctctgcaaagaggatgtgcggaaagcaaagctctcgtttttattccagctctcttttacaggaacaccttgcatctattatggcgatgaaattggaataacaggagatcaagatccaggctgccgcaaatgcatgatatgggatgaacatcagcaaaatcgcgagctttttagacatgtccaaaagcttattgcattgcgcaaggcttataaggcatttggaaatcgcggaaatcttcattttatcgatgcaaatgatgaaacgaatcatttgatctatatgaaaacattcgaagaagaagcgatcattttcctcgtgaacaataacgaacaagaaatagagatcaccttgcctctctctctaaaaggaaagctgctcacgaatttatggacaaatgagcagtttagcgctgaggctgacacattaaagtcgacacttccaccatacggatttttcatctataaaatcgaagattggttataaagcgaggaagactctcctcgtcatatgcggtaaacaatgctgcggtactctgt

SEQ ID NO: 1738 - protein, 590 aa, Bacillus stearothermophilus
MFKEAIYHRPKDNFAYAYDEQTLHIRLRTKKNDVEHVRLIYGDPYEWENGHWQVSYQSMQKSGTDELFDYWFIALTPPYRRLRYGFELTSNNEQIVYTEKGFYRTAPMDDTAYYFCFPFLNKIDVFQAPEWVKDTIWYQIFPERFANGNEALNPAGTLPWGSADPTPTSFFGGDFEGIIQKLDHLVDLGVNGIYFTPIFKASSNHKYDTIDYFEIDPQFGDKQTFKRLVELCHQKAIRVMLDAVFNHSGYEFPPFQDVLKYGENSKYKHWFHIREFPLQTVPRPNYDTFAFTPNMPKLNTENQEVKNYLLDVATYWIREFDIDGWRLDVANEVDHQFWREFRQAVKTIKPDAYILGEIWHDAMPWLRGDQFDAVMNYPFTNGTLRFFAQHEIRASQFVGMMTHVLHSYPTNVNEVAFNLLGSHDTPRLLTLCKEDVRKAKLSFLFQLSFTGTPCIYYGDEIGITGDQDPGCRKCMIWDEHQQNRELFRHVQKLIALRKAYKAFGNRGNLHFIDANDETNHLIYMKTFEEEAIIFLVNNNEQEIEITLPLSLKGKLLTNLWTNEQFSAEADTLKSTLPPYGFFIYKIEDWL

SEQ ID NO: 1739 - DNA, 2066 bp, Bacillus stearothermophilus
ttctattttcgattcgtgtcaaactcaaaattgtttaaattcgatattgaaaacgattacaaataaaaattataatgggacgtaaacgttcgagggttttggcttcctttttagctctttttatgcaatcgatttccttaattttttggaagccaaaccgtcgaatgcaacatttgattaagggggaagggcattgtgctaacgtttcaccgcatcattcgaaaagggtgggtgttcctgctcgcgttttggctcactgcctcgctgttctgcccgacaggacagcccgccaaggctgccgcaccgtttaacggcaccatgatgcagtattttgaatggtacttgccggatgatggcacgttatggaccaaagtggccaatgaagccaacaacttatccagccttggcatcaccgctctttggctgccgcccgcttataaaggaacaagccgcagcgacgtagggtacggagtatacgacttgtatgacctcggcgaattcaatcaaaaagggaccgtccgcacaaaatacggaacaaaagctcaatatcttcaagccattcaagccgcccacgccgctggaatgcaagtgtacgccgatgtcgtgttcgaccataaaggcggcgccgacggcacggaatgggtggacgccgtcgaagtcaatccgtccgaccgcaaccaagaaatctcgggcacctatcaaatccaagcatggacgaaatttgattttaacgggcggggcaacacctactccagctttaagtggcgctggtaccattttgacggcgttgactgggacgaaagccgaaaattaagccgcatttacaaattccgcggcatcggcaaagcgtgggattgggaagtagacacggaaaacggaaactatgactacttaatgtatgccgaccttgatatggatcatcccgaagtcgtgaccgagctgaaaaactgggggaaatggtatgtcaacacaacgaacattgatgggttccggcttgatgctgtcaagcatattaagttcagtttttttcctgattggttgtcgtatgtgcgttctcagactggcaagccgctatttaccgtcggggaatattggagctatgacatcaacaagttgcacaattacattacgaaaacaaacggaacgatgtctttgtttgatgccccgttacacaacaaattttatactgcttccaaatcggggggcgcatttgatatgagcacgttaatgaacaatactctcatgaaagatcaaccgacattggccgtcaccttcgttgataatcatgacaccgaacccggccaagcgctgcagtcatgggtcgacccatggttcaaaccgttggcttacgcctttattctaactcggcaggaaggatacccgtgcgtcttttatggtgactattatggcattccacaatataacattccttcactgaaaagcaaaatcgatccgctcctcatcgcgcgcagggattatgcttatggaacgcaacatgattatcttgatcactccgacatcatcgggtggacaagggaaggcgttaccgaaaaaccaggatccggactggccgcactgatcaccgatgggccgggaggaagcaaatggatgtacgttggcaaacaacacgccggaaaagtgttctatgaccttaccggcaaccggagtgacaccgtcaccatcaacagtgatggatggggggaattcaaagtcaatggcggttcggtttcggtttgggttcctagaaaaacgaccgtctctactatcgcttggccgatcacaacccgaccgtggactggtgaattcgtccgttggaccgaaccacggttggtggcatggccttgatgcctgcgatcgcgttgtaaagacattccgctctatcattgaggcaaaaaacatggccttgtccgccatgaatggcggcacaaggccgtgtttgatgttaccatccatttgcttgcttcaacttttccttcgacggcgtttcgtagcggatgtgcgtgtcgatgtcggtcacgtaatacccgccgccgaccgcgtattgcccgcgaagcgcgcgtcatacc

SEQ ID NO: 1740 - protein, 549 aa, Bacillus stearothermophilus
MLTFHRIIRKGWVFLLAFWLTASLFCPTGQPAKAAAPFNGTMMQYFEWYLPDDGTLWTKVANEANNLSSLGITALWLPPAYKGTSRSDVGYGVYDLYDLGEFNQKGTVRTKYGTKAQYLQAIQAAHAAGMQVYADVVFDHKGGADGTEWVDAVEVNPSDRNQEISGTYQIQAWTKFDFNGRGNTYSSFKWRWYHFDGVDWDESRKLSRIYKFRGIGKAWDWEVDTENGNYDYLMYADLDMDHPEVVTELKNWGKWYVNTTNIDGFRLDAVKHIKFSFFPDWLSYVRSQTGKPLFTVGEYWSYDINKLHNYITKTNGTMSLFDAPLHNKFYTASKSGGAFDMSTLMNNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTIAWPITTRPWTGEFVRWTEPRLVAWP

SEQ ID NO: 1741 - DNA, 3048 bp, Bacillus stearothermophilus
ctgccgttgaccgcaattttgtactcataggtcccggctggcgacgtcccggtgaatgtataaagcccattcccttcatcatgcatcctcgtcgccaatgcccccgggtcccattccgccgtatggcccaactcatcttgcaaattgccgactagcgtgatcgtccgtggctgcgaggccgtggattcggccgttcaccgatgctccccattccctagagcgctagaacttcctgtttcgttcgcgcggcaaccgcctggaaggagtcaatgccagcaacaacaccgatgccaaaaccaatgatagcattctccttgccctcttgatcatcccccgctcccttctcctttgtttggccaacttccttctctcctctcctttttatttctttgtgcaatcgtttgcacaaaatggttggtgcaaacgatttcatcaatctttatcttataccaataaacagaatatttcaactatattcccctctgtttttttattttcgattcactcctaactcaaaatcgtttaaattcgatattgaaaacgatcacaaataaaaattataatagacgtaaccgttcgaggttttgcttcctgtttactctttttatgcaatcatttcccttcattttttggaatccaaaccgtcgaatgtaacatttgattaagggggaagggcattgtgctaacgtttcaccgcatcattcgaaaaggatggatgttcctgctcgcgtttttgctcactgccttgctgttctgcccaaccggacagcccgccaaggctgccgcaccgtttaacggcaccatgatgcagtattttgaatggtacttgccggatgatggcacgttatggaccaaagtggccaatgaagccaacaacttatccagccttggcatcaccgctctttggctgccgcccgcttataaaggaacaagccgcagcgacgtagggtacggagtatacgacttgtatgacctcggtgaattcaatcaaaaaggggccgtccgcacaaaatacggaacaaaagctcaatatcttcaagccattcaagccgcccacgccgctggaatgcaagtgtacgccgatgtcgtgttcgaccataaaggcggcgccgacggcacggaatgggtggacgccgtcgaagtcaatccgtccgaccgcaaccaagaaatctcgggcacctatcaaatccaagcatggacgaaatttgattttcccgggcggggcaacacctactccagctttaagtggcgctggtaccattttgatggcgttgattgggacgaaagccgaaaattgagccgcatttacaaattccgcggcatcggcaaagcgtgggattgggaagtagacacggaaaacggaaactatgactacttaatgtatgccgaccttgatatggatcatcccgaagtcgtgactgagctgaaaagctgggggaaatggtatgtcaacacaacgaacattgatgggttccggcttgatgccgtcaagcatattaagttcagtttttttcctgattggttgtctgatgtgcgttctcagactgggaagccgctatttaccgttggggaatattggagctatgacatcaacaagttgcacaattacattatgaaaacaaacggaacgatgtctttgtttgatgccccgttacacaacaaattttataccgcttccaaatcagggggcacatttgatatgcgcacgttaatgaccaatactctcatgaaagatcaaccaacattggccgtcaccttcgttgataatcatgacaccgaacccggccaagcgctgcagtcatgggtcgacccatggttcaaaccgttggcttacgcctttattctaactcggcaggaaggatacccgtgcgtcttttatggtgactattatggcattccacaatataacattccttcgctgaaaagcaaaatcgatccgctcctcatcgcgcgcagggattatgcttacggaacgcaacatgattatcttgatcactccgacatcatcgggtggacaagggaaggggtcactgaaaaaccaggatccggactggccgcattgatcaccgatgggccgggaggaagcaaatggatgtacgttggcaaacaacacgccggaaaagtgttctatgaccttaccggcaaccggagtgacaccgtcaccatcaacagtgatggatggggggaattcaaagtcaatggcggttcggtttcggtttgggttcctagaaaaacgaccgtctctactatcgcttggtcgatcacaacccgaccgtggactgatgaattcgtccgttggaccgaaccacggttggtggcatggccttgatgcctgcgatcgcgttgtaaagatattccgctctatcattgagacaaaaaacacggccttgcccgccatgaatggcggcacaaggccgtgtttgatgttaccatccatttgcttgcttcaacttctcctttgacggcgtttcatagcggatgtgcgtgtcaatgtctgttacgtaatacccgccgccgaccgcgtactgcccaccgaagcgcgcgatcatacccgtagacgcggtacacttccccaggctgtaagatgcggacgaacacaaggcgcccatccttcgtttccgtttccatagattgattggcttttgcaccgtttgatgattgtaccgtgattttcttcgcgaggaagtgagacgaaatgacgattttcgacctttgaaccatttcatatatgtctcaaacattcctgggttaccattaaatccctagttgaaatgccgtgtacagtatatttgctttttgtcacaactcccgggagccgcaatgtttcatgcacgttctcatgatacaaccgaacgttttcattcatgaccttccactcaaccgatcgttgatggcaaaacccatcgatatcattgtcgagatgtttcacatagcgataggggctaatgatcccaatgctgagccatgctccattgcgaaccaacacgatatccccttgttccatcgtatggacaaacgcccagattgcgccaagagcgaagccaagct

SEQ ID NO: 1742 - protein, 549 aa, Bacillus stearothermophilus
MLTFHRIIRKGWMFLLAFLLTALLFCPTGQPAKAAAPFNGTMMQYFEWYLPDDGTLWTKVANEANNLSSLGITALWLPPAYKGTSRSDVGYGVYDLYDLGEFNQKGAVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKSWGKWYVNTTNIDGFRLDAVKHIKFSFFPDWLSDVRSQTGKPLFTVGEYWSYDINKLHNYIMKTNGTMSLFDAPLHNKFYTASKSGGTFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTIAWSITTRPWTDEFVRWTEPRLVAWP

SEQ ID NO: 1743 - DNA, 1891 bp, Bacillus stearothermophilus
gatcatattttgcatcggtcctggccgtcatccaccctactgcccgatcacccgcacggtgaaagtcaccaatgtgggacgtccgtcgatggcagaagatcacaaataaaaattataatagacgtaaccgttcgaggttttgcttcctgtttactctttttatgcaatcatttcccttcattttttggaatccaaaccgtcgaatgtaacatttgattaagggggaagggcattgtgctaacgtttcaccgcatcattcgaaaaggatggatgttcctgctcgcgtttttgctcactgccttgctgttctgcccaaccggacagcccgccaaggctgccgcaccgtttaacggcaccatgatgcagtattttgaatggtacttgccggatgatggcacgttatggaccaaagtggccaatgaagccaacaacttatccagccttggcatcaccgctctttggctgccgcccgcttataaaggaacaagccgcagcgacgtagggtacggagtatacgacttgtatgacctcggtgaattcaatcaaaaaggggccgtccgcacaaaatacggaacaaaagctcaatatcttcaagccattcaagccgcccacgccgctggaatgcaagtgtacgccgatgtcgtgttcgaccataaaggcggcgccgacggcacggaatgggtggacgccgtcgaagtcaatccgtccgaccgcaaccaagaaatctcgggcatctatcaaatccaagcatggacgaaatttgattttcccgggcggggcaacacctactccagctttaagtggcgctggtaccattttgatggcgttgattgggacgaaagccgaaaattgagccgcatttacaaattccgcggcatcggcaaagcgtgggattgggaagtagacacggaaaacggaaactatgactacttaatgtatgccgaccttgatatggatcatcccgaagtcgtgactgagctaaaagctggggctaaatggtatgtcaacacaagaacacttgatgggttccggcttgatgccgtcaagcatattaagttcagtttttttcctgattggttgtcgtatgtgcgttctcagactggcaagccgctatttaccgttggggaatattggagctatgacatcaacaagttgcacaattacattatgaaaacaaacggaacgatgtctttgtttgatgccccgttacacaacaaattttataccgcttccaaatcagggggcacatttgatatgcgcacgttaatgaccaatactctcatgaaagatcaaccaacattggccgtcaccttcgttgataatcatgacaccgaacccggccaagcgctgcagtcatgggtcgacccatggttcaaaccgttggcttacgcctttattctaactcggcaggaaggatacccgtgcgtcttttatggtgactattatggcattccacaatataacattccttcgctgaaaagcaaaatcgatccgctcctcatcgcgcgcagggattatgcttacggaacgcaacatgattatcttgatcactccgacatcatcgggtggacaagggaaggggtcactgaaaaaccaggatccggactggccgcattgatcaccgatgggccgggaggaagcaaatggatgtacgttggcaaacaacacgccggaaaagtgttctatgaccttaccggcaaccggagtgacaccgtcaccatcaacagtgatggatggggggaattcaaagtcaatggcggttcggtttcggtttgggttcctagaaaaacgaccgtctctactatcgcttggtcgatcacaacccgaccgtggactgatgaattcgtccgttggaccgaaccacggttggtggcatggccttgatgcctgc

SEQ ID NO: 1744 - protein, 549 aa, Bacillus stearothermophilus
MLTFHRIIRKGWMFLLAFLLTALLFCPTGQPAKAAAPFNGTMMQYFEWYLPDDGTLWTKVANEANNLSSLGITALWLPPAYKGTSRSDVGYGVYDLYDLGEFNQKGAVRTKYGTKAQYLQAIQAAHAAGMQVYADVVFDHKGGADGTEWVDAVEVNPSDRNQEISGIYQIQAWTKFDFPGRGNTYSSFKWRWYHFDGVDWDESRKLSRIYKFRGIGKAWDWEVDTENGNYDYLMYADLDMDHPEVVTELKAGAKWYVNTRTLDGFRLDAVKHIKFSFFPDWLSYVRSQTGKPLFTVGEYWSYDINKLHNYIMKTNGTMSLFDAPLHNKFYTASKSGGTFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTIAWSITTRPWTDEFVRWTEPRLVAWP

SEQ ID NO: 1745 - DNA, 1814 bp, Bacillus stearothermophilus
aaattcgatattgaaaacgattacaaataaaaattataatagacgtaaacgttcgagggtttgctccctttttactctttttatgcaatcgtttcccttaattttttggaagccaaaccgtcgaatgtaacatttgattaagggggaagggcattgtgctaacgtttcaccgcatcattcgaaaaggatggatgttcctgctcgcgtttttgctcactgtctcgctgttctgcccaacaggacagcccgccaaggctgccgcaccgtttaacggcaccatgatgcagtattttgaatggtacttgccggatgatggcacgttatggaccaaagtggccaatgaagccaacaacttatccagccttggcatcaccgctctttggctgccgcccgcttacaaaggaacaagccgcagcgacgtagggtacggagtatacgacttgtatgacctcggcgaattcaatcaaaaagggaccgtccgcacaaaatacggaacaaaagctcaatatcttcaagccattcaagccgcccacgccgctggaatgcaagtgtacgccgatgtcgtgttcgaccataaaggcggcgctgacggcacggaatgggtggacgccgtcgaagtcaatccgtccgaccgcaaccaagaaatctcgggcacctatcaaatccaagcatggacgaaatttgattttcccgggcggggcaacacctactccagctttaagtggcgctggtaccattttgacggcgttgattgggacgaaagccgaaaattgagccgcatttacaaattccgcggcatcggcaaagcgtgggattgggaagtagacacggaaaacggaaactatgactacttaatgtatgccgaccttgatatggatcatcccgaagtcgtgaccgagctgaaaaactgggggaaatggtatgtcaacacaacgaacattgatgggttccggcttgatgccgtcaagcatattaagttcagtttttttcctgattggttgtcgtatgtgcgttctcagactggcaagccgctatttaccgtcggggaatattggagctatgacatcaacaagttgcacaattacattacgaaaacagacggaacgatgtctttgtttgatgccccgttacacaacaaattttataccgcttccaaatcagggggcgcatttgatatgcgcacgttaatgaccaatactctcatgaaagatcaaccgacattggccgtcaccttcgttgataatcatgacaccgaacccggccaagcgctgcagtcatgggtcgacccatggttcaaaccgttggcttacgcctttattctaactcggcaggaaggatacccgtgcgtcttttatggtgactattatggcattccacaatataacattccttcgctgaaaagcaaaatcgatccgctcctcatcgcgcgcagggattatgcttacggaacgcaacatgattatcttgatcactccgacatcatcgggtggacaagggaagggggcactgaaaaaccaggatccggactggccgcactgatcaccgatgggccgggaggaagcaaatggatgtacgttggcaaacaacacgctggaaaagtgttctatgaccttaccggcaaccggagtgacaccgtcaccatcaacagtgatggatggggggaattcaaagtcaatggcggttcggtttcggtttgggttcctagaaaaacgaccgtttctaccatcgctcggccgatcacaacccgaccgtggactggtgaattcgtccgttggaccgaaccacggttggtggcatggccttgatgcctgcga

SEQ ID NO: 1746 - DNA, 2169 bp, Bacillus stearothermophilus
gatcatcccccgctcccttctcctttgtttggccaacttccttctctcctttcctttttatattctttgtgcaatcgtttgcacaaaacggttgatgcaaacgatttcatcaatctttatcttatacgaataaacagaatatttcaactatattttccacttgttgaaaaacgaatcgtgtcaaactcaaaattgtttaaattcgatattgaaaacgattacaaataaaaattataatagacgtaaacgttcgagggtttgctccctttttactctttttatccaatcgtttcccttaattttttggaagccaaaccgtcgaatgtaacatttgattaagggggaagggcattgtgctaacgtttcaccgcatcattcgaaaaggatggatgttcctgctcgcgtttttgctcactgcctcgctgttctgcccaacaggacagcacgccaaggctgccgcaccgtttaacggcaccatgatgcagtattttgaatggtacttgccggatgatggcacgttatggaccaaagtggccaatgaagccaacaacttatccagccttggcatcaccgctctttggctgccgcccgcttacaaaggaacaagccgcagcgacgtagggtacggagtatacgacttgtatgacctcggcgaattcaatcaaaaagggaccgtccgcacaaaatatggaacaaaagctcaatatcttcaagccattcaagccgcccacgccgctggaatgcaagtgtacgccgatgtcgtgttcgaccataaaggcggcgctgacggcacggaatgggtggacgccgtcgaagtcaatccgtccgaccgcaaccaagaaatctcgggcacctatcaaatccaagcatggacgaaatttgattttcccgggcggggcaacacctactccagctttaagtggcgctggtaccattttgacggcgttgattgggacgaaagccgaaaattaagccgcatttacaaattccgcggcatcggcaaagcgtgggattgggaagtagacacagaaaacggaaactatgactacttaatgtatgccgaccttgatatggatcatcccgaagtcgtgaccgagctgaaaaactgggggaaatggtatgtcaacacaacgaacattgatgggttccggcttgatgccgtcaagcatattaagttcagtttttttcctgattggttgtcgtatgtgcgttctcagactggcaagccgctatttaccgtcggggaatattggagctatgacatcaacaagttgcacaattacattacgaaaacaaacggaacgatgtctttgtttgatgccccgttacacaacaaattttataccgcttccaaatcagggggcgcatttgatatgcgcacgttaatgaccaatactctcatgaaagatcaaccgacattggccgtcaccttcgttgataatcatgacaccgaacccggccaagcgctgcagtcatggtgcgacccatggttcaaaccgttggcttacgcctttattctaactcggcaggaaggatacccgtgcgtcttttatggtgactattatggcattccacaatataacattccttcgctgaaaagcaaaatcgatccgctcctcatcgcgcgcagggattatgcttacggaacgcaacatgattatcttgatcactccgacatcatcgggtggacaagggaaggggtcactgaaaaaccaggatccgggctggccgcactgatcaccgatgggccgggaggaagcaaatggatgtacgttggcaaacaacacgctggaaaagtgttctatgaccttaccggcaaccggagtgacaccgtcaccatcaacagtgatggatggggggaattcaaagtcaatggcggttcggtttcggtttgggttcctagaaaaacgaccgtttctaccatcgctcggccgatcacaacccgaccgtggactggtgaattcgtccgttggaccgaaccacggttggtggcatggccttgatgcctgcgatcgcgttgtaaagacattccgctctatcattgaggcaaaaaacacggccttgcccgccatgaatggcggcacaaggccgtgtttgatgttatcatccatttgcttgcttcaacttctccccgagttcgacagtcactaggcacaaacaaaatgcttg

SEQ ID NO: 1747 - protein, 549 aa, Bacillus stearothermophilus
MLTFHRIIRKGWMFLLAFLLTASLFCPTGQHAKAAAPFNGTMMQYFEWYLPDDGTLWTKVANEANNLSSLGITALWLPPAYKGTSRSDVGYGVYDLYDLGEFNQKGTVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKNWGKWYVNTTNIDGFRLDAVKHIKFSFFPDWLSYVRSQTGKPLFTVGEYWSYDINKLHNYITKTNGTMSLFDAPLHNKFYTASKSGGAFDMRTLMTNTLMKDQPTLAVTFVDNHDTEPGQALQSWCDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTIARPITTRPWTGEFVRWTEPRLVAWP

SEQ ID NO: 1748 - DNA, 2471 bp, Bacillus licheniformis
tgaggctgtttctcgaccggatcgcttcgcctcgcctgacaaccgtgcaacagcctgttgttgaaatgggagaggcttgcgcgagaatcctgctgaaaaaaatgaatgaagacggaggcgccgcaacagatcaatttttttaaccggaacttattgtccgcgaatcgactttgtagggtgtctcattctgttaccgttaacagctgaaaatgattgttcctgttaccgccgtcatgataatttcagaataaaagccggtttatcacaaccggacaaccaaaagggggaaacatgatcgaattagcagcgatacatcatcagcctttcaactctgatgcctattcttacaatggacggacattgcacatcaagatccgtacaaaaaaggatgatgccgaacacgtcgcttggtttggggcgatccttacgaatacaccggcgcacatggaaagcgaacgagcttacgtggcgaaaattggccgcaacaagcagcccatgattactggtttgccgaagtgcggcctccattcaggctcagcaatacggatttatctgacagccctgatgatcgagacactttttacggaagcaatggtgcatgtccgtttccgatataggcaaacacatgttttaaatttccgtttgttcatgaggcagacacgtttgatgcaccgactgggtcaaatcaaccgtctggtatcaaatttttccggagctttccgagcgggcgggaagatttgctccggaaaacctttgccatggggaaggaaagatcctgaggcgcacgattttttcggagggcatttgcaggggatcatgacaagctggactatttggaagacttggggggaggccggaatctatttgacgccgatctttgccgcgccttccaaccataaatacgacacattggactattgctccatcgatccgcattttggcgatgaggagctctttcgcaccgtggtcagccggattcacgagcggggaatgaaaatcatgcttgatgctgtttttaaccacattggcacgtcgcaagagtggcaggatgttgtcaaaaacggggaaacgtcccgctataaagactggttcatattcattctttccctgttaaagaaggcagctatgatacatttgcgtttagtcccgagatgccgaagctcaatagccggaacccggaagttcaggcttatttgcttgatattgcgctgtactggatccgcgaatttgatatcgacggctggcgtttggatgtggcaaatgaagttgatcatgcgttttggaagaaattccggcaagccgtcaccggaaaagcccgacatttttatattgggcgaaatctggcatcaggctgatccgtggcttagaggagacgaatttcatatcggtcatgaactacccgttcacagaaccgatgattcactatttttcagacggatcgatttcagctcgcaaatagccagccgcatcaattcgcaaaaaatgagcgggatgaagcaggtgaaggaggtgatgttgaatttgctggacagtcacgagcggattttgacaagatgcggaggagatcagagaaaaggtgcgcgtctcttttggcattcatgtttgctcagacagggtcgcatttattacccacggaagtcgggcttcacggcggcgatgatccattgtgccggaagtgcatggtttgggaagaggaaaaacagaatcaagagatgcctcgcatttatgaaacccctgatcgctttgcgaaaacaagagaatgatgtattgacttatggcgcgcttgagtggaagctggttgatgaccaaaacgattttgtcagtttttctcgaacgcatgaaggaaaagagctgatctacttcttccaccagggcagagaggtgcgccgtgtcagattgcgggatttgaagattgcaagcgataaaagaatatacgatgcgtggacggaagaagcgcttcacgatgatgatgtggtcgacattcagccaggcgatttttcatttttggggcggtctaaattctgttaggcctaacaggtttaaaactattgtaagcgtttctgtcgaggattacaattgtctcagattccaagatagaagggggaaaaaagatgcaacatttaaaaaaaggaattttagtgctgctggcgtcagttctgctgttcggtgttcccgcgctgttcaagttcaaaggaaacgggagggcagcggcgggaaaaaagttttttgaccgtgtctgtagaagaggtctataaaccttaccgtcgaaagcataaaggaaggttttgaaaaagagaacgagggacagtcaaaatccattgaaaagccgatgttcgaccacgttgaagaccttccgttgacggtaccggcagcaatgcgacccgatgtccatgcttgcgcatacgaccgtatcgcggcttaggacagcaaggtcatttgcagatagtcaaaccgtctgacacaaaaagctt

SEQ ID NO: 1749 - protein, 578 aa, Bacillus licheniformis
MIELAAIHHQPFNSDAYSYNGRTLHIKIRTKKDDAEHVAWFGAILTNTPAHMESERAYVAKIGRNKQPMITGLPKCGLHSGSAIRIYLTALMIETLFTEAMVHVRFRYRQTHVLNFRLFMRQTRLMHRLGQINRLVSNFSGAFRAGGKICSGKPLPWGRKDPEAHDFFGGHLQGIMTSWTIWKTWGEAGIYLTPIFAAPSNHKYDTLDYCSIDPHFGDEELFRTVVSRIHERGMKIMLDAVFNHIGTSQEWQDVVKNGETSRYKDWFIFILSLLKKAAMIHLRLVPRCRSSIAGTRKFRLICLILRCTGSANLISTAGVWMWQMKLIMRFGRNSGKPSPEKPDIFILGEIWHQADPWLRGDEFHIGHELPVHRTDDSLFFRRIDFSSQIASRINSQKMSGMKQVKEVMLNLLDSHERILTRCGGDQRKGARLFWHSCLLRQGRIYYPRKSGFTAAMIHCAGSAWFGKRKNRIKRCLAFMKPLIALRKQENDVLTYGALEWKLVDDQNDFVSFSRTHEGKELIYFFHQGREVRRVRLRDLKIASDKRIYDAWTEEALHDDDVVDIQPGDFSFLGRSKFC

SEQ ID NO: 1750 - DNA, 1920 bp, Bacillus licheniformis
cggaagattggaagtacaaaaataagcaaaagattgtcaatcatgtcatgagccatgcgggagacggaaaaatcgtcttaatgcacgatatttatgcaacgttcgcagatgctgctgaagagattattaaaaagctgaaagcaaaaggctatcaattggtaactgtatctcagcttgaagaagtgaagaagcagagaggctattgaataaatgagtagaagcgccatatcggcgcttttcttttggaagaaaatatagggaaaatggtacttgttaaaaattcggaatatttatacaacatcatatgtttcacattgaaaggggaggagaatcatgaaacaacaaaaacggctttacgcccgattgctgacgctgttatttgcgctcatcttcttgctgcctcattctgcagcagcggcggcaaatcttaatgggacgctgatgcagtattttgaatggtacatgcccaatgacggccaacattggaggcgtttgcaaaacgactcggcatatttggctgaacacggtattactgccgtctggattcccccggcatataagggaacgagccaagcggatgtgggctacggtgcttacgacctttatgatttaggggagtttcatcaaaaagggacggttcggacaaagtacggcacaaaaggagagctgcaatctgcgatcaaaagtcttcattcccgcgacattaacgtttacggggatgtggtcatcaaccacaaaggcggcgctgatgcgaccgaagatgtaaccgcggttgaagtcgatcccgctgaccgcaaccgcgtaatttcaggagaacacctaattaaagcctggacacattttcattttccggggcgcggcagcacatacagcgattttaaatggcattggtaccattttgacggaaccgattgggacgagtcccgaaagctgaaccgcatctataagtttcaaggaaaggcttgggattgggaagtttccaatgaaaacggcaactatgattatttgatgtatgccgacatcgattatgaccatcctgatgtcgcagcagaaattaagagatggggcacttggtatgccaatgaactgcaattggacggtttccgtcttgatgctgtcaaacacattaaattttcttttttgcgggattgggttaatcatgtcagggaaaaaacggggaaggaaatgtttacggtagctgaatattggcagaatgacttgggcgcgctggaaaactatttgaacaaaacaaattttaatcattcagtgtttgacgtgccgcttcattatcagttccatgctgcatcgacacagggaggcggctatgatatgaggaaattgctgaacggtacggtcgtttccaagcatccgttgaaatcggttacatttgtcgataaccatgatacacagccggggcaatcgcttgagtcgactgtccaaacatggtttaagccgcttgcttacgcttttattctcacaagggaatctggataccctcaggttttctacggggatatgtacgggacgaaaggagactcccagcgcgaaattcctgccttgaaacacaaaattgaaccgatcttaaaagcgagaaaacagtatgcgtacggagcacagcatgattatttcgaccaccatgacattgtcggctggacaagggaaggcgacagctcggttgcaaattcaggtttggcggcattaataacagacggacccggtggggcaaagcgaatgtatgtcggccggcaaaacgccggtgagacatggcatgacattaccggaaaccgttcggagccggttgtcatcaattcggaaggctggggagagtttcacgtaaacggcgggtcggtttcaatttatgttcaaagatagaagagcagagaggacggatttcctgaaggaaatccgtttttttatttt

SEQ ID NO: 1751 - DNA, 1563 bp, Bacillus licheniformis
cgcggattcgcgatgaaacaacaaaaacggctttacgcccgattgctgccgctgttatttgcgctcatcttcttgctgcctcattctgcagcagcggcggcaaatcttaaagggacgctgatgcagtattttgaatggtacatgcccaatgacggccaacattggaagcgcttgcaaaacgactcggcatatttggctgaacacggtattactgccgtctggattcccccggcatataagggaacgagccaagcggatgtgggctacggtgcttacgacctttatgatttaggggagtttcatcaaaaagggacggttcggacaaagtacggcacaaaaggagagctgcaatctgcgatcaaaagtcttcattcccgcgacattaacgtttacggggatgtggtcatcaccaacaaaggcggcgctgatgcgaccgaagatgtaaccgcggttgaagtcgatcccgctgaccgcaaccgcgtaatttcaggagaacaccgaattaaagcctggacacattttcattttccggggcgcggcagcacatacagcgattttaaatggcattggtaccattttgacggaaccgattgggacgagtcccgaaagctgaaccgcatctataagtttcaaggaaaggcttgggattgggaagtttccaatgaaaacggcaactatgattatttgatgtatgccgacatcgattatgaccatcctgatgtcgcagcagaaattaagagatggggcacttggtatgccaatgaactgcaattggacggtttccgtcttgatgctgtcaaacacattaaattttcttttttgcgggattgggttaatcatgtcagggaaaaaacggggaaggaaatgtttacggtagctgaatattggcagaatgacttgggcgcgctggaaaactatttgaacaaaacaaattttaatcattcagtgtttgacgtgccgcttcattatcagttccatgctgcatcgacacagggaggcggctatgatatggggaaattgctgaacggtacggtcgtttccaagcatccgttgaaagcggttacatttgtcgataaccatgatacacagccggggcaatcgcttgagtcgactgtccaaacatggtttaagccgcttgcttacgcttttattctcacaagggaatctggatatccctcaggtttctacggggatatgtacgggacaaaaggagcctcccagcgcgaaattcctgccttgaaacacaaaattgaaccgatcttaaaagcgagaaaacagtatgcgtacggagcacagcatgattatttcgaccaccatgacattgtcggctggacaagggaaggcgacagctcggttgcaaattcaggtttggcggcattaataacagacggacccggtggggcaaagcgaatgtatgtcggccggcaaaacgccggtgagacatggcatgacattaccggaaaccgttcggagccggttgtcatcaattcggaaggctggggagagtttcacgtaaacggcgggtcggtttcaatttatgttcaaagatagccggaattccgg

SEQ ID NO: 1752 - protein, 512 aa, Bacillus licheniformis
MKQQKRLYARLLPLLFALIFLLPHSAAAAANLKGTLMQYFEWYMPNDGQHWKRLQNDSAYLAEHGITAVWIPPAYKGTSQADVGYGAYDLYDLGEFHQKGTVRTKYGTKGELQSAIKSLHSRDINVYGDVVITNKGGADATEDVTAVEVDPADRNRVISGEHRIKAWTHFHFPGRGSTYSDFKWHWYHFDGTDWDESRKLNRIYKFQGKAWDWEVSNENGNYDYLMYADIDYDHPDVAAEIKRWGTWYANELQLDGFRLDAVKHIKFSFLRDWVNHVREKTGKEMFTVAEYWQNDLGALENYLNKTNFNHSVFDVPLHYQFHAASTQGGGYDMGKLLNGTVVSKHPLKAVTFVDNHDTQPGQSLESTVQTWFKPLAYAFILTRESGYPSGFYGDMYGTKGASQREIPALKHKIEPILKARKQYAYGAQHDYFDHHDIVGWTREGDSSVANSGLAALITDGPGGAKRMYVGRQNAGETWHDITGNRSEPVVINSEGWGEFHVNGGSVSIYVQR

SEQ ID NO: 1753 - DNA, 1452 bp, Bacillus licheniformis
gcaaatcttaatgggacgctgatgcagtattttgaatggtacatgcccaatgacggccaacattggaagcgcttgcaaaacgactcggcatatttggctgaacacggtattactgccgtctggattcccccggcatataagggaacgagccaagcggatgtgggctacggtgcttacgacctttatgatttaggggagtttcatcaaaaagggacggttcggacaaagtacggcacaaaaggagagctgcaatctgcgatcaaaagtcttcattcccgcgacattaacgtttacggggatgtggtcatcaaccacaaaggcggcgctgatgcgaccgaagatgtaaccgcggttgaagtcgatcccgctgaccgcaaccgcgtaatttcaggagaacaccgaattaaagcctggacacattttcattttccggggcgcggcagcacatacagcgattttaaatggcattggtaccattttgacggaaccgattgggacgagtcccgaaagctgaaccgcatctataagtttcaaggaaaggcttgggattgggaagtttccaatgaaaacggcaactatgattatttgatgtatgccgacatcgattatgaccatcctgatgtcgcagcagaaattaagagatggggcacttggtatgccaatgaactgcaattggacggtttccgtcttgatgctgtcaaacacattaaattttcttttttgcgggattgggttaatcatgtcagggaaaaaacggggaaggaaatgtttacggtagctgaatattggcagaatgacttgggcgcgctggaaaactatttgaacaaaacaaattttaatcattcagtgtttgacgtgccgcttcattatcagttccatgctgcatcgacacagggaggcggctatgatatgaggaaattgctgaacagtacggtcgtttccaagcatccgttgaaagcggttacatttgtcgataaccatgatacacagccggggcaatcgcttgagtcgactgtccaaacatggtttaagccgcttgcttacgcttttattctcacaagggaatctggataccctcaggttttctacggggatatgtacgggacgaaaggagactcccagcgcgaaattcctgccttgaaacacaaaattgaaccgatcttaaaagcgagaaaacagtatgcgtacggagcacagcatgattatttcgaccaccatgacattgtcggctggacaagggaaggcgacagctcggttgcaaattcaggtttggcggcattaataacagacggacccggtggggcaaagcgaatgtatgtcggccggcaaaacgccggtgagacatggcatgacattaccggaaaccgttcggagccggttgtcatcaattcggaaggctggggagagtttcacgtaaacggcgggtcggtttcaatttatgttcaaagatag

SEQ ID NO: 1754 - DNA, 1539 bp, Bacillus licheniformis
atgaaacaacaaaaacggctttacgcccgattgctgacgctgttatttgcgctcatcttcttgctgcctcattctgcagcagcggcggcaaatcttaatgggacgctgatgcagtattttgaatggtacatgcccaatgacggccaacattggaagcgcttgcaaaacgactcggcatatttggctgaacacggtattactgccgtctggattcccccggcatataagggaacgagccaagcggatgtgggctacggtgcttacgacctttatgatttaggggagtttcatcaaaaagggacggttcggacaaagtacggcacaaaaggagagctgcaatctgcgatcaaaagtcttcattcccgcgacattaacgtttacggggatgtggtcatcaaccacaaaggcggcgctgatgcgaccgaagatgtaaccgcggttgaagtcgatcccgctgaccgcaaccgcgtaatttcaggagaacaccgaattaaagcctggacacattttcattttccggggcgcggcagcacatacagcgattttaaatggcattggtaccattttgacggaaccgattgggacgagtcccgaaagctgaaccgcatctataagtttcaaggaaaggcttgggattgggaagtttccaatgaaaacggcaactatgattatttgatgtatgccgacatcgattatgaccatcctgatgtcgcagcagaaattaagagatggggcacttggtatgccaatgaactgcaattggacggtttccgtcttgatgctgtcaaacacattaaattttcttttttgcgggattgggttaatcatgtcagggaaaaaacggggaaggaaatgtttacggtagctgaatattggcagaatgacttgggcgcgctggaaaactatttgaacaaaacaaattttaatcattcagtgtttgacgtgccgcttcattatcagttccatgctgcatcgacacagggaggcggctatgatatgaggaaattgctgaacggtacggtcgtttccaagcatccgttgaaagcggttacatttgtcgataaccatgatacacagccggggcaatcgcttgagtcgactgtccaaacatggtttaagccgcttgcttacgctttcattctcacaagggaatctggataccctcaggttttctacggggatatgtacgggacgaaaggagactcccagcgcgaaattcctgccttgaaacacaaaattgaaccgatcttaaaagcgagaaaacagtatgcgtacggagcacagcatgattatttcgaccaccatgacattgtcggctggacaagggaaggcgacagctcggttgcaaattcaggtttggcggcattaataacagacggacccggtggggcaaagcgaatgtatgtcggccggcaaaacgccggtgagacatggcatgacattaccggaaaccgttcggagccggttgtcatcaattcggaaggctggggagagtttcacgtaaacggcgggtcggtttcaatttatgttcaaagatag

SEQ ID NO: 1755 - DNA, 1920 bp, Bacillus licheniformis; identical to SEQ ID NO: 1750

SEQ ID NO: 1756 - DNA, 1862 bp, Bacillus licheniformis
agtgaagaagcagagaggctattgaataaatgagtagaaagcgccatatcggcgcttttcttttggaagaaaatatagggaaaatggtacttgttaaaaattcggaatatttatacaatatcatatgtttcacattgaaaggggaggagaatcatgaaacaacaaaaacggctttacgcccgattgctgacgctgttatttgcgctcatcttcttgctgcctcattctgcagcagcggcggcaaatcttaatgggacgctgatgcagtattttgaatggtacatgcccaatgacggccaacattggaagcgtttgcaaaacgactcggcatatttggctgaacacggtattactgccgtctggattcccccggcatataagggaacgagccaagcggatgtgggctacggtgcttacgacctttatgatttaggggagtttcatcaaaaagggacggttcggacaaagtacggcacaaaaggagagctgcaatctgcgatcaaaagtcttcattcccgcgacattaacgtttacggggatgtggtcatcaaccacaaaggcggcgctgatgcgaccgaagatgtaaccgcggttgaagtcgatcccgctgaccgcaaccgcgtaatttcaggagaacacctaattaaagcctggacacattttcattttccggggcgcggcagcacatacagcgattttaaatggcattggtaccattttgacggaaccgattgggacgagtcccgaaagctgaaccgcatctataagtttcaaggaaaggcttgggattgggaagtttccaatgaaaacggcaactatgattatttgatgtatgccgacatcgattatgaccatcctgatgtcgcagcagaaattaagagatggggcacttggtatgccaatgaactgcaattggacggtttccgtcttgatgctgtcaaacacattaaattttcttttttgcgggattgggttaatcatgtcagggaaaaaacggggaaggaaatgtttacggtagctgaatattggcagaatgacttgggcgcgctggaaaactatttgaacaaaacaaattttaatcattcagtgtttgacgtgccgcttcattatcagttccatgctgcatcgacacagggaggcggctatgatatgaggaaattgctgaacggtacggtcgtttccaagcatccgttgaaatcggttacatttgtcgataaccatgatacacagccggggcaatcgcttgagtcgactgtccaaacatggtttaagccgcttgcttacgcttttattctcacaagggaatctggataccctcaggttttctacggggatatgtacgggacgaaaggagactcccagcgcgaaattcctgccttgaaacacaaaattgaaccgatcttaaaagcgagaaaacagtatgcgtacggagcacagcatgattatttcgaccaccatgacattgtcggctggacaagggaaggcgacagctcggttgcaaattcaggtttggcggcattaataacagacggacccggtggggcaaagcgaatgtatgtcggccggcaaaacgccggtgagacatggcatgacattaccggaaaccgttcggagccggttgtcatcaattcggaaggctggggagagtttcacgtaaacggcgggtcggtttcaatttatgttcaaagatagaagagcagagaggacggatttcctgaaggaaatccgtttttttattttgcccgtcttataaatttctttgattacattttataattaattttaacaaactgtcatcagccctcaggaaggacttcctgacagtagaatcgcataggtaaggcggggatgaaatggcaacg

SEQ ID NO: 1757 - protein, 512 aa, Bacillus licheniformis
MKQQKRLYARLLTLLFALIFLLPHSAAAAANLNGTLMQYFEWYMPNDGQHWKRLQNDSAYLAEHGITAVWIPPAYKGTSQADVGYGAYDLYDLGEFHQKGTVRTKYGTKGELQSAIKSLHSRDINVYGDVVINHKGGADATEDVTAVEVDPADRNRVISGEHLIKAWTHFHFPGRGSTYSDFKWHWYHFDGTDWDESRKLNRIYKFQGKAWDWEVSNENGNYDYLMYADIDYDHPDVAAEIKRWGTWYANELQLDGFRLDAVKHIKFSFLRDWVNHVREKTGKEMFTVAEYWQNDLGALENYLNKTNFNHSVFDVPLHYQFHAASTQGGGYDMRKLLNGTVVSKHPLKSVTFVDNHDTQPGQSLESTVQTWFKPLAYAFILTRESGYPQVFYGDMYGTKGDSQREIPALKHKIEPILKARKQYAYGAQHDYFDHHDIVGWTREGDSSVANSGLAALITDGPGGAKRMYVGRQNAGETWHDITGNRSEPVVINSEGWGEFHVNGGSVSIYVQR

SEQ ID NO: 1758 - DNA, 1539 bp, Bacillus licheniformis
atgaaacaacaaaaacggctttatgcccgattgctgccgctgttatttgcgctcatcttcttgctgcctcactctgcagctgcggcggcaaatcttaatgggacgctgatgcaatattttgagtggtacatgccaaatgacggccaacattggaaacgcttacaaaatgactcggcatatttggctgaacacggtattactgccgtctggattcccccggcatataagggaacgagtcaagacgatgtaggctacggcgcttacgatctgtatgatttaggggagtttcatcaaaaagggacggttcggacaaagtacggcacaaagggagaactgcaatctgcgatcaacagtcttcattcccgggacatcaacgtttacggcgatgtagtcatcaaccacaaaggcggcgctgatgcgaccgaagatgtaacggctgttgaagtcgatcccgccgaccgcaaccgcgtaacatcaggagaacagcgaatcaaagcgtggacacattttcaattcccggggcgcggcagcacatacagcgatttcaaatggcattggtaccattttgacggaaccgattgggacgagtcccgaaagctgaaccgcatctataagtttcaaggaaaggcatgggattgggaagtttccaatgtaaacggcaactatgattacttgatgtatgccgacatcgattatgatcatcctgatgccacggcagaaataaagagatggggaacgtggtatgccaatgagctgcaattggacggattccgccttgatgcggtcaaacacattaaattttcttttttgcgggattgggtcaatcatgtcagggaaaaaacaggaaaggaaatgtttacggtagccgaatattggcagaatgacttaggtgcgctggaaaactatttgaacaaaacaaactttaatcattcagtgtttgacgtgccgcttcattaccagttccatgctgcatcgacacagggaggcggctatgatatgaggaaattgctgaacggaacagtcgtttccaagcatcctgtgaaagcggttacgtttgttgataaccatgatacacagccggggcaatcgcttgagtcgactgtccaaacatggtttaagccgctggcttacgcttttattttgacaagagaagcaggctacccgcagattttctacggggatatgtacgggacgaaaggagcctcgcagcgcgaaattcctgccctgaaacacaaaatcgaaccgatcttaaaagcgagaatacaatatgcgtacggagcacagcatgattatttcgatcatcatgacattgtcggctggacgagggaaggcgacagctcggttgcaaattctggtttggcggcgttaataacagacggacccggcgggacaaagcgaatgtatgtcggccggcaaaacgccggtgagacatggcatgacatcaccggaaaccgttccgattctgttgtcatcaatgcagaaggctggggagagtttcacgtaaacggcggatcggtttcgatctatgttcaaagatag

SEQ ID NO: 1759 - protein, 512 aa, Bacillus licheniformis
MKQQKRLYARLLPLLFALIFLLPHSAAAAANLNGTLMQYFEWYMPNDGQHWKRLQNDSAYLAEHGITAVWIPPAYKGTSQDDVGYGAYDLYDLGEFHQKGTVRTKYGTKGELQSAINSLHSRDINVYGDVVINHKGGADATEDVTAVEVDPADRNRVTSGEQRIKAWTHFQFPGRGSTYSDFKWHWYHFDGTDWDESRKLNRIYKFQGKAWDWEVSNVNGNYDYLMYADIDYDHPDATAEIKRWGTWYANELQLDGFRLDAVKHIKFSFLRDWVNHVREKTGKEMFTVAEYWQNDLGALENYLNKTNFNHSVFDVPLHYQFHAASTQGGGYDMRKLLNGTVVSKHPVKAVTFVDNHDTQPGQSLESTVQTWFKPLAYAFILTREAGYPQIFYGDMYGTKGASQREIPALKHKIEPILKARIQYAYGAQHDYFDHHDIVGWTREGDSSVANSGLAALITDGPGGTKRMYVGRQNAGETWHDITGNRSDSVVINAEGWGEFHVNGGSVSIYVQR

SEQ ID NO: 1760 - DNA, 1449 bp, Bacillus licheniformis
gcaaatcttaatgggacgctgatgcagtattttgaatggtacatgcccaatgacggccaacattggaagcgtttgcaaaacgactcggcatatttggctgaacacggtattactgccgtctggattcccccggcatataagggaacgagccaagcggatgtgggctacggtgcttacgacctttatgatttaggggagtttcatcaaaaagggacggttcggacaaagtacggcacaaaaggagagctgcaatctgcgatcaaaagtcttcattcccgcgacattaacgtttacggggatgtggtcatcaaccacaaaggcggcgctgatgcgaccgaagatgtaaccgcggttgaagtcgatcccgctgaccgcaaccgcgtaatttcaggagaacacctaattaaagcctggacacattttcattttccggggcgcggcagcacatacagcgattttaaatggcattggtaccattttgacggaaccgattgggacgagtcccgaaagctgaaccgcatctataagtttcaaggaaaggcttgggattgggaagtttccaatgaaaacggcaactatgattatttgatgtatgccgacatcgattatgaccatcctgatgtcgcagcagaaattaagagatggggcacttggtatgccaatgaactgcaattggacggtttccgtcttgatgctgtcaaacacattaaattttcttttttgcgggattgggttaatcatgtcagggaaaaaacggggaaggaaatgtttacggtagctgaatattggcagaatgacttgggcgcgctggaaaactatttgaacaaaacaaattttaatcattcagtgtttgacgtgccgcttcattatcagttccatgctgcatcgacacagggaggcggctatgatatgaggaaattgctgaacggtacggtcgtttccaagcatccgttgaaatcggttacatttgtcgataaccatgatacacagccggggcaatcgcttgagtcgactgtccaaacatggtttaagccgcttgcttacgcttttattctcacaagggaatctggataccctcaggttttctacggggatatgtacgggacgaaaggagactcccagcgcgaaattcctgccttgaaacacaaaattgaaccgatcttaaaagcgagaaaacagtatgcgtacggagcacagcatgattatttcgaccaccatgacattgtcggctggacaagggaaggcgacagctcggttgcaaattcaggtttggcggcattaataacagacggacccggtggggcaaagcgaatgtatgtcggccggcaaaacgccggtgagacatggcatgacattaccggaaaccgttcggagccggttgtcatcaattcggaaggctggggagagtttcacgtaaacggcgggtcggtttcaatttatgttcaaaga

SEQ ID NO: 1761 - DNA, 1777 bp, Bacillus licheniformis
tctagagtcatgaaacaacaaaaacggctttacgcccgattgctgacgctgttatttgcgctcatcttcttgctgcctcattctgcagcagcggcggcaaatcttaatgggacgctgatgcagtattttgaatggtacatgcccaatgacggccaacattggaagcgtttgcaaaacgactcggcatatttggctgaacacggtattactgccgtctggattcccccggcatataagggaacgagccaagcggatgtgggctacggtgcttacgacctttatgatttaggggagtttcatcaaaaagggacggttcggacaaagtacggcacaaaaggagagctgcaatctgcgatcaaaagtcttcattcccgcgacattaacgtttacggggatgtggtcatcaaccacaaaggcggcgctgatgcgaccgaagatgtaaccgcggttgaagtcgatcccgctgaccgcaaccgcgtaatttcaggagaacacctaattaaagcctggacacattttcattttccggggcgcggcagcacatacagcgattttaaatggcattggtaccattttgacggaaccgattgggacgagtcccgaaagctgaaccgcatctataagtttcaaggaaaggcttgggattgggaagtttccaatgaaaacggcaactatgattatttgatgtatgccgacatcgattatgaccatcctgatgtcgcagcagaaattaagagatggggcacttggtatgccaatgaactgcaattggacggtttccgtcttgatgctgtcaaacacattaaattttcttttttgcgggattgggttaatcatgtcagggaaaaaacggggaaggaaatgtttacggtagctgaatattggcagaatgacttgggcgcgctggaaaactatttgaacaaaacaaattttaatcattcagtgtttgacgtgccgcttcattatcagttccatgctgcatcgacacagggaggcggctatgatatgaggaaattgctgaacggtacggtcgtttccaagcatccgttgaaatcggttacatttgtcgataaccatgatacacagccggggcaatcgcttgagtcgactgtccaaacatggtttaagccgcttgcttacgcttttattctcacaagggaatctggataccctcaggttttctacggggatatgtacgggacgaaaggagactcccagcgcgaaattcctgccttgaaacacaaaattgaaccgatcttaaaagcgagaaaacagtatgcgtacggagcacagcatgattatttcgaccaccatgacattgtcggctggacaagggaaggcgacagctcggttgcaaattcaggtttggcggcattaataacagacggacccggtggggcaaagcgaatgtatgtcggccggcaaaacgccggtgagacatggcatgacattaccggaaaccgttcggagccggttgtcatcaattcggaaggctggggagagtttcacgtaaacggcgggtcggtttcaatttatgttcaaagatagaagagcagagaggacggatttcctgaaggaaatccgtttttttattttgcccgtcttataaatttctttgattacattttataattaattttaacaaagtgtcatcagccctcaggaaggacttgctgacagtttgaatcgcataggtaaggcggggatgaaatggcaacgttatctgatgtagcaaagaaagcaaatgtgtcgaaaatgacggtatcgcgggtgatca

SEQ ID NO: 1762 - protein, 512 aa, Bacillus licheniformis; identical to SEQ ID NO: 1757

SEQ ID NO: 1763 - DNA, 1968 bp, Bacillus licheniformis
agcttgaagaagtgaagaagcagagaggctattgaataaatgagtagaaagcgccatatcggcgcttttcttttggaagaaaatatagggaaaatggtacttgttaaaaattcggaatatttatacaacatcatatgtttcacattgaaaggggaggagaatcatgaaacaacaaaaacggctttacgcccgattgctgacgctgttatttgcgctcatcttcttgctgcctcattctgcagcagcggcggcaaatcttaatgggacgctgatgcagtattttgaatggtacatgcccaatgacggccaacattggaagcgtttgcaaaacgactcggcatatttggctgaacacggtattactgccgtctggattcccccggcatataagggaacgagccaagcggatgtgggctacggtgcttacgacctttatgatttaggggagtttcatcaaaaagggacggttcggacaaagtacggcacaaaaggagagctgcaatctgcgatcaaaagtcttcattcccgcgacattaacgtttacggggatgtggtcatcaaccacaaaggcggcgctgatgcgaccgaagatgtaaccgcggttgaagtcgatcccgctgaccgcaaccgcgtaatttcaggagaacacctaattaaagcctggacacattttcattttccggggcgcggcagcacatacagcgattttaaatggcattggtaccattttgacggaaccgattgggacgagtcccgaaagctgaaccgcatctataagtttcaaggaaaggcttgggattgggaagtttccaatgaaaacggcaactatgattatttgatgtatgccgacatcgattatgaccatcctgatgtcgcagcagaaattaagagatggggcacttggtatgccaatgaactgcaattggacggtttccgtcttgatgctgtcaaacacattaaattttcttttttgcgggattgggttaatcatgtcagggaaaaaacggggaaggaaatgtttacggtagctgaatattggcagaatgacttgggcgcgctggaaaactatttgaacaaaacaaattttaatcattcagtgtttgacgtgccgcttcattatcagttccatgctgcatcgacacagggaggcggctatgatatgaggaaattgctgaacggtacggtcgtttccaagcatccgttgaaatcggttacatttgtcgataaccatgatacacagccggggcaatcgcttgagtcgactgtccaaacatggtttaagccgcttgcttacgcttttattctcacaagggaatctggataccctcaggttttctacggggatatgtacgggacgaaaggagactcccagcgcgaaattcctgccttgaaacacaaaattgaaccgatcttaaaagcgagaaaacagtatgcgtacggagcacagcatgattatttcgaccaccatgacattgtcggctggacaagggaaggcgacagctcggttgcaaattcaggtttggcggcattaataacagacggacccggtggggcaaagcgaatgtatgtcggccggcaaaacgccggtgagacatggcatgacattaccggaaaccgttcggagccggttgtcatcaattcggaaggctggggagagtttcacgtaaacggcgggtcggtttcaatttatgttcaaagatagaagagcagagaggacggatttcctgaaggaaatccgtttttttattttgcccgtcttataaatttctttgattacattttataattaattttaacaaagtgtcatcagccctcaggaaggacttgctgacagtttgaatcgcataggtaaggcggggatgaaatggcaacgttatctgatgtagcaaagaaagcaaatgtgtcgaaaatgacggtatcgcgggtgatcaatcatcctgagactgtgacggatgaattgaaaaagct

SEQ ID NO: 1764 - protein, 512 aa, Bacillus licheniformis; identical to SEQ ID NO: 1757

SEQ ID NO: 1765 - DNA, 1948 bp, Bacillus licheniformis
attggtaactgtatctcagcttgaagaagtgaagaagcagagaggctattgaataaatgagtagaaagcgccatatcggcgcttttcttttggaagaaaatatagggaaaatggtatttgttaaaaattcggaatatttatacaatatcatatgtttcacattgaaaggggaggagaatcatgaaacaacaaaaacggctttacgcccgattgctgacgctgttatttgcgctcatcttcttgctgcctcattctgcagcagcggcggcaaatcttaatgggacgctgatgcagtattttgaatggtacatgcccaatgacggccaacattggaagcgcttgcaaaacgactcggcatatttggctgaacacggtattactgccgtctggattcccccggcatataagggaacgagccaagcggatgtgggctacggtgcttacgacctttatgatttaggggagtttcatcaaaaagggacggttcggacaaagtacggcacaaaaggagagctgcaatctgcgatcaaaagtcttcattcccgcgacattaacgtttacggggatgtggtcatcaaccacaaaggcggcgctgatgcgaccgaagatgtaaccgcggttgaagtcgatcccgctgaccgcaaccgcgtaatttcaggagaacaccgaattaaagcctggacacattttcattttccggggcgcggcagcacatacagcgattttaaatggcattggtaccattttgacggaaccgattgggacgagtcccgaaagctgaaccgcatctataagtttcaaggaaaggcttgggattgggaagtttccaatgaaaacggcaactatgattatttgatgtatgccgacatcgattatgaccatcctgatgtcgcagcagaaattaagagatggggcacttggtatgccaatgaactgcaattggacggtttccgtcttgatgctgtcaaacacattaaattttcttttttgcgggattgggttaatcatgtcagggaaaaaacggggaaggaaatgtttacggtagctgaatattggcagaatgacttgggcgcgctggaaaactatttgaacaaaacaaattttaatcattcagtgtttgacgtgccgcttcattatcagttccatgctgcatcgacacagggaggcggctatgatatgaggaaattgctgaacagtacggtcgtttccaagcatccgttgaaagcggttacatttgtcgataaccatgatacacagccggggcaatcgcttgagtcgactgtccaaacatggtttaagccgcttgcttacgcttttattctcacaagggaatctggataccctcaggttttctacggggatatgtacgggacgaaaggagactcccagcgcgaaattcctgccttgaaacacaaaattgaaccgatcttaaaagcgagaaaacagtatgcgtacggagcacagcatgattatttcgaccaccatgacattgtcggctggacaagggaaggcgacagctcggttgcaaattcaggtttggcggcattaataacagacggacccggtggggcaaagcgaatgtatgtcggccggcaaaacgccggtgagacatggcatgacattaccggaaaccgttcggagccggttgtcatcaattcggaaggctggggagagtttcacgtaaacggcgggtcggtttcaatttatgttcaaagatagaagagcagagaggacggatttcctgaaggaaatccgtttttttattttgcccgtcttataaatttctttgattacattttataattaattttaacaaagtgtcatcagccctcaggaaggacttgctgacagtttgaatcgcataggtaaggcggggatgaaatggcaacgttatctgatgtagcaaagaaagcaaatgtgtcgaaaatgacggtatcgcgggtgatca

SEQ ID NO: 1766 - protein, 508 aa, Bacillus licheniformis
MKQQKRLYARLLTLLFALIFLLPHSAAAAANLNGTLMQYFEWYMPNDGQHWKRLQNDSAYLAEHGITAVWIPPAYKGTSQADVGYGAYDLYDLGEFHQKGTVRTKYGTKGELQSAIKSLHSRDINVYGDVVINHKGGADATEDVTAVEVDPADRNRVISGEHRIKAWTHFHFPGRGSTYSDFKWHWYHFDGTDWDESRKLNRIYKFQGKAWDWEVSNENGNYDYLMYADIDYDHPDVAAEIKRWGTWYANELQLDGFRLDAVKHIKFSFLRDWVNHVREKTGKEMFTVAEYWQNDLGALENYLNKTNFNHSVFDVPLHYQFHAASTQGGGYDMRKLLNSTVVSKHPLKAVTFVDNHDTQPGQSLESTVQTWFKPLAYAFILTRESGYPQVFYGDMYGTKGDSQREIPALKHKIEPILKARKQYAYGAQHDYFDHHDIVGWTREGDSSVANSGLAALITDGPGGAKRMYVGRQNAGETWHDITGNRSEPVVINSEGWGEFHVNGGSVSI

SEQ ID NO: 1767 - DNA, 2892 bp, Halothermothrix orenii
gatcctgagcttattatttcggttaaatccctgggggcagggagtatgcagatataccgggaagtaataattccagccactttccctaaaatttttacggctaccagaataagtattggtacagctatagctgtccttttcctgaccgaaacctttgctactttcaggggactggggtactttattatggattgctggaccagggtcaactatactgaaatgtatgccgggattttaattttaagccttcttggcctctccctgtttctgttgatagacctgctggagcgtattatctgcccctggttatttattgacaggggtatatagtccagtggtaggctggattatataatttattgaaattttcgataaattccgttataataatattaaatctgaaaatatttagtaaaaggatgtgagatatgtgaagctaaaacgcttgtctttcttcatgtttgttaccttactggtatttatatctgtttttcctgtttatgcaaacgatttcgaaaaacatggtacatattatgaaatttttgtcaggtctttttatgactctgatggtgacggaataggggatttgaaaggtataatagaaaaactggattatcttaatgatggagaccctgaaaccattgctgatctgggggttaatggtatctggttaatgcctatctttaaatctccctcctatcatggctatgatgtaaccgattattataagattaatcctgactacgggactctggaagacttccataagcttgttgaggctgcccatcaaaggggaatcaaggttataattgatttacccatcaatcataccagtgaaagacatccctggtttctcaaggcttcccgggataagaatagtgaatacagggattattatgtctgggctggccccgataccgataccaaagaaaccaagttagatggaggccgggtctggcattattccccgaccggcatgtattatgggtatttctggagtggcatgcctgatttaaactataataaccctgaagttcaggaaaaggttattgggatagcaaaatactggttaaaacagggggttgatggtttcaggcttgatggagccatgcatatcttcccaccggcccagtatgataaaaactttacctggtgggagaagttccgtcaggaaattgaagaggtaaaacccgtttacctggtgggtgaggtctgggatatttcggaaacggtagctccttacttcaaatatggttttgattctacctttaactttaaactggcagaggcagttatcgctacggctaaagctggatttccctttggttttaataaaaaggcaaaacatatttacggggtatatgacagggaggttggatttgggaattatatcgatgctcccttcctgaccaaccatgatcagaaccggattttggaccagcttgggcaggatcgtaataaggccagggttgctgccagtatttatttgaccttgcctggtaatccctttatttactatggtgaagaaatcggtatgagggggcaggggccccatgaagttatcagggagcccttccagtggtataatggatccggggagggagaaacatactgggagccagccatgtataatgatggctttacttctgttgaacaggaagaaaagaatctcgattccctcttaaatcactacaggaggttaatccatttccggaacgaaaatcctgtcttttataccggtaagattgagattataaatggaggattaaatgtagttgcatttagaagatataatgataagagggatttatatgtctaccataacctggtaaacagaccggttaaaataaaagtggctagtggtaactggaccttattgtttaattcaggtgataaggaaattacccctgttgaagataataataaacttatgtatactatccctgcttatactaccattgttctggaaaaggagtaaagggagagggtgagtaataattatgaaaaggagagggtaaatccctctccttttttgttaaatatttttattatacctgttataattgatttttttgatgttatttattttttaaattgagatagaactgaactaattggtctgagtttgatttgatgtcagctcaatttcacccagtgttgtaacctcaccggctgtaacctggacatcttcgattattgttgattcatcatagttgtcggcagtaatttcaaggtcataggttccttccacgaggccgagaagtttaaagccaccttcattaccactattggtagaagtgacatacccctcttcagtaaattcatcattgtgataaactgtaatgggtgcttcagcaataccattaccattactgtcaaccaccttaccctggatatctcctaagatccctttttcacataatccttatagttggtttaagtttatatttattatttggataaattagagactttctggcatcaaaatcaagcaacaggacggtacccttgtctggagaaacagtaaatgagttgaccagtttaataccggtctgatctgcagaaggaatatcgacaggttctgtactatctttaccagattcttgtacccgggctttggagacataaaccctcatttgagtgtagtgtccttcaggtaaatagtctttgccgattaattcagaaaccccctgaagttctaataaatcaaactctttttcctcttccaggattgtgaaccagccctcttcgtcgttatgtgtttctattctcgatatggttaccagtaatttttctacattatcggccggggcatcggtcaggagtagttggatttcaccggtttctttgccaaaaaaagacaggttatcacaggctgtcagccccaggatc

SEQ ID NO: 1768 - protein, 515 aa, Halothermothrix orenii
MKLKRLSFFMFVTLLVFISVFPVYANDFEKHGTYYEIFVRSFYDSDGDGIGDLKGIIEKLDYLNDGDPETIADLGVNGIWLMPIFKSPSYHGYDVTDYYKINPDYGTLEDFHKLVEAAHQRGIKVIIDLPINHTSERHPWFLKASRDKNSEYRDYYVWAGPDTDTKETKLDGGRVWHYSPTGMYYGYFWSGMPDLNYNNPEVQEKVIGIAKYWLKQGVDGFRLDGAMHIFPPAQYDKNFTWWEKFRQEIEEVKPVYLVGEVWDISETVAPYFKYGFDSTFNFKLAEAVIATAKAGFPFGFNKKAKHIYGVYDREVGFGNYIDAPFLTNHDQNRILDQLGQDRNKARVAASIYLTLPGNPFIYYGEEIGMRGQGPHEVIREPFQWYNGSGEGETYWEPAMYNDGFTSVEQEEKNLDSLLNHYRRLIHFRNENPVFYTGKIEIINGGLNVVAFRRYNDKRDLYVYHNLVNRPVKIKVASGNWTLLFNSGDKEITPVEDNNKLMYTIPAYTTIVLEKE

SEQ ID NO: 1769 - DNA, 1807 bp, Xanthomonas campestris
agcgctgatgttacctagttgactggatggcacctacggaaaacagaccgtgctgcagcgctcctgcagacgcagcgcgtctgcaaaatcaacgtcgccacatacgcgcctgccgcgccggcagggtgaaggtgtacgagccactggagatgcgcaccacgttgccggaacccagtgcatcgacgtaatccgcattccagaacaacacgctgccgttcatggcgacggtggtgttgaccgggttgccgcacttgttgatgcccacgatgccgaggctgccgcggcggaacaggatgtggcaggcactggatgacagcacctgcatgtcgctgccctgcacgccgttgtggaagccaatcatgcggcgcagatcatcgcgcagataggcattgacccagcggttgtcgccgctttcgttgttgtcggtgtagaccatcggcacgccgccgttgcggcccagcaagtacgcataggccagcgtttcatcgaccgggtcgagaatcgcgtagcggaagcctgcgttattggggatgtcatgcgtcacggcaaaggtgactgcacggttgcccggcaaggcctgcccggcggacgccgggtccaccaactgttgcatgctcgcacccacaccgaaggcattgcgtaccgcgttgaacagcgggaaatcgtaggcggcatgcggggtggattgcagatacggcgccaggaactggtcgtagtcgccattgccgctgccaccgccggtgatcacttcaccaaacacgtacacaccggagcggatgccggcatcgaaaacgcggttgagatggtcgaaggtcatgtgcttggccgcgtccacgcggaagccggtgacgcccaggcccttgagcgcctgcaggtaggcgcgctgctgctgcaccacccaatcgttgccgagcagatccggcaggcccggatcgctgccgccgccgcagatgcggtaattgcgcacctggaaggcatcgttgtagttgctgatgcattgcgccggcccgaaatcactgccgctcaaaaagttggactgcaccgtgccgaacaggcgcagtgcatcgtagcgcccaggattggccgcgtactgcgccagcaccgcgctgccggggtaattgaggtccgagcgcgttgctgcttcgttggccatgtggttgaacaccacgtcggcataggtttccacaccgttgtttgccagtgcctgcaccatgcgcgcgaacgcggtggtgtcgccgagtggattgtcgatcaggcggatatcctgcggctggtagcgcgcccaccaggtactgccttcggagcgatacgccggtgcgaccagtaccttgcgatacccggcatcggcgatctgcttggcgcgcgcttctaccgtggcgtagggccagttgaacgcatgcaggatgacgtcggcctgtgcgctggcggtggtcagcaacaaggtcagcgcgatcaacagcaactggtgagcgcgttgccagaacgtgcgtggacaggggcgagaggtggcgtgcatcgggtgtgtctcctgatcagtggacgcacgcatcccgcacagcgatgcatgcagcaatgccctccggcccctgttccggaaagcgcgccccacggcgtgcggcgcgcggtgatgctaagcgcgcatcgcggcgcagcatcgaccctgtgcatacgtattcactgcacaacagccgcgaaacgtgcggccggttcgatgccgagggcgtgcacggtcgcactcgcaccgatgcactgcgcgcggtgctgatcactgacggcggtggttgccggtatgatgccgtgacgtcca

SEQ ID NO: 1770 - protein, 475 aa, Xanthomonas campestris
MHATSRPCPRTFWQRAHQLLLIALTLLLTTASAQADVILHAFNWPYATVEARAKQIADAGYRKVLVAPAYRSEGSTWWARYQPQDIRLIDNPLGDTTAFARMVQALANNGVETYADVVFNHMANEAATRSDLNYPGSAVLAQYAANPGRYDALRLFGTVQSNFLSGSDFGPAQCISNYNDAFQVRNYRICGGGSDPGLPDLLGNDWVVQQQRAYLQALKGLGVTGFRVDAAKHMTFDHLNRVFDAGIRSGVYVFGEVITGGGSGNGDYDQFLAPYLQSTPHAAYDFPLFNAVRNAFGVGASMQQLVDPASAGQALPGNRAVTFAVTHDIPNNAGFRYAILDPVDETLAYAYLLGRNGGVPMVYTDNNESGDNRWVNAYLRDDLRRMIGFHNGVQGSDMQVLSSSACHILFRRGSLGIVGINKCGNPVNTTVAMNGSVLFWNADYVDALGSGNVVRISSGSYTFTLPARQARMWRR

SEQ ID NO: 1771 - DNA, 1813 bp, Xanthomonas campestris pv. campestris
gatccgctgatgttacctagtcgcctggatggcacctacggaaaacagaccgtgctgcagcgctcctgcaaacgcagcgcgtctgcaaaatcaacgtcgccacatacgcgcctgccgcgccggcagggtgaaggtgtacgagccactggagatgcgcaccacggtgccggaacccagtgcatcgacgtaatccgcattccagaacaacacgctgccgttcatggcgacggtggtgttgaccgggttgccgcacttgttgatgcccacgatgccgaggctgccgcggcggaacgggatgtggcaggcactggatgacagcacctgcatgtcgctgccctgcacgccgttgtggaagccaatcatgcggcgcagatcatcgcgcagataggcattgacccagcggttgtcgccgctttcgttgttgtcggtgtagaccatcggcacgccgccgttgcggcccagcaagtacgcataggccagcgtttcatcgaccgggtcgagaatcgcgtagcggaagcccgcgttattggggatgtcatgcgttacggcaaaggtgactgcgcgattgcccggcaaggcctgcccggtggacgccgggtccaccaactgttgcatgctcgcacccacaccgaaggcattgcgtaccgcgttgaacagcgggaaatcgtaagcggcatgcggggtggattgcagatacggcgccaggaactggtcgtagtcgccattgccgctgccaccgccggtgatcacttcaccaaacacgtacacaccggagcggatgccggcatctaaaacgcggttgagatggtcgaaggtcatgtgcttggccgcgtccacgcggaagccggtgacgcccaggcccttgagcgcctgcaggtaggcgcgctgcttctgcaccacccaatcgttgccgagcagatccggcaggcccggatcgctgccgccgccgcagattcggtaattgcgcacctggaaggcatctttgtagttactgatgcattgcgccggcccgaaatcactggcgctcaaaaagttggactgcaccgtgccgaacaggcgcagtgcatcgtagcgcccaggattggctgcgtactgcgccagcaccgcgctgccggggtaattgaggtccgagcgcgttgctgcttcgttggccatgtggttgaacaccacgtcggcataggtttccacaccgttgtttgccagtgcctgcaccatgcgcgcgaacgcggtggtgtcgccgagtggattgtcgatcaggcggatatcctgcggctggtagcgcgcccaccaggcactgccttcggagcgataggccggtgcgaccagtaccttgcgatacccggcatcggcgatctgcttggcgcgcgcttctaccgtggcgtagggccagttgaacgcatgcaggatgacgtcggcctgtgcgctggtggtggtcagcaacaaggtcagcgcgatcaacagcaactggtgagcgtgttgccagaacgtgcgtggacaggggcgagaggtggcgtgcatcgggtgtgtctcctgatcagtggacgcacgcatcccgcacagcgatgcatgcagcaatgccctccggcccctgttccggaaagcgcgccccacggcgtgcggcgcgcggtgatgctaagcgcgcatcgcggcgcagcattgaccctgtgcatacgtattcactgcacaacagccgcgaaacgtgcggccggttcgatgccgagggcgtgcacggtcgcactcgcaccgatgcactgcgcgcggtgctgatgaatggcggcggtggttgccggtatgatgccgtgacgtccagcag

SEQ ID NO: 1772 - protein, 475 aa, Xanthomonas campestris pv. campestris
MHATSRPCPRTFWQHAHQLLLIALTLLLTTTSAQADVILHAFNWPYATVEARAKQIADAGYRKVLVAPAYRSEGSAWWARYQPQDIRLIDNPLGDTTAFARMVQALANNGVETYADVVFNHMANEAATRSDLNYPGSAVLAQYAANPGRYDALRLFGTVQSNFLSASDFGPAQCISNYKDAFQVRNYRICGGGSDPGLPDLLGNDWVVQKQRAYLQALKGLGVTGFRVDAAKHMTFDHLNRVLDAGIRSGVYVFGEVITGGGSGNGDYDQFLAPYLQSTPHAAYDFPLFNAVRNAFGVGASMQQLVDPASTGQALPGNRAVTFAVTHDIPNNAGFRYAILDPVDETLAYAYLLGRNGGVPMVYTDNNESGDNRWVNAYLRDDLRRMIGFHNGVQGSDMQVLSSSACHIPFRRGSLGIVGINKCGNPVNTTVAMNGSVLFWNADYVDALGSGTVVRISSGSYTFTLPARQARMWRR

SEQ ID NO: 1773 - DNA, 1808 bp, Xanthomonas campestris pv. campestris str. 8004
gctgatgttacctagtcgcctggatggcacctacggaaaacagaccgtgctgcagcgctcctgcaaacgcagcgcgtctgcaaaatcaacgtcgccacatacgcgcctgccgcgccggcagggtgaaggtgtacgagccactggagatgcgcaccacggtgccggaacccagtgcatcgacgtaatccgcattccagaacaacacgctgccgttcatggcgacggtggtgttgaccgggttgccgcacttgttgatgcccacgatgccgaggctgccgcggcggaacaggatgtggcaggcactggatgacagcacctgcatgtcgctgccctgcacgccgttgtggaagccaatcatgcggcgcagatcatcgcgcagataggcattgacccagcggttgtcgccgctttcgttgttgtcggtgtagaccatcggcacgccgccgttgcggcccagcaagtacgcataggccagcgtttcatcgaccgggtcgagaatcgcgtagcggaagcccgcgttattggggatgtcatgcgttacggcaaaggtgactgcgcgattgcccggcaaggcctgcccggtggacgccgggtccaccaactgttgcatgctcgcacccacaccgaaggcattgcgtaccgcgttgaacagcgggaaatcgtaggcggcatgcggggtggattgcagatacggcgccaggaactggtcgtagtcgccattgccgctgccaccgccggtgatcacttcaccaaacacgtacacaccggagcggatgccggcatcgaaaacgcggttgagatggtcgaaggtcatgtgcttggccgcgtccacgcggaagccggtgacgcccaggcccttgagcgcctgcaggtaggcgcgctgctgctgcaccacccaatcgttgccgagcagatccggcaggcccggatcgctgccgccgccgcagatgcggtaattgcgcacctggaaggcatcgttgtagttgctgatgcattgcgccggcccgaaatcactggcgctcaaaaagttggactgcaccgtgccgaacaggcgcagtgcatcgtagcgcccaggattggctgcgtactgcgccagcaccgcgctgccggggtaattgaggtccgagcgcgttgctgcttcgttggccatgtggttgaacaccacgtcggcataggtttccacaccgttgtttgccagtgcctgcaccatgcgcgcgaacgcggtggtgtcgccgagtggattgtcgatcaggcggatatcctgcggctggtagcgcgcccaccaggcactgccttcggagcgataggccggtgcgaccagtaccttgcgatacccggcatcggcgatctgcttggcgcgcgcttctaccgtggcgtagggccagttgaacgcatgcaggatgacgtcggcctgtgcgctggcggtggtcagcaacaaggtcagcgcgatcaacagcaactggtgagcgtgttgccagaacgtgcgtggacaggggcgagaggtggcgtgcatcgggtgtgtctcctgatcagtggacgcacgcatcccgcacagcgatgcatgcagcaatgccctccggcccctgttccggaaagcgcgccccacggcgtgcggcgcgcggtgatgctaagcgcgcatcgcggcgcagcattgaccctgtgcatacgtattcactgcacaacagccgcgaaacgtgcggccggttcgatgccgagggcgtgcacggtcgcactcgcaccgatgcactgcgcgcggtgctgatgaatggcggcggtggttgccggtatggatgccgtgacgtccagca

SEQ ID NO: 1774 - protein, 475 aa, Xanthomonas campestris pv. campestris str. 8004
MHATSRPCPRTFWQHAHQLLLIALTLLLTTASAQADVILHAFNWPYATVEARAKQIADAGYRKVLVAPAYRSEGSAWWARYQPQDIRLIDNPLGDTTAFARMVQALANNGVETYADVVFNHMANEAATRSDLNYPGSAVLAQYAANPGRYDALRLFGTVQSNFLSASDFGPAQCISNYNDAFQVRNYRICGGGSDPGLPDLLGNDWVVQQQRAYLQALKGLGVTGFRVDAAKHMTFDHLNRVFDAGIRSGVYVFGEVITGGGSGNGDYDQFLAPYLQSTPHAAYDFPLFNAVRNAFGVGASMQQLVDPASTGQALPGNRAVTFAVTHDIPNNAGFRYAILDPVDETLAYAYLLGRNGGVPMVYTDNNESGDNRWVNAYLRDDLRRMIGFHNGVQGSDMQVLSSSACHILFRRGSLGIVGINKCGNPVNTTVAMNGSVLFWNADYVDALGSGTVVRISSGSYTFTLPARQARMWRR

SEQ ID NO: 1775 - DNA, 1813 bp, Xanthomonas campestris
ctgctggacgtcacggcatccataccggcaaccaccgccgccattcatcagcaccgcgcgcagtgcatcggtgcgagtgcgaccgtgcacgccctcggcatcgaaccggccgcacgtttcgcggctgttgtgcagtgaatacgtatgcacagggtcaatgctgcgccgcgatgcgcgcttagcatcaccgcgcgccgcacgccgtggggcgcgctttccggaacaggggccggagggcattgctgcatgcatcgctgtgcggatgcgtgcgtccacgtatcaggagacacacccgatgcacgccacctctcgcccctgtccacgcacgttctggcaacgcgctcaccagttgctgttgatcgcgctgaccttgttgctgaccaccgccagcgcacaggccgacgtcatcctgcatgcgttcaactggccctacgccacggtagaagcgcgcgccaagcagatcgccgatgccgggtatcgcaaggtactggtcgcaccggcctatcgctccgaaggcagtgcctggtgggcgcgctaccagccgcaggatatccgcctgatcgacaatccactcggcgacaccaccgcgttcgcgcgcatggtgcaggcactggcaaacaacggtgtggaaacctatgccgacgtggtgttcaaccacatggccaacgaagcagcaacgcgctcggacctcaattaccccggcagcgcggtgctggcgcagtacgcagccaatcctgggcgctacgatgcactgcgcctgttcggcacggtgcagtccaactttttgagcgccagtgatttcgggccggcgcaatgcatcagcaactacaacgatgccttccaggtgcgcaattaccgcatctgcggcggcggcagcgatccgggcctgccggatctgctcggcaacgattgggtggtgcagcagcagcgcgcctacctgcaggcgctcaagggcctgggcgtcaccggcttccgcgtggacgcggccaagcacatgaccttcgaccatctcaaccgcgttttcgatgccggcatccgctccggtgtgtacgtgtttggtgaagtgatcaccggcggtggcagcggcaatggcgactacgaccagttcctggcgccgtatctgcaatccaccccgcatgccgcctacgatttcccgctgttcaacgcggtacgcaatgccttcggtgtgggtgcgagcatgcaacagttggtggacccggcgtccaccgggcaggccttgccgggcaatcgcgcagtcacctttgccgtaacgcatgacatccccaataacgcgggcttccgctacgcgattctcgacccggtcgatgaaacgctggcctatgcgtacttgctgggccgcaacggcggcgtgccgatggtctacaccgacaacaacgaaagcggcgacaaccgctgggtcaatgcctatctgcgcgatgatctgcgccgcatgattggcttccacaacggcgtgcagggcagcgacatgcaggtgctgtcatccagtgcctgccacatcctgttccgccgcggcagcctcggcatcgtgggcatcaacaagtgcggcaacccggtcaacaccaccgtcgccatgaacggcagcgtgttgttctggaatgcggattacgtcgatgcactgggttccggcaccgtggtgcgcatctccagtggctcgtacaccttcaccctgccggcgcggcaggcgcgtatgtggcgacgttgattttgcagacgcgctgcgtttgcaggagcgctgcagcacggtctgttttccgtaggtgccatccaggcgactaggtaacatcagcggatc

SEQ ID NO: 1776 - protein, 475 aa, Xanthomonas campestris
MHATSRPCPRTFWQRAHQLLLIALTLLLTTASAQADVILHAFNWPYATVEARAKQIADAGYRKVLVAPAYRSEGSAWWARYQPQDIRLIDNPLGDTTAFARMVQALANNGVETYADVVFNHMANEAATRSDLNYPGSAVLAQYAANPGRYDALRLFGTVQSNFLSASDFGPAQCISNYNDAFQVRNYRICGGGSDPGLPDLLGNDWVVQQQRAYLQALKGLGVTGFRVDAAKHMTFDHLNRVFDAGIRSGVYVFGEVITGGGSGNGDYDQFLAPYLQSTPHAAYDFPLFNAVRNAFGVGASMQQLVDPASTGQALPGNRAVTFAVTHDIPNNAGFRYAILDPVDETLAYAYLLGRNGGVPMVYTDNNESGDNRWVNAYLRDDLRRMIGFHNGVQGSDMQVLSSSACHILFRRGSLGIVGINKCGNPVNTTVAMNGSVLFWNADYVDALGSGTVVRISSGSYTFTLPARQARMWRR

SEQ ID NO: 1777 - DNA, 2477 bp, Bifidobacterium adolescentis
tctagacgaatgttccagcattttctgacaacaagcaatactccgttccagataaacatcaattaactcgcgcttatgcaagcagtactcagagaaagccactatgaatgccaccacagccaacagggccataacacagttagcaattgtgtcaatgtactcaaccatcattcccctttccctgaaaacaaatactagattgtttcagtcagtcacatcatcaagtattccgaaatatacagaaataccgcaatgcacggcaaattcaattaaacgcaactcttcataggccacttaaacaaaccaccaccccatcaaattggatagagcatatacaagcccacatccagcagcacccccgtacccctacttgcgcaaatgagaaagatttgcagggttgacgcatcgacaacaactggattgcattttcagggcatcgccgaatatactcccaccacacaacaagttagggtggtacaaaacaccatcaattaagtaccacctttgcaaacattttcacaaatgaaagagttgtttcagcaacgattttcattgttttttccaaggcttttcgcactttagcaccctagaaaaggtataaaataaacagcatacgttcgcaatagtgcaaacgctatcaaagaagatgaacccccgttaaagggattgaagaaaaggaataaaggagccatgaaacatcggaaacccgcaccggcctggcataggctggggctgaagattagcaagaaagtggtggtcggcatcaccgccgcggcgaccgccttcggcggactggcaatcgccagcaccgcagcacaggccagcaccgatcgcgacagctacgccgacaccgttgaaaacaccacgttcgaacaggcgcgcaagcattacggactggcgcagcaaatgagcgagggcgccaccctgcatgcatgggagtggagcttcaaaaccattgaggaaaacatccccgctattgccgaagccggttacacctccgtgcagaccgagccgatttccgctattcataacggcggcaagggcatgatcttcaccgagaactggtactacgtatatcagccgaccgacaccaccatcggcaactgggtgatgggtaccgaagatgatctgaagagcctgtgcaacgcggctcacaagtacggcgtgcgtatcatcgtcgatgtggtagccaaccatatgaccgcgacttggggcgccatcgccgatcgttggaagaagtccgagtactaccaccacgactgcaatgacggtgatgtgcaggattggaacaaccgctatcaggtgacccactgcaagctgctcggcctgtatgacatcaacactgagaacaccaaaaccgccaacatgatgcacgatttcctcgtgcaagcggtcaacgacggtgtggacgggttccgtttcgatgcggccaagcacatcgaactgccggacgagtataacggctcccagtattggaacatcattcttaacaatggcgcgcagttccaatacggcgaagtgttgcaggattccatctcccgcgatagcgactatgcaaagctgttctccagccacagcaagaacggcggcggcgtcaccgatctctacggcagcaagctgcgcggagccctgaattcgaagaacctgaacgccggcaccctgtccgattggagcaactccgccagcccgagcaatcttgtctcttggctggaatcgcatgataactattccaatagcgatagggaatccaccggcatgagcgaatggcagatgaccatgggctggggcgtgatcggttcccgttcccagaccatgccgctgtacttcgaccgcccggtcggctccggcggcagccagccgcagttcgccgagaaaagcaagctcggcgatgccggtgcggattcttggaaggatgcgcaggtcgtggcggtgaaccacttccgcaatactatgaacaacaacaaggcttcggagtatctgcgcaactgcggcgcgaattcctgcctcatggtggaacgctacatcaaggacggcaacttcaagaacgacggcgtgaccatcaccaacatgggtgatacgcaagagctgtccggcactgccaccaaccttgacgacggcacctacaaggaccaggtctccggcggtaccatcaccgtttccggcggcaagattacttccggctctgctcccggcggcaagatcagtgtgttcttcaccgacaattccggttcggtctccgcaaccccgggcgacagctcgttcaagacggacaccactaccgttaccctgaatgcgaacaacgtcaccgatgccacctacaccacttcggagggcaagtccggctcgtatcaggatggcgacaccatcaccatcggcgcttccacggcgatcggtgacaccatcaccgtgaagctgcagggcaaggatgcggatggccaaacggtctccgcaacatacaagtacacgaagaaggatcc

SEQ ID NO: 1778 - protein, 596 aa, Bifidobacterium adolescentis
MKHRKPAPAWHRLGLKISKKVVVGITAAATAFGGLAIASTAAQASTDRDSYADTVENTTFEQARKHYGLAQQMSEGATLHAWEWSFKTIEENIPAIAEAGYTSVQTEPISAIHNGGKGMIFTENWYYVYQPTDTTIGNWVMGTEDDLKSLCNAAHKYGVRIIVDVVANHMTATWGAIADRWKKSEYYHHDCNDGDVQDWNNRYQVTHCKLLGLYDINTENTKTANMMHDFLVQAVNDGVDGFRFDAAKHIELPDEYNGSQYWNIILNNGAQFQYGEVLQDSISRDSDYAKLFSSHSKNGGGVTDLYGSKLRGALNSKNLNAGTLSDWSNSASPSNLVSWLESHDNYSNSDRESTGMSEWQMTMGWGVIGSRSQTMPLYFDRPVGSGGSQPQFAEKSKLGDAGADSWKDAQVVAVNHFRNTMNNNKASEYLRNCGANSCLMVERYIKDGNFKNDGVTITNMGDTQELSGTATNLDDGTYKDQVSGGTITVSGGKITSGSAPGGKISVFFTDNSGSVSATPGDSSFKTDTTTVTLNANNVTDATYTTSEGKSGSYQDGDTITIGASTAIGDTITVKLQGKDADGQTVSATYKYTKKDP

SEQ ID NO: 1779 - DNA, 1787 bp, Streptomyces lividans
taggggttgaccgtggttgaaggccgcccttacggtcacgaccgcaaccgcttgcagaattcttgctgcaacgcactgcaagtacctgccggctccccagaacccgtcggcaccgcacccgggacacccgcaccctcacacgggagactccatgcacgggaacaccagcccagcgcgaagaatcaccgccaccgcgctcgccctcaccgccggcgtggccggcagcctcctcgccaccacggcaccggcccaggcgtccccacccggagacaaggacgtcaccgcggtgatgttcgagtggaagttcacctccgtcgcccaggcctgcaccgacaccctcggcccggccggctacggctacgtccaggtctcaccgccccaggagcacatccagggcggacagtggtggacctcgtaccagccggtgagctaccggatcgcgggccgcctcggtgaccgcgcccagttcaagagcatggtcgacacctgccacgccgccggggtgaaggtcgtggccgactcggtcgtcaaccacatgtcggccggcaacggcacgggcaccggcggctcgtcctacaccaagtacgactatcccggcctctactcgtcgaacgacctcgacaactgcacctcgcagataaacaactacggcgaccgcttcaacgtccaggagtgcgaactggtcggcctcgcggacctggacaccggcgaggactacgtacgggggaagatcgccggctacctcaacgacctgctctccctcggcgtcgacggcttccgcatcgacgcggccaagcacatggccgccgccgacctggccgccatcaagtccaggctcagcaacccgaacgtctactggaagcacgaggcgatctacgccgcgggcgaggccgtgtccccgaccgagtacgtcggcagcggcgacgtacaggaagttcgcttacgcaacgcaaacctcacgcgcgtcttcaacggcgagaacctcgcgtacctgaagaacttcggcgaggcctggggccacctgccatcggacgaggccggcgtctttgtcaacaaacacgacaccgagcgcaacggcgagaccctcacctacaaggacggcgccacctacaccctggcgcacgtcttcatgctggcctggccgtacggcagccccgacgtccactccggctacgagttcaccgaccacgacgccgggccgccgaacggcggtcaggtgaacgcctgctacagcgacggatggaagtgccagcacgcctggcgcgagatctcctccatggtcgctttccgcaacaccgcacgcggccagggggtgaccgactggtgggacaacggcggcgaccagatcgccttcggccgcggctccaaggcgtacgtcgccatcaaccacgagggcacctcgctgacccgtacgttccagacgtcgctgcccgcgggggactactgcgacgtccagacgggcaagggtgtcacggtcgacggggcaggccggttcaccgccaccctgggcgccggcacggccgtggccctgcacgtcggcgcccgcacctgtgacggcggcgatcccggcgaccccgacccggtgtcctccggcgtgtccttcgcggtcgacgccaccaccagctggggccagaacatctacgtgaccggcaaccggccggaactgggcaactgaaacccgggcggcgcccttcaactcgacccggccgcctacccggtgtggaagcgggacgtcgaactccccgagggcacgaccttcgagtacaagtacctccgcaaggacgaca

SEQ ID NO: 1780 - protein, 507 aa, Streptomyces lividans
MHGNTSPARRITATALALTAGVAGSLLATTAPAQASPPGDKDVTAVMFEWKFTSVAQACTDTLGPAGYGYVQVSPPQEHIQGGQWWTSYQPVSYRIAGRLGDRAQFKSMVDTCHAAGVKVVADSVVNHMSAGNGTGTGGSSYTKYDYPGLYSSNDLDNCTSQINNYGDRFNVQECELVGLADLDTGEDYVRGKIAGYLNDLLSLGVDGFRIDAAKHMAAADLAAIKSRLSNPNVYWKHEAIYAAGEAVSPTEYVGSGDVQEVRLRNANLTRVFNGENLAYLKNFGEAWGHLPSDEAGVFVNKHDTERNGETLTYKDGATYTLAHVFMLAWPYGSPDVHSGYEFTDHDAGPPNGGQVNACYSDGWKCQHAWREISSMVAFRNTARGQGVTDWWDNGGDQIAFGRGSKAYVAINHEGTSLTRTFQTSLPAGDYCDVQTGKGVTVDGAGRFTATLGAGTAVALHVGARTCDGGDPGDPDPVSSGVSFAVDATTSWGQNIYVTGNRPELGN

SEQ ID NO: 1781 - DNA, 683 bp, MICROBISPORA SP.V2
  misc_feature (649)..(649): n is a, c, g, or t
  misc_feature (661)..(661): n is a, c, g, or t
  misc_feature (678)..(678): n is a, c, g, or t
gtctgggccggtgggccgtacgaccagagcaacacgaggggcgcggcggccctggggcagatccggcaactggtcttccagaaccagtggagccaggcccagagcctgatcgaccagaacatgctcggcaaccccgcgggccagctcgcctaccagaccgtcggcaacctgcggctcgccttcggcagcgccagcggggtctcggagtacacccgcttcctggacctgaccacggccaccaccaccacgtcgtacctgcaggcgcggctgccgcacctgaccgtggtgaacgacctcaccttcgccttcctccccgacgagcacttcaccgtggtccacgcgcacagcgtgttctcccacagcccgatcgaggtgatcgaccagtgcctccggcacgtcggccgcatcctccacccggacggcttcttcgacttcaccttcgaccgtacggagaaggccgagcaccacgtgctgcgcgaggacttctactaccggaccgagacgctcgtgaacctcgccgagcggtacggcctcacggcgaggttcatggacgactgggaacggacccggcacaagcagtccaagctgcgcgtcacccgctgagacgggcggctacagcgtcgagcagaccgtgccgttcacgcggaanaccgtgggtgangggtaggccccctcgtnggcgc

SEQ ID NO: 1782 - DNA, 1787 bp, Streptomyces lividans; identical to SEQ ID NO: 1779

SEQ ID NO: 1783 - protein, 507 aa, Streptomyces lividans; identical to SEQ ID NO: 1780

SEQ ID NO: 1784 - DNA, 2575 bp, Thermoactinomyces vulgaris
tgtttccttcgacgatgacgatggtagccatttaccttttgcttaatatgttgcatttgcttgatacgcatctggggcttttgcttttttatgccggaacgcaaattccttttaacacttggcttgtgaaagggtattttgacacgattccccacagtttggatgaagcggcgcggatcgatggagcggggcatctaaccatcttctggaaagtgatattgccgctggcaaaacccattttggcagtcgttttcctctttaatttcatgggtcccatgacggactttctgctgccgcaaattatattgaccagcccggaacaccaaacactggcggtagggctcttcagttttatcaatgatgatttcaaaaagcagtataccctgtttgcggcggggtcggtgttgattgcattgccaattaccgttattttcctgtctctgcaacgctgctttatttccgggctcaccgcgggtgccagcaagggataacgttgaagggggaagagtccatgctgttggaagcgatttttcatgaagcgaaaggaagctatgcttacccgatttcggaaacgcaactgcgggtgagattgcgggcgaaaaaaggggacgtggtgagatgcgaggtgctctatgcggaccgctatgcttcgccggaggaagaactggcacatgcacttgcgggcaaagcagggtccgatgagcgatttgattattttgaggctttactggaatgttccaccaaacgggtgaaatacgtgtttttgttgacaggcccacaaggggaggctgtttattttggcgagaccggtttttccgccgaacggtctaaagcgggggtgttccaatatgcttacatccaccggagcgaagtgtttacgacaccggaatgggcaaaggaggcggtgatctaccagatctttcccgaacgttttgccaatggggatcccagcaatgatccgccgggaacggaacaatgggccaaagacgccagacctcggcacgacagtttttacggcggagatttaaagggggtgatcgaccgtttgccatatttggaggagttgggagtgacggcgctttattttactcccatttttgcttcgccgtcccatcacaaatatgatacagctgattatttggcgattgatccgcaatttggggatttgcccacctttcggcgtttggtggatgaagctcaccggcgcgggatcaaaatcattttggatgccgtgtttaaccatgccggagatcagttttttgcgtttcgggatgttctgcaaaagggagaacagtcgcgatataaggattggtttttcatcgaggattttcccgtttccaagacgtcaagaaccaattatgaaacctttgccgtccaagtgccggccatgcccaaattgcggacggaaaatccggaagtgaaggaatatttgtttgatgtcgcgcgattttggatggagcaggggatcgacggatggagactggatgtggccaatgaggtggatcacgccttttggcgcgagtttcgccgccttgtcaaatccctcaatcccgacgccttgattgtcggagagatttggcatgacgcttccggctggctgatgggagaccaatttgattcggtgatgaattatttgtttcgcgagagtgtgatccgtttttttgccacgggggagatccatgccgaaagatttgacgccgaacttacccgggccaggatgctttatccggaacaggcggcacaagggttatggaacctcctcgactcacacgatacggaacgttttttgacatcgtgtggggggaatgaggcgaaattccgcctggctgttttgtttcagatgacatacctggggacgccgctgatttattacggtgatgagatcgggatggccggagcgacggacccggattgccggcgcccgatgatatgggaggaaaaagagcagaaccgcggcttgtttgagttttataaggaattgattcgcttgcgccatcggctggcatcgctcaccaggggaaatgtccggtcttggcatgccgacaaacaagccaatctttatgcttttgtgcgcacggttcaagaccaacatgtcggtgtggttctcaataatcgtggcgagaagcaaaccgttttgctacaggtgccggaatcgggcggaaaaacttggctggattgtttgaccggagaagaagtgcatggcaaacaagggcaactgaagctgacacttcgcccttaccagggaatgattctctggaatggccggtagattttcggtgcccaaaccagtgattgggatatgattccaggctagtttttggataaaattaggaggatcaaatggcaaacaaacgttatttgattgatgcagtgatcggaaatgacaagatcttggccgttttggaccggtatggagaattgcaccgcttgtggtggccgcagaaagattatgcgcaacatgtgaaccggctatctgccggggttctgatcccaggcaaatcaaaaggggtctggtggtttcatcagcctgcggggaaacatgagcaaacatatgttcatgatgctcccattctaa

SEQ ID NO: 1785 - protein, 162 aa, Thermoactinomyces vulgaris
FPSTMTMVAIYLLLNMLHLLDTHLGLLLFYAGTQIPFNTWLVKGYFDTIPHSLDEAARIDGAGHLTIFWKVILPLAKPILAVVFLFNFMGPMTDFLLPQIILTSPEHQTLAVGLFSFINDDFKKQYTLFAAGSVLIALPITVIFLSLQRCFISGLTAGASKG

SEQ ID NO: 1786 - protein, 585 aa, Thermoactinomyces vulgaris
MLLEAIFHEAKGSYAYPISETQLRVRLRAKKGDVVRCEVLYADRYASPEEELAHALAGKAGSDERFDYFEALLECSTKRVKYVFLLTGPQGEAVYFGETGFSAERSKAGVFQYAYIHRSEVFTTPEWAKEAVIYQIFPERFANGDPSNDPPGTEQWAKDARPRHDSFYGGDLKGVIDRLPYLEELGVTALYFTPIFASPSHHKYDTADYLAIDPQFGDLPTFRRLVDEAHRRGIKIILDAVFNHAGDQFFAFRDVLQKGEQSRYKDWFFIEDFPVSKTSRTNYETFAVQVPAMPKLRTENPEVKEYLFDVARFWMEQGIDGWRLDVANEVDHAFWREFRRLVKSLNPDALIVGEIWHDASGWLMGDQFDSVMNYLFRESVIRFFATGEIHAERFDAELTRARMLYPEQAAQGLWNLLDSHDTERFLTSCGGNEAKFRLAVLFQMTYLGTPLIYYGDEIGMAGATDPDCRRPMIWEEKEQNRGLFEFYKELIRLRHRLASLTRGNVRSWHADKQANLYAFVRTVQDQHVGVVLNNRGEKQTVLLQVPESGGKTWLDCLTGEEVHGKQGQLKLTLRPYQGMILWNGR

SEQ ID NO: 1787 - DNA, 1545 bp, BACILLUS SP. YX
atgattcaaaaacgaaagcggacagtttcgttcagacttgtgcttatgtgcacgctgttatttgtcagtttgccgattacaaaaacatcagccgtaaatggcacgctgatgcagtattttgaatggtatacgccgaacgacggccagcattggaaacgattgcagaatgatgcggaacatttatcggatatcggaatcactgccgtctggattcctcccgcatacaaaggaacgagccaatccgataacggatacggaccttatgatttgtatgatttaggagaattccagcaaaaagggacggtcagaacgaaatacggcacaaaatcagagcttcaagatgcgatcggctcactgcattcccggaacgtccaagtatacggagatgtggttttgaatcataaggctggtgctgatgcaacagaagatgtaactgccgtcgaagtcaatccggccaatagaaatcaggaaacttcgggggaatatcaaatcaaagcgtggacggattttcgttctccgggccgtggaaacacgtacagtgattttaaatggcattggtatcatttcgacggagcggactgggatgaatcccggaagatcagccgcatctttaagtttcgtggggaaggaaaagcgtgggattgggaagtatcaagtgaaaacggcaactatgactatttaatgtatgctgatgttgactacgaccaccctgatgtcgtggcagagacaaaaaaatggggtatctggtatgcgaatgaactgtcattagacggcttccgtattgatgccgccaaacatattaaattttcatttctgcgtgattgggttcaggcggtcagacaggcgacgggaaaagaaatgtttacggttgcggagtattggcagaataatgccgggaaactcgaaaactacttgaataaaacaagctttaatcaatccgtgtttgatgttccgcttcatttcaatttacaggcggcttcctcacaaggaggcggatatgatatgaggcgtttgctggacggtaccgttgtgtccgagcatccggaaaaggcggttacatctgttgaaaatcatgacacacagccgggacagtcattggaatcgacagtccaaacttggtttaaaccgcttgcatacgcctttattttgacaagagaatccggttatcctcaggtgttctatggggatatgtacgggacaaaagggacatcgccaaaggaaattccctcactgaaagataagttagagccgattttaaaagcgcgtaaggagtacgcatacgggccccagcacgattatattgaccacccggatgtgatcggatggacgagggaaggtgacagctccgccgccaaatcaggtttggccgctttaatcacggacggacccggcggatcaaagcggatgtatgccggcctgaaaaatgccggcgagacatggtatgacataacgggcaaccgttcagatactgtaaaaatcggatctgacggctggggagagtttcatgtaaacggagggtccgtctccatttatgttcagaaataa

SEQ ID NO: 1788 - protein, 514 aa, BACILLUS SP. YX
MIQKRKRTVSFRLVLMCTLLFVSLPITKTSAVNGTLMQYFEWYTPNDGQHWKRLQNDAEHLSDIGITAVWIPPAYKGTSQSDNGYGPYDLYDLGEFQQKGTVRTKYGTKSELQDAIGSLHSRNVQVYGDVVLNHKAGADATEDVTAVEVNPANRNQETSGEYQIKAWTDFRSPGRGNTYSDFKWHWYHFDGADWDESRKISRIFKFRGEGKAWDWEVSSENGNYDYLMYADVDYDHPDVVAETKKWGIWYANELSLDGFRIDAAKHIKFSFLRDWVQAVRQATGKEMFTVAEYWQNNAGKLENYLNKTSFNQSVFDVPLHFNLQAASSQGGGYDMRRLLDGTVVSEHPEKAVTSVENHDTQPGQSLESTVQTWFKPLAYAFILTRESGYPQVFYGDMYGTKGTSPKEIPSLKDKLEPILKARKEYAYGPQHDYIDHPDVIGWTREGDSSAAKSGLAALITDGPGGSKRMYAGLKNAGETWYDITGNRSDTVKIGSDGWGEFHVNGGSVSIYVQK

SEQ ID NO: 1789 - DNA, 2996 bp, Bacillus sp. B1018
ttatttgagtacattttatgtattcccacattgcgcccgatatctacgcttagaaaaaaatcgtcggaaaagcgccccaaaaaatttttattgttatttattgacagttgtattcgctttcatctacaatgatggaggaacgcaatactcgatataatttaagggccatgcattccgtgaccgcacacccggtatggaacaaccccggtatctcgatggagaagccggggttttttgtcgcccttttttaggaggtgatccggcgacagcggatcaagcctggaattcaaataattacataggaggtataacatgaagaaatttctgaaaatgacagccgcgttttccctgggattatccctggcgttcgggcttttcagccccgcccaggccgcgccggatacctcggtatccaacaagcaaaatttcagcaccgacgtcatctatcaaattttcaccgacaggttttcggacggcaatcccgccaacaatccgaccggcgcggcgtttgacggaacctgcacgaacctccggctgtattgcggcggcgactggcagggcatcatcaacaaaatcaacgacggttacctgaccgggatgggcgttaccgccatctggatctcccagccggtcgaaaacatctacagcatcatcaattattccggcgtcaacaacacggcctatcacggctactgggcccgggacttcaagaagacgaatccggcctacggcacgattgcggacttccagaacctgatcgccgccgcgcatgccaaaaacatcaaagtcattatcgacttcgccccgaaccatacgtcgcccgcctcgtccgaccagccttcctttgcggaaaacggccggctgtacgataacggcacgctgctcgggggatacacgaacgatacgcagaacctgttccaccataacggcggcacggacttttccacgaccgaaaacggcatctacaaaaacctgtacgatctcgccgacctgaaccataacaacagcacgtcggacgtctacttgaaggacgcgatcaaaatgtggctggatctcggcatcgacggcatccgcatggatgcggtgaagcatatgccgttcggctggcagaagagctttatggctgccgtcaacaactataagccggtctttaccttcggcgaatggttcctgggcgtaaacgaagtaggcccggaaaaccataagtttgccaacgaatccggcatgagcctgcttgatttccgttttgcccaaaaggtgcggcaggtgttccgggacaacaccgacaatatgtacggcctgaaggcgatgctggagggctccgcagccgattacgcccaggtggatgaccaggtgacgttcatcgacaaccatgacatggagcgtttccacgcaagcaatgcaaaccgccggaagctggagcaagcgctggcgttcacgctgatcctcgcgcgcgtccccgccatttattacggcaccgagcagtacatgtcgggtgggaccgatccggacaaccgggcgcggatcccttccttctccacgtcgacgaccgcctatcaagtcattcaaaagctggcgccgctgcgcaagtccaacccggccatcgcctacggatcgacgcaggagcgctggatcaacaacgacgtgctcatttatgagcgcaaattcggcagcaacgttgccgtcgttgccgtcaaccgcaatttgaacgcgccggcttccatttcgggacttgtcacttccctgccgcaaggcagctacaatgacgtccttggcggccttctgaacggcaacacgttaacggtaggctccggcggagccgcctccaatttcacgcttgcggccggcggcacggcggtgtggcagtacaccgcggcaacggcgacgccgaccatcgggcatgtcgggccgatgatggccaagccgggcgtgacgatcacgatcgacggccgcggcttcggctctagcaaaggcaccgtctacttcggcacgacggcggtgagcggcgccaacatcacgtcttgggaagacacgcagatcaaagtgaaaattccggccgtcgcaggcggcatctacaacattaaagtcgcaaacgccgccggaacggcaagcaacgtgtacgacaacttcgaggtattgtccggagaccaggtcagcgtccgcttcgtggtcaacaacgcgacaacggcccttgggcaaaatctctacctgacgggcaatgtcagcgagctggggaactgggacccggcaaaagcgatcgggccgatgtacaaccaggtcgtttaccaatatccgaactggtattatgacgtcagcgttccggccggcaaaacgatcgagttcaagtttttgaaaaaacaaggctccaccgtcacgtgggaaggcggcagcaaccacaccttcaccgcgccgtccagcggcaccgcgaccattaacgtgaattggcagccataaggcgtgagggataggcggctggcattcattggaaaaggcggactatatgacgtccgttccgtgagcaacgctcatcgctccgttcaaaccgccacaaggctgatcttcagccaaaaaaagaggggacctttcccctctttttttatttccgttgactaacggtattcccaaaaattacattgggggataagctccctcccctctaatagcaataacaagagcgtaaacccaaccaggtgatccatagcgtgcggtcgcctttaatcccggtatcaaaatgtatcctaccttacaaaaatgatcggatcatacaaaatagtgcgtactactcaacgaaatagaacctacatacagaacgatcgatccagatttcaacgaacggcacggtcgtttaaaaaaatggtgtgcggggtgcgagaatatgcaagaatatcaactgactttgaaagataagcggatcgtatgggggaaggcgatcgaccttgagcctctcattggcaaatatcctggcgactcgattagacagggcatgaacgaagctt

SEQ ID NO: 1790 - protein, 713 aa, Bacillus sp. B1018
MKKFLKMTAAFSLGLSLAFGLFSPAQAAPDTSVSNKQNFSTDVIYQIFTDRFSDGNPANNPTGAAFDGTCTNLRLYCGGDWQGIINKINDGYLTGMGVTAIWISQPVENIYSIINYSGVNNTAYHGYWARDFKKTNPAYGTIADFQNLIAAAHAKNIKVIIDFAPNHTSPASSDQPSFAENGRLYDNGTLLGGYTNDTQNLFHHNGGTDFSTTENGIYKNLYDLADLNHNNSTSDVYLKDAIKMWLDLGIDGIRMDAVKHMPFGWQKSFMAAVNNYKPVFTFGEWFLGVNEVGPENHKFANESGMSLLDFRFAQKVRQVFRDNTDNMYGLKAMLEGSAADYAQVDDQVTFIDNHDMERFHASNANRRKLEQALAFTLILARVPAIYYGTEQYMSGGTDPDNRARIPSFSTSTTAYQVIQKLAPLRKSNPAIAYGSTQERWINNDVLIYERKFGSNVAVVAVNRNLNAPASISGLVTSLPQGSYNDVLGGLLNGNTLTVGSGGAASNFTLAAGGTAVWQYTAATATPTIGHVGPMMAKPGVTITIDGRGFGSSKGTVYFGTTAVSGANITSWEDTQIKVKIPAVAGGIYNIKVANAAGTASNVYDNFEVLSGDQVSVRFVVNNATTALGQNLYLTGNVSELGNWDPAKAIGPMYNQVVYQYPNWYYDVSVPAGKTIEFKFLKKQGSTVTWEGGSNHTFTAPSSGTATINVNWQP

SEQ ID NO: 1791 - DNA, 3419 bp, Bacillus halodurans
atcgattctattacgatttatttttttaactcgaaaagtaaacgttttctttttgaaggtaaggctgtgtgaagaaagattctttttattacaaatttgtgcaaacgtttgcctaaattgcacaagggggaggaaatatgaacgccagttatgtaaaaaaagtgagcctttatttgctattgtcatttgtgataacgcttccattgttttcgcctacattctctatcaatagcgttgatgcctctcaaggtggcgagcagcaatcgttctcatgggataacgcaacggtatattttgcgattaccgaccgttttcacgatggcaacccatccaacaaccagtcatacggacgaccacaagaagacgcatggggtcaaaacattgggacgttccacggtggggatctccaagggttaacggataagcttaatgagggatattttacggagttaggcattaatgcgatttggatcactgctccttacgaacaagtgcatggctgggttggtggtggctcagacggtgattttgcccattacgcttaccatggttactatgcattagactacacgatgatcgatcaaaatatgggaacggttgaagatatgagggaattcgtccatacagcccatgagcaagggattcgggtcgttttggacgtggtgatgaatcatcctgggtataacacgattaaagatatgcatgagtacgggtttggtaatcccggggtatcagaacattggacgcctggtcaaggacaaaattggcacgatgtccatcaacagattaactatgaggacgcgggtgcttggcgtcattggtggggaccttggattcgggcgggtattgccggttatgaatcgtgcggaaatagtgagattacgatgtgcttagccggcttaccagactttaggacggaactcacacatagtgtagggttgccaccgctattagaaacgaagtggaatcaagaacgacaaggtggatacgaggactggatcgtaccagctgcgaatgacctgcgtcgtgatttaggtgttgcaccagctgattacatcgttaaatggctttctgcttgggttgaagaattcggtattgatggatttcgtgttgatacggcaaagcatgtggagctgtcccgctggcagcaattaaaggatgctgcaaatgaagctctctggaaatggcgggaggagaacccagaagccccgggcgccaactggacagatgatttttggatggtcggtgaagtgtggggacatggtgttggccggagtgaatattttgatcatggatttgattcggtgattaatttcacattccaaggggagcatggcaacgggcccgcgtaccgattagatacgatggaaagtacgttttctcggtacgccgatgcaatcaatacagattcgaccttcaatgtgctaagctacttatcccaacatgatacgcagctatatccgcgtgagcgactgatcgacggaggaacgtatttaatgctgcttcctggcggtgtgcaagtattttacggagatgagactgcgcgaccttttggacctacaggctctgaccctcatcaggggacgcgttcatcgatgaactgggattctgtcaatgaggaagtattgcaccattggcaaaagatggggcaatttagaagcaaccacctagcggttggggcaggggaacatcgacaaatcgctgcaagtccgtatacgtttagtcgcacatatgttgagggggatgtggatgaccgcgtagtcgtagtagtcggcgcgagtggagagacaacaattgacgtttcctctgtcttttcggacggacaacaagtccgagacttctacaccgggaatgtgactgtcgtcgaaaatggtcatgttacgttcccggctcatcgaaatggtgtcattttaattgaaagggcgggagacttgcttccatctgtatccgcttctccagctggtggtgagtttgatcgtgagcagcaagaggtgaccctttacgtccaacatgcggagtggggggcgtatacgattgatggttccgaccctaaggaagaaggaacagcttttgccaatggggacgtgattacggttggtagagaattaaacatcgatgaatctctaacgttacggctttatgctgaaaatgaaactggtgaagcgaaagccgagttcacgtttacaaaggttccagcctacccgcaagtttttgctgatcctcctgggggtacttttgctggtgacacactcaaagtaacgcttcacactcggaatgtagagggtggaacctactcgattgacggctctgatgagcaagcctttaccgatggggacgagattatgattgggaaagggatagaagctgggagcgagactacactccagcttaaagctgagaacgaattcggtacaatagaagaaacatacacatacacgaaatcaacggggctgacaatttattttaaaaagccagactcgtggggaacgccgcatttgtattattacgatacaaaccctaaagtcgatgagccgacatggagtgaggcccctgaaatggagcattacgaaggggattggtatacgcatacgatcgaaggagtagagagtgtgcgactattatttaaggatcgtggaacgaatcaatggcctggtcctggagagcctggttttttccgagatcaagacggttggttcgatggtgaatggcatgttgatagacctggggacgcaacggatataacgatttactataagacaggatggactcatccgcatatacattattcgctgaaccaaggggcgtggacgaccttgccgggggtaccactgacaaaatcagaatatgaaggttacgtaaaagtaacgattgaagccgaagaaggtagccagcttcgcgcagcattcaataacggcagtggacaatgggataacaatcaagggagagattacgatttttcttcaggggttcatacactagcagacgggcgaatcttaagtggaactcctaagtaagtaatacgggtgactcgcagcgatcagctgacgagtcgctttttttatgagtaactggaaaatcagagcataaatggttttcgattactttaccaacatttaatatgaataggttcattttattaatagatgttgaatgatagagaaagcgagcctaaatgaatgaaaacaatagatgatgtacgcttacattctatttttttaaatctatgattcgtgttaagatttcgatgtttacaacggactcgacttttgtgagagtcaaaagtcacatttttataaaaataaaagaaagaggtgctgaattgaacattcaacaactgaaaaacgaatggtttggcaatgtccgtggggacgttcttgcgggcattgtggtcgccttagcgctcataccagaagcaattg

SEQ ID NO: 1792 - protein, 958 aa, Bacillus halodurans
MNASYVKKVSLYLLLSFVITLPLFSPTFSINSVDASQGGEQQSFSWDNATVYFAITDRFHDGNPSNNQSYGRPQEDAWGQNIGTFHGGDLQGLTDKLNEGYFTELGINAIWITAPYEQVHGWVGGGSDGDFAHYAYHGYYALDYTMIDQNMGTVEDMREFVHTAHEQGIRVVLDVVMNHPGYNTIKDMHEYGFGNPGVSEHWTPGQGQNWHDVHQQINYEDAGAWRHWWGPWIRAGIAGYESCGNSEITMCLAGLPDFRTELTHSVGLPPLLETKWNQERQGGYEDWIVPAANDLRRDLGVAPADYIVKWLSAWVEEFGIDGFRVDTAKHVELSRWQQLKDAANEALWKWREENPEAPGANWTDDFWMVGEVWGHGVGRSEYFDHGFDSVINFTFQGEHGNGPAYRLDTMESTFSRYADAINTDSTFNVLSYLSQHDTQLYPRERLIDGGTYLMLLPGGVQVFYGDETARPFGPTGSDPHQGTRSSMNWDSVNEEVLHHWQKMGQFRSNHLAVGAGEHRQIAASPYTFSRTYVEGDVDDRVVVVVGASGETTIDVSSVFSDGQQVRDFYTGNVTVVENGHVTFPAHRNGVILIERAGDLLPSVSASPAGGEFDREQQEVTLYVQHAEWGAYTIDGSDPKEEGTAFANGDVITVGRELNIDESLTLRLYAENETGEAKAEFTFTKVPAYPQVFADPPGGTFAGDTLKVTLHTRNVEGGTYSIDGSDEQAFTDGDEIMIGKGIEAGSETTLQLKAENEFGTIEETYTYTKSTGLTIYFKKPDSWGTPHLYYYDTNPKVDEPTWSEAPEMEHYEGDWYTHTIEGVESVRLLFKDRGTNQWPGPGEPGFFRDQDGWFDGEWHVDRPGDATDITIYYKTGWTHPHIHYSLNQGAWTTLPGVPLTKSEYEGYVKVTIEAEEGSQLRAAFNNGSGQWDNNQGRDYDFSSGVHTLADGRILSGTPK

SEQ ID NO: 1793 - DNA, 1596 bp, BACILLUS SP. WHO
atgaaagggaaaaaatggacagctttagcactaacactgccgctggctgctagcttatcaacaggcgttcacgccgaaaccgtacataaaggtaagtctgaagcagcagataaaaacggtgtcttttatgaggtgtatgtaaactctttttacgatgcaaataaagatggacatggtgatttaaaaggtctgacacaaaagttggattatttaaatgacggcaattctcatacaaagaatgatcttcaagtaaacgggatttggatgatgcccgtaaacccttctcctagctatcataaatatgatgtaacggactattataatattgatccgcagtatggaagtctgcaagattttcgcaaactgatgaaagaagcagacaaacgagacgtaaaagttattatggacctcgttgtgaatcatacgagcagtgaacacccttggtttcaagctgcgttaaaagataaaaacagcaagtacagagattactatatttgggctgataaaaataccgacctgaatgaaaaaggatcttggggacagcaagtatggcataaagctccaaacggagagtatttttacggaacgttctgggaaggaatgcctgacttaaattacgataaccctgaagtaagaaaagaaatgattaacgtcggaaagttttggctaaagcaaggcgttgaaggcttccgcttagatgctgcccttcatatctttaaaggtcaaacagctgaaggcgctaagaaaaatatcctttggtggaatgagtttagagatgcgatgaaaaaagaaaaccctaacgtatatctaacgggtgaagtatgggatcagccggaagtggtagccccttactatcaatcgcttgattctttatttaactttgatttagcaggaaaaattgtcagctctgtaaaagcgggaaatgatcaaggaatcgctactgcagcagcggcaactgatgagctgttcaaatcatacaatccaaataaaattgacggcattttcttaaccaaccatgaccaaaaccgcgtcatgagtgagctgagcggcgatgtgaacaaagcaaaatcagctgcttctatcttacttacgcttcctggcaacccgtatatttattacggtgaagaaatcggcatgaccggtgaaaagcctgatgagttaatccgtgaaccgttccgctggtacgaaggaaacggacttggacaaactagctggggaacgcctgtatataacaaaggcggcaacggtgtgtcagtagaagcacaaacaaaacaaaaggattctttgttaaatcattaccgtgaaatgattcgtgtgcgtcaacagcacgaagagttagtaaaaggaacgcttcaatctatttcagtagacagtaaagaagttgttgcttatagccgcacgtataatggcaactcgattagcgtgtatcataatatttcaaatcaacctgtaagagtatctgtagcagcggaaggtaaattgatttttgctagtgaaaaaggtgctaagaaagtcaaaaatcagcttgtgattccggcgaatcggacggttttaataaaaaatgaaagggaaaaaatggacaggctcaaaaactag

SEQ ID NO: 1794 - protein, 531 aa, BACILLUS SP. WHO
MKGKKWTALALTLPLAASLSTGVHAETVHKGKSEAADKNGVFYEVYVNSFYDANKDGHGDLKGLTQKLDYLNDGNSHTKNDLQVNGIWMMPVNPSPSYHKYDVTDYYNIDPQYGSLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVEGFRLDAALHIFKGQTAEGAKKNILWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELSGDVNKAKSAASILLTLPGNPYIYYGEEIGMTGEKPDELIREPFRWYEGNGLGQTSWGTPVYNKGGNGVSVEAQTKQKDSLLNHYREMIRVRQQHEELVKGTLQSISVDSKEVVAYSRTYNGNSISVYHNISNQPVRVSVAAEGKLIFASEKGAKKVKNQLVIPANRTVLIKNEREKMDRLKN

SEQ ID NO: 1795 - DNA, 3258 bp, BACILLUS SP. US149
gaattcaacctagtatagaaaaggtgcgacgggcactgatttttttgaaaaaagaataggaggggtttgtgtgtttaaagaagcgattgatcacaggccaaaaggtgcttatgcgtatgcgttcgataaggagacgctgcacattaagcttcgtgcaaagaagaatgatttgaaaacggttacccttattgggggggatccgtacgattggaccaaggagggctggcagttcaaacgtttgcctatgacgaaggtgggcacagatgatctgtttgattattggctggctgtcgtgaagccgccttttcgacgcctgcgttatggatttgaaatcagcgatggcaagacaaagagcacgtatacggaacgcggtttctttgcggattctccaaaggacaccagttattatttctgcttcccatttttaaatggtattgatgtgttcgatgcaccggactgggtgaagtcaacggtatggtatcaaatcttccctgaacgttttgtcaatggcgattcatccattgatcctgaaggggtgcttccttggggcagtgaagaacccaagcccaataatttctttgggggagacttccaaggggtgatcgatcatcttgaccatcttgaagaccttggcatcacggggctttacttcacgccgatatttaaagcaacatctaatcataaatatgacacgattgactatttagagattgatccacaatttggggataaagccactttcaaaaaaatggtggaagcctgccatgaacgtgggattcgcattatgctggatgcggtgtttaatcactccggttattatttcgagccatttcaggatgtgcttgaaaaaggcgagaagtcggcttataaagactggttccatctgcgtgaattccctgttgttgcagagccaaaaccaaactatgacacatttgcctttactccgatgatgccgaagctgaatacagagaacccagaagtgaaggcctatctcttaaaggttggacgctattgggtagaggaattggatatcgatggctggcgtttagatgtggctaatgaggtcgaccatgcattttggcgtgagttccgcaaagaagtccgttcagtcaaacctgacgtgtatattttgggcgagatctggcacgattcgatgccatggctccaaggcgatcaatttgatgcagtcatgaactatcgttatacatcggctgctttggacttcttggccaaagaagacatgacggctagtgagtttgcggatgaactaactcgtgtgtttatgtcttatccagaaaatgttaatcaagtcgcttttaacttgctcgacagccatgatacaccgcgtcttctcacacattgtggcggtgacggcaaaaaagccgaccttctttacgtgacacaaatgacggttcctggtacaccttgtatttattatggggatgaagttggcatggctggcgaaaatgatccaggctgcagagcttgcatgatctgggatgaagagaagcaggaccgtgagcgatttgccttcttgaaaaaatggattgcgcttcgtgcagcccatcctgtgctcggttcagaaggaagttttgagtttctaccggtccaaaatgatgatgtcgtcagctacaaacgggaaaaagaggacgtgtcttattacatcgtgatcaaccgttcagaagatgagattaactggcaaactcctaagaaattagttgggaaagccgtcaaaaatgtctggaccggtgaaagcctaactcttgaaaaatccgtggtcctcgcgccgcaaagtttctttgtcttcttatttaagtaagtgacaagagacacataatcctagcaaaagagaagtgccaatgcccttgtcagttgctgctggggccaataggctagttaatttaacgagctgtccgaagtagactttggtttctcgcaaaaataagaaaaggttcccttatgggggaaccttttctgcgtgaaatgatgtgctttatccatggtataaggtgcccgtgccaatttgggcttcgattgagatctggttcagtaaatcgtctcaacaccattttcctcgagcggcatcacgccgtttttaattcgtctatgagactccttcaccctaaaaaggctaactccattgacaaacggagagttctccgttttatcttaccttaacaaaaggagatgacaatagatgaaacatcaaaaaaacaggaggagggcacgagcccatggcgaatcgtaatccgttttcttggagattcgtggcaccgcctttacatggggtccacgcttaattccgatcaatagctcgaatgattgccactgcccttgtgccgatcgccgcctatctgcatgtttccgtggctcatacgacactccttgttacgtcgctctatctagcaagctccattgctcagccgactggccggcaaactctcagaggcgtttggacctcgccgggtattcctgacgggtatcctcttagtgctattaggcgggttaataggaggcatggcgaccaatttgaccatgctggtcctatcacgcgtcctaataggaatgggtacttcaaccgcttatccttctgcaatgctcctcattcggagacgtgcagaagcggtggggatggctaagccgccgggaaatgtacttggcgcccttcaaattgccggagttgtaacagccgctgtggggctcccgattggcggtttgcttgtggatgcttggggatggcggacaacatttttagtcaatatcccattttcactcgttgcatttgtcatggccgcactgtggattccaaaggatgagatcattaaagggggaaaatctatgcgggcgatttcctctcgcattgatacaacaggcatcattggattcgctgccacaattagctcccttatggtatttctgttctcattacctaatccctcttggatggctcttgctctgtctattgtgcttggcctatttcttatctggtgggactggcgcgcgaagcatctttatcgatgtacgtatgctcgcttcgaatctcggctctcgcggacttatgcccggtttgctttgatcactttgtgcatttataccgtcctttatggtttaacggaatggatcagcgccgcacgtggaacctctgcactcgaagccggccttctcattctacctatgagcatcctttccgctttggtcgtaggtcctgtgtcaaagcgcaatttggtgcgcggaccactcattatttgtgcgggatcc

SEQ ID NO: 1796 - protein, 582 aa, BACILLUS SP. US149
MFKEAIDHRPKGAYAYAFDKETLHIKLRAKKNDLKTVTLIGGDPYDWTKEGWQFKRLPMTKVGTDDLFDYWLAVVKPPFRRLRYGFEISDGKTKSTYTERGFFADSPKDTSYYFCFPFLNGIDVFDAPDWVKSTVWYQIFPERFVNGDSSIDPEGVLPWGSEEPKPNNFFGGDFQGVIDHLDHLEDLGITGLYFTPIFKATSNHKYDTIDYLEIDPQFGDKATFKKMVEACHERGIRIMLDAVFNHSGYYFEPFQDVLEKGEKSAYKDWFHLREFPVVAEPKPNYDTFAFTPMMPKLNTENPEVKAYLLKVGRYWVEELDIDGWRLDVANEVDHAFWREFRKEVRSVKPDVYILGEIWHDSMPWLQGDQFDAVMNYRYTSAALDFLAKEDMTASEFADELTRVFMSYPENVNQVAFNLLDSHDTPRLLTHCGGDGKKADLLYVTQMTVPGTPCIYYGDEVGMAGENDPGCRACMIWDEEKQDRERFAFLKKWIALRAAHPVLGSEGSFEFLPVQNDDVVSYKREKEDVSYYIVINRSEDEINWQTPKKLVGKAVKNVWTGESLTLEKSVVLAPQSFFVFLFK

SEQ ID NO: 1797 - DNA, 2247 bp, BACILLUS SP. KR-8104
acgcctgagaaatatccggagctggaaaaaacgctcaataaactttccggaaaaattacggacgatgagatgagaaacatgaattatcttgtaaacgtaaaaggggaatctgctgaaaaagttgcaagagactttttaacgaaggcacagcttttaaaagaatagctggctgacagagaaggggctgtctgaaaagtcctgaagaaagaaatagttaagatcatttcctcctgagcgctcacggcattcaggaggttttttttacccattttttgatgtttgaccttgctagataaccggaacaggtgaaacccgcaggcgaaaagtgctgagaggctcaccgcccgcccaaggataagcgaatgactggagcggaaatcaacagccaagtttaacaaagctttggataaaagcggaaccgggttaggaatgagatccagagatttttcagaatcacccggggacatcagctgaagctgccaagagcaagtgatatgtgaaacagacagggataaatactcatacatgcctattcaaatatcaatccaaatgctcatgtggaaaaaaccccgtccattgtatattcaatattgtaagcgctttaatttactaaaggagagggagcgggtaaatggtaaatctgaaaaggatgatagggattgtgtttgtttttgtgctaacgtttgcactcattcttccggcagaacggtcaagagcagctgacaatgggacgatgatgcagtattttgaatggtatcttccgaatgatggccagcactggaataaaatgaacaatgatgcagcgtatctgtccagtatcggaataacagcactatggattccgccagcttataaaggcacaagccaggcagatgttggctatggcgcctatgatctttatgatctcggagaatttaatcagaaaggcacggtccggacaaaatatggaacaaaaggggagcttgtttcggccattacctctcttcataacagaggcataaatgtatatggtgatgtcgtgatgaatcacaaaggcggagcggattttacggaaactgtaacagcggttgaggtaaacccaaacaaccggaatcaggaaacatccggcgactaccaaattcaagcgtacacaggctttaactttcctggccgcggcaatacctattccagcttcaaatggaattggtatcacttcgatggcacggattatgatcaatccagaaacttaaacagaatctataaattccgcggaaccggcaaggcgtgggattgggaagtttccagcgaatatgggaattatgattacctcctgtacgcagatatcgattacgatcatccggatgttgtaaatgaaatgaaaaagtggggcacttggtatgctaatgagttaaagcttgatggattccgcattgatgcagcgaaacatattaagcattcgttccttggggattgggtaacgtcagtccgcacatctaccggaaaagaaatgtttactgttgctgaatactggcagaataaccttggcgctctgcaaaactatctgaataaaacgggctataatcagtctgtatttgatgttcctcttcactataacttccaggcagcttcatcacagagcggttactatgatatgaggaatctattaaatggaaccgttacctccacaaatcctacgaagtcggttacgtttgtcgataaccatgatacccagcctggacaggcactggaatcaacagtccaaagctggtttaaaccgctcgcatatgcatttatcctaacacgcgagtcaggctatccaaacgtgttttacggagatctttatggaacgaaagggacaagcggcagagaaatacctgcattaaaaacaaagattgaacctttattaaaagccagaaaagattttgcatatggaacgcagcgtgattacatcgataatcaggacgtaatcggctggacgagagaggggaacacctctaaagccaaatccggattggcggctctcattacagacggtccgggcggagcgaagcggatgtatgtcggcacccagaatgccggagaagtctggtatgacataaccggaaaccggacggataaagtgacaattggttctgatggatgggctgcctttaatgtgaacggcggttctgtctccgtctacgtccagcaataaaattgattagcgatagggaagctgatgctgaaagaggatgtaatgtccttttcaagtgtccgcttctttttttt

SEQ ID NO: 1798 - protein, 513 aa, BACILLUS SP. KR-8104
MVNLKRMIGIVFVFVLTFALILPAERSRAADNGTMMQYFEWYLPNDGQHWNKMNNDAAYLSSIGITALWIPPAYKGTSQADVGYGAYDLYDLGEFNQKGTVRTKYGTKGELVSAITSLHNRGINVYGDVVMNHKGGADFTETVTAVEVNPNNRNQETSGDYQIQAYTGFNFPGRGNTYSSFKWNWYHFDGTDYDQSRNLNRIYKFRGTGKAWDWEVSSEYGNYDYLLYADIDYDHPDVVNEMKKWGTWYANELKLDGFRIDAAKHIKHSFLGDWVTSVRTSTGKEMFTVAEYWQNNLGALQNYLNKTGYNQSVFDVPLHYNFQAASSQSGYYDMRNLLNGTVTSTNPTKSVTFVDNHDTQPGQALESTVQSWFKPLAYAFILTRESGYPNVFYGDLYGTKGTSGREIPALKTKIEPLLKARKDFAYGTQRDYIDNQDVIGWTREGNTSKAKSGLAALITDGPGGAKRMYVGTQNAGEVWYDITGNRTDKVTIGSDGWAAFNVNGGSVSVYVQQ

SEQ ID NO: 1799 - DNA, 4677 bp, Thermoactinomyces vulgaris
tgtttccttcgacgatgacgatggtagccatttaccttttgcttaatatgttgcatttgcttgatacgcatctggggcttttgcttttttatgccggaacgcaaattccttttaacacttggcttgtgaaagggtattttgacacgattccccacagtttggatgaagcggcgcggatcgatggagcggggcatctaaccatcttctggaaagtgatattgccgctggcaaaacccattttggcagtcgttttcctctttaatttcatgggtcccatgacggactttctgctgccgcaaattatattgaccagcccggaacaccaaacactggcggtagggctcttcagttttatcaatgatgatttcaaaaagcagtataccctgtttgcggcggggtcggtgttgattgcattgccaattaccgttattttcctgtctctgcaacgctgctttatttccgggctcaccgcgggtgccagcaagggataacgttgaagggggaagagtccatgctgttggaagcgatttttcatgaagcgaaaggaagctatgcttacccgatttcggaaacgcaactgcgggtgagattgcgggcgaaaaaaggggacgtggtgagatgcgaggtgctctatgcggaccgctatgcttcgccggaggaagaactggcacatgcacttgcgggcaaagcagggtccgatgagcgatttgattattttgaggctttactggaatgttccaccaaacgggtgaaatacgtgtttttgttgacaggcccacaaggggaggctgtttattttggcgagaccggtttttccgccgaacggtctaaagcgggggtgttccaatatgcttacatccaccggagcgaagtgtttacgacaccggaatgggcaaaggaggcggtgatctaccagatctttcccgaacgttttgccaatggggatcccagcaatgatccgccgggaacggaacaatgggccaaagacgccagacctcggcacgacagtttttacggcggagatttaaagggggtgatcgaccgtttgccatatttggaggagttgggagtgacggcgctttattttactcccatttttgcttcgccgtcccatcacaaatatgatacagctgattatttggcgattgatccgcaatttggggatttgcccacctttcggcgtttggtggatgaagctcaccggcgcgggatcaaaatcattttggatgccgtgtttaaccatgccggagatcagttttttgcgtttcgggatgttctgcaaaagggagaacagtcgcgatataaggattggtttttcatcgaggattttcccgtttccaagacgtcaagaaccaattatgaaacctttgccgtccaagtgccggccatgcccaaattgcggacggaaaatccggaagtgaaggaatatttgtttgatgtcgcgcgattttggatggagcaggggatcgacggatggagactggatgtggccaatgaggtggatcacgccttttggcgcgagtttcgccgccttgtcaaatccctcaatcccgacgccttgattgtcggagagatttggcatgacgcttccggctggctgatgggagaccaatttgattcggtgatgaattatttgtttcgcgagagtgtgatccgtttttttgccacgggggagatccatgccgaaagatttgacgccgaacttacccgggccaggatgctttatccggaacaggcggcacaagggttatggaacctcctcgactcacacgatacggaacgttttttgacatcgtgtggggggaatgaggcgaaattccgcctggctgttttgtttcagatgacatacctggggacgccgctgatttattacggtgatgagatcgggatggccggagcgacggacccggattgccggcgcccgatgatatgggaggaaaaagagcagaaccgcggcttgtttgagttttataaggaattgattcgcttgcgccatcggctggcatcgctcaccaggggaaatgtccggtcttggcatgccgacaaacaagccaatctttatgcttttgtgcgcacggttcaagaccaacatgtcggtgtggttctcaataatcgtggcgagaagcaaaccgttttgctacaggtgccggaatcgggcggaaaaacttggctggattgtttgaccggagaagaagtgcatggcaaacaagggcaactgaagctgacacttcgcccttaccagggaatgattctctggaatggccggtagattttcggtgcccaaaccagtgattgggatatgattccaggctagtttttggataaaattaggaggatcaaatggcaaacaaacgttatttgattgatgcagtgatcggaaatgacaagatcttggccgttttggaccggtatggagaattgcaccgcttgtggtggccgcagaaagattatgcgcaacatgtgaaccggctatctgccggggttctgatcccaggcaaatcaaaaggggtctggtggtttcatcagcctgcggggaaacatgagcaaacatatgttcatgatgctcccattctaagaacgactgccacgtgcagggagtggcctctggaagttgtgtgcgaagatgaggtggtttccggccggaatgtattgatgcgccattatgtgatcaccaattgcggagaagaggaaatccccctgcaatttgtctcctatacctcttttcacatgggggagatgaaacgttataataccactttgtttgtggggaaaaaagaagcgttggttcattaccggcgggaatttgccgtggctgtcggaagtgtgttgcccacaacccgctttgcggccggttcaaacaaagatcatatcgaccaggggctttttaactgcaacgacattgctatgcacaccgatggcgggtgtttgtgggaattggggctttgcccgccgggagaaagcaagtgcatgactttatttttcgcctttggcaaaacggtagaaaaagcgctggaagagttggaagaggcacggacgttgggatttgaacgtttgcgaagccagaccctggccgactgggaagcctattttggacaagcaaaaccggtacaaacaggttgtgaggaaatggatcgcctttaccgccgttccctcgccgttttccggttgatgacggatggggaatatggaagcatgatcgccgggcctgagtttgacgaagattttgtccggtgcggcggatatgcgtattgttgggggcgggacgctgcgtatattgctaccgcgattgaccgcgcagggtaccatgacagggttcgcgctttttaccgttgggcgatgcaaacgcaaagcagggatggttcatggcaacaacggcattatcttgatggccgcctggccccgcaatgggggttgcaaatcgatgaaaccggttcaatcctgtggggaatgtggcaacattatttgctcacaaatgatcgggcttttcttgatgagatatgggaaagtgtacagaaagccgcgcagtttctcatcctttttatcgacccggaaaccggtttgcccttgccaagccgtgatctgtgggaggagagggaaggggaacacacttattccgcgtcggccgtttgcggtggactcgatgcggcggcggccgtggcagataagctgggggaaaaacggctggcgcaaaactggaaagaggcggcaggagccatacgccgtgcggttgaagagaagtgctgggatccggagcggcaggtcttttatcgtggcttaaagctcatggttcccccggaagaatgggcccacgctgaaaaggaaggaaaacgggggatgattcacgttgacgaaaagggcatttcccgtccgatgctatggcaggacccggtcattgatatcagtttggtgggaatcagtgttcctttcaatttgattgcgccagatgatgaacgaatggtaaaaatggcggaagccattgaaacccatctgaccagtccgatcgtggggggcatcaagcggtatgagaatgatccgtatgttggaggcaacccttggattcttaccaccttgtggctggcgcagttatatatcaaacagggcagaataaaaaaggctctcaaccatctgaagtgggtggtggatcatcgcaccgatttggatctgttgccggagcaggttgaccgtgagacggggaaagcggcttgggtcgtaccgcttacttggtcccacgccatgtttgtgttgaccgtcttggatttgttggagattggggcaattgggccgaaaaaaagttgaacctgggggatttcattggaaaaggcgtgcttgattcaattcaggcacgcctaaaaaatgatgtttccgttgggagcccggcaacataaagagaaatgaacaagagcccaattcaacatacaaacacaatctcatattttttggcgaaaaatatagtataatcaatgatgaaaacgattgcacgacttggtgaataaattttaaaaaggggttttcgagaatggcgaccatcaaagatgtggcaaaattggcggctgtttcgccatcgactgtatcgcgtgtcatcgcgggaagcaaccggatcagcttggaaaccaaacagcgtgtgcaaaaggcgatggaagaattgaactatgttcccaatgcgattgcgcgaagctt

SEQ ID NO: 1800 - protein, 162 aa, Thermoactinomyces vulgaris; identical to SEQ ID NO: 1785

SEQ ID NO: 1801 - protein, 585 aa, Thermoactinomyces vulgaris; identical to SEQ ID NO: 1786

SEQ ID NO: 1802 - protein, 651 aa, Thermoactinomyces vulgaris
MANKRYLIDAVIGNDKILAVLDRYGELHRLWWPQKDYAQHVNRLSAGVLIPGKSKGVWWFHQPAGKHEQTYVHDAPILRTTATCREWPLEVVCEDEVVSGRNVLMRHYVITNCGEEEIPLQFVSYTSFHMGEMKRYNTTLFVGKKEALVHYRREFAVAVGSVLPTTRFAAGSNKDHIDQGLFNCNDIAMHTDGGCLWELGLCPPGESKCMTLFFAFGKTVEKALEELEEARTLGFERLRSQTLADWEAYFGQAKPVQTGCEEMDRLYRRSLAVFRLMTDGEYGSMIAGPEFDEDFVRCGGYAYCWGRDAAYIATAIDRAGYHDRVRAFYRWAMQTQSRDGSWQQRHYLDGRLAPQWGLQIDETGSILWGMWQHYLLTNDRAFLDEIWESVQKAAQFLILFIDPETGLPLPSRDLWEEREGEHTYSASAVCGGLDAAAAVADKLGEKRLAQNWKEAAGAIRRAVEEKCWDPERQVFYRGLKLMVPPEEWAHAEKEGKRGMIHVDEKGISRPMLWQDPVIDISLVGISVPFNLIAPDDERMVKMAEAIETHLTSPIVGGIKRYENDPYVGGNPWILTTLWLAQLYIKQGRIKKALNHLKWVVDHRTDLDLLPEQVDRETGKAAWVVPLTWSHAMFVLTVLDLLEIGAIGPKKS

SEQ ID NO: 1803 - protein, 53 aa, Thermoactinomyces vulgaris
MATIKDVAKLAAVSPSTVSRVIAGSNRISLETKQRVQKAMEELNYVPNAIARS

SEQ ID NO: 1804 - DNA, 477 bp, Bifidobacterium thermophilum
gactcggtcatcaaccacaccaacttaaacgaatcgggcgagggcaccggcgtcgccggcagtcggtccgacggcgatttcaacttaaatgtaataaagtacaccaaagaaaccttccacacctgtttcaatttcatcggcgactacaccaaatccgacgaagtttcaaacttaagcttgaccagcctgcaggacctcgacacaaccaaaaaatacgtgcaacataatttcgccgactacatgaaccgcctgctcgacctcggcgtctacggattccgcgtcgacgcggtaaattccataaacacttccgacgtggcacacatcaatatacagctatacgagaaaaccggccgcaacgccgacgatatcttcttcgagcaggaagtcatcggcaacgcctccgaagccgctcaaataccgcctatcaactatacctttgaacaacaaggtctccgaattcaacttcaccaaccacct

SEQ ID NO: 1805 - protein, 159 aa, Bifidobacterium thermophilum
DSVINHTNLNESGEGTGVAGSRSDGDFNLNVIKYTKETFHTCFNFIGDYTKSDEVSNLSLTSLQDLDTTKKYVQHNFADYMNRLLDLGVYGFRVDAVNSINTSDVAHINIQLYEKTGRNADDIFFEQEVIGNASEAAQIPPINYTFEQQGLRIQLHQPP

SEQ ID NO: 1806 - DNA, 2951 bp, CLOSTRIDIUM SP.
ctgcagagtacgatgatgtcattattatcaggactaggatcgattttttaaaaggcaccagaataaggtttgcctatgatatcataagagaaaataacaataggcttttggcacaaggaatgacggagcatccatttactacactagataaaaagcctgtaaatattaaaaaagttttacctcatgtatatgaaatgcttaataaatgttatggcgatcgctaagaaattgcttaaaagatatgttgcaaacatagcgagaggcggcagcataagatttttcttcagaagatgaatataattgaataagttggttataatggtaagggtagccgattgtactgtggggcattatgcccctatttttttatttataaatatgaaaaacggttgcacaaaccaagatgataatgtaaaataataaaaggaggcgatatgatgagtaggaaacttattaaatatttacctttactagtgctggcatccagtgttttaagcggatgttccaacaatgtgtcaagtatcaaaatagatagatttaataatattagcgcagtaaatggacctggtgaagaagatacatgggccagtgctcaaaaacagggtgttggtacagcaaataattacgtatcaaaagtttggtttacgctggcaaatggcgccatatcagaggtgtactatccaacgatagatactgcagatgtaaaagaaattaaatttattgtcactgatgggaaatcgtttgtctcagatgaaacaaaggatacaataagcaaggtagagaagtttaccgataagtcattaggttataagctagtcaatacagataaaaaaggaaggtataggataacaaaagaaatatttacagatgtaaaacgcaattctctgataatgaaagcaaagtttgaagcattagaaggaagtatacatgactataagctgtatcttgcatacgacccacatattaaaaatcagggaagttacaatgaaggttatgtaataaaggctaataacaatgagatgttgatggcaaaaagagataacgtatatactgctttatcatctaacataggttggaaaggatattcgattgggtactataaagttaatgatattatgactgaccttgacgagaataagcaaatgactaagcattatgatagtgcaaggggcaatatcatagaaggtgcggagatagatcttaagaaaaacagccaatttgaaattgtcttatcgtttggaaatagtgaagatgaggcagtaaaagcatctatagaaactttaagtgagaattatgatagcttaaagagtgcgtatatagacgaatgggaaaaatattgtaatagccttaacaattttaacggaaaagcaaattcactctattacaacagtatgatgatattaaaagcaagcgaagataagacaaataaaggcgcatatattgcatctctttcgattccatggggggatggacaaggtgatgacaatacaggtggctatcatcttgtatggtcaagggatttgtaccatgtagcgaatgctttcattgcggctggagatgttgattctgccaatagatcgctggattaccttgccaaagtggttaaggacaatgggatgattcctcaaaatacttggattagtggtaagccgtattggacaggcattcagcttgatgagcaggcagatccaatcatactcagttatagacttagaaggtatgacctatatgatagtttagttaagccattggcagatttcataataaaaatggggcctaagacaggccaagaaaggtgggaagagataggtggatactcgcctgcaacaatggctgcagaggtagcaggacttacatgtgcagcgtatatagctgagcaaaataaagattatgaatccgcacaaaaatatcaagaaaaagcagataattggcagaagcttatcgacaatcttacttatactgaacatggaccactagaaaatggccaatactatattagaatagctggattacctgatccaaatgcggattttacgataagcatagcgaatggcggtggagtatatgatcaaaaagaaatagtagatccgagttttctggagcttgtaaggcttggagttaaatcgccagatgatcctaaaatattaaatacgttaagagttgttgatagcacaatcaaagttgatacgccaaaggggccgtcgtggtacagatataatcatgatggatatggtgagccatcaaagacagaactgtatcatggcgcaggaaagggaagattgtggcctcttcttactggtgagagaggcatgtacgaaattgccgcaggaaaagatgcgacaccgtatttaaaagcaatggagaattttgcaaacgaaggtggcataatatctgagcaggtttgggaggataccggtcttccaactgattccgcatcacctcttaattgggcacatgcagaatacgtagtattatttccgtcaaatatagaacacaaggtacttgatatgccggatattgtctataaaaggtatgttgcaaagtaaagcacagattttccggataagtatgtccggggaatctattttttattgcttaaatgaagtataattgtgtatgagaatatggatttggagtgataattattgcaaaacatcaacatcggcgataaatacgaaatatacattgataatatggcgcatgaaggacaaggagtcggaaggcttgatggaatagctgtttttgtaagaggcgctttaaaaggagaaagggtcttagctaaaatagatgaaaaacacaaaaattatttaaatgcacatgtagaaaaaatcttattgccatcacaggaaagaattatgccgaagtgcatctacgctggcaagtgcggcggttgcacattacagcatttaagctataaaggacaattggaatttaaaaaacaagtcgttgac

SEQ ID NO: 1807 - protein, 702 aa, CLOSTRIDIUM SP.
MSRKLIKYLPLLVLASSVLSGCSNNVSSIKIDRFNNISAVNGPGEEDTWASAQKQGVGTANNYVSKVWFTLANGAISEVYYPTIDTADVKEIKFIVTDGKSFVSDETKDTISKVEKFTDKSLGYKLVNTDKKGRYRITKEIFTDVKRNSLIMKAKFEALEGSIHDYKLYLAYDPHIKNQGSYNEGYVIKANNNEMLMAKRDNVYTALSSNIGWKGYSIGYYKVNDIMTDLDENKQMTKHYDSARGNIIEGAEIDLKKNSQFEIVLSFGNSEDEAVKASIETLSENYDSLKSAYIDEWEKYCNSLNNFNGKANSLYYNSMMILKASEDKTNKGAYIASLSIPWGDGQGDDNTGGYHLVWSRDLYHVANAFIAAGDVDSANRSLDYLAKVVKDNGMIPQNTWISGKPYWTGIQLDEQADPIILSYRLRRYDLYDSLVKPLADFIIKMGPKTGQERWEEIGGYSPATMAAEVAGLTCAAYIAEQNKDYESAQKYQEKADNWQKLIDNLTYTEHGPLENGQYYIRIAGLPDPNADFTISIANGGGVYDQKEIVDPSFLELVRLGVKSPDDPKILNTLRVVDSTIKVDTPKGPSWYRYNHDGYGEPSKTELYHGAGKGRLWPLLTGERGMYEIAAGKDATPYLKAMENFANEGGIISEQVWEDTGLPTDSASPLNWAHAEYVVLFPSNIEHKVLDMPDIVYKRYVAK

SEQ ID NO: 1808 - DNA, 2133 bp, Clostridium thermoamylolyticum
atgttattggaggcgatgaaattgaatagaaaacttataaaatatttacccgtactatttcttgcgtccagtgtgctaagtggatgcgctaacaataatatatcaaacattaaaattgagagattgaataatgtacaagcagtaaatggccctggagaggctgatacttgggctaaagctcagaaacaaggtgtagggactgcaaacaactatacttccaaagtatggtttaccattgcagacggagggatatctgaggtttactatccgactatagatactgctgatgtaaaggatattaaattctttgtgacagatggaaaaacgtttgtctcagatgagacaaaagacacaataaccaaagtcgaaaagtttactgaaaaatcgttggggtataaaatcattaacacagataaagaagggagatataagataactaaagaaatatttacggatgtaaagaggaattctctcgtaattaaaacgaagtttgaagccttaaaaggcaatgttgatgattacaggctttacgtaatgtgtgatcctcatgtaaaaaatcagggcaaatataatgaaggatatgcagttaaggcaaatggcaatgttgcgctaattgctgaaagagatggaatttacactgcattgtcatctgacataggatggaaaaagtattcgatagggtattataaagtaaatgacattgagaccgatctttataaaaatatgcaaatgacttacaattacgacagtgcaagaggcaacatcatagaaggtgctgagatagatcttaagaaaaacaggcaatttgaaatcgttctgtctttcggacagagtgaagacgaggcagtaaaaacaaacatggaaactttaaatgataattatgacagcttaaagaaagcgtatatagaccaatgggagaagtattgcgatagccttaatgactttggaggaaaagcaaattcactgtattttaacagtatgatgatattaaaggccagtgaagacaagacaaacaaaggtgcttatatagcatcgctatctattccgtggggtgatggccaagaagatgacaatattggtggctaccatctcgtatggtcaagagatctgtaccatgtagcgaatgcatttattgttgctggtgatactgattcggcaaatagagcactggattatttagacaaagtagtgaaagacaatggaatgattcctcaaaatacatggataaatggaaggccttattggacaggcatacagcttgatgagcaggcggatccaataatattaagctataggttgaaaagatacgatctctatgaaagtcttgttaagcctttggcggatttcatcatgaaaataggccctaagacgggacaagaaagatgggaagaaataggtggatattcgccagcaacattggcttcagaagtagctggacttacatgtgctgcgtatatagctgaacaaaataaggactttgaatctgctaaaaaatatcaagaaaaggcggataattggcaaaggcttattgacaacctaacttacacagaaaaaggcccattgggagatggtcactattatataaggatagcagggcttccagatccaaatgccgatttcatgataagcatagcgaatggcggtggtgtatacgaccaaaaagaaatcgtggatccaagttttctggaacttgtaaggcttggagtaaaatcagcagatgaccctaaaatactaaatacgctgaaagtcgtggatgaaacaataaaagtcgatacaccgaaaggaccatcatggtataggtataatcatgatggatatggtgagatgtctaagacagaactatatcatgggacaggaaaaggaagattgtggccactgcttacaggtgagagaggcatgtacgaaattgctgcaggaaaagatgcaacatcttatgtgaaagcaatggagaactttgcaaacgaaagcggtataatatctgagcaagtatgggaagatactggacttcctactgattcagcatcaccgcttaattgggcacatgctgaatatgtgatattatttgcatcaaatatagaacacaaggtacttgatatgccagacatcgtttataaaaggtatgcttcaaagtga

SEQ ID NO: 1809 - protein, 710 aa, Clostridium thermoamylolyticum
MLLEAMKLNRKLIKYLPVLFLASSVLSGCANNNISNIKIERLNNVQAVNGPGEADTWAKAQKQGVGTANNYTSKVWFTIADGGISEVYYPTIDTADVKDIKFFVTDGKTFVSDETKDTITKVEKFTEKSLGYKIINTDKEGRYKITKEIFTDVKRNSLVIKTKFEALKGNVDDYRLYVMCDPHVKNQGKYNEGYAVKANGNVALIAERDGIYTALSSDIGWKKYSIGYYKVNDIETDLYKNMQMTYNYDSARGNIIEGAEIDLKKNRQFEIVLSFGQSEDEAVKTNMETLNDNYDSLKKAYIDQWEKYCDSLNDFGGKANSLYFNSMMILKASEDKTNKGAYIASLSIPWGDGQEDDNIGGYHLVWSRDLYHVANAFIVAGDTDSANRALDYLDKVVKDNGMIPQNTWINGRPYWTGIQLDEQADPIILSYRLKRYDLYESLVKPLADFIMKIGPKTGQERWEEIGGYSPATLASEVAGLTCAAYIAEQNKDFESAKKYQEKADNWQRLIDNLTYTEKGPLGDGHYYIRIAGLPDPNADFMISIANGGGVYDQKEIVDPSFLELVRLGVKSADDPKILNTLKVVDETIKVDTPKGPSWYRYNHDGYGEMSKTELYHGTGKGRLWPLLTGERGMYEIAAGKDATSYVKAMENFANESGIISEQVWEDTGLPTDSASPLNWAHAEYVILFASNIEHKVLDMPDIVYKRYASK

SEQ ID NO: 1810 - DNA, 9244 bp, Thermoactinomyces vulgaris
atggcaacttttggggccggatgtttttggggagtggaagaaacgttccgccaagttccgggggtaattgacaccgccgtcggttacatgggcggtacgacagaaaatcctacatacgaagaggtttgtaccgacaaaaccggccatgcggaagtcgtacaagtggaatatgacccggaacaagtgagttatgaggaactgctgaatgttttttgggacaatcataacccgacgacgttaaaccgccaaggccccgatgtgggaaccaatatcgctcggttattttttaccacactgaagagcaaagaaattccgcagaaaaatccaaagcggaaatggatcaaagcgggcgttggaaaaatccgattgtgacggagattgtcccggccagcactttttggcgggcggaggagtaccaccaacgttacctgcaaaaacgcgggcttgggtcctgccatttgtaagggaagggcgctgttcaaataagaacggcgcctttttttggatgagccaatcatgcgtcatctcattggatggacaagggtcgtgatggttcgagagggcgtatccagcagcgttttcccctatgctccacctcgatcggcgtatcaaaaaagtcactaaggagttcctcggtcaaaacatgggaagtggggcctgcccgaaaaatctctccttgtttgagaagcaacgtatgggtaaagcaatttgtaatctcttccacatggtgcgtgacatagatcagggcaggggattgggggtgcgcgctaatggattgaatggaatgaagcaattgttcacgggcaaacaggtcaagcccggtacagggttcatccaatatcataagctggggggaggccattaatgccctggcaatcagcactttttgcttttccccttgggaaagggtttgataggtttgggtaataagatggccgcaccccatcatttccagcagggcagccgctttttccatgtcaattttttccggtttgtcgtagaggccgatcgaagcgaattttccgctgagaacgatgttgatggcagtttcgtggttgtgaagttgttgtgccagggatgaactgacccagccgatctttttgcgaagttcgcgcaaattgacttcgccaaactttttcccgaataatttgacggttccggttgtcggccaaatataaccgtttaccaaattcaagagcgtggttttgcctgaaccgtttaacccgatcaggcaccagttttcaccgggctgcacttgccaggagatatttttcaaaatcattttcccttcgcgcatccaggaaacgctattcatttcgataatcataccggggctcctttatctagagtatctatgattcttttcattatactgcaaacggcaaacgattgaaggatcatggaaaacggtttccttagcaaagggggggaagacaaaataaaaatggcttgatcacagatgcattcaagtgtaaaatgaagccgtgaaaccgttttcttggattttatttttttcgcattttatgcaaacgattgcgcaaagagggggttgcaacatgagaaaattcttatcactggcactaattagtgcccttgtcatcggtctgttgacggcttgcgggccaaagcgggatccctatgccaaagcggggaaaagtgaaggaaagccagacaaattggtggtttgggaaaatgctgatgatggtgtgcaattgaacaatacgaaaaagtgggcgggagagttcacgaaaaagactggcatccaagtggaagtggtaccggttgctcttttaaaacaacaagaaaaattgacgctggatggaccggcgggcaaaggagccgatctggtaacttggccccatgaccggttgggtgaagcagttaccaagggattgctgcagccgatccaagtggataattcggtaaaaaaccaatttgatgatgtggccatgaaagctttgacctatggcgggaaactgtatggtttgcccaaggcgatcgaaagtgtggcgctgatttacaacaaaaaattgatgggccaagtgccggccacttatgatgaattgttccaatatgcgaaagcgaacaacaagccggatgaacaaaaatatggtgtcctgtttgaagcgaacaacttctattacacctatttcctgtttgcggccaaaggcgctgcggttttcaaagaacaggatggtaccttggatccaaacgagatcggcctaaacagccctgaagcagttcaaggaatgaacgaagtgcagaaatggtttacggaagcccgtcttccgcaaagtttgaaagccgacacagttaacggcctgttcaagtctggtaaagtggcggccgtaatcaatgggccgtgggcgatcaaagactaccaagctgccgggatcaatgtgggggttgctccgcttccgaaaatcgatggaaaggatgcgcaaacctttatcggggtgaagggatggtatttgtcggcttacagcaaatatccaaaatatgcgaccgaattgatgcaatttttgacgagtaaagaagcgctcgcttcacgctttaaggaaacgggcgaaattccgccgcaaaaagagttgctaaacgatccgatgatcaaaaataacccggttgtcaatgggtttgccaagcaagcaagcaagggggttccaatgccgagcattccggagatgggagtcgtatgggaaccgatcaacaatgcccatacgtttgtggcgcaaggaaagcaaacacccgaacaggctctgaatgatgcggtgaagatcatgaaagaaaaaatccaaacgatgaaacagtaatggttcggctcgtgtatttctgataaatcggaatttgataaatcatttaggaacggaaggtgcggtggtcggcatcgcgcctttttcgcaaaaaaatagaagaagggggagagcgcggtggagaaagatgagcggcttcagcaaagcaagcgaaaaatcgcggcggttttatcggcgctgtcaatggggcttgggcaaatgtacaacgggcagtgggttaaaggggttttatttctggtatgcaggttatcctatctcttggtgttttatgatttattcaatctcggcttgtgggggatcgtcacgttgggaacaattcccggggtggacaattccatggagctgttggcggaagggttgatttctcttttattgattttgttcgggctgtttttttatgggttgaacattcgcgatgcgtataaagtgggagcgatgagggagcgcggcattcgcccgcccggggtgatggaaacctgccgccatgtcactgaccggggctttccctattttgtgatggcgccgtcgatgattctgttgatgtttattgtattgtttcccattttgttcatggtgaccatcgcattcaccaattttgatttataccaccaaccgccggccaaattggtaagctatgtcggagtggacaatttcattaacctgtttcggctgagtttttggaaaaactcttttttgggcgtgctttcgtggactgttgtatggacacttgtttctaccacggtgcaggtggcgctgggcttgtttttggccgttctcctcaaccaaaagcggctcaggatcaaaaaatttttccggacggtattaattttgccttgggcagtgccatcttttgtaaccattctcgttttctccggactgtttgatgataatttcggcccggtcaatcattttttggttgccctcggattaaaggcgatcccgtggatgtccgatccattttggtgcaaagtggctgtcttgctaattcagttttggctcggatttccatttagcttggccttgtataccggcgttctgcagtcgatctcaagggatctttatgaagcggctgaggtggacggggctaccgtttggcagaagttccgccatattaccttacccatggccctttattccaccgccccgttgctgattgtccaatatgccggaaattttaataattttaatgtgatttatctatttaataaaggattgccggcggtccccggacaaacggcgggcggaacggacattttgatttcttgggtatacaaactgacctttgaaacgtccaagtacaattatgcggccgccatttcgattatgatcggtttgattgtggcggtgctggcggtttggcagttccgcaacacccgttcgtttaaagaggagggaatgatccagtgagtagcaaaaaatggagatcccatgtgggtctcaccctcagttatctggtgttgattgggatggcggtgctctctgtctatcccgtgctatgggtgattggagcttcctttagcccgggggacaccattttttccacttcgctgattcccaagcatgcgacgctggatcactacaaatggctcttcttcaatccagatagccaatacccgacttggtacctgaacacgctgaaaattgctttgatcaatggtgtggtttccgtcctcatcacgaccggcacggcttatgtattttcgcggtaccgttttgccgggcgccagtacgggttgatgtcctttttgatcctgcagatgtttccttcgacgatgacgatggtagccatttaccttttgcttaatatgttgcatttgcttgatacgcatctggggcttttgcttttttatgccggaacgcaaattccttttaacacttggcttgtgaaagggtattttgacacgattccccacagtttggatgaagcggcgcggatcgatggagcggggcatctaaccatcttctggaaagtgatattgccgctggcaaaacccattttggcagtcgttttcctctttaatttcatgggtcccatgacggactttctgctgccgcaaattatattgaccagcccggaacaccaaacactggcggtagggctcttcagttttatcaatgatgatttcaaaaagcagtataccctgtttgcggcggggtcggtgttgattgcattgccaattaccgttattttcctgtctctgcaacgctgctttatttccgggctcaccgcgggtgccagcaagggataacgttgaagggggaagagtccatgctgttggaagcgatttttcatgaagcgaaaggaagctatgcttacccgatttcggaaacgcaactgcgggtgagattgcgggcgaaaaaaggggacgtggtgagatgcgaggtgctctatgcggaccgctatgcttcgccggaggaagaactggcacatgcacttgcgggcaaagcagggtccgatgagcgatttgattattttgaggctttactggaatgttccaccaaacgggtgaaatacgtgtttttgttgacaggcccacaaggggaggctgtttattttggcgagaccggtttttccgccgaacggtctaaagcgggggtgttccaatatgcttacatccaccggagcgaagtgtttacgacaccggaatgggcaaaggaggcggtgatctaccagatctttcccgaacgttttgccaatggggatcccagcaatgatccgccgggaacggaacaatgggccaaagacgccagacctcggcacgacagtttttacggcggagatttaaagggggtgatcgaccgtttgccatatttggaggagttgggagtgacggcgctttattttactcccatttttgcttcgccgtcccatcacaaatatgatacagctgattatttggcgattgatccgcaatttggggatttgcccacctttcggcgtttggtggatgaagctcaccggcgcgggatcaaaatcattttggatgccgtgtttaaccatgccggagatcagttttttgcgtttcgggatgttctgcaaaagggagaacagtcgcgatataaggattggtttttcatcgaggattttcccgtttccaagacgtcaagaaccaattatgaaacctttgccgtccaagtgccggccatgcccaaattgcggacggaaaatccggaagtgaaggaatatttgtttgatgtcgcgcgattttggatggagcaggggatcgacggatggagactggatgtggccaatgaggtggatcacgccttttggcgcgagtttcgccgccttgtcaaatccctcaatcccgacgccttgattgtcggagagatttggcatgacgcttccggctggctgatgggagaccaatttgattcggtgatgaattatttgtttcgcgagagtgtgatccgtttttttgccacgggggagatccatgccgaaagatttgacgccgaacttacccgggccaggatgctttatccggaacaggcggcacaagggttatggaacctcctcgactcacacgatacggaacgttttttgacatcgtgtggggggaatgaggcgaaattccgcctggctgttttgtttcagatgacatacctggggacgccgctgatttattacggtgatgagatcgggatggccggagcgacggacccggattgccggcgcccgatgatatgggaggaaaaagagcagaaccgcggcttgtttgagttttataaggaattgattcgcttgcgccatcggctggcatcgctcaccaggggaaatgtccggtcttggcatgccgacaaacaagccaatctttatgcttttgtgcgcacggttcaagaccaacatgtcggtgtggttctcaataatcgtggcgagaagcaaaccgttttgctacaggtgccggaatcgggcggaaaaacttggctggattgtttgaccggagaagaagtgcatggcaaacaagggcaactgaagctgacacttcgcccttaccagggaatgattctctggaatggccggtagattttcggtgcccaaaccagtgattgggatatgattccaggctagtttttggataaaattaggaggatcaaatggcaaacaaacgttatttgattgatgcagtgatcggaaatgacaagatcttggccgttttggaccggtatggagaattgcaccgcttgtggtggccgcagaaagattatgcgcaacatgtgaaccggctatctgccggggttctgatcccaggcaaatcaaaaggggtctggtggtttcatcagcctgcggggaaacatgagcaaacatatgttcatgatgctcccattctaagaacgactgccacgtgcagggagtggcctctggaagttgtgtgcgaagatgaggtggtttccggccggaatgtattgatgcgccattatgtgatcaccaattgcggagaagaggaaatccccctgcaatttgtctcctatacctcttttcacatgggggagatgaaacgttataataccactttgtttgtggggaaaaaagaagcgttggttcattaccggcgggaatttgccgtggctgtcggaagtgtgttgcccacaacccgctttgcggccggttcaaacaaagatcatatcgaccaggggctttttaactgcaacgacattgctatgcacaccgatggcgggtgtttgtgggaattggggctttgcccgccgggagaaagcaagtgcatgactttatttttcgcctttggcaaaacggtagaaaaagcgctggaagagttggaagaggcacggacgttgggatttgaacgtttgcgaagccagaccctggccgactgggaagcctattttggacaagcaaaaccggtacaaacaggttgtgaggaaatggatcgcctttaccgccgttccctcgccgttttccggttgatgacggatggggaatatggaagcatgatcgccgggcctgagtttgacgaagattttgtccggtgcggcggatatgcgtattgttgggggcgggacgctgcgtatattgctaccgcgattgaccgcgcagggtaccatgacagggttcgcgctttttaccgttgggcgatgcaaacgcaaagcagggatggttcatggcaacaacggcattatcttgatggccgcctggccccgcaatgggggttgcaaatcgatgaaaccggttcaatcctgtggggaatgtggcaacattatttgctcacaaatgatcgggcttttcttgatgagatatgggaaagtgtacagaaagccgcgcagtttctcatcctttttatcgacccggaaaccggtttgcccttgccaagccgtgatctgtgggaggagagggaaggggaacacacttattccgcgtcggccgtttgcggtggactcgatgcggcggcggccgtggcagataagctgggggaaaaacggctggcgcaaaactggaaagaggcggcaggagccatacgccgtgcggttgaagagaagtgctgggatccggagcggcaggtcttttatcgtggcttaaagctcatggttcccccggaagaatgggcccacgctgaaaaggaaggaaaacgggggatgattcacgttgacgaaaagggcatttcccgtccgatgctatggcaggacccggtcattgatatcagtttggtgggaatcagtgttcctttcaatttgattgcgccagatgatgaacgaatggtaaaaatggcggaagccattgaaacccatctgaccagtccgatcgtggggggcatcaagcggtatgagaatgatccgtatgttggaggcaacccttggattcttaccaccttgtggctggcgcagttatatatcaaacagggcagaataaaaaaggctctcaaccatctgaagtgggtggtggatcatcgcaccgatttggatctgttgccggagcaggttgaccgtgagacggggaaagcggcttgggtcgtaccgcttacttggtcccacgccatgtttgtgttgaccgtcttggatttgttggagattggggcaattgggccgaaaaaaagttgaacctgggggatttcattggaaaaggcgtgcttgattcaattcaggcacgcctaaaaaatgatgtttccgttgggagcccggcaacataaagagaaatgaacaagagcccaattcaacatacaaacacaatctcatattttttggcgaaaaatatagtataatcaatgatgaaaacgattgcacgacttggtgaataaattttaaaaaggggttttcgagaatggcgaccatcaaagatgtggcaaaattggcggctgtttcgccatcgactgtatcgcgtgtcatcgcgggaagcaaccggatcagcttggaaaccaaacagcgtgtgcaaaaggcgatggaagaattgaactatgttcccaatgcgattgcgcgaagct

SEQ ID NO: 1811 - protein, 123 aa, Thermoactinomyces vulgaris
MATFGAGCFWGVEETFRQVPGVIDTAVGYMGGTTENPTYEEVCTDKTGHAEVVQVEYDPEQVSYEELLNVFWDNHNPTTLNRQGPDVGTNIARLFFTTLKSKEIPQKNPKRKWIKAGVGKIRL

SEQ ID NO: 1812 - protein, 266 aa, Thermoactinomyces vulgaris
MIIEMNSVSWMREGKMILKNISWQVQPGENWCLIGLNGSGKTTLLNLVNGYIWPTTGTVKLFGKKFGEVNLRELRKKIGWVSSSLAQQLHNHETAINIVLSGKFASIGLYDKPEKIDMEKAAALLEMMGCGHLITQTYQTLSQGEKQKVLIARALMASPQLMILDEPCTGLDLFAREQLLHSIQSISAHPQSPALIYVTHHVEEITNCFTHTLLLKQGEIFRAGPTSHVLTEELLSDFFDTPIEVEHRGKRCWIRPLEPSRPLSIQ

SEQ ID NO: 1813 - protein, 417 aa, Thermoactinomyces vulgaris
MRKFLSLALISALVIGLLTACGPKRDPYAKAGKSEGKPDKLVVWENADDGVQLNNTKKWAGEFTKKTGIQVEVVPVALLKQQEKLTLDGPAGKGADLVTWPHDRLGEAVTKGLLQPIQVDNSVKNQFDDVAMKALTYGGKLYGLPKAIESVALIYNKKLMGQVPATYDELFQYAKANNKPDEQKYGVLFEANNFYYTYFLFAAKGAAVFKEQDGTLDPNEIGLNSPEAVQGMNEVQKWFTEARLPQSLKADTVNGLFKSGKVAAVINGPWAIKDYQAAGINVGVAPLPKIDGKDAQTFIGVKGWYLSAYSKYPKYATELMQFLTSKEALASRFKETGEIPPQKELLNDPMIKNNPVVNGFAKQASKGVPMPSIPEMGVVWEPINNAHTFVAQGKQTPEQALNDAVKIMKEKIQTMKQ

SEQ ID NO: 1814 - protein, 407 aa, Thermoactinomyces vulgaris
MGLGQMYNGQWVKGVLFLVCRLSYLLVFYDLFNLGLWGIVTLGTIPGVDNSMELLAEGLISLLLILFGLFFYGLNIRDAYKVGAMRERGIRPPGVMETCRHVTDRGFPYFVMAPSMILLMFIVLFPILFMVTIAFTNFDLYHQPPAKLVSYVGVDNFINLFRLSFWKNSFLGVLSWTVVWTLVSTTVQVALGLFLAVLLNQKRLRIKKFFRTVLILPWAVPSFVTILVFSGLFDDNFGPVNHFLVALGLKAIPWMSDPFWCKVAVLLIQFWLGFPFSLALYTGVLQSISRDLYEAAEVDGATVWQKFRHITLPMALYSTAPLLIVQYAGNFNNFNVIYLFNKGLPAVPGQTAGGTDILISWVYKLTFETSKYNYAAAISIMIGLIVAVLAVWQFRNTRSFKEEGMIQ

SEQ ID NO: 1815 - protein, 260 aa, Thermoactinomyces vulgaris
MAVLSVYPVLWVIGASFSPGDTIFSTSLIPKHATLDHYKWLFFNPDSQYPTWYLNTLKIALINGVVSVLITTGTAYVFSRYRFAGRQYGLMSFLILQMFPSTMTMVAIYLLLNMLHLLDTHLGLLLFYAGTQIPFNTWLVKGYFDTIPHSLDEAARIDGAGHLTIFWKVILPLAKPILAVVFLFNFMGPMTDFLLPQIILTSPEHQTLAVGLFSFINDDFKKQYTLFAAGSVLIALPITVIFLSLQRCFISGLTAGASKG

SEQ ID NO: 1816 - protein, 585 aa, Thermoactinomyces vulgaris; identical to SEQ ID NO: 1786

SEQ ID NO: 1817 - protein, 651 aa, Thermoactinomyces vulgaris; identical to SEQ ID NO: 1802

SEQ ID NO: 1818 - protein, 53 aa, Thermoactinomyces vulgaris; identical to SEQ ID NO: 1803

SEQ ID NO: 1819 - DNA, 2416 bp, Thermoanaerobacterium thermosaccharolyticum
tttggcacaaggaatgacggagcatccatttactacactagataaaaagcctgtaaatattaaaaaagttttacctcatgtatatgaaatgcttaataaatgttatggcgatcgctaagaaattgcttaaaagatatgttgcaaacatagcaagaggcggcagtataagatttttcttcagaagatgaatataattgaataagttggttataatggtaagggtagccgattgtactgtggggcattatgcccctattttttatttataaatatgaaaaaaggttgcacaaaccaggatgataatgtaaaataataaaaggaggcgatatgatgagtaggaaacttattaaatatttacctttactagtgctggcatccagtgttttaagcggatgttccaacaatgtgtcaagtatcaaaatagatagatttaataatattagcgcagtaaatggacctggtgaagaagatacatgggccagtgctcaaaaacagggtgtcggtacagcaaataattacgtatcaaaagtttggtttacgctggcaaatggcgccatatcagaggtgtactatccaacgatagatacagcagatgtaaaagaaattaaatttattgtgactgatgggaaatcgtttgtcccagatgaaacaaaggatgcaataagcaaggtagagaagtttaccgataagtcattaggttataagctagtcaatacagataaaaaaggaaggtataggataacaaaagatattacagatgtaaaacgcaattctctgataatgaaagcaaagtttgaagcattagaaggaagtatacatgactataagctgtatcttgcatacgacccacatattaaaaatcagggaagttacaatgaaggttatgtaataaaggctaataacaatgagatgttgatggcaaaaagagataacgtatatactgctttatcatctaacataggttggaaaggatattcgattgggtactataaagttaatgatattatgactgaccttgacgagaataagcaaatgactaagcattatgatagtgcaaggggcaatatcatagaaggggcagagattgatttaacaaaaaacagcgaatttgaaatcgttctgtcatttggtggaagcgatagtgaggcagcaaaaacggccttagagactcttggggaagattataacaatttaaaaaataactatatagatgaatggactaaatattgcaatactctcaataatttcaatggcaaagcaaattcactctattacaacagcatgatgatattaaaagcaagcgaagataagacaaacaaaggcgcatatattgcatctctttcgattccatggggggatggacaaagggatgacaatacaggcggctatcatctcgtatggtcaagagatttgtaccatgtagcgaatgctttcattgcggctggagatgttgattctgccaatagatcgctggattaccttgccaaagtggttaaggacaatggcatgattcctcaaaatacttggattagtggtaagccctattggacaggcattcagctagatgagcaggcagatccaatcatactcagctataggctgaaaagatacgatctatatgacagcttagttaagccattggcagatttcataataaagatagggcctaagacagggcaagaaagatgggaagagataggtggatactcgcctgcaacaatggctgcagaggtagcaggacttacatgtgcagcgtatatagctgagcaaaataaagattatgagtcagcacaaaaatatcaagaaaaagcagataattggcagaagcttatcgacaatcttacttacactgaaaatggaccactaggaaatggccaatactatattagaatagctggtctgtctgatccagatgcagactttatgataaacatagcaaatggcggtggagtatatgatcaaaaagaaatagtagatccaagttttctggaacttgtaaggcttggagttaaatcggcagatgatcctaaaatattaaatacgttaaaagttgttgatagcacaatcaaagttgatacgccaaaggggccatcgtggtacagatataatcatgatgggtatggtgaaccatcaaagacagaactgtatcatggcgcaggaaaaggaagattgtggcctcttcttactggtgagagaggcatgtacgaaattgccgcaggaaaagatgcaacgccatatgtaaaagcaatggagaagtttgcaaacgaaggtggcataatatctgagcaggtttgggaggataccggtcttccaactgattcagcatcacctcttaattgggcacatgccgaatacgtaatattatttgcatcaaatatagagcataaagtgctagatatgccggatattgtctatg

SEQ ID NO: 1820 - protein, 695 aa, Thermoanaerobacterium thermosaccharolyticum
MSRKLIKYLPLLVLASSVLSGCSNNVSSIKIDRFNNISAVNGPGEEDTWASAQKQGVGTANNYVSKVWFTLANGAISEVYYPTIDTADVKEIKFIVTDGKSFVPDETKDAISKVEKFTDKSLGYKLVNTDKKGRYRITKDITDVKRNSLIMKAKFEALEGSIHDYKLYLAYDPHIKNQGSYNEGYVIKANNNEMLMAKRDNVYTALSSNIGWKGYSIGYYKVNDIMTDLDENKQMTKHYDSARGNIIEGAEIDLTKNSEFEIVLSFGGSDSEAAKTALETLGEDYNNLKNNYIDEWTKYCNTLNNFNGKANSLYYNSMMILKASEDKTNKGAYIASLSIPWGDGQRDDNTGGYHLVWSRDLYHVANAFIAAGDVDSANRSLDYLAKVVKDNGMIPQNTWISGKPYWTGIQLDEQADPIILSYRLKRYDLYDSLVKPLADFIIKIGPKTGQERWEEIGGYSPATMAAEVAGLTCAAYIAEQNKDYESAQKYQEKADNWQKLIDNLTYTENGPLGNGQYYIRIAGLSDPDADFMINIANGGGVYDQKEIVDPSFLELVRLGVKSADDPKILNTLKVVDSTIKVDTPKGPSWYRYNHDGYGEPSKTELYHGAGKGRLWPLLTGERGMYEIAAGKDATPYVKAMEKFANEGGIISEQVWEDTGLPTDSASPLNWAHAEYVILFASNIEHKVLDMPDIVY

SEQ ID NO: 1821 - DNA, 2016 bp, CHAETOMIUM THERMOPHILUM
ctgcctgaccaggcaatgccgcgacgctatcatctgtcaaaaaatggctgaacgcctctaagtcagaatccgtgatgtccgcatcggtcctgttggtctttgcacagcacgaagtatcgggtgccgcatcgcacgcaccccagtgggctaatctccaacgctcagcggtcgattcctacattgagcgtgagacccctatcgcgtggaacgctttgctgaacaacataggcccatgcggcgattgcgtcacgggagcggcctgcggaatcgtcgtggcgaggccctgcaagtccgaccctgattacttctaccagtggcagcgagacgccgctctgcaaggtcaaattccgagcatacgattgcataggggacagcaagaatttagccacgaaattcagcagcacagccaggcacaagctattcttcagttaatatggaacccgtcaggtgacaatggcgaggcctggggcttgggcgaacctaggttcatggttgacggcttcattcacagctggttccagggctggggaagtccacagcgggatggcccggcgttgagtgcaattgcatttattcaaacacacagctggcttaaggacatggggcaagcaccccacgcgaagttaataatctggcctatcgttaaaaacgatctcacgtaccacggtcaatactggaataattcgggccaggacctttgggaagaggtattgcaaaccaccttcttccaaattgccgaacagcacagcgcgcttctagaaggcgcgaactttgcattcctttccggccctcaatgcattagctgcgaccaggcgccgcaggttttatgtttccaaggcaggttctggaaaggccaccaatgctataatagcggcaggccccggagcgggttagactttaactgcgagctaggctcgatccaaatgttcgaccccaaggcggaatgcgatcaaattcaattccagcctcatagggacagcgcgctagctaatcacaaggttgttcaagactcgttccgctaccacggctgtaataacggccaccagtggggcgacgccgttgccgtaggaagttacccggaattcgtatactataatggcatgccatggtaccttgccattcaggcggccgcggagcagctttacgacgccgtttatcaatggcaagatgttgaatggattcacatgggcattcaatcccttgtgttcttccacgcggatgtactaacctcggcggccgggcaatacaccaggtcccacacgacgtatcaaaatatccacgacgctgttaagacctacgccgacggcttcgtttcggttgtatcgtgtgccaagtaccaccccaggaacgggaccctacatgagggcgaacataggaatgacggcaagcccgactcggccagccacttgcactggaggtatgcggccttgttgtgcgccatacacagcagggcgacccaagtacctgcctcgtggggcgaggcgtgcgcgacgagccccggggtgtgcaccgccattgagcaatcagggcattactccacggcccataatcaatcctggccgtccgcgtgcagtcaacaacatcataggcagaccccgtgccactgccaacatcccgtggcctaccatttcaatggcattcaacaatacggcgaaatctacgttcttggaacgatacccgcgctgggcaactggagggactggggctgtcacctgagggccgacaaatataccaactcggaccagatttggtattccattgtacaacttccagcgggcgaaagggccgtttataagtatatacgcaaatgggaaggcagggtcgacccgaaccggctcacgcaagttcaggactgtggtcaagaccactggtgagtcacttcagtcgtctgcagaggatttatccccgcgcgtggtgacattgcaatccgccagccagctcccggggcttctcccgagggacgtcgtcagcctgctgaggtacatgacccggagctaatcgaaaaaaaaaaaaaaa

SEQ ID NO: 1822 - protein, 599 aa, CHAETOMIUM THERMOPHILUM
MSASVLLVFAQHEVSGAASHAPQWANLQRSAVDSYIERETPIAWNALLNNIGPCGDCVTGAACGIVVARPCKSDPDYFYQWQRDAALQGQIPSIRLHRGQQEFSHEIQQHSQAQAILQLIWNPSGDNGEAWGLGEPRFMVDGFIHSWFQGWGSPQRDGPALSAIAFIQTHSWLKDMGQAPHAKLIIWPIVKNDLTYHGQYWNNSGQDLWEEVLQTTFFQIAEQHSALLEGANFAFLSGPQCISCDQAPQVLCFQGRFWKGHQCYNSGRPRSGLDFNCELGSIQMFDPKAECDQIQFQPHRDSALANHKVVQDSFRYHGCNNGHQWGDAVAVGSYPEFVYYNGMPWYLAIQAAAEQLYDAVYQWQDVEWIHMGIQSLVFFHADVLTSAAGQYTRSHTTYQNIHDAVKTYADGFVSVVSCAKYHPRNGTLHEGEHRNDGKPDSASHLHWRYAALLCAIHSRATQVPASWGEACATSPGVCTAIEQSGHYSTAHNQSWPSACSQQHHRQTPCHCQHPVAYHFNGIQQYGEIYVLGTIPALGNWRDWGCHLRADKYTNSDQIWYSIVQLPAGERAVYKYIRKWEGRVDPNRLTQVQDCGQDHW

SEQ ID NO: 1823 - DNA, 4226 bp, Aspergillus awamorii
  misc_feature (2003)..(2003): n is a, c, g, or t
  misc_feature (2095)..(2095): n is a, c, g, or t
  misc_feature (4116)..(4116): n is a, c, g, or t
  misc_feature (4208)..(4208): n is a, c, g, or t
taagcagtggtaacaacgcaaagtacgcggggatcctcaacatcgttactcccccgccgcaatgtcgttccgatctcttctcgccctgagcggccttgtctgctcggggttggcaagtgttatttccaagcgcgcgaccttggattcgtggttgagcaacgaagcgaccgtggctcgtactgcgatcctgaataacatcggggcggacggtgcttgggtgtcgggcgcggactctggcattgtcgttgccagtcccagcacggataacccggactacttctacacttggactcgcgactctggtctcgtcatcaagaccctcgtcgatctcttccgcaatggagatactgatctcctttccaccattgagaactacatctcctctcaggcaattgttcagggtatcagtaacccctctggtgatctgtccagcggtggtcttggtgagcccaagttcaatgtcgatgagactgcctacaccgggtcttggggacggccgcagcgtgatggtcctgccctgagagcaactgctatgatcggcttccgccagtggctgcttgacaatggctacaccagcgctgcaacggagattgtttggcctctcgttaggaatgacctgtcgtatgtggctcagtactggaaccagacgggatatgatctctgggaagaagttaatggctcgtccttcttcactattgctgtgcagcaccgcgccctcgtcgaaggtagtgccttcgcgacggccgttggctcgtcctgctcctggtgtgattcgcaggcacctcagattctctgctacctgcagtccttctggaccggcgaatacatcctggccaactttgatagcagccgttccggcaaggacaccaataccctcctgggaagcatccacacctttgatcctgaggctgggtgcgacgactccaccttccagccctgctccccgcgtgcgctcgccaaccataaggaggttgtagactctttccgctcgatctatactctcaacgatggtctcagtgacagtgaggcggttgccgtcggtcggtaccccaaggatagctactacaacggcaacccgtggttcctgtgcaccttggctgccgcggagcagctgtacgatgctctgtaccagtgggacaagcagggatccttggagatcacagacgtgtcacttgacttcttccaggctctgtacagtgatgctgccaccggcacatactcttcgtccagctcgacctatagcagcattgtggatgccgtaaagactttcgctgatggtttcgtttctattgtggaaactcacgccgcaagcaacggctctctgtccgagcaatacgacaagtctgatggcgacgagctttctgctcgcgacctgacctggtcttacgctgctctgctgaccgccaacaaccgtcgtaactctgtcatgcctccttcttggggcgagacttctgccagcagcgtgcccggcacctgtgcggctacctctgcctctggtacctacagtagtgtgactgtcacctcgtcgcccagtatcgtggctactggtggcaccactacgacggctaccaccactggatttggcggcgtgacctcgaccagcaagaccaccacaactgctagtaagaccagcaccactacgtcttcgacctcctgcaccactcccaccgccgtagctgtgacatttgatctgacggcgaccaccacctacggcgagaacatctacctggtcgggtcgatctctcagctcggtgactgggacaccagcgacggcatagctctgagcgctgacaagtacacttccagcaacccgctctggtatgtaaccgtgactctgccggctggtgagtcgtttgagtacaagttcatccgcattgagagcgatgactccgtggagtgggagagcgacccgaaccgggagtacacggttcctcaggcgtgtggcgagtcgaccgcgacggtgactgacacctggcggtagacaattcattcctattgatatngaaggatgaaaatgacagtcattggttatataatcatgtatgtagtggatgtgcataagagcaacgaaatggaagcctgatcatgtgattgnaaaaaaaaaaaaaaaaaataagcagtggtaacaacgcaaagtacgcggggatcctcaacatcgttactcccccgccgcaatgtcgttccgatctcttctcgccctgagcggccttgtctgctcggggttggcaagtgttatttccaagcgcgcgaccttggattcgtggttgagcaacgaagcgaccgtggctcgtactgcgatcctgaataacatcggggcggacggtgcttgggtgtcgggcgcggactctggcattgtcgttgccagtcccagcacggataacccggactacttctacacttggactcgcgactctggtctcgtcatcaagaccctcgtcgatctcttccgcaatggagatactgatctcctttccaccattgagaactacatctcctctcaggcaattgttcagggtatcagtaacccctctggtgatctgtccagcggtggtcttggtgagcccaagttcaatgtcgatgagactgcctacaccgggtcttggggacggccgcagcgtgatggtcctgccctgagagcaactgctatgatcggcttccgccagtggctgcttgacaatggctacaccagcgctgcaacggagattgtttggcctctcgttaggaatgacctgtcgtatgtggctcagtactggaaccagacgggatatgatctctgggaagaagttaatggctcgtccttcttcactattgctgtgcagcaccgcgccctcgtcgaaggtagtgccttcgcgacggccgttggctcgtcctgctcctggtgtgattcgcaggcacctcagattctctgctacctgcagtccttctggaccggcgaatacatcctggccaactttgatagcagccgttccggcaaggacaccaataccctcctgggaagcatccacacctttgatcctgaggctgggtgcgacgactccaccttccagccctgctccccgcgtgcgctcgccaaccataaggaggttgtagactctttccgctcgatctatactctcaacgatggtctcagtgacagtgaggcggttgccgtcggtcggtaccccaaggatagctactacaacggcaacccgtggttcctgtgcaccttggctgccgcggagcagctgtacgatgctctgtaccagtgggacaagcagggatccttggagatcacagacgtgtcacttgacttcttccaggctctgtacagtgatgctgccaccggcacatactcttcgtccagctcgacctatagcagcattgtggatgccgtaaagactttcgctgatggtttcgtttctattgtggaaactcacgccgcaagcaacggctctctgtccgagcaatacgacaagtctgatggcgacgagctttctgctcgcgacctgacctggtcttacgctgctctgctgaccgccaacaaccgtcgtaactctgtcatgcctccttcttggggcgagacttctgccagcagcgtgcccggcacctgtgcggctacctctgcctctggtacctacagtagtgtgactgtcacctcgtcgcccagtatcgtggctactggtggcaccactacgacggctaccaccactggatttggcggcgtgacctcgaccagcaagaccaccacaactgctagtaagaccagcaccactacgtcttcgacctcctgcaccactcccaccgccgtagctgtgacatttgatctgacggcgaccaccacctacggcgagaacatctacctggtcgggtcgatctctcagctcggtgactgggacaccagcgacggcatagctctgagcgctgacaagtacacttccagcaacccgctctggtatgtaaccgtgactctgccggctggtgagtcgtttgagtacaagttcatccgcattgagagcgatgactccgtggagtgggagagcgacccgaaccgggagtacacggttcctcaggcgtgtggcgagtcgaccgcgacggtgactgacacctggcggtagacaattcattcctattgatatngaaggatgaaaatgacagtcattggttatataatcatgtatgtagtggatgtgcataagagcaacgaaatggaagcctgatcatgtgattgnaaaaaaaaaaaaaaaaaa

SEQ ID NO: 1824 - protein, 639 aa, Aspergillus awamorii
MSFRSLLALSGLVCSGLASVISKRATLDSWLSNEATVARTAILNNIGADGAWVSGADSGIVVASPSTDNPDYFYTWTRDSGLVIKTLVDLFRNGDTDLLSTIENYISSQAIVQGISNPSGDLSSGGLGEPKFNVDETAYTGSWGRPQRDGPALRATAMIGFRQWLLDNGYTSAATEIVWPLVRNDLSYVAQYWNQTGYDLWEEVNGSSFFTIAVQHRALVEGSAFATAVGSSCSWCDSQAPQILCYLQSFWTGEYILANFDSSRSGKDTNTLLGSIHTFDPEAGCDDSTFQPCSPRALANHKEVVDSFRSIYTLNDGLSDSEAVAVGRYPKDSYYNGNPWFLCTLAAAEQLYDALYQWDKQGSLEITDVSLDFFQALYSDAATGTYSSSSSTYSSIVDAVKTFADGFVSIVETHAASNGSLSEQYDKSDGDELSARDLTWSYAALLTANNRRNSVMPPSWGETSASSVPGTCAATSASGTYSSVTVTSSPSIVATGGTTTTATTTGFGGVTSTSKTTTTASKTSTTTSSTSCTTPTAVAVTFDLTATTTYGENIYLVGSISQLGDWDTSDGIALSADKYTSSNPLWYVTVTLPAGESFEYKFIRIESDDSVEWESDPNREYTVPQACGESTATVTDTWR

SEQ ID NO: 1825 - DNA, 1854 bp, Thermomyces lanuginosus
atgttattccaaccgactttgtgcgcggcccttggactcgccgccttgatcgtccaaggcggagaagccagacctgaaacaaccgtcccacatgcaacgggctcgctcgacgacttcctcgccgcacagagtccgattgctttccaaggcatcctgaacaatatcgggcctagcggagcgtactcggaaggtgtcaatccgggtgtggtcattgcgagtccaagtaaacaagatcccgactacttttacacctgggtgcgcgacgctgctctcactgtccaatatctggtggaggagctggttgcaggaaatgccagtcttcagttcctcattcaggactacatcagctcccaggcacgactgcagacggtggaaaatccatccggctccctctcgtcaggtggtctaggagagcccaagtttcatgtcgacgagaccgcctttacggactcctggggccgaccacagcgggacggcccgcctctccgcgccattgccatgatttcgtttgccaattacctgattgacaacggtcatcaatcgactgtggaggacatcatctggccgattggtcgcaatgacttgtcctatgtctcgcagcattggaacgaaacaacttttgacatctgggaggaagtccatagctcatcgtttttcaccacggctgtccagtaccgtgctctggtccaaggcagtgccttggctagcaagctcggccatacctgcgacaactgcgggtcccaagcaccgcagatcctttgcttcctgcagtcgtattggaccgggtcgcacatcttagccaacaccggtggcggccgctcgggaaaggacgtcagcacgatcctcggcgtcattggctcgtttgatccgaacgccgactgtgatgacgttaccttccagccctgctcggcccgggctcttgcaaatcacaagcaggtcgttgacagcttccgcagtatctatgccatcaacgctggcatcccgtcagggtcggctgttgcggttggacgttatcccgaggatgtctatcagggtggacacccctggtacctaacaacggctgcggcggcggagcagctttacgacgccatttaccagtggaaccatgtagggcacatcgacatcaatgctgtcaatctggacttcttcaagagcatttatccgtcagccgccgagggcacatacacatcagactcttcaacatttcaagacattatatctgctgtacggacctatgcggacgggtttctcagcgtaattgagaaatacactccgccggataacttgcttgccgagcagttccaccgggagacgggcattccactatcggcagcttctctgacatggtcctacgccgcgctcaacacggccgcgcagcggcgagcgtcaatcgtgccctcaccgtggaactctaacagcacagatctcccggacaaatgctcggcaacctcggcaacagggccgtatgccacgcccacaaacacggcatggccaaccactacgcagccaccggagcggccggcatgcacaccgccgtcggaagtaacactcaccttcaacgcgctcgtcgacaccgcgtttggccagaatatttatctcgtgggctccattccggagctcggatcgtgggatccggccaacgccctcttgatgagcgcaaagagctggactagcggaaatccggtctggacgctatccatttcccttccagcaggaacctcttttgagtacaagttcattcgaaaggatgatggttcctcggatgttgtctgggaaagtgacccgaatcgttcgtacaacgtgccgaaggattgcggtgccaacacggccaccgtgaattcttggtggcgatga

SEQ ID NO: 1826 - protein, 617 aa, Thermomyces lanuginosus
MLFQPTLCAALGLAALIVQGGEARPETTVPHATGSLDDFLAAQSPIAFQGILNNIGPSGAYSEGVNPGVVIASPSKQDPDYFYTWVRDAALTVQYLVEELVAGNASLQFLIQDYISSQARLQTVENPSGSLSSGGLGEPKFHVDETAFTDSWGRPQRDGPPLRAIAMISFANYLIDNGHQSTVEDIIWPIGRNDLSYVSQHWNETTFDIWEEVHSSSFFTTAVQYRALVQGSALASKLGHTCDNCGSQAPQILCFLQSYWTGSHILANTGGGRSGKDVSTILGVIGSFDPNADCDDVTFQPCSARALANHKQVVDSFRSIYAINAGIPSGSAVAVGRYPEDVYQGGHPWYLTTAAAAEQLYDAIYQWNHVGHIDINAVNLDFFKSIYPSAAEGTYTSDSSTFQDIISAVRTYADGFLSVIEKYTPPDNLLAEQFHRETGIPLSAASLTWSYAALNTAAQRRASIVPSPWNSNSTDLPDKCSATSATGPYATPTNTAWPTTTQPPERPACTPPSEVTLTFNALVDTAFGQNIYLVGSIPELGSWDPANALLMSAKSWTSGNPVWTLSISLPAGTSFEYKFIRKDDGSSDVVWESDPNRSYNVPKDCGANTATVNSWWR

SEQ ID NO: 1827 - DNA, 1860 bp, Aspergillus fumigatus
atgcgatttgctggcattgcttgcatagccagtgtcctagggcacttggccactccttcgtctgctaaagaacttgctgcacgctcccctgcagcggcaaattcacgtctggtcaaagagggactgttcgcctacgagagcattcttgcggctcttgggaacactggcatcaatgctcctggcacagcggctggattactcattgcaagtcctaccatacagaaccctgattacttctatacgtggactcgggatgcggcattgactttcaaaggacttgtcgatatcttcattgggggcgatacatttatcgtcgtcaatctcgacggtcttgaaacccacatccaggactacatctcttcccaggcagttttgcagaacgtgtccaacccatccggaagactttctgacggctctggactcggcgagcccaagttcgaggtcaatttcaacccatactccggcggttggggccgtccccagcgcgatggtcctgcccttcgcgccattaccatgttgacctatattcgtcagctaatccagcaagggaaacagtctgtggcttccaacctgatctggcccgttgtagccaacgatctcacctatgtcgcgcagtactggaaccacaccggattcgatctctgggaagaaatcgatggctcttccttctttacgactgccgtgcagcaccgagcgatggttgagggtagtgcgatagctcaagcccttggtaagccacatgctgggtatgacgcggttgctcccgagattctttgcttgctgcagagctactggaacgaaagcgccattatctcgaacatcaatgtcaataacggccggtcgggcatcgatctcaactcagtcctgaccagtattcatacctttgaccctgcggctggttgtgatgattccaccttccaaccatgttcgtctaaagctttggcaaatcataaggtctatgtcgattctttccgttctatctacggtatcaacgctggccttggtcctggaaaggctgcaaatgtaggccgttacgctgaagatgtttaccagggaggaaatccatggtacctcgcaactcttgcggcggcagagcagctgtatgatgccctctatcagtggaaaaagcagggttatctgaccgtcacacaaacctcgctcgccttcttccgtgacttctcgtccaccgtcgagccaggaacttacaagtcgaataccccgacctacaaatccctgactgattatgtccgcacctacgctgatgacttcttcttccttgttgaaaaatacaccccaagcaacggctccttagccgagcagtatgaccgcaacaccggtgtccctctgtcagccaacgatcttacctggtcctatgcagccttcctctctacccttcagcgccgcctcaacatcatgcctgactcctggggcccctcgtctgcaaatcctgttcccactacctgcagcaaaaccaccataactggtacatatagtgctgtggcgcctccctttccgacgtccaccgctcagtgcgttgccgctgtgactgttcctgtcaccttttggttgatcgagaatacctactatggcgagaatgtgtacatgaccggcaacgtcagcgctctcggtgactggaacgccagcgcaggctatagtctgaatgccggtctctacacctcggatgagaatctttggttcgcaactgtcaagggactcgagccgggtgttaccatggagtacaagttctacaagattgaaccgggaaactccgtgacttttgaggggggggagaacagggtgtatgcagttcctacagcatgtcctgtggcgcctcaggtccacgcggtttggcagacctga

SEQ ID NO: 1828 - protein, 619 aa, Aspergillus fumigatus
MRFAGIACIASVLGHLATPSSAKELAARSPAAANSRLVKEGLFAYESILAALGNTGINAPGTAAGLLIASPTIQNPDYFYTWTRDAALTFKGLVDIFIGGDTFIVVNLDGLETHIQDYISSQAVLQNVSNPSGRLSDGSGLGEPKFEVNFNPYSGGWGRPQRDGPALRAITMLTYIRQLIQQGKQSVASNLIWPVVANDLTYVAQYWNHTGFDLWEEIDGSSFFTTAVQHRAMVEGSAIAQALGKPHAGYDAVAPEILCLLQSYWNESAIISNINVNNGRSGIDLNSVLTSIHTFDPAAGCDDSTFQPCSSKALANHKVYVDSFRSIYGINAGLGPGKAANVGRYAEDVYQGGNPWYLATLAAAEQLYDALYQWKKQGYLTVTQTSLAFFRDFSSTVEPGTYKSNTPTYKSLTDYVRTYADDFFFLVEKYTPSNGSLAEQYDRNTGVPLSANDLTWSYAAFLSTLQRRLNIMPDSWGPSSANPVPTTCSKTTITGTYSAVAPPFPTSTAQCVAAVTVPVTFWLIENTYYGENVYMTGNVSALGDWNASAGYSLNAGLYTSDENLWFATVKGLEPGVTMEYKFYKIEPGNSVTFEGGENRVYAVPTACPVAPQVHAVWQT

SEQ ID NO: 1829 - DNA, 5805 bp, Rhizopus oryzae
gatccatacgaagtattaggtgtaaaaaagaatgcgagttcaaatgaaattaaaaaggcttattatgctgtaagttaaatacactagagaaaaagtcaagaaaagacattgaatgtaataatagcttgcaaaaaaatatcatccagataccaacaaagataagcatgctcgtgaaaaatttgttcaaattcaagaagcttatgaggttctctctgatgatgaaaagcgtaaacaatatgatcaatttggacatggatttgaggctggaggggcagcaggcggtggtggatttcatggaagtggcttccctggtggatttgatcccaatgatatctttagtcaattctttggtggaggttttggcggaggctttggcggaggctttagtggaggaggtgctactgagggtgatccatttgctaaaccctcagcaggaaatacaattcagatgccattgacattgacatttatggaagccgtgaagggaacaacaaaatacgttcaggttaatcgagtaataaattgtaatacttgtcagggaagtggcctcaaacctggtaaaagtaaaaacacgtgtaggacatgtcacggtacaggtttacaaaccattatgatgggtggtggatttggtatgcaaaccacctgtcagacatgtggcggagaaggtttttccattccatctggttatggatgttcggcatgtaatagtacgggcaaaataaaagaacgtaagacagttcaagtgattgtcccacctggtgtggatcaaaattcaagaataaaggttcctggtgaaggcgatgcgccattgaaaggaaatggacctaatggtgatttgtttattatgttaaatgtaaagggattgttttatagattcctatctcttttgatttatttcttgtgctgttttatagattcaaccatcaaagatctttcgcagacagaatacagatatctttgtggatgcaaagattcctttctataaagctatattaggaggacgcattcgtattccaacagtagatggtgatgttgatttaaaagttcctccgggatcacaatctgaagacaacatagcattaagaggccatggtatccaacatctccgtaatactgttcgcggtgatcaaattgtaacactcaaggttgaatttccaagaagcttacgaggaagacaaaaggaaataattgaggaatatgccagcctagtagatgatgattacaaaccaagagggcaatcagtgaagaaaagcaatccttcgccaaacatatcaccaccttcaaaaatgtcatctgaggatcgaaatgaagaaaataaaaaacatgacaagtgatcctttgaaggtacttttgataaaattaatggacgagatttataatgaaaatgaagatgagaaccacaaaagaattacatagtaatcagtctttcttcaggaaataataaaaagaataaaatttcgtagggccagaatataccatgattttttaatagccaacgttcaaagtttatatatttcatagtgcagatgataatatatgtattattcaattggccgtgcattctttgtattatagatgtctgtatgtgcataatataaatatatatcattagtgattagcctgtctcgataatgtacatgtactaaataagcctacatgtcacataatctactactgagaaggtataatggttgattttttatccaatgattatcttggaagacagctgtcaataaagtaataagaattttgctagtatttgttatttgtattttcttattcttctttatgcctatatccaatgaagcttttgtttccttgttaaaacaacgatctttttttttttttttttttttatgtataaacataaattgtagcatttaaaacagatttgttatagtacatgtttgtacactctccattatagaactaataaatttgatattgatcgtatgtatttttcctatgtccattttatactccaatagcactattatattgattaatttaaaaagactttacggatagtaaatacctcagtctggttgcaaccaaccatcattattttacctgagagtgttaccagcaacgtcgtattttcagcacattgtaagtttcacggggataccaatcattgtgtttatcaatttcgttgtgttgtcaaaaaaagaaagtttgtaaaccaaactgaaattaactacctttttataataggaaatatatttatgatgtgtatagttaatgtcgttaatgctgttcattttactgctttgtcgtcagaaaaaaaaaaagaggggtacagattaacttttaaaggaggacagaattgaactcaaaacaaattagtggtcgctgaaaaacttagtgtatttagacttctcggttctgggaaaagtggtatagtaaaataaaacgggatggtaatttggttagattcaggttaattgtattacattggtactatggtacttcactgtactttttttttaaaaaaaattgtccaagagtcggcttttactgtaaaaaacgggtattcggctgttttgtagttatattttcctttgggaagttatgtgccaattggattagcaactaaaaatatttaataggtgtaatatagagagagcagtgttacatatatttctaaacataattcccatgcatgtctgcttagtaatgattaattttcaaatatttgcaaaatcaatggcaaagatcacgcttatattccatgtccacttcaatcataaatagcttgttcattaaagtaggtctttttagaagttgttactttgaaagctgtatagagtccagtcatcagttaatggtactttgtgtaatccattttccctcctttgtgtaaattcttcaatgcctctggttagacttggaattctctgcttcttgagaaaaaggaaaaagaaagaaaaaaaaatgcaattgtaatactttagaattcatccttcattttttcaacttctgtgagccatacaatttagtatttttacgagttaatactaagcataaaaagcttcaattaaagtttttaatttcatataaacattaggcattgaatcaattattcaacatgcaatttcactgtaactttaatctgtaaaaatctgtaaaacattgtaaaaaactgtaaaaaactgaatgcataaatgattccatatatttccaaggacccttatgtttaagggcaatcatccaattatttttaattgatgacactgtttgtcggtaaaacgttttctagattgttcacaaagcatgatgtaacaaggataacatcatttgttggccaatagttctttgtccaacatgacacacactgcataaaattttgggatgatctattacttgttaataattcaatcgaaaattgccataaatatacactgaaactaggaaatatgactattgtttaacatattacaatgtctcaagctggaatatcagggaaatcctttaatttatgttcctgtttaattgaacttatagaagatctcaatttgtgttgtgatatattcagatttaaaatttcaaacatatataagacgcgtttatttcctcgtttttcaaaaatcatcacttgtcttcaaattggtctttctctaatgcaattattcaatttgccattgaaagtctcattctttcttgtcctctcttacttttctttgcttgtttctgctgcaagtattcctagcagtgcttctgtccagcttgattcatacaactacgatggctctactttttcaggaaaaatttatgtaggttgcatataattcaaacaataaaaaatatattaatgttcatgctgtacgttgtaggtcaagaacattgcttactccaagaaagttactgtagtttacgccgatggctctgacaactggaataataatggaaacaccattgctgcttctttctctggccctatctctggatcaaattacgaatactggacattctctgcctccgttaaaggtatcaaggagttctacattaaggtagcttatttttattttatgatatttgcccttatacttaattaactaacccttttctctatagtatgaagtcagtggaaaaacatactatgataacaacaattctgccaattaccaaggtaaaagtaataatatgcaaatgcctacagctattcacatttttatagtatctacatccaagcccactactactactgctgctactactactactactgctccttctacttctaccacaactcgcccctcaagctctgagccagctactttcccaactggtaactctacaatctcctcatggattaagaagcaagaagatatcagtcgctttgctatgcttcgaaacatcaaccctcctggaagtgctaccggtttcattgctgcttcactctctaccgctggtcccgattactactacgcttggactcgtgatgctgcattaacctccaatgtaattgtttacgaatacaacactactttgtctggtaataagactatcctcaacgtcctcaaggactatgttacattctcagttaagacccaatcaacttctaccgtctgtaactgccttggtgagcctaagttcaatcctgatggttctggatacactggtgcttggggaagacctcaaaatgatggacctgctgaacgtgctactactttcgttttgtttgctgacagttatcttactcaaacaaaggatgcttcctatgtcactggtacactcaagcctgctatcttcaaggatttggactatgtcgtcaatgtctggtctaatggctgtttcgatttatgggaagaagtcaatggtgttcacttctatactttaatggttatgcgtaagggtttgcttcttggtgcagatttcgctaaacgtaacggtgactctactcgtgcatctacttatagcagtactgcatccactattgcaaacaagatctctagcttctgggtttcttctaataactgggttcaagtcagtcaaagtgttactggtggtgtcagtaaaaagggtttggatgtctctacattgttggctgctaatcttggtagtgttgatgatggattcttcactcctggttctgaaaaggtaaactaacatgcacaaaagaataagactataacattactaatycacattttctacttagatccttgccactgctgtagctgttgaagattccttcgcttccttgtatcctatcaacaaaaaccttccatcttaccttggtaacgctattggtagatatcctgaagacacttacaatggtaacggaaactctcaaggaaacccttggttcttggctgtaactggttatgctgagctctattaccgtgccatcaaggaatggatcagcaacggtggtgtcactgtcagcagcatcagtttacccttcttcaagaagtttgattcatctgctacatctggaaagaaatacactgttggtacctccgactttaataaccttgctcaaaatattgcactcgctgctgaccgtttcttgtccactgtccagctccatgctcccaacaatggatctcttgctgaagagtttgaccgtaccactggtttctccaccggtgctagagacttgacctggtctcacgcttctttaatcaccgcttcttacgctaaggctggtgcacctgctgcttaagctgtgaatttaaatgcaaagcattacagcttattttctctttcaaataaagacatattgatatgtttatgaccttttcttgtttattgtactgtaatatgggtaaccacataagcataaacagcaaaaagcagcac

SEQ ID NO: 1830 - protein, 604 aa, Rhizopus oryzae
MQLFNLPLKVSFFLVLSYFSLLVSAASIPSSASVQLDSYNYDGSTFSGKIYVKNIAYSKKVTVVYADGSDNWNNNGNTIAASFSGPISGSNYEYWTFSASVKGIKEFYIKYEVSGKTYYDNNNSANYQVSTSKPTTTTAATTTTTAPSTSTTTRPSSSEPATFPTGNSTISSWIKKQEDISRFAMLRNINPPGSATGFIAASLSTAGPDYYYAWTRDAALTSNVIVYEYNTTLSGNKTILNVLKDYVTFSVKTQSTSTVCNCLGEPKFNPDGSGYTGAWGRPQNDGPAERATTFVLFADSYLTQTKDASYVTGTLKPAIFKDLDYVVNVWSNGCFDLWEEVNGVHFYTLMVMRKGLLLGADFAKRNGDSTRASTYSSTASTIANKISSFWVSSNNWVQVSQSVTGGVSKKGLDVSTLLAANLGSVDDGFFTPGSEKILATAVAVEDSFASLYPINKNLPSYLGNAIGRYPEDTYNGNGNSQGNPWFLAVTGYAELYYRAIKEWISNGGVTVSSISLPFFKKFDSSATSGKKYTVGTSDFNNLAQNIALAADRFLSTVQLHAPNNGSLAEEFDRTTGFSTGARDLTWSHASLITASYAKAGAPAA

SEQ ID NO: 1831 - DNA, 3295 bp, Rhizopus oryzae
gatcacgcttatattccatgtccacttcaatcataaatagcttgttcattaaagtaggtctttttagaagttgttactttgaaagctgtatagagtccagtcatcagttaatggtactttgtgtaatccattttccctcctttgtgtaaattcttcaatgcctctggttagacttggaattctctgcttcttgagaaaaaggaaaaagaaagaaaaaaaaatgcaattgtaatactttagaattcatccttcatttttttcaacttctgtgagccatacaatttagtatttttacgagttaatactaagcataaaaagcttcaattaaagtttttaatttcactgtaactttaatctgtaaaaaactgtaaaaaactgtaaaaaactgaatgaatagatggtttcatatatttccagggacacttatgtttaagggcaatcatccaattgtttttctagattgttcacaaagcatgattttttttttttttttttttttttttttttttttttaaaaaatttaaattctttttttattacacaacgtcttttttattacacgaaaagataatggtgacaagtcaaaacaggatttgtttcccccacagtaactcatgacgtaaccattgacttctttttattctacatctttaaactattctatgcttcaattctttgcaaagatagaaatcatggctattgtttctttattctatgtttttcttttcttttgatgattaatctgtcgatgggtttgtttgctgagaatcaaatcaacaattctattttctgtattcaattctattttctgtattcacaaagcatgatgtaacaaggataacttcatatgttggccaatagttctttatccaacatgacgcacactacataaaattttgggatgatctattacttgttaataattcaatcgaaaattgccataaatatacactgaaaccgggaaatatgactactgtttaacatattacaatgtctcaagctggaatatcagggaaatcctttaatttatgtttctgtctaattgaacttacagaagatctcaatttgtgttatgatgtattcagatttaaaatttcaaacatatataagacgcgtttatttcctcgtttttcaaaaaccatcacttgtcttcaaattggtctttctctaatgcaattattcaatttgccattgaaagtctcattctttcttgtcctctcttacttttctttgcttgtttctacatccaagccagctactttcccaactggtaactctacaatctcctcatggattaagaagcaagaggatatcagtcgctttgctatgcttcgaaacatcaaccctcctggaagtgctaccggtttcattgctgcttcactcactacctctaatcccgattactactactattggactcgtgatgctgcattaacctccaatgtaattgtttacgaatacaacactactttgtctggtaataagactatcctcaacgtcctcaaggactatgttacattctcagttaagacccaatcaactcctacagtctgtaactgccttggtgagcctaggttcaatcctgatggttctggccacactggtgcttggggaagacctcaaaatgatggacctgctgaacgtgctattaccttcgttttgtttgctgacagttatcttactcaaacaaaggatgcttcctatgtcactggtacactcaagcctgctatcttcaaggatttggactatgtcgtcaatgtctggcctaatagctgtttcgatttatgggaagaagccaatggtgttcacttctatactttaatggttatgcgtaagggtttgcttcttggtgcagatttcgctaaacgtaacggtgactctactcgtgcatctacttatagcagtactgcatccactattgcaaacaagatctctagcttctgggtttcttctaataactggattcaagtcagtcaaaatgttactggtggtttcagtcaaaatgctgctgctgctgtcagtaaaaagggtttggatttctctacattgttggctgctaaccttggtagtgttgatgatggattcttcactcctggttctgaaaaggtaaactaacatgcacaaaagaataagactatagcattactaattcgcattttctacttagatccttgccactgctgtagctgttgaagattccttcgcttccttgtatcctatcaacaaaaaccttccatcttatcttggtaacgctattggtagatatcctgaagacacttccaatggtgtcggatacactcaaggaaacccttggttcttggctgtaactggttacgctgagctctattaccgtgccatcaaggaatggatcagcaacggtggtgtcactgtcagcagcatcagtttacccttcttcaagaagtttgattcatctgctatatctggaaagaaatacactgttggtacctccgactttaacaaccttgctcaaaatattgcactcgctgctgaccgtttcttgtccactgtccagttccatgctcacaacaatggatctattcctgaagagtttaaccgtaccactggtttacccaccggtgctagagacttgacctggtctcacgctgctgtaatcaccgcttcttacgctaaggctggtgcacctgctgcttaagctgtgaatttaaatgcaaagcattacagcttattttctctttcaaataaagacatattgatatgtttataaccttttcttgtttattgtactgtaatatgggtaaccacataagcataaacagcaaaaagcagcacaaaactttatttttgattaaattgtaagagaaacaaggacaattatgcaggtattgtactgagatttgccctatggcctaatttttaataaacaaattcctttagtctccgctgttgcataatggttaaggtaataaaaaagaaggcggaaacaaaaataaagaaacagtttgaatattttttgaaacggatctttatttcagtttaagttaaagtaaaaaattattctaattgaaggcaggtatttatatcttattgagtgagtggcttgatgtcttctattgtaagcgttcttctaatattcaggtactttagcaagtgtcatctataattatgattataaaaacttttcgtttgttcttttgtatgtctatcatagattatcttttattctgggaattcctcactgatttgaatagtgttattttacgcgttatttcaattatatgaaagattaacaatattcctgatattggattggatc

SEQ ID NO: 1832 - protein, 480 aa, Rhizopus oryzae
MQLFNLPLKVSFFLVLSYFSLLVSTSKPATFPTGNSTISSWIKKQEDISRFAMLRNINPPGSATGFIAASLTTSNPDYYYYWTRDAALTSNVIVYEYNTTLSGNKTILNVLKDYVTFSVKTQSTPTVCNCLGEPRFNPDGSGHTGAWGRPQNDGPAERAITFVLFADSYLTQTKDASYVTGTLKPAIFKDLDYVVNVWPNSCFDLWEEANGVHFYTLMVMRKGLLLGADFAKRNGDSTRASTYSSTASTIANKISSFWVSSNNWIQVSQNVTGGFSQNAAAAVSKKGLDFSTLLAANLGSVDDGFFTPGSEKILATAVAVEDSFASLYPINKNLPSYLGNAIGRYPEDTSNGVGYTQGNPWFLAVTGYAELYYRAIKEWISNGGVTVSSISLPFFKKFDSSAISGKKYTVGTSDFNNLAQNIALAADRFLSTVQFHAHNNGSIPEEFNRTTGLPTGARDLTWSHAAVITASYAKAGAPAA

SEQ ID NO: 1833 - DNA, 2614 bp, Aspergillus shirousami
gtcgttctgaagagctgaagtggcgagatggtctctgcaggaataccaagctagatgttaagcgatgctgcactgcaatctgtactgtgtggtgatgcatgtgcttcttccttcaacttcccccctcctgcagatgctggtttggatataaactgacgtggtcgctcaggggtcactgagggggtgaaactagcttcctccccctcaagacgcgacaactgactgactgagcttcatcctcaacatcgttactcccccaccgcaatgtcgttccgatctcttctcgccctgagcggccttgtctgctcggggttggcaagtgtgatttccaagcgcgcgaccttggattcgtggttgagcaacgaagcgaccgtggctcgtactgccatcctgaataacatcggggcggacggtgcttgggtgtcgggcgcggactctggcattgtcgttgccagtcccagcaccgataacccggactgtatgttttgagttcggattatgaatgtgtcttgggtgaatgatggtgactggcgtgtcttttgatgattgtagacttctacacctggactcgcgactctggtatcgtcctcaagaccctcgtcgacctcttccgcaatggagatactgatctcctttccaccattgagcactacatctcctctcaggcaattattcagggtgtcagtaacccctctggtgatctgtccagcggtggtcttggtgagcccaagttcaatgtcgatgagactgcctacgccggttcttggggacggccgcagcgtgatggtcctgccctgagagcaactgctatgatcggctttgggcagtggctgcttgtatgttctccacccccttgcgtctgatctgtgacatatgtagctgactggtcaggacaatggctacaccagcgctgcaacagagattgtttggcccctcgttaggaacgacctgtcgtatgtggctcagtactggaaccagacgggatatggtgtgtttgattgatcggggttcaagggtgtttgtgcatcggagctaacttcgcggtcgcagatctctgggaagaagttaatggctcgtccttcttcactattgccgtgcaacaccgcgccctcgtcgaaggtagtgccttcgcgacggccgtcggctcgtcctgctcctggtgtgattcgcaggcacctcagattctctgttacttgcagtccttctggaccggcagctacatcctggccaactttgacagcagccgttccggcaaggacacaaacaccctcctgggaagcatccacacctttgatcctgaggctggatgcgacgactccaccttccagccctgctccccgcgtgcgctcgccaaccataaggaggttgtagactctttccgctcgatctatactctcaacgatggtctcagtgacagtgaggcggttgcggtcggtcggtaccctgaggatagctactacaacggcaacccgtggttcctgtgcaccttggctgccgcggaacagctgtacgatgctctgtaccagtgggacaagcaggggtcgttggagatcacagacgtgtcacttgacttcttcaaggctctgtacagtggtgctgccaccggcacgtactcttcgtccagctcgacctatagcagcattgtgagtgccgtcaagactttcgctgatggttttgtttctattgtggtaagtctacgctagacgagcgctcatatttacagagggtgcgtactaacaggattaggaaactcacgccgcaagcaacggctctctgtctgagcaattcgacaagtctgatggcgacgagctttctgctcgcgatctgacctggtcttacgctgctctgctgaccgccaacaaccgtcgtaattctgtcgtgcccccgtcttggggtgagacctctgccagcagcgtgcccggcacctgtgcggctacctctgcctctggtacctacagcagtgtgaccgtcacctcgtggccgagcatcgtggctactggtggcaccactacgacggctaccaccactggatcgggcggcgtgacctcgaccagcaagaccaccacaactgctagtaagaccagcaccactacgtcctcgacctcctgcaccacccccactgccgtagctgtgacctttgatctgacggcgaccaccacctacggcgagaacatctacctggtcgggtcgatctctcagctcggtgactgggagaccagcgatggcatagctctgagcgctgacaagtacacttccagtaacccgccttggtatgtaactgtgactctgccggctggtgagtcatttgagtacaagttcatccgcgttgagagcgatgactccgtggagtgggagagcgacccgaaccgggaatacaccgttcctcaggcgtgcggcgagtcgaccgcgacggtgaccgacacctggcggtagactattcattcctattgatatgaaggatgagtatgagggtaattggttatataatcatgtatgtagtggatgtgcataagagcaacgaaatggaagcctgatcatgtgattctttgtattgcgaccgacggaattgaggatattgccgggaaatcggacaatgccaagccattgtcttcca

SEQ ID NO: 1834 - protein, 639 aa, Aspergillus shirousami
MSFRSLLALSGLVCSGLASVISKRATLDSWLSNEATVARTAILNNIGADGAWVSGADSGIVVASPSTDNPDYFYTWTRDSGIVLKTLVDLFRNGDTDLLSTIEHYISSQAIIQGVSNPSGDLSSGGLGEPKFNVDETAYAGSWGRPQRDGPALRATAMIGFGQWLLDNGYTSAATEIVWPLVRNDLSYVAQYWNQTGYDLWEEVNGSSFFTIAVQHRALVEGSAFATAVGSSCSWCDSQAPQILCYLQSFWTGSYILANFDSSRSGKDTNTLLGSIHTFDPEAGCDDSTFQPCSPRALANHKEVVDSFRSIYTLNDGLSDSEAVAVGRYPEDSYYNGNPWFLCTLAAAEQLYDALYQWDKQGSLEITDVSLDFFKALYSGAATGTYSSSSSTYSSIVSAVKTFADGFVSIVETHAASNGSLSEQFDKSDGDELSARDLTWSYAALLTANNRRNSVVPPSWGETSASSVPGTCAATSASGTYSSVTVTSWPSIVATGGTTTTATTTGSGGVTSTSKTTTTASKTSTTTSSTSCTTPTAVAVTFDLTATTTYGENIYLVGSISQLGDWETSDGIALSADKYTSSNPPWYVTVTLPAGESFEYKFIRVESDDSVEWESDPNREYTVPQACGESTATVTDTWR

SEQ ID NO: 1835 - DNA, 2748 bp, TALAROMYCES EMERSONII
acgagatgtgtatatactgtgaaccaaactagatgatgtcagttatgctggtctgagaactcatagaagcccttgaaaataccccaagctagcactccaaccctaactctgttgctctactagatcaagacgagtactctgattgagctgcaggcttggaatatatgattagcagaaaaagggttaaaacttgtatgacaatcagtttgtcagtactccgtagtgatgccatgtctatagagtcgacactaaggcagcatgtgaatgagtcggaaatgacaggaagcagattccttaacagtcatgttctccgtgcctgcatccccacgtcacctgcaaagatgcgacgctactccacaccggcgccttgatgtctgctgttcctggcctagtggagccccatgcgctgctagctcgtggtcttcgaataaatcagaataaaaaacggagtaattaattgcgcccgcaacaaactaagcaatgtaactcaatgccaagcttccgctgatgctcttgacatctccgtagtggcttctttcgtaatttcagacgtatatatagtagtaatgcccagcaggccgggataatgatggggatttctgaactctcagcttccgtacgctgaacagtttgcttgcgttgtcaaccatggcgtccctcgttgctggcgctctctgcatcctgggcctgacgcctgctgcatttgcacgagcgcccgttgcagcgcgagccaccggttccctggactcctttctcgcaaccgaaactccaattgccctccaaggcgtgctgaacaacatcgggcccaatggtgctgatgtggcaggagcaagcgccggcattgtggttgccagtccgagcaggagcgacccaaattgtaggttctttcccaccagaaattacttatttaaatcagccctctgacaggttgaagatttctactcctggacacgtgacgcagcgctcacggccaaatacctcgtcgacgccttcatcgcgggcaacaaggacctagagcagaccatccagcagtacatcagcgcgcaggcgaaggtgcaaactatctccaatccgtccggagatttatccaccggtggcttaggtgagcccaagttcaatgtgaatgagacggcttttaccgggccctggggtcgtccacagagggacggaccagcgttgagagcgacggccctcattgcgtatgcgaactatctcatcgtaagcttctgctcgctgcccttctctctgctcgtatgctaagtagtcctgtcaggacaacggcgaggcttcgactgccgatgagatcatctggccgattgtccagaatgatctgtcctacatcacccaatactggaactcatccaccttcggtaggcaaatgaatattcccgacacagcgtggtactaatttgattcagacctctgggaagaagtagaaggatcctcattcttcacaaccgccgtgcaacaccgcgccctggtcgaaggcaatgcactggcaacaaggctgaaccacacgtgctccaactgcgtctctcaggcccctcaggtcctgtgtttcctgcagtcatactggaccggatcgtatgttctggccaactttggtggcagcggtcgttccggcaaggacgtgaattcgattctgggcagcatccacacctttgatcccgccggaggctgtgacgactcgaccttccagccgtgttcggcccgtgccttggcaaatcacaaggtggtcaccgactcgttccggagtatctatgcgatcaactcaggcatcgcagagggatctgccgtggcagtcggccgctaccctgaggatgtctaccagggcgggaacccctggtacctggccacagcagcggctgcagagcagctttacgacgccatctaccagtggaagaagatcggctcgataagtatcacggacgttagtctgccatttttccaggatatctacccttctgccgcggtgggcacctataactctggctccacgactttcaacgacatcatctcggccgtccagacgtatggtgatggatatctgagtattgtcgtacgttttgccttagattctcaggtgtaaagaaaaaaatggaactaactcagttctaggagaaatatactccctcagacggctctcttaccgaacaattctcccgtacagacggcactccgctttctgcctctgccctgacttggtcgtacgcttctctcctaaccgcttcggcccgcagacagtccgtcgtccctgcttcctggggcgaaagctccgcaagcagcgtccctgccgtctgctctgccacctctgccacgggcccatacagcacggctaccaacaccgtctggccaagctctggctctggcagctcaacaaccaccagtagcgccccatgcaccactcctacctctgtggctgtgaccttcgacgaaatcgtcagcaccagttacggggagacaatctacctggccggctcgatccccgagctgggcaactggtccacggccagcgcgatccccctccgcgcggatgcttacaccaacagcaacccgctctggtacgtgaccgtcaatctgccccctggcaccagcttcgagtacaagttcttcaagaaccagacggacgggaccatcgtctgggaagacgacccgaaccggtcgtacacggtcccagcgtactgtgggcagactaccgccattcttgacgatagttggcagtgagataacatccacccttctgtttta

SEQ ID NO: 1836 - protein, 618 aa, TALAROMYCES EMERSONII
MASLVAGALCILGLTPAAFARAPVAARATGSLDSFLATETPIALQGVLNNIGPNGADVAGASAGIVVASPSRSDPNYFYSWTRDAALTAKYLVDAFIAGNKDLEQTIQQYISAQAKVQTISNPSGDLSTGGLGEPKFNVNETAFTGPWGRPQRDGPALRATALIAYANYLIDNGEASTADEIIWPIVQNDLSYITQYWNSSTFDLWEEVEGSSFFTTAVQHRALVEGNALATRLNHTCSNCVSQAPQVLCFLQSYWTGSYVLANFGGSGRSGKDVNSILGSIHTFDPAGGCDDSTFQPCSARALANHKVVTDSFRSIYAINSGIAEGSAVAVGRYPEDVYQGGNPWYLATAAAAEQLYDAIYQWKKIGSISITDVSLPFFQDIYPSAAVGTYNSGSTTFNDIISAVQTYGDGYLSIVEKYTPSDGSLTEQFSRTDGTPLSASALTWSYASLLTASARRQSVVPASWGESSASSVPAVCSATSATGPYSTATNTVWPSSGSGSSTTTSSAPCTTPTSVAVTFDEIVSTSYGETIYLAGSIPELGNWSTASAIPLRADAYTNSNPLWYVTVNLPPGTSFEYKFFKNQTDGTIVWEDDPNRSYTVPAYCGQTTAILDDSWQ

SEQ ID NO: 1837 - DNA, 2769 bp, Arxula adeninivorans
cacagaccagacggagatcatcctaacattagcaattccaaatccgccgacccgttcgttactcaggttgatcataaggggtcctcattccccaagaggagaaaacggtgtcttaattgcgcacctcttgtttttgtagcatttttcaactaactagaccgttcgttctatacctaattacaacatccgcccacctttctccttattgatttgcaattactatccgaatagcgccgatattgtttggtgccgtagatgcaatgttattacggcaggaaaaatatgtacggataattgttccgcgaaaatccggaatcgtaaattgtattatcggatctgatgaatcagctatgaaagataatatatggtatagctacgactatagtaaaccatagtcaaaatcaaaagtttcaacgttttcactgttatctcatttatccccggattggccaagaaactaaggttttttggaccctggaacatgcataatgcggagatctcactcggcccgacttggaagtgtaagggaggggatccaactcggcccgactggaaggtgcaatgagtgaatggaagtagactggaggactatataaacactcgcagcctggttacaattgacgtggacgaaacagaatgcgtcagtttctagcacttgctgctgctgcttccatagcggtggcagattcttgtcacacgtttaccttggccaactctcctcctgacgacaaagctgttgcgttgagttcgtactcctattgtggaggttatcttagcgcatctgcgttcgtaaagaacttgagctatgacaagcttgtcactttgtattggaccaatgctgacaacaagtctactcctctcaatgcgggttccttggactatgtcaaggctgccagcgatgatcagtcttgggaactgtggtcattgaacgtaaccaccgtacctgatggagttgacgcccttcttaacattacttatgtggctgccagcattggaaagactaacagccagcagttgaatgtccaagttgaagccactggagatcccattcccactccccaaatccctaccatctataagccatatgcttctcccagtgatttctccgacgacattactaattggctcaaaccttccaacgactcccagactggaattgcaaagtcattcctgtttaacaacatcaacattcctggtgcagccccaggaactgtcattgccgctcagtcgtattcagaacccgattacgcatacacttgggtgagagatgcctccttggtgatggatgtggtcaacagactttattcatctgctaaatcggaagaaaaacgccagttgtacgaaaagatccttttccagtatgcaaaagctggtgctcaggagcaaaatgatcccacggcaatttccggcatgggagaaccaaagttctatctgaacaacactgcgttcactggctcatggggacggcctcagaacgatggaccagctacccgggccattacgctgattgagtttgctaacgcttatctagccaatggaggctcccaggacactgtccgggaacagctctacgattctgacaaatatccacaggtagctcccatcaagaaggaccttcaatttgtagcttccaattggtcctctccctcattcgacttgtgggaagaggaggagtcagctcacttctacactcggcttgttcagcgcaaggctctccttcttggagccgactttgcaaatgacatgggtgaccatgagctttccgacaagctcaaaactcaggcatcgaagttgtcggatacccttcctgagttctgggactctgcccgccagctgattctatatgaatatggcccagttctccgaggcaagtacagttacaaggatatttctgtcgttttgggcgtcatgcatggatacgctaatgacaatgtctttagttacaccaatgaccagatcctggcaactgcctaccaagtgtccaccagcttcctggatgtgtacaaggttgctaatactacttctgatgaatctggtaagccattgggtattcccgtaggccgttatcccgaggatgtgtatgatggagttggaaccagccagggcaacccatggtatctgacaaccatggctatggcggaattcctttaccgatcagttcaggagtttgaggatgccggatcaatcatcatttcggacacttctctaccattctggaaatactttgcctcttcagtcgaccacaaggcgggagcgaagtacaataagaatgaccagtcgttcaagacgtctcttaaatcccttactggatggggagatgcattcatgcgacgagcaaagtaccacactccttcttctggccacatgtctgaagagtttaacagaacaaccggagagccccgaggtgcgaaggatcttacctggagttacgctagtttgctgagtgctgcttttgcaagagaggaactgcgaaaccagaagaactatctcaccaatgttgctgacctatagtttgtgagtttcaaatactattagttacaattactgtctcagcctacgcaatcgtaacctaatgacaagattttccaaacttgaccaaacgagcataattatatggcagtggagccaagaaccctgcccctgttgcaatggctgctgcaatccagaattgggggtcatcgagagacacaattcctccagtaaaatgataatctaccaaattttcggccgcctccattgccagcattgacactaaactcattcctgcag

SEQ ID NO: 1838 - protein, 624 aa, Arxula adeninivorans
MRQFLALAAAASIAVADSCHTFTLANSPPDDKAVALSSYSYCGGYLSASAFVKNLSYDKLVTLYWTNADNKSTPLNAGSLDYVKAASDDQSWELWSLNVTTVPDGVDALLNITYVAASIGKTNSQQLNVQVEATGDPIPTPQIPTIYKPYASPSDFSDDITNWLKPSNDSQTGIAKSFLFNNINIPGAAPGTVIAAQSYSEPDYAYTWVRDASLVMDVVNRLYSSAKSEEKRQLYEKILFQYAKAGAQEQNDPTAISGMGEPKFYLNNTAFTGSWGRPQNDGPATRAITLIEFANAYLANGGSQDTVREQLYDSDKYPQVAPIKKDLQFVASNWSSPSFDLWEEEESAHFYTRLVQRKALLLGADFANDMGDHELSDKLKTQASKLSDTLPEFWDSARQLILYEYGPVLRGKYSYKDISVVLGVMHGYANDNVFSYTNDQILATAYQVSTSFLDVYKVANTTSDESGKPLGIPVGRYPEDVYDGVGTSQGNPWYLTTMAMAEFLYRSVQEFEDAGSIIISDTSLPFWKYFASSVDHKAGAKYNKNDQSFKTSLKSLTGWGDAFMRRAKYHTPSSGHMSEEFNRTTGEPRGAKDLTWSYASLLSAAFAREELRNQKNYLTNVADL

SEQ ID NO: 1839 - DNA, 1533 bp, Aspergillus terreus
atgttgaccaaagctattctcctcaatgctctggcgggcaccgccctggcatctcctcaccacttccccgtcttcaagagacaatccagtctcagcgacttcatcagcagcgaaacctcgatcgcgaagaagggcgtccttgccaacatcggcgctgacggagccaaagcctcaaacgcctctgctggagtcgttgtcgcctctccgtccaagtcggacccagactgttcgtcgccaaccccctccctcccttccacggccatgctaaccaccacagacttctacacctggacccgcgactccggcctgacgctggcggccttgatcgagcaattcctggcgggcgacgactcgctggagacgctcatccaggagtacgtcacctcgcaggccaagcagcaggcggtctccaacccgtccggcgatctctccgacggctcggggctgggcgagcccaagttcaacgcggacctcacggcgttcacggacgcctggggacggccgcagcgcgacgggccggcgctgcgcgcctccgccctcatcgcgtacggcaactccctggtgacaagcaacaaggcgctggtgcagaagaacatctggccgatcgtggctaacgacctcgcctacgtcggccagtactggaaccagagcacctacgacctgtgggaggaggtgcagggctcgtcgttcttcacgaccgccgtgcagcaccgcgcgctcgtcgagggcaaggcgttcgccacctcgctcggcgagacctgcgacgcctgctcggtcgcgccccagatcctctgcttcctgcagagctactggaacggctcggcggtcatctccaacacgcccagcagcgggcgcagcggcatcgacgctaactccgtcctcgcctccatccacacgttcgacccggccgcctcttgcgacgacaccaccttccagccgtgcagctcgcgcgccctatccaaccacaagatctacgtcgactcgttccgcgacatctacaccgtcaaccagggccgcggcgctggaaaggcggctgccaccgggcgctacatggaggacagctacatgggcggaaacccttggtacctgacgaccctggccgccggagagatgctgtatgacgctctctaccaatgggaccagcagggcgcgatcaaggtggacgcagtctcgcagccgttctgggcggacctggtcggcaacgtgacgaccggatccttcgccaaatcctctgcgcagtaccagtcgatgaccagcgccgtcaagacctacgccgacggcttcgtctccgtggtgcaagagtacacccccagcgacggcagcctgtcggagcagtacgcccgcgacggcggcgacccgacgtccgcgaccgatctgacctggtcttatgcggcgttcctgaccgcggtcgccagacgcaatgggactgtgccggcgtcgtggggcgcgtcgtccgccagcgatgtgcccagccagtgcagtggggagacggtgcagggcgcgtattccacgcctgccgtgccttcttggtag

SEQ ID NO: 1840 - protein, 510 aa, Aspergillus terreus
MLTKAILLNALAGTALASPHHFPVFKRQSSLSDFISSETSIAKKGVLANIGADGAKASNASAGVVVASPSKSDPDCSSPTPSLPSTAMLTTTDFYTWTRDSGLTLAALIEQFLAGDDSLETLIQEYVTSQAKQQAVSNPSGDLSDGSGLGEPKFNADLTAFTDAWGRPQRDGPALRASALIAYGNSLVTSNKALVQKNIWPIVANDLAYVGQYWNQSTYDLWEEVQGSSFFTTAVQHRALVEGKAFATSLGETCDACSVAPQILCFLQSYWNGSAVISNTPSSGRSGIDANSVLASIHTFDPAASCDDTTFQPCSSRALSNHKIYVDSFRDIYTVNQGRGAGKAAATGRYMEDSYMGGNPWYLTTLAAGEMLYDALYQWDQQGAIKVDAVSQPFWADLVGNVTTGSFAKSSAQYQSMTSAVKTYADGFVSVVQEYTPSDGSLSEQYARDGGDPTSATDLTWSYAAFLTAVARRNGTVPASWGASSASDVPSQCSGETVQGAYSTPAVPSW

SEQ ID NO: 1841 - DNA, 3455 bp, Thermomyces lanuginosus
cacagggcagccgtggtcgaattgtcaggtacgcgcaaaccggtccgctcagcatgaaatagatcgactgagcttatccactcatccggagtctgctgcccggaccagtgtgggcgacagcagagcagcaattgcggcgagagacttcatctttatgtggccaactgaagtactactcgttctatgacttgtcccgagttgaaatcgagaatcatccaacgagtcttttttcgacgagagactcagataacctcgtctgatcagttcagttgtgaccacgacagagtcagacatcggcgacaaagtggctcgatcaaccctttaaatattctacgattcgctcggtgaaggtcataccgagattagagcaaaaggcgacgacggaaaattcggaccatccatagccgtagattgatcgactgcggtggcaatggcatcttccatcttctcaaatgagcgaggtacatgattctaaagccgttggtagatgggcaattaggcaaatgtttggacaaaggtttattgtgatgggcagacaactccacccgcgacggcttctcatcacgcccaattgaacgtcgtcggatgatcgtgatggtcagttttgaggtatcttccgaagagccaatttggattacccggcagtccggcagtccgacggtcccagacaaggatcaatcagggcctggcactattttagcatgtcggttagtccccaatcggctctgcatttgacagcggacatctgccgatcaggaacgaaacggtgcctgccgttgttgccctgtgagctctttatgcatgtcaattcataataatcccgataataggccgcagctattccaccctggggaaagggtttgttgaagtgtcgatttggggtacatctgggggttcggcacttcagtgtctccaggtccgaatttcatgcattcatgcatgaaaatgcggagggaacctcggcactgtcaccatccccgtcaaatacggcttttggcgggctacatggctacaatggccacaatggctacaacggcctgtcaaggtatccattaatttctccgaagctcctgcaacgtttcgacaccctaaatttccgtttcgctacggagagcggagtaccggatactttttggacttttcatgtgcttctgtcgggcattcaaagaccgggcctgtcctaacgtccaggggatcgtttggcagatcttccctcatgcgttcacagagcgaagtttgtttaattgagtcatcaaaacatgttattccaaccgactttgtgcgcggcccttggactcgccgccttgatcgtccaaggcggagaagctagacctgaaacaaccgtcccacatgcaacgggctcgctcgacgacttcctcgccgcacagagtccgattgctttccaaggcatcctgaacaatatcgggcctagcggagcgtactcggaaggtgtcaatccgggtgtggtcattgcgagtccaagtaaacaagatcccgactgtatgcctgctctggaaatttttcaattctgttggcaggactctctctctaatatggcacatagacttttacacctgggtgcgcgacgctgctctcactgtccaatatctggtggaggagctggttgcaggaaatgccagtcttcagttcctcattcaggactacatcagctcccaggcacgactgcagacggtggaaaatccatccggctccctctcgtcgggtggtctaggagagcccaagtttcatgtcgacgagaccgcctttacggactcctggggccgaccacagcgggacggcccgcctctccgcgccattgccatgatttcgtttgccaattacctgattgtaagtcagatttcccatcatgcgagtaaattgacatggatgtgctcagtgtagttttcaggacaacggtcatcaatcgactgtggaggacatcatctggccgattgttcgcaatgacttgtcctatgtctcgcagcattggaacgaaacaacttttggtatgtgcttacgccgtactagttgattggagagtttggattataggagagcctcaagctaatacggagtttttccgaagacatctgggaggaagtccatagctcatcgtttttcaccacggctgtccagtaccgtgctctggtccaaggcagtgccttggctagcaagctcggccatacctgcgacaactgcgggtcccaagcaccgcagatcctttgcttcctgcagtcgtattggaccgggtcgcacatcttagccaacaccggtggcggccgctcgggaaaggacgtcagcacgatcctcggcgtcattggctcgtttgatccgaacgccgactgtgatgacgttaccttccagccctgctcggcccgggctcttgcaaatcacaagcaggtcgttgacagcttccgcagtatctatgccatcaacgctggcatcccgtcagggtcggctgttgcggttggacgttatcccgaggatgtctatcagggtggacacccctggtacctaacaacggctgcggcggcggagcagctttacgacgccatttaccagtggaaccatgtagggcacatcgacatcaatgctgtcaatctggacttcttcaagagcatttatccgtcagccgccgagggcacatacacatcagactcttcaacatttcaagacattatatctgctgtacggacctatgcggacgggtttctcagcgtaattgtaagtccaaaccttcgaaaacgaatgcctcaagtcttccactgacattttgcgcaggagaaatacactccgccggataacttgcttgccgagcagttccaccgggagacgggcattccactatcggcagcttctctgacatggtcctacgccgcgctcaacacggccgcgcagcggcgagcgtcaatcgtgccctcaccgtggaactctaacagcacagatctcccggacaaatgctcggcaacctcggcaacagggccgtatgccacgcccacaaacacggcatggccaaccactacgcagccaccggagcggccggcatgcacaccgccgtcggaagtaacactcaccttcaacgcgctcgtcgacaccgcgtttggccagaatatttatctcgtgggctccattccggagctcggatcgtgggatccggccaacgccctcttgatgagcgcaaagagctggactagcggaaatccggtctggacgctatccatttcccttccagcaggaacctcttttgagtacaagttcattcgaaaggatgatggttcctcggatgttgtctgggaaagtgacccgaatcgttcgtacaacgtgccgaaagattgcggtgccaacacggccaccgtgaattcttggtggcgatgaaccaacttgtttctgtccacactccgccctgttgtcagttcctggtcgtagatcgataaaatatgacttgtgtacttgac

SEQ ID NO: 1842 - protein, 617 aa, Thermomyces lanuginosus
MLFQPTLCAALGLAALIVQGGEARPETTVPHATGSLDDFLAAQSPIAFQGILNNIGPSGAYSEGVNPGVVIASPSKQDPDYFYTWVRDAALTVQYLVEELVAGNASLQFLIQDYISSQARLQTVENPSGSLSSGGLGEPKFHVDETAFTDSWGRPQRDGPPLRAIAMISFANYLIDNGHQSTVEDIIWPIVRNDLSYVSQHWNETTFDIWEEVHSSSFFTTAVQYRALVQGSALASKLGHTCDNCGSQAPQILCFLQSYWTGSHILANTGGGRSGKDVSTILGVIGSFDPNADCDDVTFQPCSARALANHKQVVDSFRSIYAINAGIPSGSAVAVGRYPEDVYQGGHPWYLTTAAAAEQLYDAIYQWNHVGHIDINAVNLDFFKSIYPSAAEGTYTSDSSTFQDIISAVRTYADGFLSVIEKYTPPDNLLAEQFHRETGIPLSAASLTWSYAALNTAAQRRASIVPSPWNSNSTDLPDKCSATSATGPYATPTNTAWPTTTQPPERPACTPPSEVTLTFNALVDTAFGQNIYLVGSIPELGSWDPANALLMSAKSWTSGNPVWTLSISLPAGTSFEYKFIRKDDGSSDVVWESDPNRSYNVPKDCGANTATVNSWWR

SEQ ID NO: 1843 - DNA, 2602 bp, Aspergillus niger
ttcgtcgcctaatgtctcgtccgttcacaaactgaagagcttgaagtggcgagatgtctctgcaggaattcaagctagatgctaagcgatattgcatggcaatatgtgttgatgcatgtgcttcttccttcagcttcccctcgtgcgagtgaggtttggctataaattgaagtggttggtcggggttccgtgaggggctgaagtgcttcctcccttttaggcgcaactgagagcctgagcttcatccccagcatcattacacctcagcaatgtcgttccgatctctactcgccctgagcggcctcgtctgcacagggttggcaaatgtgatttccaagcgcgcgaccttggattcatggttgagcaacgaagcgaccgtggctcgtactgccatcctgaataacatcggggcggacggtgcttgggtgtcgggcgcggactctggcattgtcgttgctagtcccagcacggataacccggactgtatgtttcgagctcagatttagtatgagtgtgtcattgattgattgatgctgactggcgtgtcgtttgttgtagacttctacacctggactcgcgactctggtctcgtcctcaagaccctcgtcgatctcttccgaaatggagataccagtctcctctccaccattgagaactacatctccgcccaggcaattgtccagggtatcagtaacccctctggtgatctgtccagcggcgctggtctcggtgaacccaagttcaatgtcgatgagactgcctacactggttcttggggacggccgcagcgagatggtccggctctgagagcaactgctatgatcggcttcgggcagtggctgcttgtatgttctccacccccttgcgtctgatctgtgacatatgtagctgactggtcaggacaatggctacaccagcaccgcaacggacattgtttggcccctcgttaggaacgacctgtcgtatgtggctcaatactggaaccagacaggatatggtgtgtttgttttattttaaatttccaaagatgcgccagcagagctaacccgcgatcgcagatctctgggaagaagtcaatggctcgtctttctttacgattgctgtgcaacaccgcgcccttgtcgaaggtagtgccttcgcgacggccgtcggctcgtcctgctcctggtgtgattctcaggcacccgaaattctctgctacctgcagtccttctggaccggcagcttcattctggccaacttcgatagcagccgttccggcaaggacgcaaacaccctcctgggaagcatccacacctttgatcctgaggccgcatgcgacgactccaccttccagccctgctccccgcgcgcgctcgccaaccacaaggaggttgtagactctttccgctcaatctataccctcaacgatggtctcagtgacagcgaggctgttgcggtgggtcggtaccctgaggacacgtactacaacggcaacccgtggttcctgtgcaccttggctgccgcagagcagttgtacgatgctctataccagtgggacaagcaggggtcgttggaggtcacagatgtgtcgctggacttcttcaaggcactgtacagcgatgctgctactggcacctactcttcgtccagttcgacttatagtagcattgtagatgccgtgaagactttcgccgatggcttcgtctctattgtggtaagtctacgctagacaagcgctcatgttgacagagggtgcgtactaacagaagtaggaaactcacgccgcaagcaacggctccatgtccgagcaatacgacaagtctgatggcgagcagctttccgctcgcgacctgacctggtcttatgctgctctgctgaccgccaacaaccgtcgtaactccgtcgtgcctgcttcttggggcgagacctctgccagcagcgtgcccggcacctgtgcggccacatctgccattggtacctacagcagtgtgactgtcacctcgtggccgagtatcgtggctactggcggcaccactacgacggctacccccactggatccggcagcgtgacctcgaccagcaagaccaccgcgactgctagcaagaccagcaccagtacgtcatcaacctcctgtaccactcccaccgccgtggctgtgactttcgatctgacagctaccaccacctacggcgagaacatctacctggtcggatcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctggcggtgacaatcaatccatttcgctatagttaaaggatggggatgagggcaattggttatatgatcatgtatgtagtgggtgtgcataatagtagtgaaatggaagccaagtcatgtgattgtaatcgaccgacggaattgaggatatccggaaatacagacaccggg

SEQ ID NO: 1844 - protein, 640 aa, Aspergillus niger
MSFRSLLALSGLVCTGLANVISKRATLDSWLSNEATVARTAILNNIGADGAWVSGADSGIVVASPSTDNPDYFYTWTRDSGLVLKTLVDLFRNGDTSLLSTIENYISAQAIVQGISNPSGDLSSGAGLGEPKFNVDETAYTGSWGRPQRDGPALRATAMIGFGQWLLDNGYTSTATDIVWPLVRNDLSYVAQYWNQTGYDLWEEVNGSSFFTIAVQHRALVEGSAFATAVGSSCSWCDSQAPEILCYLQSFWTGSFILANFDSSRSGKDANTLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDAATGTYSSSSSTYSSIVDAVKTFADGFVSIVETHAASNGSMSEQYDKSDGEQLSARDLTWSYAALLTANNRRNSVVPASWGETSASSVPGTCAATSAIGTYSSVTVTSWPSIVATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 1845 - protein, 534 aa, Aspergillus niger
MSFRSLLALSGLVCTGLANVISKRATLDSWLSNEATVARTAILNNIGADGAWVSGADSGIVVASPSTDNPDYFYTWTRDSGLVLKTLVDLFRNGDTSLLSTIENYISAQAIVQGISNPSGDLSSGAGLGEPKFNVDETAYTGSWGRPQRDGPALRATAMIGFGQWLLDNGYTSTATDIVWPLVRNDLSYVAQYWNQTGYDLWEEVNGSSFFTIAVQHRALVEGSAFATAVGSSCSWCDSQAPEILCYLQSFWTGSFILANFDSSRSGKDANTLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDAATGTYSSSSSTYSSIVDAVKTFADGFVSIVETHAASNGSMSEQYDKSDGEQLSARDLTWSYAALLTANNRRNSVVPASWGETSASSVPGTCAATSAIGTYSSVTVTSWPSIVATGGTTTTATPTGSGSVTSTSKTTATASKTSTTTRSGMSL

SEQ ID NO: 1846 - DNA, 1879 bp, FOMITOPSIS PALUSTRIS
acgcgggagcatcggcaccttcagcaagatgcgtctctcactctcgttcgtccttggcctcgtcgccgcggctttcgcccagtcgaatgtcacctcttacatctcgactgagaccccccttgcgaaagccggtgtgctcgccaacatcgggcctgatgggtcgctctcctcgggtgctaagtcgggtattgtcatcgccagccccagcacggtgaaccccgactacctgtacacttggacccgggattcgtctctcacgttcaaggcgctcatcgaccaattcgtcagcggcgaggacgatactctgggtcccctcatcgatgacttcacctcagcgcaggcgattatccagcagattgacaaccctagtggtagcgtgagcactggtggtctcggagaacccaagttcaacatcgacgagaccgcgttcactggggcatggggccgcccgcagcgcgatggtcctgccctgcgtgctactgcgatcatgacttacgcgacgtatctgtacaacagtgggaacacgacctacgtgaccgacacgctctggcccatcattgagctcgacctcaactacgtcgctacttactggaacgagagcactttcgacctgtgggaagaggttgactcctcgtcgttcttcaccactgctgtgcagcaccgcgccttgcgagagggtatcactttcgcgaacctcatcggcgagacctcggacgtgagcaattgggagactcaagccgatgacctcctttgcttcctgcagtcgtactggaaccctactgatctgtatatgactgccaacaccggcggcggcaggtctggcaaggacgcaaacaccgttttggcctccatccataccttcgacccggaagccggctgcgacgacgtcacattccaaccttgctctgacaaggcgctgtcgaacttgaaggtttatgttgactcgttccgttcaatctacaccattaacagcggcatctcctctgacgctgcggtggccactggccgttatcccgaggactcctactacaacggcaacccttggttcctcacgaccctcgccgctgcggagcaactctatgatgcgctcattgtttggaacgcccaggggtcgctgaacgtcacctcaacctcgctcgccttcttccagcagttcgattcctccgtgactgccggaacctatgcttctggctcagacgagttcactacgctcacgagcgccatccaaaccttcgccgacggcttcgtggagatcatcgccaagtacacgccatcgaatggttctctcagcgagcaatacagcaagagcgatggctctgagctcagcgcgtatgacctgacctggagtttcgcggccgccctcactgctttcgaggcgcgtgctggcaacacttacggcagctggggtgcggccaacctgacgacaagctgctcgggcggcagttccggttcaactgtggctgttaccttcacggtcaactacgatacggtctggggcgagaacctctacatcacgggttccgtttcggagctgtcggattggtcgacgagctcggcgttgatcatgtccgccgcggattacccgacgtggagcatcaccgttgatctcccggcaagcacgaccatccagtacaagtacatcaccatctacgatggcaccgtcacctgggaggacgatccgaacaacgagatcacgacgcccgcgagcggcagtgtgactcaggcagacagctggcactaagttaaccgtgtactaaggtgttgtaaaacgtcgacgcactcaggctgtcgtcgagttgtcgtatgtgctataccctgtctttcgctccaaaatgttgttctcatagccgaatgcacttttcatgtgttgtttgttgcc

SEQ ID NO: 1847 - protein, 570 aa, FOMITOPSIS PALUSTRIS
MRLSLSFVLGLVAAAFAQSNVTSYISTETPLAKAGVLANIGPDGSLSSGAKSGIVIASPSTVNPDYLYTWTRDSSLTFKALIDQFVSGEDDTLGPLIDDFTSAQAIIQQIDNPSGSVSTGGLGEPKFNIDETAFTGAWGRPQRDGPALRATAIMTYATYLYNSGNTTYVTDTLWPIIELDLNYVATYWNESTFDLWEEVDSSSFFTTAVQHRALREGITFANLIGETSDVSNWETQADDLLCFLQSYWNPTDLYMTANTGGGRSGKDANTVLASIHTFDPEAGCDDVTFQPCSDKALSNLKVYVDSFRSIYTINSGISSDAAVATGRYPEDSYYNGNPWFLTTLAAAEQLYDALIVWNAQGSLNVTSTSLAFFQQFDSSVTAGTYASGSDEFTTLTSAIQTFADGFVEIIAKYTPSNGSLSEQYSKSDGSELSAYDLTWSFAAALTAFEARAGNTYGSWGAANLTTSCSGGSSGSTVAVTFTVNYDTVWGENLYITGSVSELSDWSTSSALIMSAADYPTWSITVDLPASTTIQYKYITIYDGTVTWEDDPNNEITTPASGSVTQADSWH

SEQ ID NO: 1848 - DNA, 1482 bp, Aspergillus oryzae
atgcggaacaaccttcttttttccctcaatgccattgctggcgctgtcgcgcatccgtccttccctatccataagaggcagtcggatctcaacgccttcattgaggcacagacacccatcgccaaacagggcgtcctcaataatatcggcgctgatggcaagcttgttgagggggctgccgctggtatcgttgtagcctccccatccaagagtaatcccgactacttctacacctggacgcgcgacgctggcctcaccatggaagaagtgatagagcaattcatcgggggagatgcgactctcgagtccacaatccagaattatgttgactctcaagcgaacgagcaggcagtctccaacccatcaggcggcctgtcggatggctcgggtcttgctgaacccaaattttacgtcaatatctctcaattcaccgattcttggggccgaccccagcgcgacgggccagccttacgtgcttccgctttgatcgcatatggcaactctctgatttccagcgacaaacaatctgttgtcaaagctaacatctggccaattgtccagaatgacttgtcttatgtgggtcaatactggaaccagaccgggtttgatctttgggaagaggttcagggcagctccttcttcactgttgctgtgcagcacaaagccttggtggagggcgatgcgtttgcaaaggcactcggagaggaatgccaggcatgctccgtggcgcctcaaatcctctgccatcttcaggacttctggaatgggtctgctgttctttctaacttaccaaccaatgggcgcagtggactggataccaactctcttttgggctccattcacacttttgatccagccgccgcttgtgatgatacaacattccagccctgctcctctcgcgccctgtcgaaccataagcttgtggttgactctttccggtcggtctacggtatcaacaatggacgtggagcaggaaaggccgcggcagtgggcccgtacgcagaggacacctatcagggaggcaatccatggtatcttaccaccctggtcgctgcggaattgctctacgacgccttgtatcagtgggacaaacaaggtcaagtgaacgtcactgaaacttcccttcccttcttcaaggacctctccagcaatgtcaccaccggatcctacgccaagtcttcctcagcctatgagtcgcttacgagcgctgtcaagacctacgcagacggcttcatctccgttgtccaggagtatactcccgatggcggtgctttggctgagcagtacagtcgggaccagggcaccccagtttcggcatccgatctgacttggtcttatgcagctttcttgagtgctgttggacgacgaaacggcactgtccctgctagctggggctcttccacggccaacgcagttccaagccaatgttcggggggtacagtttctggaagttacactaccccaactgttgggtcgtggtag

SEQ ID NO: 1849 - DNA, 2016 bp, Rhizopus oryzae
gatctcaatttgtgttgtgatatattcagatttaaaatttcaaacatatataagacgcgtttatttcctcgtttttcaaaaatcatcacttgtcttcaaattgatctttctctaatgcaactgttcaatttgccattgaaagtttcattctttctcgtcctctcttacttttctttgctcgtttctgctgcaagcattcctagtagtgcttctgtccagcttgattcatacaattacgatggctctactttttcaggaaaaatttatgtcaagaacattgcttactccaagaaggttactgtaatttacgccgatggctctgacaactggaataataatggaaacaccattgctgcttcttactctgctcctatttctggatcaaattacgaatactggacattctctgcctccattaatggtatcaaggagttctacattaagtatgaggtcagtggaaaaacatactatgataacaacaattctgccaattaccaagtatctacatccaagcctactactactactgctactgctactactactaccgctccttccacttcaaccacgactcccccctcaagctctgagccagctactttcccaactggtaactctacaatctcctcatggattaagaagcaagaaggtatcagccgctttgctatgcttcgaaacatcaatcctcctggaagcgctaccggtttcattgctgcctcactctctaccgctggtcccgattactactatgcttggactcgtgatgctgcattaacctccaatgtaattgtttacgaatacaacactactttgtccggtaataagactatcctcaacgtcctcaaggactatgttacattctcagtcaagacccaatcaacttctaccgtctgtaactgccttggtgagcctaagttcaatcctgatggttctggctatactggtgcttggggaagacctcaaaatgatggacctgctgaacgtgctactaccttcattttgtttgctgacagttatcttactcaaacaaaggatgcttcctatgtcactggtacactcaagcctgctatcttcaaggacttggactatgtcgtcaatgtctggtctaatggctgtttcgatttatgggaagaagtcaacggtgttcacttctatactttaatggttatgcgtaagggtttgcttcttggtgcagatttcgctaaacgtaacggtgactctactcgtgcatctacctatagcagcactgcatccactattgcaaacaagatctctagcttctgggtttcttctaataactggattcaagtcagtcaaagcgttactggtggtgtcagtaaaaagggtttggatgtctccacattgttggctgctaaccttggtagtgttgatgatggattcttcactcctggctctgaaaagatccttgccactgctgttgctgttgaagactccttcgcttccttgtatcctatcaacaaaaaccttccatcttaccttggtaactctattggtagatatcctgaagacacttacaatggtaacggaaactctcaaggaaactcttggttcttggctgtaactggttacgctgagctctattaccgtgccatcaaggaatggatcggcaacggtggtgtcactgtcagcagcataagtttacccttcttcaagaagtttgattcatctgctacatctggaaagaagtacactgttggtacctccgactttaacaaccttgctcaaaatattgcactcgctgctgaccgtttcttgtccactgtccagctccatgctcacaacaatggatctcttgctgaagagtttgaccgcaccactggtttatccaccggtgctagagacttgacctggtctcacgcttctttaatcaccgcttcttacgctaaggctggtgcacctgccgcttaagctgtaaatttaaatgcaaagcattacagcttattttctttttcaaataaaaacatattgatatgttcataacaaaaaaaaaaaaaa

SEQ ID NO: 1850 - DNA, 2537 bp, Saccharomycopsis fibuligera
ctgcagtcaacatgcgcattcgaaggataaaagatgttccgaggggttaaactgattatgactacacatcgtagatcacaacattatgccatagcacttttttggaagtgttcaaaaaatataagcgtgtcttcaatatagcggcgaggttctcttggtttggtaaatagaaattggtataaatacttactacatcacctcattttctacagttttacacaatataatctttatatatcaaaaatattcaaacaaaatcaataaaaacagaactttcttttttcaaatttttttgctaccttcctgaaacttctatttgctatgaaattcggtgttttattttccgtctttgctgctattgttagtgctttacctttgcaagaaggtcctttgaacaaaagagcctatccttcttttgaagcttattcaaactataaagttgacagaactgacttggaaaccttcttggacaaacaaaaagaagtatctttatactatcttttacaaaacattgcttatcctgaaggccaatttaataatggtgttcctggtactgttattgcttctccatcaacctctaatccggactactattaccaatggaccagagattccgcaattacatttttgacagttctttctgaactagaagataataacttcaataccactttggccaaggcagttgagtactacattaacaccagttacaaccttcaaagaaccagtaacccaagtggcagctttgatgatgaaaatcataaaggcttgggagaaccaaaatttaacacagatggttctgcatacaccggagcttgggggagaccgcaaaatgatggtcctgctttgagagcttatgctatcagtagatacttgaatgatgtcaattctttaaatgaaggtaaattagtattgactgattcaggtgatatcaacttttcttcaactgaagatatttacaaaaatatcatcaaaccagacttggaatatgttatagggtactgggattctactgggtttgatctttgggaggaaaaccaaggcagacacttttttacaagcttggttcaacagaaagcccttgcttatgctgtcgatattgccaaaagttttgacgacggcgactttgcgaacacactttcttcgactgcttctaccctcgaaagttatttgagtggcagtgatggtggatttgttaatactgatgttaaccacattgttgaaaacccagatttgcttcaacaaaactctagacaaggtctagattcagccacatatattggcccacttttgactcatgatattggtgaaagcagctcaactccatttgatgttgacaatgagtatgttttgcaatcatattacttgttattggaggataacaaagacagatactctgttaacagtgcttattctgctggtgcagctattggcagatacccagaagatgtttacaatggtgatggttcatctgaaggcaatccatggttcttagctactgcctatgctgcccaagttccatacaaacttgcttatgatgcaaagtcggcctcaaatgacattaccattaacaagattaactacgatttttttaacaagtatattgttgatttatctaccatcaattctgcttaccagtcttctgatagtgtcaccattaaaagtggctctgatgaatttaacacggttgctgataatttggtcacattcggtgattcctttttgcaagtcattttggatcatattaatgatgatggctccttgaatgaacaacttaacagatatacggttattccaccggtgcctactctttgacatggagcagtggtgctcttcttgaagctattagacttagaaataaggtcaaggctttggcttaagtgctttgaaaagtaagtgtttttcctttgtggagaacatgcaaccataatccgacagctttgttatgatactacttttttgatattttccccttctttgaccaggctatctaattatggctctattttctttctactttttggctcgagcttctgaaacatatacgtcagcgagtatcaataaacttttatttgttacttttttttaggatatctttaactggtaacttttggagattatcaatagagttaatagtatcgtggcgcctgcatatatagttaatgctattatttggaatttacactgtcagcacgtttccagtcttggtagtcaggaatagacttatgaaataacagaaagggcatccgtgaccatttatcatcaaaattatatcaaaacaattggtcgtggttcctacaaatattggaaaaaatattctctgagatgtattttcctccgattgggtcgtttctcttatactattcctgaatctacctaacactactagtagactgatgtgtctatctatcgtttaaatgagactaagatggaaaagattttgttgcaaagaaacaatttttttcaatattgtaaagtgaaaacattcaatacttttgaatttaatttccaagaatacaaaatcggtgttgctgcag

SEQ ID NO: 1851 - DNA, 3411 bp, Aspergillus awamorii
gaattcaagctagatgctaagcgatattgcatggcaatatgtgttgatgcatgtgcttcttccttcagcttcccctcgtgcagatgaaggaaaggctataaattgaagtggttggtcggggttccgtgaggggctgaagtgcttcctcccttttagacgcaactgagagcctgagcttgatccccagcatcattacacctcagcaatgtcgttccgatctctactcgccctgagcggcctcgtctgcacagggttggcaaatgtgatttccaagcgcgcgaccttggattcatggttgagcaacgaagcgaccgtggctcgtactgccatcctgaataacatcggggcggacggtgcttgggtgtcgggcgcggactctggcattgtcgttgctagtcccagcacggataacccggactgtatgtttcgagctcagatttagtatgagtgtgtcattgattgattgatgctgactggcgtgtcgtttgttgtagacttctacacctggactcgcgactctggtctcgtcctcaagaccctcgtcgatctcttccgaaatggagataccagtctcctctccaccattgagaactacatctccgcccaggcaattgtccagggtatcagtaacccctctggtgatctgtccagcggcgctggtctcggtgaacccaagttcaatgtcgatgagactgcctacactggttcttggggacggccgcagcgagatggtccggctctgagagcaactgctatgatcggcttcgggcaatggctgcttgtatgttctccacccccttgcgtctgatctgtgacatatgtagctgactggtcaggacaatggctacaccagcaccgcaacggacattgtttggcccctcgttaggaacgacctgtcgtatgtggctcaatactggaaccagacaggatatggtgtgtttgttttattttaaatttccaaagatgcgccagcagagctaacccgcgatcgcagatctctgggaagaagtcaatggctcgtctttctttacgattgctgtgcaacaccgcgcccttgtcgaaggtagtgccttcgcgacggccgtcggctcgtcctcgtcctggtgtgattctcaggcacccgaaattctctgctacctgcagtccttctggaccggcagcttcattctggccaacttcgatagcagccgttccggcaaggacgcaaacaccctcctgggaagcatccacacctttgatcctgaggccgcatgcgacgactggaccttccagccctgctccccgcgcgcgctcgccaaccacaaggaggttgtagactctttccgctcaatctataccctcaacgatggtctcagtgacagcgaggctgttgcggtgggtcggtaccctgaggacacgtactacaacggcaacccgtggttcctgtgcaccttggctgccgcagagcagttgtacgatgctctataccagtgggacaagcaggggtcgttggaggtcacagatgtgtcgctggacttcttcaaggcactgtacagcgatgctgctactggcacctactcttcgtccagttcgacttatagtagcattgtagatgccgtgaagactttcgccgatggcttcgtctctattgtggtaagtctacgctagacaagcgctcatgttgacagagggtgcgtactaacagaagtaggaaactcacgccgcaagcaacggctccatgtccgagcaatacgacaagtctgatggcgagcagctttccgctcgcgacctgacctggtcttatgctgctctgctgaccgccaacaaccgtcgtaacgtcgtgccttccgcttcttggggcgagacctctgccagcagcgtgcccggcacctgtgcggccacatctgccattggtacctacagcagtgtgactgtcacctcgtggccgagtatcgtggctactggcggcaccactacgacggctacccccactggatccggcagcgtgacctcgaccagcaagaccaccgcgactgctagcaagaccagcaccagtacgtcatcaacctcctgtaccactcccaccgccgtggctgtgactttcgatctgacagctaccaccacctacggcgagaacatctacctggtcggatcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagactgatcccaaccgagaatacaccgttcctcaggcgtgcggaacgtcgaccgcgacggtgactgacacctggcggtagacaatcaatccatttcgctatagttaaaggatggggatgagggcaattggttatatgatcatgtatgtagtgggtgtgcataatagtagtgaaatggaagccaagtcatgtgattgtaatcgaccgacggaattgaggatatccggaaatacagacaccgtgaaaggcatggtctttccttcgtgtagaagaccagacagacagtccctgatttaccctgcacaaagcactagaaaattagcattccatccttctctgcttgctctgctgatatcactgtcattcaatgcatagccatgagctcatcttagatccaagcacgtaattccatagccgaggtccacagtggagcagcaacattccccatcattgctttccccaggggcctcccaacgtctaaatcaagagtatatctctaccgtccaatagatcgtcttcgcttcaaaatctttgacaattccaagagggtccccatccatcaaacccagttcaataatagcccagatgcatggtggagtcaattaggcagtattgctggaatgtcggggccagttccgggtggtcattggccgcctgtgatgccatctgccactaaatccgatcattgatccaccgcccacgagggcgtctttgctttttgcgcggcgtccaggttcaactctctctgcagctccagtccaacgctgactgactagtttacctactggtctgatcggctccatcagagctatggcgttatcccgtgccgttgctgcgcaatcgctatcttgatcgcaaccttgaactcactcttgttttcctagtgatcttggtgacggagtgtcggtgagtgacaaccaacatcgtgcaagggagattgatacggaattgtcgctcccataatgatgttcttgccggctttgttggccctattcgtgggatcgatgccctcctgtgcagcagcaggtactgctggatgaggagccatcggtctctgcacgcaaacccaacttcctcttcattctcacggatgatcaggatctccggatgaattc

SEQ ID NO: 1852 - DNA, 1839 bp, Aspergillus oryzae
atggtgtctttctcctcttgtctccgggccttagccctcggatcctcagttctcgcggtccaacctgtccttagacaggcgactggtctagatacctggctgagcacagaagcaaatttttcccgccaggcaatcttgaataatatcggcgcagatggccagtcggcgcagggcgcaagtccaggggtggtgattgccagccctagcaaaagtgacccagattatttctatacctggacccgtgactcgggtctcgtcatgaaaaccctggtcgatctgttcagaggcggagatgccgatcttctccctatcatcgaggagttcattagctcccaggctcggatccaaggcatctcaaacccttctggtgctctttccagtgggggtctgggcgagcctaagttcaatgtcgacgagacagcatttaccggcgcatggggtcggccgcagcgtgacggaccagctttgcgcgcgaccgctatgatctcgtttggagaatggctagttgaaaatggtcatacaagcatagcgacggacctggtatggcctgttgttaggaatgatctatcctatgtggctcagtattggagccaatccgggttcgatctctgggaggaagtccaaggcacatcattctttactgttgcagtttctcatcgcgctttggtagaaggtagcagcttcgcaaagactgtcggttcctcgtgcccctattgtgactcgcaagcgccccaagtccgatgttatttacaatccttctggaccgggagttacatccaggccaatttcggtggcgggcgatcgggcaaagacatcaacactgtcctgggtagtatccacacgttcgatcctcaagcgacgtgtgatgatgctaccttccagccctgttcggcgcgagccttggccaaccataaggtagtaacggactcgttccgatcaatctatgccatcaactccggtcgtgctgagaatcaagctgttgctgttggccgctaccccgaagacagctattacaacgggaatccttggttcctgaccaccctggccgccgcagagcagttgtatgacgcgttgtaccagtgggataaaattggatcattggccatcacggacgtttctttgccattcttcaaagctctttacagttctgccgcgacagggacctacgcatcgtccacgacggtgtataaggatattgtctcagccgtcaaggcctatgcagacggatacgtgcagatcgtccaaacctacgctgcatccaccggctccatggccgagcaatataccaagacggacgggagtcagacctccgcccgggatcttacctggtcgtacgctgcacttctcacggccaacaaccgacgaaacgcggtcgttcctgcaccatggggcgagaccgctgccaccagcattccgtcagcttgctctacgacttccgcctcgggcacctacagcagcgtggttatcacatcctggccgaccattagcggatacccaggcgcgccagacagcccctgccaggtgccgacgactgtgtcggtgaccttcgcggtgaaagctactacggtctacggtgagtctatcaagatcgtcgggtcgatctctcagctcgggagctggaatcctagcagcgcgaccgcattgaacgcggacagctacactactgacaaccccttgtggacgggaacaataaacttgcctgctggacagtcgttcgagtataagtttattcgcgttcagaacggggcggttacgtgggagagtgaccccaaccggaaatataccgttccttcgacttgcggggtgaaaagtgctgtgcagagcgatgtttggcggtga

SEQ ID NO: 1853 - protein, 612 aa, Aspergillus oryzae
MVSFSSCLRALALGSSVLAVQPVLRQATGLDTWLSTEANFSRQAILNNIGADGQSAQGASPGVVIASPSKSDPDYFYTWTRDSGLVMKTLVDLFRGGDADLLPIIEEFISSQARIQGISNPSGALSSGGLGEPKFNVDETAFTGAWGRPQRDGPALRATAMISFGEWLVENGHTSIATDLVWPVVRNDLSYVAQYWSQSGFDLWEEVQGTSFFTVAVSHRALVEGSSFAKTVGSSCPYCDSQAPQVRCYLQSFWTGSYIQANFGGGRSGKDINTVLGSIHTFDPQATCDDATFQPCSARALANHKVVTDSFRSIYAINSGRAENQAVAVGRYPEDSYYNGNPWFLTTLAAAEQLYDALYQWDKIGSLAITDVSLPFFKALYSSAATGTYASSTTVYKDIVSAVKAYADGYVQIVQTYAASTGSMAEQYTKTDGSQTSARDLTWSYAALLTANNRRNAVVPAPWGETAATSIPSACSTTSASGTYSSVVITSWPTISGYPGAPDSPCQVPTTVSVTFAVKATTVYGESIKIVGSISQLGSWNPSSATALNADSYTTDNPLWTGTINLPAGQSFEYKFIRVQNGAVTWESDPNRKYTVPSTCGVKSAVQSDVWR

SEQ ID NO: 1854 - DNA, 2641 bp, Trichoderma harzianum
gtctgtcttacatccagccagcccgcgtgaagaggagacgacagaaggatagaagagccgagcaggaaagagctgaagatccctgcaattgcccaactactgtttattgccatcgccgctgcttgctcctttgtttctatcccgcagccactgagtgcaaaccgccatattcagccggtttttcttttcacaggtttgcaccgcccgtcgcggcacttgggccccggagaatcggccctttcacagcgttgcggccctcagttccccatggggatgatccgcacatccactcttggccctgtagaccttttgttgtcggtccgagtcggactaaactgagtgttgagagttgtacctacgcacgacgttgcgggcaacagctgatctcattggaccaagtcggcaaaacgaaagccgttgttgttattgcgagaagtgctctgactcggggcgccgtatcataaagatgcctgccttcgccatggacctggccgcgagccactcggcatcggctctgtctctcaacgtttcctctcatacgtcttccttcattccgcccatcatgcacgtgctgtcgactgctgtgctacttggctcagttgccgtccaaaaagttctgggaagaccaggatcaaacggcctgtccggcgtcacaaaacgatctgtggatgactttatcaacacacagactcccattgcactaaacaaccttctttgcaatgttggccctgatggatgccgtgcctttggtacatcggccggtgctgtgattgcatctccgagcacaactgacccagactactactacatgtggacgcgagatagtgctcttgtcttcaagaacattgtcgaccgcttcactcagcagtatgatgccggcctgcagcgccgcatcgagcagtacatttctgcccaggtcactcttcagggcatctcaaacccctctggctctctttcggacgggtccggtcttggtgaacccaagtttgagttgaccttgagccagttcactggcaactggggtcgcccgcagcgcgatggcccagctctccgagccattgccttgattggttattcgaagtggctcatcaacaacaactaccagtcaacggtgtcaaatatcatctggcccattgtacggaatgacctcaactatgttgcccaatactggaaccaaaccggtttcgacctgtgggaggaagtcaatggtagctcgttctttaccgttgccaaccagcaccgagctcttgtagggcgccacacttgctgccaccctcggccagtcgggaagcacctattcctcagttgcgcctcaagatcctgtgcttcctccaaagattctgggtgtcgggtggatacattgactccaccatcaccaccaacgaaggcaggactggaaaagatgccaactctcttctcgcatctatccacacgttcgatcctagcctcgggctgcgacgcctctaccttccagccttgcagtgacaaagctctctccaacctcaaggttgttgtagactccttccgctccatctacggtgtcaacaagggcattcccgctggctctgctgtcgccatcggcagataccccgaagacgtgtactttaacggtaacccctggtatctcgccacgttcgctgctgccgagcaactttacgactccgtctacgtctggaagaagacaggctccatcacagtgacttccacttctttggccttcttccaggagctcgtccccggcgtcgcagctggaacttactccagcagccagtctaccttcacaagcatcatcaacgccgtctcgacatatgctgatggattcctcagcgaggctgccaagtacgtccccgctgatggttcgctcgccgagcagtttgatcgcaacaccggcacacctctgtcagctgttcacctgacctggtcgtacgcctcgtttctcaccgccgcggcccgtcgggctggcgttgtccccccctcgtgggccagcagtggcgccaactcagtcccttcaagctgctcgggagcttctgtggttggatcctactcgcgtcctacagccagtcattccaccatcgcacccccaagcggcgttcttgggtactccttcacttcccattcctgtgctaccccgacttccgttgccgtcactttccatgagcttgccgcaaccaagtttggtcagactatcaaagtcgctggtagcgctcccgagctgggcaatggagcacgagcgcagccattgctctggatgccgtcaactatgccactaaccatcccttgtggattggatcggtcaatctggaggccggggacgttatcgagtacaagtacatcaacgtgggccaggatggttccgtcacctgggagagcgaccccaaccacacctacactgttcctgcggtggcctgtgttaccgaggtggtgaaggaggatacctggcagtcataataaatgaaagcactgaggatacagagtactgagcatgaagtacagattgcagatggaagatgggggattgaaattgccaatagaacaagtgggatacatcgggcaaccagtagggaagaatgctcttcacgatgatgcgttatagcattaatttagccgttatgaatcagacatgaatatccgatcaatatgg

SEQ ID NO: 1855 - protein, 620 aa, Trichoderma harzianum
MHVLSTAVLLGSVAVQKVLGRPGSNGLSGVTKRSVDDFINTQTPIALNNLLCNVGPDGCRAFGTSAGAVIASPSTTDPDYYYMWTRDSALVFKNIVDRFTQQYDAGLQRRIEQYISAQVTLQGISNPSGSLSDGSGLGEPKFELTLSQFTGNWGRPQRDGPALRAIALIGYSKWLINNNYQSTVSNIIWPIVRNDLNYVAQYWNQTGFDLWEEVNGSSFFTVANQHRALVGRHTCCHPRPVGKHLFLSCASRSCASSKDSGCRVDTLTPPSPPTKAGLEKMPTLFSHLSTRSILASGCDASTFQPCSDKALSNLKVVVDSFRSIYGVNKGIPAGSAVAIGRYPEDVYFNGNPWYLATFAAAEQLYDSVYVWKKTGSITVTSTSLAFFQELVPGVAAGTYSSSQSTFTSIINAVSTYADGFLSEAAKYVPADGSLAEQFDRNTGTPLSAVHLTWSYASFLTAAARRAGVVPPSWASSGANSVPSSCSGASVVGSYSRPTASHSTIAPPSGVLGYSFTSHSCATPTSVAVTFHELAATKFGQTIKVAGSAPELGNGARAQPLLWMPSTMPLTIPCGLDRSIWRPGTLSSTSTSTWARMVPSPGRATPTTPTLFLRWPVLPRW

SEQ ID NO: 1856 - DNA, 1881 bp, Saccharomycopsis fibuligera
ctgcagtcaacatgcgcattcgaaggataaaagatgttccgaggggttaaactgattatgactacacatcgtagatcacaacattatgccatagcacttttttggaagtgttcaaaaaatgtaagcgtgtcttcaatatagcggcgaggttctcttggtttggtaaatagaaattggtataaatacttactacatcacctcattttctacagttttacacaatataatctttatatatcaaaaatattcaaacaaaatcaataaaaacagaactttcttttttcaaatttttttgctaccttcctgaaacttctatttgctatgagattcggtgttttaatttccgtctttgttgctattgttagtgctttacctttgcaagaaggtcctttgaacaaaagagcctatccttcttttgaagcttattcaaactataaagttgacagaactgacttggaaaccttcttggacaaacaaaaagatgtatctttatactatcttttacaaaacattgcttatccagaaggccaatttaatgacggtgttcccggtactgttattgcttctccatcaacctctaatccggactactattaccaatggaccagagattccgcaattacatttttgacagttctttctgaactagaagataataacttcaataccactttggctaaggcagttgagtactacattaataccagttacaaccttcaaagaaccagtaacccaagtggcagctttgatgatgaaaatcataaaggcttgggagaaccaaaatttaacacagatggttctgcatacaccggagcttgggggagaccgcaaaatgatggtcctgctttgagagcttatgctatcagtagatacttgaatgatgtcaattctttaaataaaggtaaattagtattgactgattcaggtgatatcaacttttcttcaactgaagatatttacaaaaatatcatcaaaccagacttggaatatgttatagggtactgggattctactgggtttgatctttgggaggaaaaccaaggcagacacttttttacaagcttggttcaacagaaagcccttgcttatgctgtcgatattgccaaaagttttgacgatggcgactttgcgaacacactttcttcgactgcttctaccctcgaaagttatttgagtggcagtgatggtggatttgttaatactgatgttaaccacattgttgaaaacccagatttgctccaacaaaactctagacaaggtctagattcagccacttatattggcccacttttgactcatgatattggcgaaagcagctcaactccatttgatgttgacaatgagtatgttttgcaatcatattacttgttattggaggataataaagacagatactctgttaacagtgcttattctgctggtgcagctattggcagatacccagaagatgtttacaatggtgatggttcatctgaaggcaatccatggtttttagctactgcctatgctgcccaagttccatacaaacttgtttatgatgcaaagtctgcctcaaatgacattaccattaacaagattaactacgatttttttaacaagtatattgttgatttatctaccatcaattctggttaccagtcttctgatagtgtcaccattaaaagtggctctgatgaatttaacacggttgctgataatttggtcacattcggtgattcctttttgcaagtcattttggatcatattaatgatgatggctccttgaatgaacaacttaacagaaataccggttattccaccagtgcctactctttgacatggagcagtggtgctcttcttgaagctattagacttagaaataaggtcaaggctttggcttaa

SEQ ID NO: 1857 - protein, 519 aa, Saccharomycopsis fibuligera
MRFGVLISVFVAIVSALPLQEGPLNKRAYPSFEAYSNYKVDRTDLETFLDKQKDVSLYYLLQNIAYPEGQFNDGVPGTVIASPSTSNPDYYYQWTRDSAITFLTVLSELEDNNFNTTLAKAVEYYINTSYNLQRTSNPSGSFDDENHKGLGEPKFNTDGSAYTGAWGRPQNDGPALRAYAISRYLNDVNSLNKGKLVLTDSGDINFSSTEDIYKNIIKPDLEYVIGYWDSTGFDLWEENQGRHFFTSLVQQKALAYAVDIAKSFDDGDFANTLSSTASTLESYLSGSDGGFVNTDVNHIVENPDLLQQNSRQGLDSATYIGPLLTHDIGESSSTPFDVDNEYVLQSYYLLLEDNKDRYSVNSAYSAGAAIGRYPEDVYNGDGSSEGNPWFLATAYAAQVPYKLVYDAKSASNDITINKINYDFFNKYIVDLSTINSGYQSSDSVTIKSGSDEFNTVADNLVTFGDSFLQVILDHINDDGSLNEQLNRNTGYSTSAYSLTWSSGALLEAIRLRNKVKALA

SEQ ID NO: 1858 - DNA, 1996 bp, Amorphotheca resinae
ttcccggttacttccagactcatctcatcatgcgcctcctcccctcgtcgtgtgcaggggctctctctttgctctgctccctggcgatcgcagcacctacggaattgaaagccagagatttgagctcttttatagcttcagagagagcaattgcattgcagggcgcgctcaataacattggacccgatggctcagcagtaccaggggctggagcgggcttcgtagtcgcaagtccttcaaaggccaatcccgattacttctacacatggagtcgggactcagccttgacattgaaaatgatcattgatgagtttatccttggaaacaccaccctccagacgataatcgaacaatatatccatgcccaagcagttcttcagaccgtttccaatccatctggaaccttcctgcctgacggtgtcggattaggagagccaaagttcatggtcgatggaactcggttcaatgggccttggggacggcctcaacgtgacggcccagctctccgcgctattgccttaatgacctatagtaattggctcattaagaatggtcaatttgcggaggccaagacaaagatatggcccattattgccaacgatctctcatacgtgggacaatattggaaccagagtggttttgacctttgggaagaaacttacgcatccagcttcttcaccatccagaaccagcaccgagctcttgtcgagggtgcgcagctcgcccatgatctcggtgtcacatgtacaggctgtgaccaggcaccggaggttctctgcttcctccaaagtttctggaacggtaaatacatcgtgtcgaacatcaacgtcaataacggccgaactggcttggatggaaactccatactaggggccatctcaacttttgatatcgatgcgtactgcgatagtccaaccttgcaaccttgccatagccagtctttggcaaatttcaaggtcttgacagacacttttaggaacttgtataccatcaacgctggcattccggaaggccaaggggtagctgtcgggagatacgccgaggacgtttacatgggcggtaatccatggtatctgatcaccaccgcagcagcagagttcttgtatgatgcagtagcacagtggaaggctcgtcatgtgctcaccgttgacgagacgtctctcgcattcttcaaagatatctaccccgaagtcaccgtccgcgagtacaaaagcgggaacgccaacagcccattcgcacagatcatggatgctgtgaccgcctacgccgactcgtacgtcgccatcgccgagaaatacatcccctccaacggatccctctcggagcaattcaaccgcgatacaggaacccccctatccgccatcgacctcacctggtcctacgccgccttcataaccatgtctcaacgccgcgccggccaataccccagcagctggggctcccgcaacgccttgccgcctcctaccacctgctccgccagctccaccccgggcatctacacccccgccaccgccgccggcgcccccaacgtaacatccagctgccaggtcagcatcaccttcaacatcaacgccaccacctactacggcgagaacctctacgtgatcggtaactcgtcagatctgggcgcctggaatatcgccgatgcgtacccgctcagcgccagtgcatatacgcaggaccgcccgctctggagtgccgctatcccgttgaatgcgggtgaggttattagctatcagtatgtgcgccaggaagactgtgatcagccgtatatatacgagacggttaatcgcaccctgacggtacccgcgtgtggaggcgcggctgtcactacggatgatgcgtggatgggaccggtgggctcatctgggaattgctgaagggggtttggggtttgggattgaagatagatagatggagatttagatctggttaattactgggtttataaacttacgtgcattcagtaattcatgggttttgcaaaaaaaaaaaa

SEQ ID NO: 1859 - protein, 616 aa, Amorphotheca resinae
MRLLPSSCAGALSLLCSLAIAAPTELKARDLSSFIASERAIALQGALNNIGPDGSAVPGAGAGFVVASPSKANPDYFYTWSRDSALTLKMIIDEFILGNTTLQTIIEQYIHAQAVLQTVSNPSGTFLPDGVGLGEPKFMVDGTRFNGPWGRPQRDGPALRAIALMTYSNWLIKNGQFAEAKTKIWPIIANDLSYVGQYWNQSGFDLWEETYASSFFTIQNQHRALVEGAQLAHDLGVTCTGCDQAPEVLCFLQSFWNGKYIVSNINVNNGRTGLDGNSILGAISTFDIDAYCDSPTLQPCHSQSLANFKVLTDTFRNLYTINAGIPEGQGVAVGRYAEDVYMGGNPWYLITTAAAEFLYDAVAQWKARHVLTVDETSLAFFKDIYPEVTVREYKSGNANSPFAQIMDAVTAYADSYVAIAEKYIPSNGSLSEQFNRDTGTPLSAIDLTWSYAAFITMSQRRAGQYPSSWGSRNALPPPTTCSASSTPGIYTPATAAGAPNVTSSCQVSITFNINATTYYGENLYVIGNSSDLGAWNIADAYPLSASAYTQDRPLWSAAIPLNAGEVISYQYVRQEDCDQPYIYETVNRTLTVPACGGAAVTTDDAWMGPVGSSGNC

SEQ ID NO: 1860 - DNA, 2103 bp, Aspergillus niger
tcccttttaggcgcaactgagagcctgagcttcatccccagcatcattacacctcagcaatgtcgttccgatctctactcgccctgagcggcctcgtctgcacagggttggcaaatgtgatttccaagcgcgcgaccttggattcatggttgagcaacgaagcgaccgtggctcgtactgccatcctgaataacatcggggcggacggtgcttgggtgtcgggcgcggactctggcattgtcgttgctagtcccagcacggataacccggactacttctacacctggactcgcgactctggtctcgtcctcaagaccctcgtcgatctcttccgaaatggagataccagtctcctctccaccattgagaactacatctccgcccaggcaattgtccagggtatcagtaacccctctggtgatctgtccagcggcgctggtctcggtgaacccaagttcaatgtcgatgagactgcctacactggttcttggggacggccgcagcgagatggtccggctctgagagcaactgctatgatcggcttcgggcagtggctgcttgacaatggctacaccagcaccgcaacggacattgtttggcccctcgttaggaacgacctgtcgtatgtggctcaatactggaaccagacaggatatgatctctgggaagaagtcaatggctcgtctttctttacgattgctgtgcaacaccgcgcccttgtcgaaggtagtgccttcgcgacggccgtcggctcgtcctgctcctggtgtgattctcaggcacccgaaattctctgctacctgcagtccttctggaccggcagcttcattctggccaacttcgatagcagccgttccggcaaggacgcaaacaccctcctgggaagcatccacacctttgatcctgaggccgcatgcgacgactccaccttccagccctgctccccgcgcgcgctcgccaaccacaaggaggttgtagactctttccgctcaatctataccctcaacgatggtctcagtgacagcgaggctgttgcggtgggtcggtaccctgaggacacgtactacaacggcaacccgtggttcctgtgcaccttggctgccgcagagcagttgtacgatgctctataccagtgggacaagcaggggtcgttggaggtcacagatgtgtcgctggacttcttcaaggcactgtacagcgatgctgctactggcacctactcttcgtccagttcgacttatagtagcattgtagatgccgtgaagactttcgccgatggcttcgtctctattgtggaaactcacgccgcaagcaacggctccatgtccgagcaatacgacaagtctgatggcgagcagctttccgctcgcgacctgacctggtcttatgctgctctgctgaccgccaacaaccgtcgtaactccgtcgtgcctgcttcttggggcgagacctctgccagcagcgtgcccggcacctgtgcggccacatctgccattggtacctacagcagtgtgactgtcacctcgtggccgagtatcgtggctactggcggcaccactacgacggctacccccactggatccggcagcgtgacctcgaccagcaagaccaccgcgactgctagcaagaccagcaccagtacgtcatcaacctcctgtaccactcccaccgccgtggctgtgactttcgatctgacagctaccaccacctacggcgagaacatctacctggtcggatcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctggcggtgacaatcaatccatttcgctatagttaaaggatggggatgagggcaattggttatatgatcatgtatgtagtgggtgtgcataatagtagtgaaatggaagccaagtcatgtgattgtaatcg

SEQ ID NO: 1861 - protein, 640 aa, Aspergillus niger; identical to SEQ ID NO: 1844

SEQ ID NO: 1862 - DNA, 1548 bp, Saccharomycopsis fibuligera
atgatcagattgacagtctttttgacagcagtttttgctgcagttgctagttgcgtcccggtggaattggacaaaagaaacactggacatttccaagcttattctggatacacagttgccagatcaaatttcactcaatggattcatgagcaaccagctgtttcttggtattatcttttgcaaaacattgattatccagaaggacaatttaaatctgcaaagccaggcgtggtagttgcttctccatccacctcagaacctgactatttttatcaatggaccagagacactgccattacatttctttcgttgattgccgaggttgaagaccatagctttagcaataccacccttgccaaggtcgtggaatactacatcagcaacacctacactttgcaaagagtttcaaacccaagtggaaatttcgacagtcctaaccacgacggtttgggagaaccaaagttcaatgttgacgacaccgcctacacagcttcttggggcagacctcaaaatgatggcccagctttaagagcttatgccatttccagatatttgaatgctgtggccaaacataacaatggcaaattgttgctcgccggccaaaacggaatcccttattctagtgcttctgacatttattggaaaattattaaaccagacttgcaacatgtcagcacccattggagcacctctggctttgatctttgggaagaaaatcaaggaactcatttcttcactgctttggttcaactcaaagctcttagctacggtattcctttgagtaagacttacaacgaccctggctttacttcctggcttgaaaaacaaaaagatgccttgaactcatacatcaactcctctggattcgtcaactcgggtaaaaaacatattgttgaaagcccacaactttcttctagaggcggtttggacagtgccacctacattgctgccttgatcacccatgacattggtgatgatgacacttacactcctttcaacgtggataattcctatgtgctcaattccctatactacttgttggttgacaacaaaaacagatacaagatcaatggcaactacaaagcaggtgctgcggttggaagatatccagaagacgtctacaatggcgttggaactagcgaaggtaacccatggcaattggctactgcctacgctggtcaaactttctacactttggcttacaactctttgaaaaataaaaagaacttggttatagaaaaactcaattacgacctttacaactcctttattgctgacttgtccaagattgactcttcttatgcttccaaagatagtttgactttgacttatggcagcgacaactataaaaatgttatcaaaagtttgctacaatttggtgactctttcttgaaagttctccttgaccatattgatgacaatggccaactcaccgaggaaatcaacagatacactggtttccaagccggcgctgtctccttgacttggagtagtggcagtttgcttagtgcaaacagagctagaaacaaattgattgaacttctttga

SEQ ID NO: 1863 - protein, 515 aa, Saccharomycopsis fibuligera
MIRLTVFLTAVFAAVASCVPVELDKRNTGHFQAYSGYTVARSNFTQWIHEQPAVSWYYLLQNIDYPEGQFKSAKPGVVVASPSTSEPDYFYQWTRDTAITFLSLIAEVEDHSFSNTTLAKVVEYYISNTYTLQRVSNPSGNFDSPNHDGLGEPKFNVDDTAYTASWGRPQNDGPALRAYAISRYLNAVAKHNNGKLLLAGQNGIPYSSASDIYWKIIKPDLQHVSTHWSTSGFDLWEENQGTHFFTALVQLKALSYGIPLSKTYNDPGFTSWLEKQKDALNSYINSSGFVNSGKKHIVESPQLSSRGGLDSATYIAALITHDIGDDDTYTPFNVDNSYVLNSLYYLLVDNKNRYKINGNYKAGAAVGRYPEDVYNGVGTSEGNPWQLATAYAGQTFYTLAYNSLKNKKNLVIEKLNYDLYNSFIADLSKIDSSYASKDSLTLTYGSDNYKNVIKSLLQFGDSFLKVLLDHIDDNGQLTEEINRYTGFQAGAVSLTWSSGSLLSANRARNKLIELL

SEQ ID NO: 1864 - DNA, 2065 bp, Aspergillus niger
atgtcgttccgatctcttctcgccctgagcggcctcgtctgcacagggttggcaaatgtgatttccaagcgcgcgaccttggattcatggttgagcaacgaagcgaccgtggctcgtactgccatcctgaataacatcggggcggacggtgcttgggtgtcgggcgcggactctggcattgtcgttgctagtcccagcacggataacccggactacttctacacctggactcgcgactctggtctcgtcctcaagaccctcgtcgatctcttccgaaatggagataccagtctcctctccaccattgagaactacatctccgcccaggcaattgtccagggtatcagtaacccctctggtgatctgtccagcggcgctggtctcggtgaacccaagttcaatgtcgatgagactgcctacactggttcttggggacggccgcagcgagatggtccggctctgagagcaactgctatgatcggcttcaggcagtggctgcttgacaatggctacaccagcaccgcaacggacattgtttggcccctcgttaggaacgacctgtcgtatgtggctcaatactggaaccagacaggatacgatctctgggaagaagtcaatggctcgtctttctttacgattgctgtgcaacaccgcgcccttgtcgaaggtagtgccttcgcgacggccgtcggctcgtcctgctcctggtgtgattctcaggcacccgaaattctctgctacctgcagtccttctggaccggcagcttcattctggccaacttcgatagcagccgttccggcaaggacgcaaacaccctcctgggaagcatccacacctttgatcctgaggccgcatgcgacgactccaccttccagccctgctccccgcgcgcgctcgccaaccacaaggaggttgtagactctttccgctcaatctataccctcaacgatggtctcagtgacagcgaggctgttgcggtgggtcggtaccctgaggacacgtactacaacggcaacccgtggttcctgtgcaccttggctgccgcagagcagttgtacgatgctctataccagtgggacaagcaggggtcgttggaggtcacagatgtgtcgctggacttcttcaaggcactgtacagcgatgctgctactggcacctactcttcgtccagttcgacttatagtagcattgtagatgccgtgaagactttcgccgatggcttcgtctctattgtggaaactcacgccgcaagcaacggctccatgtccgagcaatacgacaagtctgatggcgagcagctttccgctcgcgacctgacctggtcttatgctgctctgctgaccgccaacaaccgtcgtaactccgtcgtgcctgcttcttggggcgagacctctgccagcagcgtgcccggcacctgtgcggccacatctgccattggtacctacagcagtgtgactgtcacctcgtggccgagtatcgtggctactggcggcaccactacgacggctacccccactggatccggcagcgtgacctcgaccagcaagaccaccgcgactgctagcaagaccagcaccagtacgtcatcaacctcctgtaccactcccaccgccgtggctgtgactttcgatttgacagctaccaccacttacggcgagaacatctacctggtcggatcgatctctcagctgggtgactgggaaaccagcgacggcatagctttgagtgctgacaagtacacttccggggacccgctttggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctggcggtagacaatcaatccattacgctatagttaaaggatggggatgagggcaattggttatatgatcatgtatgtagtgggtgtgcataatagtagtaaaatggaagccaagtcatgtgattgtaaaaaaaaaaaaaaaaaaaaaaaaa

SEQ ID NO: 1865 - protein, 640 aa, Aspergillus niger
MSFRSLLALSGLVCTGLANVISKRATLDSWLSNEATVARTAILNNIGADGAWVSGADSGIVVASPSTDNPDYFYTWTRDSGLVLKTLVDLFRNGDTSLLSTIENYISAQAIVQGISNPSGDLSSGAGLGEPKFNVDETAYTGSWGRPQRDGPALRATAMIGFRQWLLDNGYTSTATDIVWPLVRNDLSYVAQYWNQTGYDLWEEVNGSSFFTIAVQHRALVEGSAFATAVGSSCSWCDSQAPEILCYLQSFWTGSFILANFDSSRSGKDANTLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDAATGTYSSSSSTYSSIVDAVKTFADGFVSIVETHAASNGSMSEQYDKSDGEQLSARDLTWSYAALLTANNRRNSVVPASWGETSASSVPGTCAATSAIGTYSSVTVTSWPSIVATGGTTTTATPTGSGSVTSTSKTTATASKTSTSTSSTSCTTPTAVAVTFDLTATTTYGENIYLVGSISQLGDWETSDGIALSADKYTSGDPLWYVTVTLPAGESFEYKFIRIESDDSVEWESDPNREYTVPQACGTSTATVTDTWR

SEQ ID NO: 1866 - DNA, 2067 bp, Aspergillus ficuum
atgtcgttccgatctctactcgccctgagcggcctcgtctgcacagggttggcaaatgtgatttccaagcgcgcgaccttggattcatggttgagcaacgaagcgaccgtggctcgtactgccatcctgaataacatcggggcggacggtgcttgggtgtcgggcgcggactctggcattgtcgttgctagtcccagcacggataacccggactacttctacacctggactcgcgactctggtctcgtcctcaaggccctcgtcgatctcttccgaaatggagataccagtctcctctccaccattgagaactacatctccgcccaggcaattgtccagggtatcagtaacccctctggtgatctgtccagcggcgctggtctcggtgaacccaagttcaatgtcgatgagactgcctacactggttcttggggacggccgcagcgagatggtccggctctgagagcaactgctatgatcgacttcgggcagtggctgcttgacaatggctacaccagcaccgcaacggacattgtttggcccctcgttaggaacgacctgtcgtatgtggctcaatactgggaccagacaggatatgatctctgggaagaagtcaatggctcgtctttcttcacgattgctgtgcaacaccgcgcccttgtcgaaggtagtgccttcgcgaagtccgtcggctcgtcctgctcctggtgtgattctcaggcacctgagattctctgctacctgcagtcattctggaccggcagcttcattttggccaacttcgatagcagccgttccggcaaggacgcaaacaccctcctgggaagcatccacacctttgatcctgaggccgcatgcgacgactccaccttccagccctgctccccccgcgcgctcgccaaccacaaggaggtcgtagactctttccgctcaatttataccctcaacgacggtctcagtgacagtgaggctgttgcggtcggtcggtaccctgaggacacgtactacaacggcaacccgtggttcctgtgcaccttggctgctgcagagcagttgtacgatgctctataccagtgggacaagcaggggtcgttggaggtcacggatgtgtcgctggacttcttcaaggcactgtacagcgatgctgctactggcacctactcttcgtccagctcgacttatagtagcattgtagatgccgtgaagactttcgccgatggcttcgtctctattgtggaaactcacgccgcaagcaacggctccatgtccgagcaatacgataagtctgatggcgagcagctttccgctcgcgacctgacctggtcttatgctgctctgctgaccgccaacaaccgtcgtaactccgtcgtgcctgcttcttggggcgagacctctgccagcagcgtgcccggcacctgtgcggccacatctgccactggtacctacagcagtgtgactgtcacctcgtggcccagtatcgtggctactggcggcaccactacgacggctacccccactggatccggcagcgtgacctcgaccagcaagaccaccgcgactgctagcaagaccagcaccagtacgtcattagcctcctgtaccactcccaccgccgtggctgtgactttcgatctgacagctaccaccacctacggcgagaacatctacctggtcggatcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctggcggtagacaatcaatccatttcgctatagttaaaggatgggatgagggcaattggttatatgatcatgtatgtagtgggtgtgcataatagtagtgaaatggaagccaagtcatgtgattgtaaaaaaaaaaaaaaaaaaaaaaaaaaaa

SEQ ID NO: 1867 - protein, 640 aa, Aspergillus ficuum
MSFRSLLALSGLVCTGLANVISKRATLDSWLSNEATVARTAILNNIGADGAWVSGADSGIVVASPSTDNPDYFYTWTRDSGLVLKALVDLFRNGDTSLLSTIENYISAQAIVQGISNPSGDLSSGAGLGEPKFNVDETAYTGSWGRPQRDGPALRATAMIDFGQWLLDNGYTSTATDIVWPLVRNDLSYVAQYWDQTGYDLWEEVNGSSFFTIAVQHRALVEGSAFAKSVGSSCSWCDSQAPEILCYLQSFWTGSFILANFDSSRSGKDANTLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDAATGTYSSSSSTYSSIVDAVKTFADGFVSIVETHAASNGSMSEQYDKSDGEQLSARDLTWSYAALLTANNRRNSVVPASWGETSASSVPGTCAATSATGTYSSVTVTSWPSIVATGGTTTTATPTGSGSVTSTSKTTATASKTSTSTSLASCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 1868 - DNA, 1961 bp, Penicillium chrysogenum
ggacacctttccaatgaacatcattatccgaagttttacatgagagatcaatgtgaaactcaatttccgacgtgcctgactgcttgatgacctaattatccgaacagtgttggctgtcgaacatataaagagactaggattcccagaagatcccgaagaacagtcacacaattacaatattacaaaatcatcaaatcatacattatgttgacattgaatgttttgacggcactgttggcacctggtgtgttatcatctgccttgcctgctcgcgatctcaatgcgcgtgccgattcgaagcctgctgctcttcaagccatcctgaacaacattggcgccgatggatctgctgtttcgagagcatctgcaggcgttgtggtagcatccccatccaaatcggatcccgattacttttacacctggactcgtgatgcagccttgacatacaaggtcttgattgatgagctcattgccggagacacctcgctggaacctaccatccaggactacgtctctgctcaagcaaagctgcaggccgtgtctaacccgtctggtgacttgtccgatggatcaggacttgcagagcccaagtaccacgtggacttgactgccttcacggaggcctggggtcgtccccagcgtgacggacccgctcttcgagccacagcactgattacccatggtaactatttgatttcgaaggagagaacatccgtcgtcaagtcgaacatctggcccattgtgcaaaatgatctcaactatgttgcgcaatactggaaccaaaccggattcgatctgtgggaggaggtcgagggctcctcgttctttaccattgctgcacaacaccgcgcattggtggagggcagcgcatttgccaaggcgctgggagagtcctgcgagggatgcgattcccaggcacctcaggtcctatgcttccagcagtccttctgggatggcaaggctattgtttctaacttcgccaacaatggtcgaaccggtctcgatgccaattcggtgcttacctcgatcggaaacttcgaccccaaggctccctgcgatgacgtgaccttccagccttgctctgctcgtgccctgtcgaaccacaagctatacgttgactcattccgtaagatctatcctgtgagcagtggtaaggaagctggaactgccgttgctgttggacgttattccgaagacacttacatgggcggcaacccatggtatttgaccaccctggccgcggccgagcagctgtacgatgctctttaccagtggaagcaactgggatcgctagaaatcaccgagatcagtcttcctttcttcaaggaccttgtttcgtctgccgccgccggaaagtatcccagctcctcggaaacttacacgtccatcactgccgcagtcaaaaagtatgccgatggatttgtggctgttgttaaggagcacacgcccagcgatgggtctctcgctgaacaatacactcgggacaacggcagcccggcctctgctaaggacttgacctggtcctacgcggcgctcctgtctgctgcccgccgtgaggctggaacagtgccccctacctggggtgcgtcgactgccaataaggtaccctcaaagtgtgagggtagctcggccaaggggagctacacgacaccatcagtcggcaagtggtaaagggaggagatgcggtaccaacagcatctgattcagtgaggcagtatagctgtgtcgatctttcctaatctagagggattctgaatgagtcggagggtctgtgaaggtgaagcattgcttgcttgtaggctggttgtcaaatctccttttgtccctttcaggcctttgtccctttacccttgtcaaagtacattcgagaactgcattacagtagggcagatcatcaagagttatgttagagaggttattgataggttataagccaaaaaaaaaaaaaaaaaaaaaaaaaa

SEQ ID NO: 1869 - protein, 488 aa, Penicillium chrysogenum
MLTLNVLTALLAPGVLSSALPARDLNARADSKPAALQAILNNIGADGSAVSRASAGVVVASPSKSDPDYFYTWTRDAALTYKVLIDELIAGDTSLEPTIQDYVSAQAKLQAVSNPSGDLSDGSGLAEPKYHVDLTAFTEAWGRPQRDGPALRATALITHGNYLISKERTSVVKSNIWPIVQNDLNYVAQYWNQTGFDLWEEVEGSSFFTIAAQHRALVEGSAFAKALGESCEGCDSQAPQVLCFQQSFWDGKAIVSNFANNGRTGLDANSVLTSIGNFDPKAPCDDVTFQPCSARALSNHKLYVDSFRKIYPVSSGKEAGTAVAVGRYSEDTYMGGNPWYLTTLAAAEQLYDALYQWKQLGSLEITEISLPFFKDLVSSAAAGKYPSSSETYTSITAAVKKYADGFVAVVKEHTPSDGSLAEQYTRDNGSPASAKDLTWSYAALLSAARREAGTVPPTWGASTANKVPSKCEGSSAKGSYTTPSVGKW

SEQ ID NO: 1870 - DNA, 4295 bp, Aspergillus niger
ctcgaggattgtctgaacattgacattcggcgcccagcggcgaccactgcggacgcgaagtgcccgtgctggtctggatctttggcggaggctttgaacttggttcaaaggccatgtatgacggcacaacgatggtatcatcgtcgatagacaagaatatgcctatcgtgtttgtagcgatgaactatcgcgtagggggcttcgggtttctgcccggaaaggagattctggaggacgggtccgccaacttaggtctacttaccaacgccttccctcagtgggctgcccgacaacatcgaggcgtttggtggagacccagacaaggtgacaatctggggagaatcagcaggggtatttctgtctttgatcagatgatcttgtacgacggaaacatcgcttacaaggaaagcccttgtttcggggagccatcatggactccggtagtgttgttcccgcagaccctgtcgacggggtcaagggacagcaagtatatgatgcggttgtggactctgcaggctgttcctcttccaacgacaccctggcttgtctgcgtgagctagactacaccgactatctcaatgcggcaaactccgtgccggggatcctaggttatcatccgtggcgctatcatatgtgcctcgaccagacgggacggcattgtcggcgtcgccagacgttttgggtaaagcagggaagtatgcgcgggtcccattcatcgtgggcgaccaagaggatgaggggaccttgttcgccttgtttcagtccttacgacgatcgacgaggtagtcgactatctgggcacctacttcttctatgacgctagccaggagcagcttgaagaattagtggccctgtacccagacaccaccacatatgggtctcccttcaggacgggcacggccaacaactggtatccgcaatttaagcgattggccgccattctcggcgacttggtcttcaccattacccggcggcattcctgtcatatgcagaggagctctcccctgacctcccgaaatggtcgtacctggcgacctatgactatggcacgccaattctggggaccttccatggaagtgacctgctgcaggtgttctatgggatcaagccgaactatgcagcgagttccagccacacgtattatctgagttttgtatacacgctggatccgaactccaatcggggggagtacatggaatggccccagtggcaggaatcacgacagttgatgaatttcggagcgaacagcgccagtctccttacggatgatttccgcaacgggacatatgagttcatcctgcagaataccgcggctttccacatctgatgccattggcggaggggtccggaggtcagggacctagccttatgaacgtaatgatggaagtgtctggcctcggcaaaggatatatagggtcataataagtagtactagttatattaatggaagggtatataccacgcgttggaccttgggacctgcattatagcttcccgttaggtataattaccgttgttatagcagccaatcaagccaccacgctcgaccggggacggcgaatccccgggaattgaaataaattgcaattcaggtcaatgcggccagcgattggacacatctccaaggcacagggccattctgcagtgccggtggattcagtgcaatttcccccgggccggcccgacaccgcgataggctggttcttccacaccaccggagattcgttctgaagagctgaagtggcgagatggtctctgcaggaattcaagctagatgctaagctagatgctaagcgatattgcatggcaatatgtgttgatgcatatgcatgtgcttcttccttcagcttcccctcgtgcagatgaggtttggctataaattgaagtggttggtcggggttccgtgaggggctgaagtgcttcctcccttttagacgcaactgagagcctgagcttcatccccagcatcattacacctcagcaatgtcgttccgatctctactcgccctgagcggcctcgtctgcacagggttggcaaatgtgatttccaagcgcgcgacctgggattcatggttgagcaacgaagcgaccgtggctcgtactgccatcctgaataacatcggggcggacggtgcttgggtgtcgggcgcggactctggcattgtcgttgctagtcccagcacggataacccggactgtatgtttcgagctcagatttagtatgagtgtgtcattgattgattgatgctgactggcgtgtcgtttgttgtagacttctacacctggactcgcgactctggtctcgtcctcaagaccctcgtcgatctcttccgaaatggagataccagtctcctctccaccattgagaactacatctccgcccaggcaattgtccagggtatcagtaacccctctggtgatctgtccagcggcgctggtctcggtgaacccaagttcaatgtcgatgagactgcctacactggttcttggggacggccgcagcgagatggtccggctctgagagcaactgctatgatcggcttcgggcaatggctgcttgtatgttctccacccccttgcgtctgatctgtgacatatgtagctgactggtcaggacaatggctacaccagcaccgcaacggacattgtttggcccctcgttaggaacgacctgtcgtatgtggctcaatactggaaccagacaggatatggtgtgtttgttttattttaaatttccaaagatgcgccagcagagctaacccgcgatcgcagatctctgggaagtcaatggctcgtctttctttacgattgctgtgcaacaccgcgcccttgtcgaaggtagtgccttcgcgacggccgtcggctcgtcctgctcctggtgtgattctcaggcacccgaaattctctgctacctgcagtccttctggaccggcagcttcattctggccaacttcgatagcagccgttccgccaaggacgcaaacaccctcctgctgggaagcatccacacctttgatcctgaggccgcatgcgacgactccaccttccagccctgctccccgcgcgcgctcgccaaccacaaggaggttgtagactctttccgctcaatctataccctcaacgatggtctcagtgacagcgaggctgttgcggtgggtcggtaccctgaggacacgtactacaacggcaacccgtggttcctgtgcaccttggctgccgcagagcagttgtacgatgctctataccagtgggacaagcaggggtcgttggaggtcacagatgtgtcgctggacttcttcaaggcactgtacagcgatgctactggcacctactcttcgtccagttcgacttatagtagcattgtagatgccgtgaagactttcgccgatggcttcgtctctattgtggtaagtctacgctagacaagcgctcatgttgacagagggtgcgtactaacagaagtaggaaactcacgccgcaagcaacggctccatgtccgagcaatacgacaagtctgatggcgagcagctttccgctcgcgacctgacctggtcttatgctgctctgctgaccgccaacaaccgtcgtaacgtcgtgccttccgcttcttggggcgagacctctgccagcagcgtgcccggcacctgtgcggccacatctgccattggtacctacagcagtgtgactgtcacctcgtggccgagtatcgtggctactggcggcaccactacgacggctacccccactggatccggcagcgtgacctcgaccagcaagaccaccgcgactgctagcaagaccagcaccagtacgtcatcaacctcctgtaccactcccaccgccgtggctgtgactttcgatctgacagctaccaccacctacggcgagaacatctacctggtcggatcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctggcggtagacaatcaatccatttcgctatagttaaaggatggggatgagggcaattggttatatgatcatgtatgtagtgggtgtgcataatagtagtgaaatggaagccaagtcatgtgattgtaatcgaccgacggaattgaggatatc

SEQ ID NO: 1871 - protein, 639 aa, Aspergillus niger
MSFRSLLALSGLVCTGLANVISKRATWDSWLSNEATVARTAILNNIGADGAWVSGADSGIVVASPSTDNPDYFYTWTRDSGLVLKTLVDLFRNGDTSLLSTIENYISAQAIVQGISNPSGDLSSGAGLGEPKFNVDETAYTGSWGRPQRDGPALRATAMIGFGQWLLDNGYTSTATDIVWPLVRNDLSYVAQYWNQTGYDLWEVNGSSFFTIAVQHRALVEGSAFATAVGSSCSWCDSQAPEILCYLQSFWTGSFILANFDSSRSAKDANTLLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDATGTYSSSSSTYSSIVDAVKTFADGFVSIVETHAASNGSMSEQYDKSDGEQLSARDLTWSYAALLTANNRRNVVPSASWGETSASSVPGTCAATSAIGTYSSVTVTSWPSIVATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 1872 - DNA, 2400 bp, Aspergillus oryzae
tttgtacatcactccactccgccccgatcctggcttaacctaaacacagtcaagaataatagtccgccttctaagagcattaagactcgactaggactcagaggttcagtccgatggggtttccaccagtgagaactaagagaatggcggcacgggcagatgtcgggatgatcacttttagtcgctccgacgcaatatcgatttcaattggatccgccacgctgcatcccggaaattaataccggatctgcttcatgatggggcctttggctgcggaaaactgctgcgagtctcagtaatctccgactgatcggcccgctgcctgttggttaatgtcatgcagcccgttgcggatcggttcactgaattatctacgttacgtctaggtcgcgctataaagagacctgaaattctcacttcgaatgaggcagccaacaaacagctacagtcatttcttgtttcttggaagtcaccaccatcatgcggaacaaccttcttttttccctcaatgccattgctggcgctgtcgcgcatccgtccttccctatccataagaggcagtcggatctcaacgccttcattgaggcacagacacccatcgccaaacagggcgtcctcaataatatcggcgctgatggcaagcttgttgagggggctgccgctggtatcgttgtagcctccccatccaagagtaatcccgactgttcgtacaatcctaccctcaagaccgcatgatattaccacagagctaactatatatagacttctacacctggacgcgcgacgctggcctcaccatggaagaagtgatagagcaattcatcgggggagatgcgactctcgagtccacaatccagaattatgttgactctcaagcgaacgagcaggcagtctccaacccatcaggcggcctgtcggatggctcgggtcttgctgaacccaaattttacgtcaatatctctcaattcaccgattcttggggccgaccccagcgcgacgggccagccttacgtgcttccgctttgatcgcatatggcaactctctgatttccagcgacaaacaatctgttgtcaaagctaacatctggccaattgtccagaatgacttgtcttatgtgggtcaatactggaaccagaccgggtttgatctttgggaagaggttcagggcagctccttcttcactgttgctgtgcagcacaaagccttggtggagggcgatgcgtttgcaaaggcactcggagaggaatgccaggcatgctccgtggcgcctcaaatcctctgccatcttcaggacttctggaatgggtctgctgttctttctaacttaccaaccaatgggcgcagtggactggataccaactctcttttgggctccattcacacttttgatccagccgccgcttgtgatgatacaacattccagccctgctcctctcgcgccctgtcgaaccataagcttgtggttgactctttccggtcggtctacggtatcaacaatggacgtggagcaggaaaggccgcggcagtgggcccgtacgcagaggacacctatcagggaggcaatccatggttggtactctgtctcatatccaaagcttaaactaatgaatattaggtatcttaccaccctggtcgctgcggaattgctctacgacgccttgtatcagtgggacaaacaaggtcaagtgaacgtcactgaaacttcccttcccttcttcaaggacctctccagcaatgtcaccaccggatcctacgccaagtcttcctcagcctatgagtcgcttacgagcgctgtcaagacctacgcagacggcttcatctccgttgtccaggagtatactcccgatggcggtgctttggctgagcagtacagtcgggaccagggcaccccagtttcggcatccgatctgacttggtcttatgcagctttcttgagtgctgttggacgacgaaacggcactgtccctgctagctggggctcttccacggccaacgcagttccaagccaatgttcggggggtacagtttctggaagttacactaccccaactgttgggtcgtggtagatgtactttccagtgcgtgtagtctactctgacctcgtgtcacgattgttgcttttgcctgtctaaatgcgaccgtgctgtgcatgtttgttaaatactgtcattcatctttgtttcaacaacaaagattacatcaattagtgctagctagacaataacttttacagttgcaacgttagtcctagtattatacatctcaccggatcctcttcaaacttcacggggtaaccaaaagaaagtaacaagactaagcctattgatactgtggttctaatcttattttagtttcctgtacgtccactgcaatcaaactaagtatacatactacatcct

SEQ ID NO: 1873 - protein, 493 aa, Aspergillus oryzae
MRNNLLFSLNAIAGAVAHPSFPIHKRQSDLNAFIEAQTPIAKQGVLNNIGADGKLVEGAAAGIVVASPSKSNPDYFYTWTRDAGLTMEEVIEQFIGGDATLESTIQNYVDSQANEQAVSNPSGGLSDGSGLAEPKFYVNISQFTDSWGRPQRDGPALRASALIAYGNSLISSDKQSVVKANIWPIVQNDLSYVGQYWNQTGFDLWEEVQGSSFFTVAVQHKALVEGDAFAKALGEECQACSVAPQILCHLQDFWNGSAVLSNLPTNGRSGLDTNSLLGSIHTFDPAAACDDTTFQPCSSRALSNHKLVVDSFRSVYGINNGRGAGKAAAVGPYAEDTYQGGNPWYLTTLVAAELLYDALYQWDKQGQVNVTETSLPFFKDLSSNVTTGSYAKSSSAYESLTSAVKTYADGFISVVQEYTPDGGALAEQYSRDQGTPVSASDLTWSYAAFLSAVGRRNGTVPASWGSSTANAVPSQCSGGTVSGSYTTPTVGSW

SEQ ID NO: 1874 - DNA, 2748 bp, TALAROMYCES EMERSONII; identical to SEQ ID NO: 1835

SEQ ID NO: 1875 - DNA, 1605 bp, Aspergillus niger
atgtcgttccgatctctactcgccctgagcggcctcgtctgcacagggttggcaaatgtgatttccaagcgcgcgaccttggattcatggttgagcaacgaagcgaccgtggctcgtactgccatcctgaataacatcggggcggacggtgcttgggtgtcgggcgcggactctggcattgtcgttgctagtcccagcacggataacccggactacttctacacctggactcgcgactctggtctcgtcctcaagaccctcgtcgatctcttccgaaatggagataccagtctcctctccaccattgagaactacatctccgcccaggcaattgtccagggtatcagtaacccctctggtgatctgtccagcggcgctggtctcggtgaacccaagttcaatgtcgatgagactgcctacactggttcttggggacggccgcagcgagatggtccggctctgagagcaactgctatgatcggcttcgggcagtggctgcttgacaatggctacaccagcaccgcaacggacattgtttggcccctcgttaggaacgacctgtcgtatgtggctcaatactggaaccagacaggatatgatctctgggaagaagtcaatggctcgtctttctttacgattgctgtgcaacaccgcgcccttgtcgaaggtagtgccttcgcgacggccgtcggctcgtcctgctcctggtgtgattctcaggcacccgaaattctctgctacctgcagtccttctggaccggcagcttcattctggccaacttcgatagcagccgttccggcaaggacgcaaacaccctcctgggaagcatccacacctttgatcctgaggccgcatgcgacgactccaccttccagccctgctccccgcgcgcgctcgccaaccacaaggaggttgtagactctttccgctcaatctataccctcaacgatggtctcagtgacagcgaggctgttgcggtgggtcggtaccctgaggacacgtactacaacggcaacccgtggttcctgtgcaccttggctgccgcagagcagttgtacgatgctctataccagtgggacaagcaggggtcgttggaggtcacagatgtgtcgctggacttcttcaaggcactgtacagcgatgctgctactggcacctactcttcgtccagttcgacttatagtagcattgtagatgccgtgaagactttcgccgatggcttcgtctctattgtggaaactcacgccgcaagcaacggctccatgtccgagcaatacgacaagtctgatggcgagcagctttccgctcgcgacctgacctggtcttatgctgctctgctgaccgccaacaaccgtcgtaactccgtcgtgcctgcttcttggggcgagacctctgccagcagcgtgcccggcacctgtgcggccacatctgccattggtacctacagcagtgtgactgtcacctcgtggccgagtatcgtggctactggcggcaccactacgacggctacccccactggatccggcagcgtgacctcgaccagcaagaccaccgcgactgctagcaagaccagcaccacgacccgctctggtatgtcactgtga

SEQ ID NO: 1876 - DNA, 2698 bp, Aspergillus kawachii
ctgcaggaataccaagctagatgttaagcgatgttgcattgcaatttgtattgtgtgttgatgcatgtgcttcttccttcaacttccccctcgtgcagatgttggtttggatataaattgacgtggtcgctcaggggtcagtgaggggttgaaagtagcttcctcccctcaagacgcgacaactgagtgactgagcttcatcctcaacatcgttactcccccaccgcaatgtcgttccgatctcttctcgccctgagcggccttgtctgctccgggttggcaaatgtgatttccaagcgcgcgaccttggattcgtggttgagcaacgaagcgaccgtggctcgtactgcgatcctgaataacatcggggcggacggtgcttgggtgtcgggcgcggactctggcattgtcgttgccagtcccagcaccgataacccggactgtatgttttgagttcggattatgaatgtgtgtcttggttgattgattgatgctgactggcgtgtcttttgatgattgtagacttctacacctggactcgcgactctggtctcgtcatcaagaccctcgtcgacctcttccgcaatggagatactgatctcctttccaccattgagcactacatctcctctcaggcaattattcagggtgtcagtaacccctctggtgatctgtccagcggtggtcttggtgagcccaagttcaatgtcgatgagactgcctacaccggttcttggggacggccgcagcgtgatggtcctgccctgagagcaactgctatgatcggctttgggcaggtgctgcttgtatgttctccacccccttgcgtctgatctgcaacatatgtagctgactggtcaggacaatggctacaccagcgctgcaacagagattgtttggcccctcgttaggaacgacctgtcgtatgtggctcagtactggaaccagacgggatatggtgtgttgatgatcggggttcaaggtgtttgtgcatcggagctaacttcgccggtcgcagatctctgggaagaagttaatggctcgtccttcttcactattgccgtgcaacaccgcgccctcgtcgaaggtagtgccttcgcgacggccgtcggctcgtcctgctcctggtgtgattcgcaggcacctcagattctctgttacttgcagtccttctggaccggcagctacatcctggccaactttgacagccgacgttccggcaaggacacaaacaccctcctgggaagcatccacacctttgatcctgaggctggatgcgacgactccaccttccagccctgctccccgcgtgcgctcgccaaccataaggaggttgtagactctttccgctcgatctatactctcaacgatggtctcagtgacagtgaggcggttgcggtcggtcggtaccctgaggatagctactacaacggcaacccgtggttccagagcaccttggctgccgcggaacagctgtacgatgctctgtaccagtgggacaagcaggggtcgttggagatcacagacgtgtcacttgacttcttcaaggctctgtacagtggtgctgccaccggcacgtactcttcgtccagctcgacctatagcagcattgtgagtgccgtcaagactttcgctgatggttttgtttctattgtggtaagtctacgctagacgagcgctcatatttacagagggtgcgtactaacaggaattaggaaactcacgccgcaagcaacggctctctgtctgagcaattcgacaagtctgatggcgacgagctttctgctcgcgatctgacctggtcttacgctgctctgctgaccgccaacaaccgtcgtaattctgtcgtgcccccgtcttggggtgagacctctgccagcagctggcccggcacctgtgcggctacctctgcctctggtacctacagcagtgtgaccgtcacctcgtggccgagcatcgtggctactggtggcaccactacgacggctactaccactggatcgggcggcgtgacctcgaccagcaagaccaccacaactgctagtaagaccagcaccactacgtcctcgacctcctgcaccacccccactgccgtagctgtgacctttgatctgacggcgaccaccacctacggcgagaacatctacctggtcgggtcgatctctcagctcggtgactgggagaccagcgatggcatagctctgagcgctgacaagtacacttccagtaacccgctttggtatgtaactgtgactctgccggctggtgagtcatttgagtacaagttcatccgcgttgagagcgatgactccgtggagtgggagagcgacccgaaccgggaatacaccgttcctcaggcgtgcggcgagtcgaccgcgacggtgaccgacacctggcggtagactattcattcctattgatatgaaggatgagtatgagggtaattggttatataatcatgtatgtagtggatgtgcataagagcaacgaaatggaagcctgatcatgtgattgtttgtattgcgcggaattgaggatatcgggagatacggacaatgccaaagccattgtcttcacttcacgttaagggaccagacagtccctgattaactcttgacctaacattagccaattgacatggccccctctcttttcgctctactgatatcactgtccctcaaagaaaagcgatgagctc

SEQ ID NO: 1877 - protein, 639 aa, Aspergillus kawachii
MSFRSLLALSGLVCSGLANVISKRATLDSWLSNEATVARTAILNNIGADGAWVSGADSGIVVASPSTDNPDYFYTWTRDSGLVIKTLVDLFRNGDTDLLSTIEHYISSQAIIQGVSNPSGDLSSGGLGEPKFNVDETAYTGSWGRPQRDGPALRATAMIGFGQVLLDNGYTSAATEIVWPLVRNDLSYVAQYWNQTGYDLWEEVNGSSFFTIAVQHRALVEGSAFATAVGSSCSWCDSQAPQILCYLQSFWTGSYILANFDSRRSGKDTNTLLGSIHTFDPEAGCDDSTFQPCSPRALANHKEVVDSFRSIYTLNDGLSDSEAVAVGRYPEDSYYNGNPWFQSTLAAAEQLYDALYQWDKQGSLEITDVSLDFFKALYSGAATGTYSSSSSTYSSIVSAVKTFADGFVSIVETHAASNGSLSEQFDKSDGDELSARDLTWSYAALLTANNRRNSVVPPSWGETSASSWPGTCAATSASGTYSSVTVTSWPSIVATGGTTTTATTTGSGGVTSTSKTTTTASKTSTTTSSTSCTTPTAVAVTFDLTATTTYGENIYLVGSISQLGDWETSDGIALSADKYTSSNPLWYVTVTLPAGESFEYKFIRVESDDSVEWESDPNREYTVPQACGESTATVTDTWR

SEQ ID NO: 1878 - DNA, 3889 bp, Candida albicans
  misc_feature (718)..(718): n is a, c, g, or t
  misc_feature (3671)..(3671): n is a, c, g, or t
gaaattccttgccccatgggaaagcacaatccccaataaaaaaccagtttttatagccacattcaattataataatgggcttagaaatttgctgtggccgtgttttgacagattctccaactggcaactctcaacttgatttcataaattgtcaagtcaatcatcgttgccaactgtaagctccttatacctacaccaagaagcaattcaatttacatttcaatcagttgattagtctccgattacttcgtttaaagaaagcaattcttggagaacttgccacaaaattggatattaacaatatagtagaattataattgccccttataatacaaaccaaaacagtataattgcttccattcttcatggagttcggaaaaaccacctctaaatctcaccactttttacaaaaactattctggtacattccgatatactctcccccaaaagcttcgtcttcttggtgttttattccacaaaagttgaactaactacaaagccccccaaattgagttttaaccaaccctaccatcactgaaattgttcatcatcaaaaacaaagaatggtttgaccggtctaaagcttaattgaagactaaccacaatgataatgtcttagttcaatattcgaggattattgttattgttgttcgtacggagatttctcccaaattacacaaagtacaataattcccctttcttgttacaaattagtgtncgtatgtagcacctgattagtttatttatttattcatagtcaggccagaaagtaattaccaagtttagtatttccgaccgcccccccaaacaggaacttattccgagcaaaagtagtttatctccttgtacgaaaagaagatgtaattattgctactaaaaaacagacaatataaaagcccccgaaaaagtaattgcaaaattcgtttgttaagaattttcaaaccaagacaaaccaaaccaaaccaaaccaaaccaagaaaaatatgaaattgttatccaaggtatttgttactgctttgggtcttacttcaattgtcaatgccgctccaacaagtagtagtagtgcagaagaagcccaaaaaactgttcctgttgaacttagtatcggtgtcaaacaacttcctaacattcacaatgattcagctgtcgatgctaatgctgttgctaaaggttattctttggtaaatgtttctttaactgctagaggtttaactggtattttgaaacttaaagaagctacaaacatttatggttacgactttgaatacttgaatttgtcagttgaataccaaagtgatacaagattaaatgttcatatagaacctactgatttgactgatgtttttgttttgccagaagaacttgttgttaaaccaaaacttgaaggtgatgctaaaacttttaattttgaaaactccgacttggtttttgaatatgatgaagaagattttggatttgaagttttaagaagctctactcgtgaagtattgttctccactaaaggtaatccattggttttctccaatcaattcattcaattcaatactactttaccaaaaggtcactcaattactggattaggcgaatccattcatggatctttgaatgaaccaggtgttgtcaaaacattgtatgccaatgatattgctgatccaattgacggtaacatttatggtgttcatccagtgtactatgatcaaagatatgatacaaacacaacacatggtgtttattggagaacttcagctattcaagaagttgtcgttggtgagacttctctcacatggcgtgctctttctggtgtaattgatctttatttcttcagtggtccagatccaaaagatgttatccaacaatatgtttctgaaattggtttacctgctatgcaaccatactgggcattgggttaccatcaatgtagatggggttacgacactgttgaatcacttgaaactgttgttgaaaatttcaaaaagtttgatattccattggaaaccatttggtcagatattgattacatggatggatacaaagatttcactaatgatccatacagattcccaacagataaatttagaaaatttttagatgatcttcacaataacagtcaacattatgttcctatatttgatgctgcaatttatgttcctaacccaaacaatgccaccgatgatgattatgaaccattccacttgggtaatgaatcagacgtgttcttgaaaaatccagatggatcattatatattggtgcagtatggccaggatacactgtattcccagactttttagccaacaatactcaagaatattggaacaaaatgtttaaagattggtatgagagaattccatttgatggtatttggacagatatgaatgaagtcagttccttctgtgttggttcatgtggtactgatagatatttcgataacccagttcatccaccatttgaagttggatattctggttctgattatccattaggttttgataaatcaaatgcatctgaatggaaatcaatttctgaagcagcagcagctactaaaacaaccaccacaacatcatcttcagcttcgacatcaattgatggcaagaacactttagctccaggtaaaggtaatatcaattatccaccatatgcaattaacaatgaccaaggtgatcatgatcttgccacacacgcaatttctccaaatgctactcatgccgatgggactgttgaatacgatattcataatatatatggtctcattcaagaacgtgccatttacgaagcattattggaaattcatcctaacaagagaccatttattattggacgttcatcatttgctggatctggtaaatacatgggtcattggggaggtgataactatgctgactattatatgatgtacttttctattcctcaagctttatcaatgggtctttctggtatcccattctttggtgtggatgcatgtgggttcaatggtaacactgatatggagttatgttctagatggatgcaattggcttcattcttcccattctacagaaaccacaatgttttgggtgctattccacaagagccatatgtttgggaagctgttatgaaagcaaccaagacatccattaatgtcagatactctttgttgccatactattacactttgttacacgaatcacatgttactggtatcccaattatgcgtgcattcaactggcaattcccttacagcaaagaattggccggcgttgatactcaatttttcgttggtgatgcattattggttacaccagttttagaaccaggtgtcaaccatactaaaggtattttcccaggtgagaatgctgtgtactatgatttctacactcataagaaacaaaaattcactgctggcaagaacgaaactttggctgctcctttgggtcacattccattacacattaaaggtggtaacatcattccaactcaagaaccaggttatactaccactgagtcaagaaaaaacccatttggattgttggttgccttggatgctgaaggtactgcttctggtaaattgtatcttgatgatggtgaatccgtagatgttgaagaagcattatatgttgactttgttgcatccaagaataaattggttgcttcagtttttggtgaatatgaagttcgtcaaccattggccaatgtnacaattttgggagttgattctgaacctaagaaggtcttgtttaacaatgaaacagtaagtcacaagtacgaaaatggtgctgtctatctcactgatttagaaaaattcaccaaagaaggtgcctttgctgaagaatttactcttcaatggtaagcaaaaatatacccaaaaagttcaaccgttattttatagttctagtatctatctcattgtgttga

SEQ ID NO: 1879 - protein, 946 aa, Candida albicans
MKLLSKVFVTALGLTSIVNAAPTSSSSAEEAQKTVPVELSIGVKQLPNIHNDSAVDANAVAKGYSLVNVSLTARGLTGILKLKEATNIYGYDFEYLNLSVEYQSDTRLNVHIEPTDLTDVFVLPEELVVKPKLEGDAKTFNFENSDLVFEYDEEDFGFEVLRSSTREVLFSTKGNPLVFSNQFIQFNTTLPKGHSITGLGESIHGSLNEPGVVKTLYANDIADPIDGNIYGVHPVYYDQRYDTNTTHGVYWRTSAIQEVVVGETSLTWRALSGVIDLYFFSGPDPKDVIQQYVSEIGLPAMQPYWALGYHQCRWGYDTVESLETVVENFKKFDIPLETIWSDIDYMDGYKDFTNDPYRFPTDKFRKFLDDLHNNSQHYVPIFDAAIYVPNPNNATDDDYEPFHLGNESDVFLKNPDGSLYIGAVWPGYTVFPDFLANNTQEYWNKMFKDWYERIPFDGIWTDMNEVSSFCVGSCGTDRYFDNPVHPPFEVGYSGSDYPLGFDKSNASEWKSISEAAAATKTTTTTSSSASTSIDGKNTLAPGKGNINYPPYAINNDQGDHDLATHAISPNATHADGTVEYDIHNIYGLIQERAIYEALLEIHPNKRPFIIGRSSFAGSGKYMGHWGGDNYADYYMMYFSIPQALSMGLSGIPFFGVDACGFNGNTDMELCSRWMQLASFFPFYRNHNVLGAIPQEPYVWEAVMKATKTSINVRYSLLPYYYTLLHESHVTGIPIMRAFNWQFPYSKELAGVDTQFFVGDALLVTPVLEPGVNHTKGIFPGENAVYYDFYTHKKQKFTAGKNETLAAPLGHIPLHIKGGNIIPTQEPGYTTTESRKNPFGLLVALDAEGTASGKLYLDDGESVDVEEALYVDFVASKNKLVASVFGEYEVRQPLANVTILGVDSEPKKVLFNNETVSHKYENGAVYLTDLEKFTKEGAFAEEFTLQW

SEQ ID NO: 1880 - DNA, 1716 bp, Lentinula edodes
atgttgctctctgctgtattcctcgccttatttgctcccagcgtctgggcacaatccagcgtcattgatgcatatgtagcctctgaatcgcccatcgccaaagcatccatgctcgccaacattggtccatctggcagcaaatcatcaggtgccttttctggaatcgttattgcctcgccatctacagaaaatccagactacctttatacgtggacaagagactcagccttgacatttcagaccatcatcgaccagtttacactcggttttgacaccacgcttcgagcagagatcgataactatgtcggagctcaggctatcgttcaacagattcccaatccttcgggtgatatcactaccggtggccttggcgagcccaagttctatgtcaacgagactgcgttcactggaccctggggtcgcccacagcgagatgggcctgcccttcgttctactgccctcataacatgggcaaactatcttttatctgaaggcaatacattttacgtgacggataccttgtggcccatcattgagaacgatttgaactatgtatcttccaattggaaccaaagcacctatgatctctgggaggaaatttattcgtcttcgttcttctctactgccgtccaacaccgtgccctgcgtcaaggaaccacgctcggtagagccattggtcaaacatcgctcgcttccagctatggaaatcaagcggactttttactttgtttcctccagtcttactggaatcctacaggatacatgaccgctaacacgggaggtggacgatctggcattgatgctaacagcgttcttgcgagtattcacacgttcgacgcggctgctggctgtgacgccatcacctttcaaccatgctctgacgttgcgctcctgaatctctttacctacgtgaacgccttccggaatgcatatgaaatcaattctggcatctctacgaatgaggctgtccttaccggacggtatccggaagatgtttacatgggtgggaatccctggtatcttaccacactagctgtagcggaacaactgtacgactctctaatcgtttggaatagtcaaggatcgctcgacgttaccaacatctcacttcccttcttcaagcagtttgactcgacgatcactgcaggcacatatacttcttcatcgcccgaattcagtacccttactgcagcagtaaaaaccttttctgacggttttgtcgcgctcgtggccaaatatacaccatcatcagggggactggccgagcaaatcagcaggagcaacggggctcccgtgagcgcagtggatctgacatggagttatgcatctgcgttgacggcgtttgatgctcgagcgggtgttatccctggtagttggggtgcacaaggcctatcgctgaactgtggtgggggtcctgtcgctcaagcggtgtctgtgactttcaatgtcgatgcttctactcttgaaggccaaaatgtctatctgactggcgcagttgacgctcttgaagactggtcgactgataatgctatccttttgagctccgcaaattatcccacttggagcgtcacggtggatcttcctggaagcaccgatgttcaatacaagtacataaagaaggatggatcgggtactgtcacctgggagtccgatccgaacatggagattacaactcccgctaatggaacatacgctacgaatgacacttggaggtag

SEQ ID NO: 1881 - protein, 571 aa, Lentinula edodes
MLLSAVFLALFAPSVWAQSSVIDAYVASESPIAKASMLANIGPSGSKSSGAFSGIVIASPSTENPDYLYTWTRDSALTFQTIIDQFTLGFDTTLRAEIDNYVGAQAIVQQIPNPSGDITTGGLGEPKFYVNETAFTGPWGRPQRDGPALRSTALITWANYLLSEGNTFYVTDTLWPIIENDLNYVSSNWNQSTYDLWEEIYSSSFFSTAVQHRALRQGTTLGRAIGQTSLASSYGNQADFLLCFLQSYWNPTGYMTANTGGGRSGIDANSVLASIHTFDAAAGCDAITFQPCSDVALLNLFTYVNAFRNAYEINSGISTNEAVLTGRYPEDVYMGGNPWYLTTLAVAEQLYDSLIVWNSQGSLDVTNISLPFFKQFDSTITAGTYTSSSPEFSTLTAAVKTFSDGFVALVAKYTPSSGGLAEQISRSNGAPVSAVDLTWSYASALTAFDARAGVIPGSWGAQGLSLNCGGGPVAQAVSVTFNVDASTLEGQNVYLTGAVDALEDWSTDNAILLSSANYPTWSVTVDLPGSTDVQYKYIKKDGSGTVTWESDPNMEITTPANGTYATNDTWR

SEQ ID NO: 1882 - DNA, 4965 bp, Aspergillus niger
gcatgccatgagttgttgggccggcctgaaggatccatcattgggaccaagggcatcatccatgcgctacggagtactttcggagaatcagcacccctgcacaaagcattgtcaatgtgttttcttatgtcaaaagctgacagagtctgaggctcgctgacgatgggattcatgctaatgacggtccgaaagagctttcacgtaacactggtgaacatcccactcgggaagccgagacttgtgacctacttagtcaaatgagatgattatcaaagccattaaatgcctcgctgtcaggggccctggtaagtgtcttcattaatcgaaacccatcttcattcgtccccgccttcagtgctcatcattttaggtttagaagcaagattgagtgccacctgctttacaaaccagcatgggtagtctgctgttgaaattcttcaccgggagcattctggggaaggtgcaaaaggcggcgcgaagtggtcgggtcgcgattgtagtctggattggagcacaagaatcgtcagagccgaagcccgaactgagggggtctcggtcatttatcgggatgagagccaatcagcgtgcgctcatcatctgatcgtctggctgccaggcccctcaggcatcaatacggtactcggcagtatccactcccgtttctccggtgcaacaaatcatcgttggagaatccccagctcccccgccaactggggtcgatgcttctccagttgtcctggtttctcccatgaactcgcttacgataagctgctgtaccagcccaccagcacaacaatatcttcaatcaggtaggtgcttgttcgttacctgccccatcctctcctcttcttcggtcattatgaactcaattcggtcgctagctttgccgattctccgcagtccataaaaatatatctgcatttgccccttacacgtcgggaattcaccggcgcaatgagccttcgggtatggtcgcacagcgtcatgtcaataggaggctgctcctagtggtgatctactagtcgcctcaacacagcaatatataaataacaagagcattccttgagcacatctgggtaatagctgttccattctcatcaaggattacgcgaccgtgcctcgagcctccttaagcgagccatggtgaagttgacgcatctccttgccagagcatggcttgtccctctggcttatggagcgagccagtcactcttatccaccactgccccttcgcagccgcagtttaccattcctgcttccgcagatgtcggtgcgcagctgattgccaacatcgatgatcctcaggctgccgacgcgcagtcggtttgtccgggctacaaggcttcaaaagtgcagcacaattcacgtggattcactgccagtcttcagctcgcgggcaggccatgtaacgtatacggcacagatgttgagtccttgacactgtctgtggagtaccaggattcggatcgactgaatattcagattctccccactcatgttgactccacaaacgcttcttggtactttctttcggaaaacctggtccccagacccaaggcttccctcaatgcatctgtatcccagagcgacctttttgtgtcatggtcaaatgagccgtcgttcaatttcaaggtgatccgaaaggctacaggcgacgcgcttttcagtacagaaggcactgtgctcgtatatgagaatcagttcatcgaatttgtgaccgcgctccctgaagaatataacttgtatggccttggggagcatatcacgcaattccgcctccagagaaatgctaatctgaccatatatccttcggatgatggaacacctattgaccagtgagtactgatatcccgcccgtatcttctggttctactcttgaaacttactcgtcctagaaacctctacggccaacatcccttctatctggatacaagatattacaaaggagataggcagaatgggtcttatattcccgtcaaaagcagcgaggctgatgcctcgcaagattatatctccctctctcatggcgtgtttctgaggaactctcatggacttgagatactcctccggtctcaaaaattgatctggcggaccctaggtggaggaatcgatctcaccttctactcaggccccgccccggccgatgttaccaggcaatatcttaccagcactgtgggattaccggccatgcagcaatacaacactcttggattccaccaatgtcgttggggctacaacaactggtcggatctggcggacgttgttgcgaactttgagaagtttgagatcccgttggaatatatctggtgcgtattgtactggtttatggtatctcaaaacagtctaacaggcacttaggaccgatattgactacatgcacggatatcgcaactttgacaacgatcaacatcgcttttcctacagtgagggcgatgaatttctcagcaagctacatgagagtggacgctactatgtacccattgttgatgcggcgctctacattcctaatcccgaaaatgcctctgatgcgtaagtgtctagtgacaaattatattactgcctgtatgctaattagcgatacagatacgctacgtatgacagaggagctgcggacgacgtcttcctcaagaatcccgatggtagcctctatattggagccgtttggccaggatatacagtcttccccgattggcatcatcccaaggcagttgacttctgggctaacgagcttgttatctggtcgaagaaagtggcgttcgatggtgtgtggtacgacatgtctgaagtttcatccttctgtgtcgggagctgtggcacaggtaacctgactctgaacccggcacacccatcgtttcttctccccggtgagcctggtgatatcatatatgattacccagaggctttcaatatcaccaacgctacagaggcggcgtcagcttcggcgggagcttccagtcaggctgcagcaaccgcgaccaccacgtcgacttcggtatcatatctgcggacaacgcccacgcctggtgtccgcaatgttgagcacccaccctatgtgatcaaccatgaccaagaaggccatgatctcagtgtccatgcggtgtcgccgaatgcaacgcatgttgatggtgttgaggagtatgatgtgcacggtctctacggacatcaaggattgaacgctacctaccaaggtctgcttgaggtctggtctcataagcggcggccatttattattggccgctcaaccttcgctggctctggcaaatgggcaggccactggggcggcgacaactattccaaatggtggtccatgtactactccatctcgcaagccctctccttctcacttttcggcattccgatgtttggtgcggacacctgtgggtttaacggaaactccgatgaggagctctgcaaccgatggatgcaactgtccgcattcttcccattctaccgaaaccacaatgagctctccacaatcccacaggagccttatcggtgggcttctgttattgaagcaaccaagtccgccatgagaattcggtacgccatcctaccttacttttatacgttgtttgacctggcccacaccacgggctccactgtaatgcgcgcactttcctgggaattccctaatgacccaacattggctgcggttgagactcaattcatggttgggccggccatcatggtggtcccggtattggagcctctggtcaatacggtcaagggcgtattcccaggagttggacatggcgaagtgtggtacgattggtacacccaggctgcagttgatgcgaagcccggggtcaacacgaccatttcggcaccattgggccacatcccagtttatgtacgaggtggaaacatcttgccgatgcaagagccggcattgaccactcgtgaagcccggcaaaccccgtgggctttgctagctgcactaggaagcaatggaaccgcgtcggggcagctctatctcgatgatggagagagcatctaccccaatgccaccctccatgtggacttcacggcatcgcggtcaagcctgcgctcgtcggctcaaggaagatggaaagagaggaacccgcttgctaatgtgacggtgctcggagtgaacaaggagccctctgcggtgaccctgaatggacaggccgtatttcccgggtctgtcacgtacaattctacgtcccaggttctctttgttggggggctgcaaaacttgacgaagggcggcgcatgggcggaaaactgggtattggaatggtagtgtcagccacaagccaggtgtgcgcgtacagcatgcaacatgggaacgatgctctgcaatgtagctctttggttataattcaaaattcaacttccacctttgtttcaccggcggccacggcattcctgcatgactaacgttctgtaaatggacccgataacacccagcacgttgcagcagagaaggtactctctcacacgcactgctctttatagttgccgagacggccgccgaggagaaaaccgccggcctgtggccactattcgctggaaggaaccctgccagtcgaacacacccgcccgtgatcgccaggggccgatggatttccccccgcatccttgtcggttcatgagtgaagactttaaatcccatctagctgacggtcgggtacatcaataactggcagcctagtttccaagacacggagaagcatgtaatcgctatttatagaatgctgggatcggacccgtcgaatggtcttccgatgggaagtgacaactcacattgtcatgttggccttactcaatccaacgggatctgacctgctttggctaacctagtataaatcagcatgtctctcctttgatacatcggatcgttcctcaaatatagttatatcttcgaaaaattgacaagaaggatgacaatctttctgtttctggccattttcgtggctacagctctggcagccacgcctgcag

SEQ ID NO: 1883 - protein, 985 aa, Aspergillus niger; identical to SEQ ID NO: 530

SEQ ID NO: 1884 - DNA, 2290 bp, Rhizopus oryzae
gatctcaatttgtgttgtgatatattcagatttaaaatttcaaacatatataagacgcgtttatttcctcgtttttcaaaaatcatcacttgtcttcaaattgatctttctctaatgcaactgttcaatttgccattgaaagtttcattctttctcgtcctctcttacttttctttgctcgtttctgctgcaagcattcctagtagtgcttctgtccagcttgattcatacaattacgatggctctactttttcaggaaaaatttatgtaggttgcatataattcaaacattaaaaaaatattaatgttcatgctgtacgctgtaggtcaagaacattgcttactccaagaaggttactgtaatttacgccgatggctctgacaactggaataataatggaaacaccattgctgcttcttactctgctcctatttctggatcaaattacgaatactggacattctctgcctccattaatggtatcaaggagttctacattaaggtaacttatttttactttatgatatttgcccttatacttaattaactaacccttttttctctatagtatgaggtcagtggaaaaacatactatgataacaacaattctgccaattaccaaggtaaagataataatatacaaatgcctacaactattcacatttttatagtatctacatccaagcctactactactactgctactgctactactactaccgctccttccacttcaaccacgactcccccctcaaggtctgagccagctactttcccaactggtaactctacaatctcctcatggattaagaagcaagaaggtatcagccgctttgctatgcttcgaaacatcaatcctcctggaagcgctaccggtttcattgctgcctcactctctaccgctggtcccgattactactatgcttggactcgtgatgctgcattaacctccaatgtaattgtttacgaatacaacactactttgtccggtaataagactatcctcaacgtcctcaaggactatgttacattctcagtcaagacccaatcaacttctaccgtctgtaactgccttggtgagcctaagttcaatcctgatgcttctggctatactggtgcttggggaagacctcaaaatgatggacctgctgaacgtgctactaccttcattttgtttgctgacagttatcttactcaaacaaaggatgcttcctatgtcactggtacactcaagcctgctatcttcaaggacttggactatgtcgtcaatgtctggtctaatggctgtttcgatttatgggaagaagtcaacggtgttcacttctatactttaatggttatgcgtaagggtttgcttcttggtgcagatttcgctaaacgtaacggtgactctactcgtgcatctacctatagcagcactgcatccactattgcaaacaagatctctagcttctgggtttcttctaataactggattcaagtcagtcaaagcgttactggtggtgtcagtaaaaagggtttggatgtctccacattgttggctgctaaccttggtagtgttgatgatggattcttcactcctggctctgaaaaggtaaattaacatgcataaaagaataagactataacattactaattcacattttctactcagatccttgccactgctgttgctgttgaagactccttcgcttccttgtatcctatcaacaaaaaccttccatcttaccttggtaactctattggtagatatcctgaagacacttacaatggtaacggaaactctcaaggaaactcttggttcttggctgtaactggttacgctgagctctattaccgtgccatcaaggaatggatcggcaacggtggtgtcactgtcagcagcataagtttacccttcttcaagaagtttgattcatctgctacatctggaaagaagtacactgttggtacctccgactttaacaaccttgctcaaaatattgcactcgctgctgaccgtttcttgtccactgtccagctccatgctcacaacaatggatctcttgctgaagagtttgaccgcaccactggtttatccaccggtgctagagacttgacctggtctcacgcttctttaatcaccgcttcttacgctaaggctggtgcacctgccgcttaagctgtaaatttaaatgcaaagcattacagcttattttctttttcaaataaaaacatattgatatgttcataacattttcttgtttgttgtactgtaatatgggtaaccacataagcataaacagcaa

SEQ ID NO: 1885 - protein, 604 aa, Rhizopus oryzae
MQLFNLPLKVSFFLVLSYFSLLVSAASIPSSASVQLDSYNYDGSTFSGKIYVKNIAYSKKVTVIYADGSDNWNNNGNTIAASYSAPISGSNYEYWTFSASINGIKEFYIKYEVSGKTYYDNNNSANYQVSTSKPTTTTATATTTTAPSTSTTTPPSRSEPATFPTGNSTISSWIKKQEGISRFAMLRNINPPGSATGFIAASLSTAGPDYYYAWTRDAALTSNVIVYEYNTTLSGNKTILNVLKDYVTFSVKTQSTSTVCNCLGEPKFNPDASGYTGAWGRPQNDGPAERATTFILFADSYLTQTKDASYVTGTLKPAIFKDLDYVVNVWSNGCFDLWEEVNGVHFYTLMVMRKGLLLGADFAKRNGDSTRASTYSSTASTIANKISSFWVSSNNWIQVSQSVTGGVSKKGLDVSTLLAANLGSVDDGFFTPGSEKILATAVAVEDSFASLYPINKNLPSYLGNSIGRYPEDTYNGNGNSQGNSWFLAVTGYAELYYRAIKEWIGNGGVTVSSISLPFFKKFDSSATSGKKYTVGTSDFNNLAQNIALAADRFLSTVQLHAHNNGSLAEEFDRTTGLSTGARDLTWSHASLITASYAKAGAPAA

SEQ ID NO: 1886 - DNA, 1876 bp, Corticium rolfsii
cttcacaatgtttcgttcactcctggccttggctgcgtgtgcagtcgcctctgtatctgcacagtctgcgtctgcgacagcatatcttaccaaggaatctgcagttgccaagaatggcgtactttgcaacattggtagccagggatgcatgtctgagggtgcctatagcggtattgtgatcgcatctccctctaaaactagccctgactatctctatacctggactcgcgactcgtcgctcgtcttcaagatgttaattgaccaatacacaaatggcctggatacgacactgcgcactctcattgacgagtttgtctctgcggaagccaccattcaacaaaccagtaactcatctggtaccgtctctaccggtggtctcggcgaacccaaattcaatatcgacgagacggcatttacgggcgcatggggtcgtccccaacgtgatggtcccgccctccgtgcaaccgcaatcatgacctatgcgacgtatctgtacaacaatggcaacacttcctacgtgaccaacaccctttggcctatcatcaagctcgaccttgactatgtcaactcggactggaaccagaccacgtttgacctctgggaagaagttgactcgtcttctttctttacgactgccgttcagcaccgtgctcttgttcagggcgcagcctttgctaccctcatcggccaaacttcgtctgcttcgacttactccgccacggcccctagcattctctgcttcttgcagtcttactggaacaccaacggatactggacggccaacactggtggcggacgttccggcaaggacgccaacaccatactcgcttctatccacacatttgacgccagcgccggctgctctgctgccacgtctcaaccatgctctgacgtagcattggccaacctgaaggtatacgttgactctttccgtagtatttatacgatcaacagcggtatttcctctacctcgggtgttgctactggtcgctaccccgaagattcgtattacaatggcaacccctggtacctctgcacactcgccgtcgccgagcagctctatgatgctctcatcgtatggaaggctgccggggagctcaacgtcacctccgtctcgctcgcgttcttccagcaattcgactcgagcatcaccgccggcacttacgcctcctcgtcgagcgtatacacttcgctcatctctgacatccaggcgttcgcagacgagtttgttgacattgttgccaagtacacgccttcgtctggcttcttgtctgagcagtatgataagtccacgggtgctcaggattcggctgctaacttgacttggtcctatgctgctgctatcaccgcttaccaagcccgcaatggcttcacaggtgcttcgtggggtgctaagggagtttctacctcctgctcgactggtgctacaagcccgggtggctcctcgggtagtgtcgaggtcactttcgacgtttacgctaccacagtatatggccagaacatctatatcaccggtgatgtgagtgagctcggcaactggacacccgccaatggtgttgcactctcttctgctaactaccccacctggagtgccacgatcgctctccccgctgacacgacaatccagtacaagtatgtcaacattgacggcagcaccgtcatctgggaggatgctatcagcaatcgcgagatcacgacgcccgccagcggcacatacaccgaaaaagacacttgggatgaatcttaaactgctgaacttgaacggcttgcaaaagcgaatggtgtagaaaataaacgaagattttgattgctttgttttgtttctcttcctatcttgtttctctagatatatacgaatgtattgcgttattctttc

SEQ ID NO: 1887 - protein, 579 aa, Corticium rolfsii
MFRSLLALAACAVASVSAQSASATAYLTKESAVAKNGVLCNIGSQGCMSEGAYSGIVIASPSKTSPDYLYTWTRDSSLVFKMLIDQYTNGLDTTLRTLIDEFVSAEATIQQTSNSSGTVSTGGLGEPKFNIDETAFTGAWGRPQRDGPALRATAIMTYATYLYNNGNTSYVTNTLWPIIKLDLDYVNSDWNQTTFDLWEEVDSSSFFTTAVQHRALVQGAAFATLIGQTSSASTYSATAPSILCFLQSYWNTNGYWTANTGGGRSGKDANTILASIHTFDASAGCSAATSQPCSDVALANLKVYVDSFRSIYTINSGISSTSGVATGRYPEDSYYNGNPWYLCTLAVAEQLYDALIVWKAAGELNVTSVSLAFFQQFDSSITAGTYASSSSVYTSLISDIQAFADEFVDIVAKYTPSSGFLSEQYDKSTGAQDSAANLTWSYAAAITAYQARNGFTGASWGAKGVSTSCSTGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 1888 - DNA, 2421 bp, Aspergillus awamorii
gctagatgttaagcgatgttgcattgcaatttgtattgtgtgttgatgcatgtgcttcttccttcaacttccccctcgtgcagatgttggtttggatataaattgacgtggtcgctcaggggtcagtgaggggttgaaagtagcttcctccccctcaagacgcgacaactgagtgactgagcttcatcctcaacatcgttactcccccaccgcaatgtcgttccgatctcttctcgccctgagcggccttgtctgctctgggttggcaagtgtgatttccaagcgcgcgaccttggattcgtggttgagcaacgaagcgaccgtggctcgtactgcgatcctgaataacatcggggcggacggtgcttgggtgtcgggcgcggactctggcattgtcgttgccagtcccagcaccgataacccggactgtatgttttgagttcggattatgaatgtgtcttggttgattgattgatgctgactggcgtgtcttttgatgattgtagacttctacacctggactcgcgactctggtctcgtcatcaagaccctcgtcgacctcttccgcaatggagatactgatctcctttccaccattgagcactacatctcctctcaggcaattattcagggtgtcagtaacccctctggtgatctgtccagcggtggtcttggtgagcccaagttcaatgtcgatgagactgcctacaccggttcttggggacggccgcagcgtgatggtcctgccctgagagcaactgctatgatcggctttgggcagtggctgcttgtatgttctccacccccttgcgtctgatctgcaacatatgtagctgactggtcaggacaatggctacaccagcgctgcaacagagattgtttggcccctcgttaggaacgacctgtcgtatgtggctcagtactggaaccagacgggatatggtgtgtttgattgatcggggttcaagggtgtttgtgcatcggagctaacttcgcggtcgcagatctctgggaagaagttaatggctcgtccttcttcactattgccgtgcaacaccgcgccctcgtcgaaggtagtgccttcgcgacggccgtcggctcgtcctgctcctggtgtgattcgcaggcacctcagattctctgttacttgcagtccttcagcagccgttccggctggaccggcagctacatcctggccaactttgacaaggacacaaacaccctcctgggaagcatccacacctttgatcctgaggctggatgcgacgactccaccttccagccctgctccccgcgtgcgctcgccaaccataaggaggttgtagactctttccgctcgatctatactctcaacgatggtctcagtgacagtgaggcggttgcggtcggtcggtaccctgaggatagctactacaacggcaacccgtggttcctgtgcaccttggctgccgcggaacagctgtacgatgctctgtaccagtgggacaagcaggggtcgttggagatcacagacgtgtcacttgacttcttcaaggctctgtacagtggtgctgccaccggcacgtactcttcgtccagctcgacctatagcagcattgtgagtgccgtcaagactttcgctgatggttttgtttctattgtggtaagtctacgctagacgagcgctcatatttacagagggtgcgtactaacagaattaggaaactcacgccgcaagcaacggctctctgtctgagcaattcgacaagtctgatggcgacgagctttctgctcgcgatctgacctggtcttacgctgctctgctgaccgccaacaaccgtcgtaattctgtcgtgcccccgtcttggggtgagacctctgccagcagctggcccggcacctgtgcggctacctctgcctctggtacctacagcagtgtgaccgtcacctcgtggccgagcatcgtggctactggtgccaccactacgacggctactaccactggatcgggcggcgtgacctcgaccagcaagaccaccacaactgctagtaagaccagcaccactacgtcctcgacctcctgcaccacccccactgccgtagctgtgacctttgatctgacggcgaccaccacctacggcgagaacatctacctggtcgggtcgatctctcagctcggtgactgggagaccagcgatggcatagctctgagcgctgacaagtacacttccagtaacccgctttggtatgtaactgtgactctgccggctggtgagtcatttgagtacaagttcatccgcgttgagagcgatgactccgtggagtgggagagcgacccgaaccgggaatacaccgttcctcaggcgtgcggcgagtcgaccgcgacggtgaccgacacctggcggtagactattcaatcctattgatatgaaggatgagtat

SEQ ID NO: 1889 - protein, 639 aa, Aspergillus awamorii
MSFRSLLALSGLVCSGLASVISKRATLDSWLSNEATVARTAILNNIGADGAWVSGADSGIVVASPSTDNPDYFYTWTRDSGLVIKTLVDLFRNGDTDLLSTIEHYISSQAIIQGVSNPSGDLSSGGLGEPKFNVDETAYTGSWGRPQRDGPALRATAMIGFGQWLLDNGYTSAATEIVWPLVRNDLSYVAQYWNQTGYDLWEEVNGSSFFTIAVQHRALVEGSAFATAVGSSCSWCDSQAPQILCYLQSFSSRSGWTGSYILANFDKDTNTLLGSIHTFDPEAGCDDSTFQPCSPRALANHKEVVDSFRSIYTLNDGLSDSEAVAVGRYPEDSYYNGNPWFLCTLAAAEQLYDALYQWDKQGSLEITDVSLDFFKALYSGAATGTYSSSSSTYSSIVSAVKTFADGFVSIVETHAASNGSLSEQFDKSDGDELSARDLTWSYAALLTANNRRNSVVPPSWGETSASSWPGTCAATSASGTYSSVTVTSWPSIVATGATTTTATTTGSGGVTSTSKTTTTASKTSTTTSSTSCTTPTAVAVTFDLTATTTYGENIYLVGSISQLGDWETSDGIALSADKYTSSNPLWYVTVTLPAGESFEYKFIRVESDDSVEWESDPNREYTVPQACGESTATVTDTWR

SEQ ID NO: 1890 - DNA, 1481 bp, Saccharomyces cerevisiae
ggatccacgggtaagatttgttctatgttttaggtatggagttttgtaccacaaaactttaggaataccggattgtgtgcctacgccagccccagagtatgttctcacggctgtaattcctagtgatcttttcctggctcaaattaaactttcgcggcaggaaaaaaaaggctttttcttttttgtgtttcagtttctgcgaatgtggcattacataagcataatccttttgggtgtgcctggaaagttcaaattaagggtttttcttctgttttcttgacaagaaaatgttgcccaaagagtttcggccgttattttcctatcgaagtgggtcctttttgtctttagtccttctctggggctagcgatcgctgcaaaattaggcttcactggtacgagttaactttttttctttttttttgtcatccttttctttggggctaagaatggacttcccttttctttttctttgttgcagcagtggcttcaaagaactgctgattgctcaaggcaatcagttaaaagaaaaattagctttttttgtcaggcattgcacaaacttttttatttctgcctatactcttagacagatcagtcattcatgttgtctttttaacggtcgtactgggacatcgcataccttgagattccgtaattaggtgcaacaatacgggcacaactcattctgcggtatcttcacggacagaatttctattgcctattggtggtgtgattaacaattggaagcgcagagcttagaatggattttcaattcaatggatttggaggtattcgtttgtttactaatatttactttgaggacattgcccaaccctaaaagtgcctgttccagaacagaataacatttatgatacgttttcctgaccgctgagcaatttaaagcaattagtagggtacgattgtttctagagaaatgtgggtcatctttttaggtccgttctcttctgatgaggtaacctttacaaaaatgtcatggagttaccaattgggattcaaggcatcatcacaatatacttcgttcttttacggagaaattaagctctttctactttgaattaactgttagacttgtcttatctgagaaatgtccgtgttcaaattaaataaaaatttagggcagttttatttaccttaacaaatatgttcaagcatttacgttactgcgctctcttctagttcaagaacgataactcatagacttacctgtacaagttgttgaagggttctcaattgataaaaaaggatcttttgcttcctaaactaaacctataaaaagcaccctattcatcagttataatctcttgtcatgttgtggttctaattgaaaatatactatggtaggcctcaaaaatccatatacgcacactatgcaaagaccatttctactcgcttatttggtcctttcgcttctatttaactcagctttgggttttccaactgcactagttcctagaggatcc

SEQ ID NO: 1891 - protein, 31 aa, Saccharomyces cerevisiae
MQRPFLLAYLVLSLLFNSALGFPTALVPRGS

SEQ ID NO: 1892 - DNA, 2349 bp, Aspergillus terreus
ttctttcgttcagaggttgcaagcattcactctgatcttcgagatcttctctgatcggcgttggctccatctgcaatgacgcgcattctcaccctcgcccttcatgggctggctcttgtccaaagtgttgttggggctccccaattggcccccagagcgacaaccagtctggatgcatggttggcatcggagacgaccgttgcgctggatgggatccttgacaacgtgggttctagtggagcctacgctaaaagtgcgaagtccggtatcgtgattgccagtccaagcaccagcgatccagactgtaagtacatgtagtgccaattgtgttattgagctaataaacatcataccagactactacacgtggactcgtgatgctgcgttgaccgtcaaggccctgatcgatctgttccgcaatggcgagacaagccttcagaccgtgatcatggagtacattagctctcaggcgtacctccagaccgtatccaacccttcagggtccttgtccaccggtggtctggcagaaccaaaatattatgtcgatgagactgcctacacgggtagctggggacgtccccagcgggatggtcctgccctgagagcgacggcgatgatcgactttggtaactggctcattgtacgtctggacagggatccaatcctgcaggatgatcaaactaatgcaggcacaggacaacggatattcaacctacgcctctagcattgtgtggccgatcgtccgcaacgatctgtcgtacgttgcccaatattggaaccagaccggatatggtcagtgcattccccaagacccccagacttgaaccctagctaatgctctgaatgaacagacctctgggaagaagtgaacggatcctccttcttcacgattgccgtgcagcaccgggctctggtggaaggcagcaccttcgcctccaaagttggtgcctcgtgctcgtggtgcgactcgcaggcgccgcaggtgctttgcttcctgcagcgcttctggacaggctcgtacatcatggccaactttggcggcgggcgatcgggcaaagacgccaacaccgtcctgggaagcatccataccttcgacccgaatgccggttgcgacgataccacgttccagccatgctctcctcgagcactggccaaccacaaggtctacactgattcgttccgttctatctactctatcaactcgggaattagctcaggcaaggctgttgccgtgggtcgctaccctgaggactcttactacaatggaaacccgtggttccttaccacgttggctgccgcagagcagttgtacgatgccatttaccagtggcagaagattgggtctattaccatcacggacgtctcgctggccttcttcaaggatctttacagttctgcggccgttggaacgtacgcctcttcgagctcggccttcacctctatcgtgagcgccgtgaagacgtacgctgatggatatatgagtattgtggtatgttcctgctaccgacgttattgaaatgccagatgctaaatggctactatagcaaacacacgcgatgacgaatggctctctctctgagcagttcggcaagtccgacggcttctcgctgtccgcccgcgatctcacctggtcgtatgcagccctcctcacagccaacctgagaagaaactcggttgttcccccatcctggggcgagacgaccgcaaccagcgtgccctccgtctgctcagctacctctgccaccggcacctacagtaccgccacgaacaccgcgtggcccagcactctgaccagcgggactggtgctacaactaccacaagcaaggcgacttcttctagtactactactacctcgtcggcctcgtcaacaacagttgaatgtgtggttccgaccgcggtggcagtcacctttgatgaagttgctaccacaacctatggcgagaatgtctacgtggtgggatccatctcccaactgggcagctgggacacgagcaaggccgtggccctgagtgccagcaaatacacctccagcaacaatctctggtatgtcacggtcacccttcccgctgggacgaccttccagtacaagttcatccgggtttcgagcagcgggtcggttacttgggagagtgacccgaaccgttcatacacggttccgtccgcttgtgggacgtccaccgcggtggtgaacaccacttggcgctagatgggtgagtctggatgagccggtgatgtctttcggcttcctgaactgttccatagccgctggagggtgacaacaggcgtgatgtatcgctcgttattgtggaagcttttaccaagaggacatttacttgtacttaattcgt

SEQ ID NO: 1893 - DNA, 3751 bp, Debaryomyces occidentalis
agatctacattttaaaccccagtctactccagatattggagtataaccccattcttaccgttatatccatgacccgcatcgaaattttcaaaggatttcgaggaaattctttcctaaaatacgaagtgttattggtgattcaattactacggaaactactcatatggtagtagagttggtgaatgtagcgcaattgtaatttgcgaagttatagtaatagtttggcaaactggagaatttttcattattgggaaaatataaataaaggcaagtatccattgaaattttaaaatgaactcatgactgtattataacaagcaagatgatttttctgaagctgattaaaagtatagtaattggtttgggattagttagtgctatccaagcagcccctgcctcttcgattggatctagtgcttcagcatctagttcaagtgagagttctcaggctacaattcccaatgatgtaacattaggtgttaaacaaattcctaatatctttaatgactctgctgtcgatgctaatgcagctgctaaagggtatgacttggtaaatgttactaatactccaagaggattaaccggtatcttaaaattaaaagaagctaccaatatttatggttatgattttgattatttaaacttaactgttgaataccaagctgataccagattaaacgttcatattgaaccaactgatttatctgatgtatttgttttaccagagcatttagttgttaaaccactggtggaaggtgatgcacaatcttataacttcgacaattccgatttggttttcgaatactctaatactgacttctcctttgaagttattagatcatctactaaagaagttttattttctactaaaggtaatccattggttttttcaaatcaattcattcaattcaattcgtcattgccaaagaaccatgttattactggtcttggtgaatctattcacggtttagttaacgaaccaggtagcgttaaaacattatttgctaatgatgttggtgatccaatcgatggtaatatttatggtgtccatccagtttatcttgatcaaagatatgacactgaaactacccatgctgtttattggagaacttctgctattcaagaagtattaatcggtgaggaatctattacttggagagctctttcaggtgttattgatttatacttctttagtggtcctacaccaaaagatgccattcaacagtatgtcaaagagattggtttaccagctttccaaccatactggtcgttaggttaccatcaatgtagatggggttacgatactatcgaaaaattatctgaagttgttgaaaacttcaagaaatttaatattccattagaaactatctggtcagacattgattacatggactcttataaagatttcacttatgatccacacagattcccactagatgaatatcgtaaattccttgatgagttgcacaaaaataatcaacactatgttcctattttggatgctgctatttacgttccaaacccaaacaatgctacggataacgaataccaacctttccactatggtaatgaaaccgatgtcttcttaaagaatccagatggttcattatatattggtgctgtttggcaggttacactgttttccagatttcttagcagaaaacattcagatatggataaagtcattaaagattggtatgaattaactccttttgatggtatttgggctgatatgaatgaagtctcatcattctgtgttggttcttgtggtactggtaaatacttcgaaaacccagcatatcctccatttactgttggaagtaaagctacctcttatccagttggtttcgatgtttctaacgcatctgaatggaaatctattcaaagctcaatttctgctactgctaagacttcttcaacttcttccgtatcgtcgtcttcatccacaatcgattatatgaacactttagctccaggtaaaggtaatattaattatccaccatatgctatttacaacatgcaaggtgactccgatcttgctactcatgcagtatctccaaatgctacacatgctgatggtacagttgaatatgatattcacaatctttatggttacttgcaagaaaatgctacttatcatgcattattggaagtttttcctaacaagagaccattcatgatttccagatcaacctttccacgcgctggtaaatggaccggccattggggtggtgacaacactgctgattgggcttatgcttacttctctatccctcaagcattctcaatgggtattgctggccttccattctttggtgccgatgtttgtggtttcaatggtaattctgattctgaattatgttcaagatggatgcaattaggttctttcttcccattctacagaaaccacaactatttaggtgctattgatcaggaaccatatgtctgggaatcagttgctgaagctactagaacttctatggccattagatacttattattaccatattactacactttattacatgaatctcatactactggtttaccaatcttaagagctttctcgtggcaattccctaacgatcgttccttaagtggtgtcgataaccaattttttgtcggtgatggtttagttgttactcctgtcttagaacctggtgttgataaggttaaaggtgttttcccaggagctggtaaagaggaagtttactacgactggtacacccaaagagaagttcactttaaagacggtaagaatgaaactttagatgcaccattaggtcatattccattacacattagaggtggtaacgtcttgccaactcaagagccaggttatactgttgctgagtcaagacaaaatccatttggtttaattgtcgctttagataacgatggcaaagctcaaggtagcttataccttgatgatggtgaatcattagtagtagactcttcattgttggttagtttctctgtttctgataacacattatcagcatctccatctggtgactataaagctgatcaacctttagctaatgttaccatcttaggggttggccataaaccaaaatcagttaaatttgaaaacgctaatgttgatttcacctacaagaaatcaaccgttttcgttactggcttagataaatacaccaaggatggtgcattttctaaggatttcaccattacttggtaattttaacatccacttagttcaattccattcttttctttttcccgtgaaattctgaatttgaaattatttgaatgatatcattttagttttcttcagcttatgctatgtttatttcgattttaaatgttaaaagttttttatgtttatgttgttttattgatgtagttgataaaatatagcaaatacatcgaaaaatttgcgatgaaattttgcagctcattagaaatgtagtcaatcattagtcacattggaccactatataacaaacaacaactattccaagaaaaatatatgtaaggatactagatcataaattcttattgactttgttttttttaacaatagttacataaggaatattcgtttactacaaaaccattggtcttgtaaagaagcagacgaggcgtatgtttgtggttgcggccgctaatactagtttacaaagctcaccttatcattgtgctagactttcttttcaacgaaaggaaagcaaaagtagatgactgctctactttaattcaattaagataaatttggtattttgctagatct

SEQ ID NO: 1894 - protein, 958 aa, Debaryomyces occidentalis
MIFLKLIKSIVIGLGLVSAIQAAPASSIGSSASASSSSESSQATIPNDVTLGVKQIPNIFNDSAVDANAAAKGYDLVNVTNTPRGLTGILKLKEATNIYGYDFDYLNLTVEYQADTRLNVHIEPTDLSDVFVLPEHLVVKPLVEGDAQSYNFDNSDLVFEYSNTDFSFEVIRSSTKEVLFSTKGNPLVFSNQFIQFNSSLPKNHVITGLGESIHGLVNEPGSVKTLFANDVGDPIDGNIYGVHPVYLDQRYDTETTHAVYWRTSAIQEVLIGEESITWRALSGVIDLYFFSGPTPKDAIQQYVKEIGLPAFQPYWSLGYHQCRWGYDTIEKLSEVVENFKKFNIPLETIWSDIDYMDSYKDFTYDPHRFPLDEYRKFLDELHKNNQHYVPILDAAIYVPNPNNATDNEYQPFHYGNETDVFLKNPDGSLYIGAVWQVTLFSRFLSRKHSDMDKVIKDWYELTPFDGIWADMNEVSSFCVGSCGTGKYFENPAYPPFTVGSKATSYPVGFDVSNASEWKSIQSSISATAKTSSTSSVSSSSSTIDYMNTLAPGKGNINYPPYAIYNMQGDSDLATHAVSPNATHADGTVEYDIHNLYGYLQENATYHALLEVFPNKRPFMISRSTFPRAGKWTGHWGGDNTADWAYAYFSIPQAFSMGIAGLPFFGADVCGFNGNSDSELCSRWMQLGSFFPFYRNHNYLGAIDQEPYVWESVAEATRTSMAIRYLLLPYYYTLLHESHTTGLPILRAFSWQFPNDRSLSGVDNQFFVGDGLVVTPVLEPGVDKVKGVFPGAGKEEVYYDWYTQREVHFKDGKNETLDAPLGHIPLHIRGGNVLPTQEPGYTVAESRQNPFGLIVALDNDGKAQGSLYLDDGESLVVDSSLLVSFSVSDNTLSASPSGDYKADQPLANVTILGVGHKPKSVKFENANVDFTYKKSTVFVTGLDKYTKDGAFSKDFTITW

SEQ ID NO: 1895 - DNA, 3279 bp, HUMICOLA GRISEA THERMOIDEA
ggatccatgggctccatggcccggcaagacatcggtgtttttctgtccctgagcatcgtcgcttaaccccttaaccccccggacggccccggatggcaccggatgacgctttgttttctcttctgacctcccccgctaccccacaccggcaccgcatccccttggcacgcccgagcagtggcccgagtgcaacgccagagcaagctccggctagctccagcaagctggagcaagggctaccgccggcctgccgttacaccaagggccgtggcagtggcgtcaagtcgtccaacggccgaatccgagtcgaatccacgccagagatagcaccgaagtcgtcttcttccaagccgccgcgccctgtgattgtcggcccttccttgcatgtcgccgcaacgacgacagctcccggtagaatgtatgtacataccgagtctacacgtgtaagtagttgaccaaccaggctgaggtgcttccccccctggcagtgattggcctccccctggcacgaatcgcgtctcctcgtcgcggtgttaccgaatccggaaatgcgcatgacaacacctacggagtacggagtagagtccatgacgacaacgagagggaagagtccatcagagggtagcatctggagcataggagcactagcatataaataagaacgacatctcctcgcccatcatgttcggacttgtggttcagcagctccaggctcaactgctctccctcccacggtcaccgcctccgacctcgtcctgtccgccatgcataccttctccaagctcctcgtcctgggctctgccgtccagtctgccctcgggcggcctcacggctcttcgcgtctccaggaacgcgctgccgttgataccttcatcaacaccgagaagcccatcgcatggaacaagctgctcgccaacatcggccctaacggcaaagccgctcccggtgccgccgccggcgttgtgattgccagcccttccaggacggaccctccttgtacgtggtggcatggaatggacccaagagactgttttagatgaaagagagtttctgctaaccgccacacccagacttcttcacctggaccccggatgccgccctggtcctcaccggcatcatcgagtcccttggccacaactacaacaccaccctgcagcaggtctcgaacccctcgggaaccttcgccgacggctcgggtctcggtgaggccaagttcaatgtcgacctcactgccttcactggcgaatggggtcgccctcagagggacggcccgcccctgcgcgccatcgctctcatccagtacgccaagtggctgatcgccaacggctacaagagcacggccaagagcgtcgtctggcccgtcgtcaagaacgatctcgcctacacggcccagtactggaacgagaccggcttcgatctctgggaggaggtccccggcagctcgttctttaccatcgccagctctcacaggggtgagtcatttattgttcagtgttttctcattgaataattaccggaatgccactgacgccaaacagctctgactgagggtgcttacctcgccgctcagctcgacaccgagtgcccgccctgcacgaccgtcgcccctcaggttctgtgcttccagcaggccttctggaactccaagggcaactatgtcgtctcaacagtaagatccctacaccaacaaaaaaaatcgaaaaggaacgttagctgacccttctagtcaacggcgggcgagtatcgctccggcaaggacgccaactcgatcctggcgtccatccacaacttcgaccctgaggccggctgcgacaacctgaccttccagccctgcagcgagcgcgccctggccaaccacaaggcctatgtcgactcgttccgcaacctctacgccatcaacaagggcatcgcccagggcaaggccgttgccgtcggccgctactcggaggatgtctactacaacggcaacccgtggtacctggccaactttgccgccgccgagcagctctacgacgccatctacgtgtggaacaagcagggctccatcaccgtgacctcggtctccctgcccttcttccgcgaccttgtctcgtcggtcagcaccggcacctactccaagagcagctcgaccttcaccaacatcgtcaacgccgtcaaggcctacgccgacggcttcatcgaggtggcggccaagtacaccccgtccaacggcgcgctcgccgagcagtacgaccgcaacacgggcaagcccgactcggccgccgacctgacgtggtcgtactcggccttcctctcggccatcgaccgccgcgcgggtctcgtccccccgagctggcgggccagcgtggccaagagccagctgccgtccacctgctcgcgcatcgaggtcgccggcacctacgtcgccgccacgagcacctcgttcccgtccaagcagaccccgaacccctccgcggcgccctccccgtccccctacccgaccgcctgcgcggacgctagcgaggtgtacgtcaccttcaacgagcgcgtgtcgaccgcgtggggcgagaccatcaaggtggtgggcaacgtgccggcgctggggaactgggacacgtccaaggcggtgaccctgtcggccagcgggtacaagtcgaatgatcccctctggagcatcacggtgcccatcaaggcgacgggctcggccgtgcagtacaagtatatcaaggtcggcaccaacgggaagattacttgggagtcggaccccaacaggagcattaccctgcagacggcgtcgtctgcgggcaagtgcgccgcgcagacggtgaatgattcgtggcgttaagcggttggggggggttaggtagcagatatcattggggaggggatggaacggtatcgggggaggtgttgggtgattgattgattggggggtttttggaaacggcaatgatgatgatgataacttggatgtatactgcattctggctgtacatattttttggggtgtcacatacaatgtgcatggaagcaattgaaggtctatgagtttctgccctccatatcagtacctgaactaccatcccctttcctaatagcttccatcagctgtgtaccgatgtgtgtatgcatgttcctagatatgcatcatgcgtcactgccctacccatccaccttctcaccgccctccccctcgtcccaacactatcctctccaactctctcatgaccaaatccaccgcccactccgccatctctccaaactcaacatcctcgccccgatccaccatggcgtggatcc

SEQ ID NO: 1896 - protein, 620 aa, HUMICOLA GRISEA THERMOIDEA
MHTFSKLLVLGSAVQSALGRPHGSSRLQERAAVDTFINTEKPIAWNKLLANIGPNGKAAPGAAAGVVIASPSRTDPPYFFTWTPDAALVLTGIIESLGHNYNTTLQQVSNPSGTFADGSGLGEAKFNVDLTAFTGEWGRPQRDGPPLRAIALIQYAKWLIANGYKSTAKSVVWPVVKNDLAYTAQYWNETGFDLWEEVPGSSFFTIASSHRALTEGAYLAAQLDTECPPCTTVAPQVLCFQQAFWNSKGNYVVSTSTAGEYRSGKDANSILASIHNFDPEAGCDNLTFQPCSERALANHKAYVDSFRNLYAINKGIAQGKAVAVGRYSEDVYYNGNPWYLANFAAAEQLYDAIYVWNKQGSITVTSVSLPFFRDLVSSVSTGTYSKSSSTFTNIVNAVKAYADGFIEVAAKYTPSNGALAEQYDRNTGKPDSAADLTWSYSAFLSAIDRRAGLVPPSWRASVAKSQLPSTCSRIEVAGTYVAATSTSFPSKQTPNPSAAPSPSPYPTACADASEVYVTFNERVSTAWGETIKVVGNVPALGNWDTSKAVTLSASGYKSNDPLWSITVPIKATGSAVQYKYIKVGTNGKITWESDPNRSITLQTASSAGKCAAQTVNDSWR

SEQ ID NO: 1897 - DNA, 3308 bp, SACCHAROMYCES DIASTATICUS
gctagcgtatcaacccatctccagatttgcccagcatttctgtagaacacccaatgcgaatgaagactaatgaatattttaaagacaaaaaataggaaaagtttaattattgatggttctcaccaccgcaaaacggtcacttgcatgcattgaggacatgcactgcagtacttgtttttctcgaatgttttttaccatctcttttttccttatctgagctgctgacgcagacggacattgtttcatatttcgaaagctgtgcgggaaaacggaccctaacacgaatgtggatgcgctaatcggtatttccacctcatgaaacctgctactttttcagtgctcttcgtatgcatttcccaaaattcattcgtagccttgtcaacttagactcagtccacggcgtgcaggacggggtattatgaataaaggatccacgggtaagatttgttctatgttttaggtatggagttttgtaccacaaaactttgaggaataccggattgtgtgcctacgccagccccagagtatgttctcacggctgtaattcctagtgatcttttgcttcctaaactaaacctataaaaagcaccctattcatcagttataatctcttgtcatgttgtggttctaattgaaaatatactatggtaggcctcaaaaatccatatacgcacactatgcaaagaccatttctactcgcttatttggtcctttcgcttctatttaactcagctttgggttttccaactgcactagttcctagaggatcctcctctagcaacatcacttcctccggtccatcttcaactccattcagctctgctactgaaagcttttctactggcactactgtcactccatcatcatccaaataccctggcagtaaaacagaaacttctgtttcttctacaaccgaaactaccattgttccaactacaactacgacttctgtcataacaccatcaacaaccactattaccactacggtttgctctacaggaacaaactctgccggtgaaactacttctggatgctctccaaagaccattacaactactgttccatgttcaaccagtccaagcgaaaccgcatcggaatcaacaaccacttcacctaccacacctgtaactacagttgtctcaaccaccgtcgttactactgagtatgcgtctactagtacaaaacaaggtggtgaaattacaactacatttgtcaccaaaaacattccaaccacttacctaactacaattgctccaacttcatcagtcactacggttaccaatttcaccccaaccactattactactacggtttgctctacaggaacaaactctgccggtgaaactacctctggatgctctccaaagactgtcacaacaactgttccttgttcaactggtactggcgaatacactactgaagctaccgcccctgttacaacagctgtcacaaccaccgttgttaccactgaatcctctacgggtactaactccgctggtaagacgacaactagttacacaacaaagtctgtaccaaccacctatgtatttgactttggcaagggcattctcgatcaaagctgcggcggtgtattttcaaacaacggctcttcgcaagtgcagctgcgggatgtagtcttgatgaatgggacagtggtatacgattcaaacggcgcttgggacagtagtccgctggaggagtggctccagcgacagaaaaaagtttccatcgaaagaatatttgaaaatattgggcccagcgccgtgtatccgtctattttgcctggggtcgtgattgcgtcaccatcgcaaacgcatccagactacttctaccaatggataagggacagcgcgttgacgataaacagtattgtctctcattctgcggacccggcaatagagacgttattgcagtacctgaacgtttcattccacttgcaaagaaccaacaacacattgggcgctggcattggttacactaacgatacagtggctttgggagaccctaagtggaacgttgacaacacggctttcacggaaccttggggtcgtcctcaaaacgatggccctgctcttcgaagcattgccatcttaaaaatcatcgactacatcaagcaatctggcactgatctgggggccaagtacccattccagtccaccgcagatatctttgatgatattgtacgttgggacctgaggttcattattgaccactggaattcttccggatttgatctatgggaggaagtcaatggcatgcatttctttactttactggtacaactgtctgcagtggacaggtcgctgtcgtattttaacgcctcagaacggtcgtctccctttgttgaagaattgcgtcagacacgccgggacatctccaagtttttagtggaccctgcgaatgggtttatcaacggcaagtacaattatattgttgagacacccatgattgccgacacattgagatccggactggacatatccactttattagctgcgaacaccgtccacgatgcgccatctgcttcccatcttccgttcgatatcgatgaccctgccgtcctgaacacgttgcaccatttgatgttgcacatgcgttcgatataccccatcaacgatagctccaaaaatgcaacgggtattgccctgggccggtatcctgaggacgtatatgatggatatggcgttggcgagggaaatccctgggtcctggccacgtgtgccgcttcaacaacgctttatcagctcatttacagacacatctctgagcagcatgacttggttgtcccaatgaacaacgattgttcgaacgcattttggagcgagctggtattctccaacctcacgactttgggaaatgacgaaggctatttgattttggagttcaatacacctgccttcaatcaaaccatacaaaaaatcttccaactagctgattcattcttggtcaagctgaaagccacgtgggaacagacggggaactaagtgaacaatttaacaaatacacagggtttatgcagggtgcccaacaccttacctggtcctatacttcattctgggatgcctatcaaataagacaagaagttttacagagtttgtagacaaaaaaaaataaaagaaaagcgagaagtatacacaagtgtatttcctagatatttacatcaaatatatatatatatacttatttacaaaactctgatattataaattaattagatactatgtcggaacgtccagcccaaccacgtttgcagttcttttcactttctcatcctgtgtcaacttgttgccaggattgtatctgtcgac

SEQ ID NO: 1898 - protein, 768 aa, SACCHAROMYCES DIASTATICUS
MQRPFLLAYLVLSLLFNSALGFPTALVPRGSSSSNITSSGPSSTPFSSATESFSTGTTVTPSSSKYPGSKTETSVSSTTETTIVPTTTTTSVITPSTTTITTTVCSTGTNSAGETTSGCSPKTITTTVPCSTSPSETASESTTTSPTTPVTTVVSTTVVTTEYASTSTKQGGEITTTFVTKNIPTTYLTTIAPTSSVTTVTNFTPTTITTTVCSTGTNSAGETTSGCSPKTVTTTVPCSTGTGEYTTEATAPVTTAVTTTVVTTESSTGTNSAGKTTTSYTTKSVPTTYVFDFGKGILDQSCGGVFSNNGSSQVQLRDVVLMNGTVVYDSNGAWDSSPLEEWLQRQKKVSIERIFENIGPSAVYPSILPGVVIASPSQTHPDYFYQWIRDSALTINSIVSHSADPAIETLLQYLNVSFHLQRTNNTLGAGIGYTNDTVALGDPKWNVDNTAFTEPWGRPQNDGPALRSIAILKIIDYIKQSGTDLGAKYPFQSTADIFDDIVRWDLRFIIDHWNSSGFDLWEEVNGMHFFTLLVQLSAVDRSLSYFNASERSSPFVEELRQTRRDISKFLVDPANGFINGKYNYIVETPMIADTLRSGLDISTLLAANTVHDAPSASHLPFDIDDPAVLNTLHHLMLHMRSIYPINDSSKNATGIALGRYPEDVYDGYGVGEGNPWVLATCAASTTLYQLIYRHISEQHDLVVPMNNDCSNAFWSELVFSNLTTLGNDEGYLILEFNTPAFNQTIQKIFQLADSFLVKLKATWEQTGN

SEQ ID NO: 1899 - DNA, 1721 bp, Aspergillus shirousami
ctctcccttctctgaacaataaaccccacagaaggcatttatgatggtcgcgtggtggtctctatttctgtacggccttcaggtcgcggcacctgctttggctgcaacgcctgcggactggcgatcgcaatccatttatttccttctcacggatcgatttgcaaggacggatgggtcgacgactgcgacttgtaatactgcggatcagaaatactgtggtggaacttggcagggcatcatcgacaagttggactatatccagggaatgggcttcacagccatctggatcacccccgttacagcccagctgccccagaccaccgcatatggagatgcctaccatggctactggcagcaggatatatactctctgaacgaaaactacggcactgcagatgacttgaaggcgctctcttcggcccttcatgagagggggatgtatcttatggtcgatgtggttgctaaccatatgggctatgatggagcgggtagctcagtcgattacagtgtgtttaaaccgttcagttcccaagactacttccacccgttctgtttcattcaaaactatgaagatcagactcaggttgaggattgctggctaggagataacactgtctccttgcctgatctcgataccaccaaggatgtggtcaagaatgaatggtacgactgggtgggatcattggtatcgaactactccattgacggcctccgtatcgacacagtaaaacacgtccagaaggacttctggcccgggtacaacaaagccgcaggcgtgtactgtatcggcgaggtgctcgacgttgatccggcctacacttgtccctaccagaacgtcatggacggcgtactgaactatcccatttactatccactcctcaacgccttcaagtcaacctccggcagcatggacgacctctacaacatgatcaacaccgtcaaatccgactgtccagactcaacactcctgggcacattcgtcgagaaccacgacaacccacggttcgcttcttacaccaacgacatagccctcgccaagaacgtcgcagcattcatcatcctcaacgacggaatccccatcatctacgccggccaagaacagcactacgccggcggaaacgaccccgcgaaccgcgaagcaacctggctctcgggctacccgaccgacagcgagctgtacaagttaattgcctccgcgaacgcaatccggaactatgccattagcaaagatacaggattcgtgacctacaagaactggcccatctacaaagacgacacaacgatcgccatgcgcaagggcacagatgggtcgcagatcgtgactatcttgtccaacaagggtgcttcgggtgattcgtataccctctccttgagtggtgcgggttacacagccggccagcaattgacggaggtcattggctgcacgaccgtgacggtgggttcggatggaaatgtgcctgttcctatggcaggtgggctacctagggtattgtatccgactgagaagttggcaggtagcaagatctgtagtagctcgtgaagggtggagagtatatgatggtactgctattcaatctggcattggacagtgagtttgagtttgatgtacagttggagtcgttactgctgtcatccccttatactctttgattgtttttcgaaccctaataccaagcacgctagtctattataagaaagaatccagattaatatgtttttat

SEQ ID NO: 1900 - protein, 499 aa, Aspergillus shirousami
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDVDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 1901 - DNA, 1619 bp, FUSICOCCUM SP. BCC4124
ccggcgcaatggcgctcgcgctccatctaccaggtcctcactgatagattcgcgcgtaccgatggcagcactacggccacctgcaacacccaggacagggtgtactgcggcggaacttaccagggcctcatcaaccggctggactacatccagaacatgggcttctctgctatctggatctcgcccattgtgtacaacctgcctgagaccaccggctatggccaggcctaccacggctactggcagcaggatctttaccgcctgaacgagaacttcggctctgcggatgacctcaaggcgctcgctgctgagctgcacgaccgcgacatgtacctcatggttgatgtcgtcgtcaatcacatggcgtgggcgggctcggccagctcagtggactacagccgtttcaatccgttcaactcgcagagctacttccactcgtactgtgaaatcaccgactacaacaaccaggacctggtcgaggactgctggctcggtgactcgaccgttgagcttgtcgatgtcaagactgaagactccaccgtggccaatatgtacaacacctggatcagccagcttgtttcaaactactccattgacggcctccgcatcgacacggccaagcacgtcgacaaatcattcttccccggctttgagtcggcggccggcgtcttctgcaccggcgaagtgtatgacggggacccatcctacacgtgcgactaccagaactacatggacagcgtgctgaactacccaatctactacccactcgtccgcgccttcacgtcgtccagcgggtccatctcggacctggtcaacgagatcaacacggtcaagtcgggttgcaaggacagcacgctgttaggcagcttctccgagaaccacgacatcacgcgcttcgcggccatcacgtcagacctctcgcaggccaagaacgtcatagcattcacgctacttgccgacggcgtgcccatcctctaccagggccaagagcagcattacgccggtgcctccgacccggacaaccgcgaggccgtgtggctatctgggtacaacgccgacgccgacctgtacaagctcaccgcctcggtcaaccagatccgcaaccgcgccatcgcggtcgacgcgacctacctgacgtacaagaactgggttatctacagcgacacgacgacgatcgccatgcgcaagggctacgacggcaaacaggtgatcacggtgctcagcaacaagggcgccagcggcgacgcgtacacgctgaacctgagcaacacggggtggacgagcgggaccgaggtcgtcgagatcctgacgtgcgcgacgacgacggtgacgagcgggaacacggtcacggtgcccatggcgaacggtctgccgcgcatctacttcccgctggcgcagctgacggggtcggggatttgtggtaagtgagcgaggcgatggtgctttacccctggagcgtggaggcaacgggccatctcttttttttcctccttctttcttcctatagtagggtctggatgcacaaaatagttctctcaaggggattctggtaacagggcaggctaaaccctacctctcgttcaaaattggatcttcatacgcttccaaaaaaaaaaaaa

SEQ ID NO: 1902 - protein, 475 aa, FUSICOCCUM SP. BCC4124
PAQWRSRSIYQVLTDRFARTDGSTTATCNTQDRVYCGGTYQGLINRLDYIQNMGFSAIWISPIVYNLPETTGYGQAYHGYWQQDLYRLNENFGSADDLKALAAELHDRDMYLMVDVVVNHMAWAGSASSVDYSRFNPFNSQSYFHSYCEITDYNNQDLVEDCWLGDSTVELVDVKTEDSTVANMYNTWISQLVSNYSIDGLRIDTAKHVDKSFFPGFESAAGVFCTGEVYDGDPSYTCDYQNYMDSVLNYPIYYPLVRAFTSSSGSISDLVNEINTVKSGCKDSTLLGSFSENHDITRFAAITSDLSQAKNVIAFTLLADGVPILYQGQEQHYAGASDPDNREAVWLSGYNADADLYKLTASVNQIRNRAIAVDATYLTYKNWVIYSDTTTIAMRKGYDGKQVITVLSNKGASGDAYTLNLSNTGWTSGTEVVEILTCATTTVTSGNTVTVPMANGLPRIYFPLAQLTGSGICGK

SEQ ID NO: 1903 - DNA, 1979 bp, Cryptococcus flavus
atggctcctgtccgctccctagctggggccctgctcgcctctctaggactggtcgctggcctgtctccagccgaatggcgaagccagtccatctaccaggtcgtcaccgaccgctttgcgctcgacaatggcggaaactcgccttcttgctcgggtcaaagcgagctcaacctctactgcaatggcacctttgcaggcatcatcgacaagctggactatatccagaacatgggcttcaccgccatctggatctcgcccgtggtcaagaacatcgacggtggctcacctaatggctacacgcctgacggatccgcttaccacggctactgggctcaggacatctacgagatcaacccacacttcggcggagcgtcaggtctgaccgacctgtcgaacgctttgcacaaccggggcatgtacttgatggtggacgttgtcgtcaaccatatggcgtactactgcggcaccaatggcggatgcggtcccggcaactcggtcaactacggatcgttcacgcctttcaacagcgagtcatacttccacccgttctgcgagatcgattacaacaaccgcacgagcatcctcgactgctgggagggtgacgagatcgtgccgctcgtcgacctccggacagaggactcggacgtgcagtccatcttcaactcgtggatcagcaacttgatccagacgtacaacatcgacggcctccggatagactcgctccagcagtctggctccttcttcttcccggggttcaaccaggccgcgggcggcatgtatatggtcggcgaggtcttcaacggcaacccgtcctacgtctgcccttaccagcaggctggcatgccaggtgtcctcaactaccctatgtgagtcttgctgcggcagccgatgagactacagctcacggctaaggttcttctacatcaccaatgccttccagacctcgtctggcagcatgagccagctcgctcagggaatttcggccatgcaatctgactgctcggacacaacgctcctcggaaggtaagtcttgcttgggggactctagctcataagacagcttcttggagaaccaggacaacccacgcttccccagtcagacgaacgacctaacccgtgctcagaacgcgatcgccttcaccatgctgcaggacggtatccccatcacctactacggccaagagcagcacctgtccggctctggcgtcccccttaaccgagaggcgctgtggacgtcgggcggatacgactcctcgtcgccgctgtacaagatgattacgacggtgaaccagctgagaacgctcgcgatcaagcagaacggcggctttgtgacctacaagatccaggtgccatacaccgactcgaaccatatcgtcacgcgcaagggcaactcgggctaccagattgtcggcgtctacaccaacgtcggctccgctggcgcgtcttcaaccttatccctctcttcgtccgagaccgggttccaggcctctgaaccggtcatggacgtcctgtcctgcacgctgtaccatactggtagtgacgggagcctgtcattcaccatgactggcggcctgccccgagtcttctacaacgccacggccctggccgagagcagtctctgcacaacctacacgacggcgaccccgccgcctggcggctgctccgcgggcactgtggtgttcgacgtctatgtccagacgcagtacggccagagcgtcgtcatcgcgggtaacatcccccagctcggcaactggagcccggcgaacggcttgaacctcaacgcaaaccagtacacggcatcgagccccaagtggaccgggaccatcaccggcgtcgcacccggtaccacgttccagtggaagcccatcgtcgttaccaatggtaatgacaactggtacactggcagcaaccagcaggccacgacgggttcggcctgtagctcgcccgcgaccgatatcgagtttacgtggtcctcctag

SEQ ID NO: 1904 - protein, 631 aa, Cryptococcus flavus
MAPVRSLAGALLASLGLVAGLSPAEWRSQSIYQVVTDRFALDNGGNSPSCSGQSELNLYCNGTFAGIIDKLDYIQNMGFTAIWISPVVKNIDGGSPNGYTPDGSAYHGYWAQDIYEINPHFGGASGLTDLSNALHNRGMYLMVDVVVNHMAYYCGTNGGCGPGNSVNYGSFTPFNSESYFHPFCEIDYNNRTSILDCWEGDEIVPLVDLRTEDSDVQSIFNSWISNLIQTYNIDGLRIDSLQQSGSFFFPGFNQAAGGMYMVGEVFNGNPSYVCPYQQAGMPGVLNYPMFFYITNAFQTSSGSMSQLAQGISAMQSDCSDTTLLGSFLENQDNPRFPSQTNDLTRAQNAIAFTMLQDGIPITYYGQEQHLSGSGVPLNREALWTSGGYDSSSPLYKMITTVNQLRTLAIKQNGGFVTYKIQVPYTDSNHIVTRKGNSGYQIVGVYTNVGSAGASSTLSLSSSETGFQASEPVMDVLSCTLYHTGSDGSLSFTMTGGLPRVFYNATALAESSLCTTYTTATPPPGGCSAGTVVFDVYVQTQYGQSVVIAGNIPQLGNWSPANGLNLNANQYTASSPKWTGTITGVAPGTTFQWKPIVVTNGNDNWYTGSNQQATTGSACSSPATDIEFTWSS

SEQ ID NO: 1905 - DNA, 3248 bp, Aspergillus awamorii
cgagaatcagtgcatctccacgagtcaagacaaggttggcttgattcttctcccataaggggcgtaatttagctaatagtgagtagtccgtgtcgagagatttgtgttctgcaacaattaaggggaccagggttaaatcctggcccccgaactggtcggagttctgaccaatgagagactgtgtatacgcccgttcctggctgatggattaattgccggcttcacttggcatccatcaagcatcaagatgtgatcagaagggtagtaggtgggttgatctgccttgcaaggtgctcagcgttctgaggtcatgctgaagggaatatttaagaatgtttatcaggaacagagttcgccgatagtcaagctgtgcttgggacactttctgtcgctttgtcggagattaatacacagctatgagagtgtcgacttcaagccttgccctttctgtgtcccttttcgggaagctggcccttgggctgtcagctgcagaatggcgctctcagtccatctattttcttttgacggatcggttcggtaggacggacaattcgactacagctacgtgcgatacgggtgaccaagtatggtattgcaattctttcatatttatatgctgacctggatagatctattgtggtggaagttggcaaggaattatcaaccatgttcgtatctcagttcatatcatccatgctgggcgcttttgactgttgctgcagctagactatatccagggcatgggattcacagctatctggatctcgcctatcactgagcagctgccccaggatacttcggacggtgaagcctaccatggttactggcagcagaagatgtatgcgctcattgcattcatattctatgctaatttgcagaccgcggctgacttggcagatacgatgtgaactccaatttcggcactgcagatgacctgaagtccctctcggatgctcttcacgcccgtggaatgtacctcatggttgatgtcgtcccaaaccacatgggctacgcaggcaacggcaacgatgtcgattacagcgtcttcgaccccttcgactcctcttcctacttccacccatactgcctcatcacggattgggacaacttgaccatggttcaagattgttgggagggtgacaccatcgtgtctctgccagacttgaacaccaccgaaaccgccgtgagaacaatctggtatgactgggtagccgacctggtatccaactactcaggttcgacggtgcgaccccaacccactaaaacaagctcagcatactaaagaattgcctcagtcgacggcctccgcatcgacagtgtcctcgaagtcgaaccagacttcttccccggctaccaagaagcagcaggagtctactgcgtcggtgaagtcgacaacggcaaccctgctctcgactgcccataccaagactatctagatggcgttctcaactaccccatgtacattctccctcccaccttacagttttttttttttttttctagccatcactaacccaattgctgcagctactggcaactcctctacgccttcgaatcctccagcggcagcatcagcgacctctacaacatgatcaaatccgttgccagcgactgctccgatcccaccctcctgggcaactttatcgaaaaccacgacaatccccgtttcgcctcgtacgtctacaccctctcccctctcctcccctccctacaaccacactcactgacaagcgaagctacacatccgactactcccaagcgaaaaacgtcctcagctacatcttcctctccgacggcatccccatcgtctacgcaggcgaagaacagcactactccggcggcgacgtgccctacaaccgcgaagcgacctggctatcaggctacgacacctccgcggagctctacacctggatagctaccacgaacgcgatccgcaaactagctatctcagcggattcggactacattacttatgcggttcgtcttccctttcaacccagaactcaacccccatcctaacacaaatctaacaatgaatagaacgacccaatctacacagacagcaacaccatcgccatgcgcaaaggcacctccggcagccaggtcatcaccgtcctctccaacaaaggctcctccggaagcagctacaccctcaccctcagcggaagcggctacacatccggcacggagctcatcgaagcatacacctgcacgtctgtgactgtggactcgaacggggatatccccgtgccgatggcttcgggattacccagggttctccttccggcttgggtggttgatagttcttcatcactctggggaggaagtacaactacaactacctcatcttctacctccacctccacatccaaagccacctcctcctcttctactactacttcatcatcatgcaccgcaacatccaccaccctccccatcaccttagaagaactagtcaccaccacctacggagaagaaatctacctgagcggatctatctctcagctcggggagtgggataccagcgacgcggtgaagttgtccgcggatgattatacctcgagtaaccccgagtggtatgttactgtgtcgttgccggtggggacgaccttcgagtataagtttattaaggtcgaggaggatgggagtgtgacttgggaaagtgatccgaatagggagtatactgtgcctgaatgtgggagtggggagacggtggttgatacgtggaggtagattgggtttactttgtgggtgtatgtatgtaggtttgggtgtggtgggatggttaatgatgtttactgttgtgagtatgggatgagtagcaattgagttaacattgtatgtgagataactcatctggttatgtacaaagtcaattagccataggcttggaagaaaaatctccgggtctctgattagagtacccaactggagatacaaaacgttaagaacatgaaaattggggaaaacaaagggtatttaacaactcatgagcatttgctcgttggtagaatgcaatcgtagcagaatggcgctctcagtccatctattttcttttgacggatcggttcggtaggacggacaattcgactacagctacgtgcgatacgggtgaccaagtatggtattgcaattctttcatatttatatgctgacttggatagatctattgtggtggaagttggcaaggaattatcaaccatgttcgtatctcagttcatatcatccatgctgggcgcttctgactg

SEQ ID NO: 1906 - protein, 634 aa, Aspergillus awamorii
MRVSTSSLALSVSLFGKLALGLSAAEWRSQSIYFLLTDRFGRTDNSTTATCDTGDQIYCGGSWQGIINHLDYIQGMGFTAIWISPITEQLPQDTSDGEAYHGYWQQKIYDVNSNFGTADDLKSLSDALHARGMYLMVDVVPNHMGYAGNGNDVDYSVFDPFDSSSYFHPYCLITDWDNLTMVQDCWEGDTIVSLPDLNTTETAVRTIWYDWVADLVSNYSVDGLRIDSVLEVEPDFFPGYQEAAGVYCVGEVDNGNPALDCPYQDYLDGVLNYPIYWQLLYAFESSSGSISDLYNMIKSVASDCSDPTLLGNFIENHDNPRFASYTSDYSQAKNVLSYIFLSDGIPIVYAGEEQHYSGGDVPYNREATWLSGYDTSAELYTWIATTNAIRKLAISADSDYITYANDPIYTDSNTIAMRKGTSGSQVITVLSNKGSSGSSYTLTLSGSGYTSGTELIEAYTCTSVTVDSNGDIPVPMASGLPRVLLPAWVVDSSSSLWGGSTTTTTSSSTSTSTSKATSSSSTTTSSSCTATSTTLPITLEELVTTTYGEEIYLSGSISQLGEWDTSDAVKLSADDYTSSNPEWYVTVSLPVGTTFEYKFIKVEEDGSVTWESDPNREYTVPECGSGETVVDTWR

SEQ ID NO: 1907 - DNA, 2087 bp, Aspergillus awamorii
gggacactttctgtcgctttgtcggagattaatacacagctatgagagtgtcgacttcaagccttgccctttctgtgtcccttttcgggaagctggcccttgggctgtcagctgcagaatggcgctctcagtccatctattttcttttgacggatcggttcggtaggacggacaattcgactacagctacgtgcgatacgggtgaccaaatctattgtggtggaagttggcaaggaattatcaaccatctagactatatccagggcatgggattcacagctatctggatctcgcctatcactgagcagctgccccaggatacttcggacggtgaagcctaccatggttactggcagcagaagatatacgatgtgaactccaatttcggcactgcagatgacctgaagtccctctcggatgctcttcacgcccgtggaatgtacctcatggttgatgtcgtcccaaaccacatgggctacgcaggcaacggcaacgatgtcgattacagcgtcttcgaccccttcgactcctcttcctacttccacccatactgcctcatcacggattgggacaacttgaccatggttcaagattgttgggagggtgacaccatcgtgtctctgccagacttgaacaccaccgaaaccgccgtgagaacaatctggtatgactgggtagccgacctggtatccaactactcagtcgacggcctccgcatcgacagtgtcctcgaagtcgaaccagacttcttccccggctaccaagaagcagcaggagtctactgcgtcggtgaagtcgacaacggcaaccctgctctcgactgcccataccaagactatctagatggcgttctcaactaccccatctactggcaactcctctacgccttcgaatcctccagcggcagcatcagcgacctctacaacatgatcaaatccgttgccagcgactgctccgatcccaccctcctgggcaactttatcgaaaaccacgacaatccccgtttcgcctcctacacatccgactactcccaagcgaaaaacgtcctcagctacatcttcctctccgacggcatccccatcgtctacgcaggcgaagaacagcactactccggcggcgacgtgccctacaaccgcgaagcgacctggctatcaggctacgacacctccgcggagctctacacctggatagctaccacgaacgcgatccgcaaactagctatctcagcggattcggactacattacttatgcgaacgacccaatctacacagacagcaacaccatcgccatgcgcaaaggcacctccggcagccaggtcatcaccgtcctctccaacaaaggctcctccggaagcagctacaccctcaccctcagcggaagcggctacacatccggcacggagctcatcgaagcatacacctgcacgtctgtgactgtggactcgaacggggatatccccgtgccgatggcttcgggattacccagggttctccttccggcttgggtggttgatagttcttcatcactctggggaggaagtacaactacaactacctcatcttctacctccacctccacatccaaagccacctcctcctcttctactactacttcatcatcatgcaccgcaacatccaccaccctccccatcaccttagaagaactagtcaccaccacctacggagaagaaatctacctgagcggatctatctctcagctcggggagtgggataccagcgacgcggtgaagttgtccgcggatgattatacctcgagtaaccccgagtggtatgttactgtgtcgttgccggtggggacgaccttcgagtataagtttattaaggtcgaggaggatgggagtgtgacttgggaaagtgatccgaatagggagtatactgtgcctgaatgtgggagtggggagacggtggttgatacgtggaggtagattgggtttactttgtgggtgtatgtatgtaggtttgggtgtggtgggatggttaatgatgtttactgttgtgagtatgggatgagtacgcaattgagttaacattgtatgtgagacaaaaaaaaaaaaaaaaaaaaaaaa

SEQ ID NO: 1908 - protein, 634 aa, Aspergillus awamorii; identical to SEQ ID NO: 1906

SEQ ID NO: 1909 - DNA, 1638 bp, Aspergillus awamorii
cacatcaagctctcccttctctgaacaataaaccccacagaaggcatttatgatggtcgcgtggtggtctctatttctgtacggccttcaggtcgcggcacctgctttggctgcaacgcctgcggactggcgatcgcaatccatttatttccttctcacggatcgatttgcaaggacggatgggtcgacgactgcgacttgtaatactgcggatcagaaatactgtggtggaacatggcagggcatcatcgacaagttggactatatccagggaatgggcttcacagccatctggatcacccccgttacagcccagctgccccagaccaccgcatatggagatgcctaccatggctactggcagcaggatatatactctctgaacgaaaactacggcactgcagatgacttgaaggcgctctcttcggcccttcatgagagggggatgtatcttatggtcgatgtggttgctaaccatatgggctatgatggagcgggtagctcagtcgattacagtgtgtttaaaccgttcagttcccaagactacttccacccgttctgtttcattcaaaactatgaagatcagactcaggttgaggattgctggctaggagataacactgtctccttgcctgatctcgataccaccaaggatgtggtcaagaatgaatggttcgactgggtgggatcattggtatcgaactactccattgacggcctccgtatcgacacagtaaaacacgtccagaaggacttctggcccgggtacaacaaagccgcaggcgtgtactgtatcggcgaggtgctcgacggtgatccggcctacacttgtccctaccagaacgtcatggacggcgtactgaactatcccatttactatccactcctcaacgccttcaagtcaacctccggcagcatggacgacctctacaacatgatcaacaccgtcaaatccgactgtccagactcaacactcctgggcacattcgtcgagaaccacgacaacccacggttcgcttcttacaccaacgacatagccctcgccaagaacgtcgcagcattcatcatcctcaacgacggaatccccatcatctacgccggccaagaacagcactacgccggcggaaacgaccccgcgaaccgcgaagcaacctggctctcgggctacccgaccgacagcgagctgtacaagttaattgcctccgcgaacgcaatccggaactatgccattagcaaagatacaggattcgtgacctacaagaactggcccatctacaaagacgacacaacgatcgccatgcgcaagggcacagatgggtcgcagatcgtgactatcttgtccaacaagggtgcttcgggtgattcgtataccctctccttgagtggtgcgggttacacagccggccagcaattgacggaggtcattggctgcacgaccgtgacggttggttcggatggaaatgtgcctgttcctatggcaggtgggctacctagggtattgtatccgactgagaagttggcaggtagcaagatctgtagtagctcgtgaagggtggagagtatatgatggtactgctattcaatctggcattggacagtgagtttgagtttaatgtacagttggagtcgttactactg

SEQ ID NO: 1910 - protein, 499 aa, Aspergillus awamorii
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWFDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 1911 - DNA, 1494 bp, Ajellomyces capsulatus
atgatgaaattcactatcattaatgtttcagtgtctattctggctgttgcaaaagctgttgttgcggcaactccagcagagtggcgttcgcaatcgatatatttccttctcacggacagagattttgcggtgggacctggcaaggaatcatcaagaaggtacccttcagagcccttcctgtctcagattgggaccttgcctaacacgttttggaagcttgattacatccagaaaatggggtttactgctatatggattactcctgtgacaaaacagttccccgagagatcggggtatggagaggcgttccatggatattggcaacaagatttgtatgccgtggagccccatcttgggtctgcagacgatctcagggtattgagcgcagcactacatgaacgtgggatgtatctcatggtcgacgtagtagcgaaccatatgggctatcctggctccagcagcagtatggattatagtcgatatgtcccgtttaataactatatctattttcacccttattgccccatcaccgattacaacaatcaacctatggttgaacatttgggtgatattcccgaataccttccgtttcgccctctacttgttcttgctgttcaaaataccctagtcttggaactaacaattactgcagtcgacggtcttcgaatcgacactgcgaagcatgtacggaagccattctggaaggagttcaatttcgccgcaggagtatattccatgggtgaagtgtatcatggtgacccaggttacgcctgtgactaccagaactatatcgatggtttagtgaattacccaatgtatggtcacggatacattgccaatggctattaccctctcattgaagcctttaaatcaccaagcggcaatatggcaaacctatacaatatgatcaatacagtgaaggacaattgtccagattccacactaataggcaccttctcagagaatcacgacactccaaggttcgcaaattataccaacgacttgtctctcgctaaaagtgtcctggtcttcacgatcctcgcagatggaattcccatagtctatgctggccaagaacagcactattcgggcgggaatgatccatacaaccgtgaagcaacctggctgtcgggctataacactgaaagtcctctattcaagctcacggcaaaagccaatagaatccggaagaaagccattgcagacgatgccaactatcttacatataaaaactatcccatctaccaagaccaaaacaccattgcgatgcgcaaaggtttcgatggcaaacaaattatcactgtactctctaaccttggctctggcggggcttcttacacgttgcagctgggtggcacgggctatccggccggcatgcgggttaccgatatttacacgtgcacgtcttctgtggtggcttctaatgggcagctaccagtgccgatgggtgcgggcgagccgaggatcctgtacccaaaaaaggagtatgaatga

SEQ ID NO: 1912 - protein, 497 aa, Ajellomyces capsulatus
MMKFTIINVSVSILAVAKAVVAATPAEWRSQSIYFLLTDRDFAVGPGKESSRRYPSEPFLSQIGTLPNTFWKLDYIQKMGFTAIWITPVTKQFPERSGYGEAFHGYWQQDLYAVEPHLGSADDLRVLSAALHERGMYLMVDVVANHMGYPGSSSSMDYSRYVPFNNYIYFHPYCPITDYNNQPMVEHLGDIPEYLPFRPLLVLAVQNTLVLELTITAVDGLRIDTAKHVRKPFWKEFNFAAGVYSMGEVYHGDPGYACDYQNYIDGLVNYPMYGHGYIANGYYPLIEAFKSPSGNMANLYNMINTVKDNCPDSTLIGTFSENHDTPRFANYTNDLSLAKSVLVFTILADGIPIVYAGQEQHYSGGNDPYNREATWLSGYNTESPLFKLTAKANRIRKKAIADDANYLTYKNYPIYQDQNTIAMRKGFDGKQIITVLSNLGSGGASYTLQLGGTGYPAGMRVTDIYTCTSSVVASNGQLPVPMGAGEPRILYPKKEYE

SEQ ID NO: 1913 - DNA, 1794 bp, Phanerochaete chrysosporium
atgttgcctctcgtgcacctctgcctatacctttccgctctcggaaccgcgttcgctgcgacagcagaggagtggaagagtcgctccatctaccagcttattgtggaccgctacgcgctgcccgacggtgcggacccgacgaagtgtaaccctgcggaccaaacgtggtgtggtggcacttggaacacggtccgcgagaacctcgactacatccagaacgctgggttcacagctatctggatcagtcccgtgtcccagaactatcaaggtcctcgtactgcctacggcgacccttaccatggttactggattgcggacgcgtcaaagcttaacgatcgctttggtacggctaatgacctcaaggctctttctgatgaagttcaccgccgtggcatgtatctgatggttgacgttgttgtgaacaatgtcatgtctacgtctctcacgccggatctgtctacatacatgttcaaggatcagtcgcaataccacccatactgccccatcgactggaacaacatcacgagcgagcagaactgctggctcggcgacacaaaggttcctcttccggatctcaacacgcagaaccccactgtcgtctctggttacagtacctggatcaagtcgctcgtcgaaacctacaacatcgatggtctccgtatcgatgctgccaagcatgtcgatgccgagttctggccgcagttttgtggcgctgctggcgtatactgcattggtgaggttttcggtgacgatatcgactttgcttccacttggcagggtccccttgatgccattctgcagtaccccatgtacaatgctctggtcgaagcctttgcgattcctggcccgcagaacatgtctgctatgtctgatatgattgctcagtccaagcagaagttcaaggaccctagcgttctcggtaacttcctcgagaaccaggacttgccgcgctggcacaacctgtcggtcgaccctcagagtctctggaacgccatggtcttcaactggatgtctgacggcattccgatcatgtactacggtcaagagcagggcttctccggcaacgctgatccttacaaccgtgagcctctgtggacttcgaaatacgagaactcgagcacgtaccaattcgtcacgaagctgaatacgctccgcaacttccttgtcagctctaccgataactggctgaactccacgaccgaggtcttgactactaccgattacggccttgccatcatgaagggtcccgtcatctccatcatgaccaacatcggttctccggtccgtgcttttgagcctgttcttgatgcaatggctaacgttcccgttatcctcacctgcacgcagcacgtcgtcggaagcaatggtaccgtcgaggtcgagtactccaagggcggtgtcccgacgatcctcgtcccgaccagcatcctcgagaactcgggcatctgcgggcagggcaacgtcgccgtgcagcagacgaaggcccagatcgtctcgtcggcgctgtccgacgtcctcgcgcggccgatgtctggcttcgccgtcgccgcgctcttcctcttgggattgttcaactctggaatcggtctgtgacagtagtacgatttgcatcattttacgcttttgttggcggatttttagtagtgtgtcccacagtcttgtcatcccactcgtttttctggcagtgtcgcaagtagctcgagcgtgtacgaagaataatagtgtggttttctggagcgcggctggcgcaatgtttcttgttcagaaaaaaaaaaaaaaaaaaaaaaaaaaaaa

SEQ ID NO: 1914 - protein, 530 aa, Phanerochaete chrysosporium
MLPLVHLCLYLSALGTAFAATAEEWKSRSIYQLIVDRYALPDGADPTKCNPADQTWCGGTWNTVRENLDYIQNAGFTAIWISPVSQNYQGPRTAYGDPYHGYWIADASKLNDRFGTANDLKALSDEVHRRGMYLMVDVVVNNVMSTSLTPDLSTYMFKDQSQYHPYCPIDWNNITSEQNCWLGDTKVPLPDLNTQNPTVVSGYSTWIKSLVETYNIDGLRIDAAKHVDAEFWPQFCGAAGVYCIGEVFGDDIDFASTWQGPLDAILQYPMYNALVEAFAIPGPQNMSAMSDMIAQSKQKFKDPSVLGNFLENQDLPRWHNLSVDPQSLWNAMVFNWMSDGIPIMYYGQEQGFSGNADPYNREPLWTSKYENSSTYQFVTKLNTLRNFLVSSTDNWLNSTTEVLTTTDYGLAIMKGPVISIMTNIGSPVRAFEPVLDAMANVPVILTCTQHVVGSNGTVEVEYSKGGVPTILVPTSILENSGICGQGNVAVQQTKAQIVSSALSDVLARPMSGFAVAALFLLGLFNSGIGL

SEQ ID NO: 1915 - DNA, 2988 bp, Paracoccidioides brasiliensis
gaaacggaggtcatccgtctaccttacaccttcagcttataccaattgctttggagcaagcggtttatcatttcctttatcaattgcacatcctgttctactccgtattctcctgacaatctttgagcggagattatccctgatagtttaatccgcttccccgcacgttttgactttgtcttcctgttttcttcactgcacaactatcattacactgtaatatcttcgggcaaccggaaggaaaagtaaaggaagaagtccgcaacaggaatgaactgaatcgtacatctagccgtgccatgagatctgtgcgggcatgttagtggtttcagatccatctgtgtttttgagttcagacaggctgaggtgcgcactattgcgtttggtcaaaggtttattgcggaatggcgtctttcatatcgtcggcatataaatacatttttcgtaggaagaagtcgaaatggcttgatattgaaggttagtaatcgttatatgacattgttttccccacccccacccccacccccacccccaaaacaccggttttctccataggattgtgtatcacattacttgtcctggcatgaccaatctccatcccacgcactctaaaaactccagtaaagacatctctaaccgtttccccagatttcaatgccgacaagccaggcgaggataaccagctcatgttccaggcctttgagtggtttgcgcctgatgacaagaaacattggcgacggctgcaggcagccctaccaagtctaaaggcgatcggagtgactagcatctggcttcctccgggatgtaaagccatgcatccatccggaaatggctatgatatctacgacctttacgacctaggcgagttcaatcagaaagggacaaaagcgaccaagtggggtactaaggaagagcttgtttctcttgtgaccagagcgcatgagatggaaattgcagtttattgggatgctgtgcttaatcacaaggctgcggccgattatgtagagaagtgcgttgcagttatggttgacccaaaaggtgagtttcattccataattgataggcatgataagtgggtgatgaaatggtggtgctttatatgatgcgagataaatattaatgctgttcattggagcggagatttagatcggagaagagtcatcagtgagcctcaggaaatagaagcctggtcgggcttttcgtttcctggtcggggaaaccagtatagcaaaatgaaataccgttctgaacattttactggtgttgattatgatgccctcactggtcgaaatgggattttcaaaatattaggtccccaaaacaaagactgggcacgcgacgtcagtaccgaaaatggaaactatgactatttaatgtttgcggatctagaccattcgaacccggaagttcgagaagacattaagagatggatagaatggctcggtaaccagctgcatctttctggtctaagatttgatgccgcaaagcactgctcagccggatttttgcgagacttcatcgcccatattcaacaaactgttggcgctggttggttttttgtagctgaatattggaaagcagaagtctgggagcttttaaattacctgggacgaatgggtcatctcgtatcgttatttgatgcgccattggtccatcaattttcttacatttcaaccactgaaggcgctgatttgcgcagagtttttgagggaagtttggtgaaatataaggagaaacatgctgtggtttgcttccccttacccattcattttccagaatttatattaaattcatattaacctctggattcctagacatttgtcatgaaccatgatacggtaagtcttatttttaatgcagtatatatatattctatcattttcactaataacagttattccagcaaccatcccaatcactcgaggtaaacccaccctccgtcatgaataattaaacaaaaaaccaaggaagggaaaaagcagaacaaggacttcgactccattaacaatcaaatcaaatacaaacaggtaccaatagcggaattcttcaagccactcgcttactccctaattctcctccgcaaggaaggttacccctgcctgttctacggtgacttgcatggcctttgcggcggctgcgaaggcattcttaggccgtcgtgtaatggccagctggctaatctctcgcttgctcggaagctgtacgcgtatggtcaacagcgggattatttcaataaaaggaattgcattggtttgtttattcttcctcttgatattcaaactcccaaccttctaccacaaccttatcaaactccacagccaccaaaaccccacaccaagttcccagtagcatcacagttaacacgtatttcacagggtttgtccgcatgggcgactcagcccaccctcatggcctcgcttgcgtgctcagtaacggccctgcagataagaagcgcatgaacgtaggaaagtcacatgcgggcagtgtatggacagaggtttacgggacctgtcgctcgagagtaacgatagatcgccgcgggtatggggtttttggtgtcgtttcgtatagcgtgagcgtttgggtccgagaggacgccactgggagagacagttttgggaagttgtatgtggattctcttttcgtttccgttttccctctccttactaatcatcaatgggctggctaatgtcttccaattctttaatagcgattcggatatctattcatccagctgctgatcgacagcttatcatccacagtgcttactctgttttttgccttgtatacaccacccatccactccctcttctttttgtattcagagtcatatggttttgtgactgagcttttatccgtggatgccgttggagaattttgttcttttctgtccaggactggcagccatgtagctttatgcattttctcctttctgccacgtttagaaaatccgttgatttagaattctagtccttaaaaacttgatcc

SEQ ID NO: 1916 - protein, 535 aa, Paracoccidioides brasiliensis
MASFISSAYKYIFRRKKSKWLDIEDFNADKPGEDNQLMFQAFEWFAPDDKKHWRRLQAALPSLKAIGVTSIWLPPGCKAMHPSGNGYDIYDLYDLGEFNQKGTKATKWGTKEELVSLVTRAHEMEIAVYWDAVLNHKAAADYVEKCVAVMVDPKDRRRVISEPQEIEAWSGFSFPGRGNQYSKMKYRSEHFTGVDYDALTGRNGIFKILGPQNKDWARDVSTENGNYDYLMFADLDHSNPEVREDIKRWIEWLGNQLHLSGLRFDAAKHCSAGFLRDFIAHIQQTVGAGWFFVAEYWKAEVWELLNYLGRMGHLVSLFDAPLVHQFSYISTTEGADLRRVFEGSLVKYKEKHATFVMNHDTQPSQSLEVPIAEFFKPLAYSLILLRKEGYPCLFYGDLHGLCGGCEGILRPSCNGQLANLSLARKLYAYGQQRDYFNKRNCIGFVRMGDSAHPHGLACVLSNGPADKKRMNVGKSHAGSVWTEVYGTCRSRVTIDRRGYGVFGVVSYSVSVWVREDATGRDSFGKFDSDIYSSSC

SEQ ID NO: 1917 - DNA, 1686 bp, Aspergillus fumigatus
atgcggcagtctttgtatcacggtgcaatctggtttgctttagccagtcttgcatcggccgatgctccatcttctcagcaatgggctgagagagcaatctatcaagttatgacagaccgctttgctcgtccagcgggctcatctgacgcaccttgtgaccccgaaaggtactgcggaggctcgtggactggcatcattgacaagctcgactacatccaggacctcggattcaccgccattcaaatctcgccggtcgtggaaaacatcccagacaataccaagtacggcgaagcataccatggatactggcccaagaatctgtatgctctcaatgaacactttgggaccgcagatgagcttcgcagattagtgagcgaggtccatcgacgagacatgtacctaattgttgatgttgtgatcaatgatatggctcaagctgtcaatggctccatgaaagatgacccgtcgctaaagattgactattcccagctctttccctttgacgatgagaagtactatcatcctttctgtgccatcacggattggactgatcctaaaatatacaagaattgctggtttgccgtggaaacggttgccctcccggatctgaacacaggagatgcctccgtcgccacaatgatcggagattggatcaagcaatttgttggtaactattctattgacggactccgcattgacgctgcactgcacatggatgacgactatgtcgagggcttctccaaggcggctggtttattcacgataggcgaagtcagcaacggagacacaagcctggtgtgcaaatacgaaaatttggtttctagcgtcctgaattatccactatattacgccttgatccaagccttcacagcgggcaatatgcttggactcgctgaaagtatccgagctgtgcaaaaggactgcaaggatttcgcgcttctggaaacgttcgtcgagaatcacgatctccctcgctttgcgtcactgaccaatgacaccaccttggcaaagaacgcgatggctttcaacatactctcagatggcatcccccaagtataccaaggtcaagagcagcacatgtcgggcaactatacgcctttcaaccgaggcgccctttggacaacgaactatgataccacgagcccgctattcaagctcaccgcaacgctcaacaagctccgcaaccatgccattagcatcgacaaccactatgtgaccaaccatagcatagagcttcattccgacaactccacgtacgccaccaggaagggccctgagggagtgcaggctgtttcagtcttctcaaaccagggcaccaatggtggtaagtaccagcttgcgttgaaggatgcgtatgcgccagggacagaggtcatggaagtcctgggctgctccaagctcactactgacgatgtaggcaacctgaccgtcgagatggacgctggtgagccaaggatctttttccctgtcgcccaactcaaaaactctgggctgtgtggctttgagaaacagaagactgcctcgtcgagcaacagcgaccgcgacagcaacagcaacgattcgacccacccctctagtcaagacaaggatgcggataagaaatcctctgcgagtatcgttggcgttccataccctggtatgctgatctctggggcggcattagcgtttctgagctggtttctctaa

SEQ ID NO: 1918 - protein, 561 aa, Aspergillus fumigatus
MRQSLYHGAIWFALASLASADAPSSQQWAERAIYQVMTDRFARPAGSSDAPCDPERYCGGSWTGIIDKLDYIQDLGFTAIQISPVVENIPDNTKYGEAYHGYWPKNLYALNEHFGTADELRRLVSEVHRRDMYLIVDVVINDMAQAVNGSMKDDPSLKIDYSQLFPFDDEKYYHPFCAITDWTDPKIYKNCWFAVETVALPDLNTGDASVATMIGDWIKQFVGNYSIDGLRIDAALHMDDDYVEGFSKAAGLFTIGEVSNGDTSLVCKYENLVSSVLNYPLYYALIQAFTAGNMLGLAESIRAVQKDCKDFALLETFVENHDLPRFASLTNDTTLAKNAMAFNILSDGIPQVYQGQEQHMSGNYTPFNRGALWTTNYDTTSPLFKLTATLNKLRNHAISIDNHYVTNHSIELHSDNSTYATRKGPEGVQAVSVFSNQGTNGGKYQLALKDAYAPGTEVMEVLGCSKLTTDDVGNLTVEMDAGEPRIFFPVAQLKNSGLCGFEKQKTASSSNSDRDSNSNDSTHPSSQDKDADKKSSASIVGVPYPGMLISGAALAFLSWFL

SEQ ID NO: 1919 - DNA, 1707 bp, Aspergillus fumigatus
atgatatactcgctgcgaatcctgcagtggctttgcatcactgcagggcttgacctgctcgtgccatccttggctgcagatacaagtgcatggaagtccaggtctatctatcagacgatgacagacagatttgcacgtacggatgggtccaccactcatccatgcaacaccacagaagggctacgctgtggtggctcatggagaggtacaatccaacacctcgattacattcaaggaatgggattcgacgctatcatgatctccccaatcgtccagaatgtcgaggggcgcgtgcagtacggagaggcctatcatggctactgggtccaggacatgtatgcgctaaacccacactttggcactcaccaggacctgttagacttgagtaaggctgttcatgatcggggcatgtatctgatggtagatactgtcatcaacaacttggcgtacatcaccgacggacgaaacccggccacgagcattgactattcagcgctcagaccattcaatgactcaatgttctttcatccatattgcaagatcaccgactatgacaactatccattggcgcaaacatgctggacaggtgatgatgttgttccccttccagatctaaagacagaagatagccaagttcagagcatgctcatggactggattagaaaaatgatggctacgtattcaatcgatggcctacgtctggatgctgcgaagcatattacaccaagtttcttgcctttgttccaaaacgcttctggcgcttttattactggagaagttttcgagccgtccgtgaagacgatctgcggatatcaaaaggacctccccagcgtccccaattatcccatctattattccatcttggaggcatttacgaaaggcaacacaagctctctgacgaatcaggtagaggtcatgaaacagacatgttctgatgttactgcccttacttcgttctcggagaatcatgacgtcgctcgatttgcaagcttcaaggatgacatcgcggtaaggcagcgaactccagttaccctgaaagtatcaaccgatgataggctaacaccggcgcagctcgctaagaacgttttaacatttacgatgctgttcgacggcataccgatgatataccaagggcaagaacaacatttctcaggcgccagtgacccggagaaccgcgaagccttatggctatcaggctacaacaccaacgctccgctttaccaactagccacgagactgaacaggatccgcaagcatgcagcccagatcgacccagcatttgtagactcacagaccttccccatctacacagggtctagcgagatgggtttccgcaaaggcgtcgagggccggcaactcgtaatggtcttgtcaactcaaggtatggacagcggcaaatatgagctggacatgccaataggctaccaacctggatttgtggtcacagatgtgcttaattgcgccaactattcggttaacgacatgggtcttctcaaggtcagcatggataagggcgagcctcgggtcctttttcccgctgacatgatggaaggaagtggtctatgcggatatggaaggtcgaatggaacgacgtatcttaatctgaaaaagaattcaacgcagttctcgggtggcgggctctcaaatcggcctaccgtgcccctactgttgatctgttgtttgacttgcttgatactatggtgttga

SEQ ID NO: 1920 - protein, 568 aa, Aspergillus fumigatus
MIYSLRILQWLCITAGLDLLVPSLAADTSAWKSRSIYQTMTDRFARTDGSTTHPCNTTEGLRCGGSWRGTIQHLDYIQGMGFDAIMISPIVQNVEGRVQYGEAYHGYWVQDMYALNPHFGTHQDLLDLSKAVHDRGMYLMVDTVINNLAYITDGRNPATSIDYSALRPFNDSMFFHPYCKITDYDNYPLAQTCWTGDDVVPLPDLKTEDSQVQSMLMDWIRKMMATYSIDGLRLDAAKHITPSFLPLFQNASGAFITGEVFEPSVKTICGYQKDLPSVPNYPIYYSILEAFTKGNTSSLTNQVEVMKQTCSDVTALTSFSENHDVARFASFKDDIAVRQRTPVTLKVSTDDRLTPAQLAKNVLTFTMLFDGIPMIYQGQEQHFSGASDPENREALWLSGYNTNAPLYQLATRLNRIRKHAAQIDPAFVDSQTFPIYTGSSEMGFRKGVEGRQLVMVLSTQGMDSGKYELDMPIGYQPGFVVTDVLNCANYSVNDMGLLKVSMDKGEPRVLFPADMMEGSGLCGYGRSNGTTYLNLKKNSTQFSGGGLSNRPTVPLLLICCLTCLILWC

SEQ ID NO: 1921 - DNA, 1752 bp, Aspergillus fumigatus
atgtcaccgcatgcgataacaaccgttcccacaggggccaacaactggtggaaagaggccactgtctaccaggtataccccgcatcattcaaagattccaacggcgacggatggggcgatatccccggtctgatctccaaggtcccataccttcattcgctgggcgtcgacgtagtatggctctcaccgcactacgactcgccaatgcacgacatgggctacgacatttccgactatgaaaaagtgcttccggcatacgggactgtcgcggacgtcaagaagctaattgacgagtgccatgcgcgcggtatgaagcttatccttgatttagttgtgaaccacaccagtgacgagcacgcctggttcaaggaaagccgcagcagcagagacaacgaaaaacgcgactggtatttctggcggccggcacggtacgacgagcacggcaatcggcttccaccgacaaattaccggggctattttgcagggagtacgtggacgtgggacgagcagacgcaagagtattacctacatctgtacgcgaaggagcagcctgacttgaactgggataaccgagccacgcgggaagccatctataacagcgcgattcggttctggcttgatagaggggtggatggcttccgcgttgacaccgtcaacaaatatagcaagcggacggatttccctgatgcgcctgtcaccgaccccaagagctatattcagcccgcggtggagatgtggtgcaatggtccgcgcatccatgagttcctgcgcgaaatgtacgacgaagcgttggcgccgtacggagacgtaatgaccgttggtgagttggcgaatacgcccgacccgaacgatgtgctcaagtatgttggtgcgtctgcgaagcagttgagcatggtcttccacttggatattggtcatatcggcatgggcagcagcttggaagacaagtacatcttccagccatggaagctcactgagctgaaggccatcgtgggcaagtggcagtcttttgtcgaggggacggacgggtggacgacggcattctgtgagaaccacgacaacggccggtcggtgtcacgatttggatccgatgaccctgagtttcgagagcgctccgcgaagatgctggcgttgatgatggtggccatgaccggaacattgttcttatatcaggggcaggaaatcggaatgatcaatgcgccgcgggattggtcaattggggagtacaaggacattgaagggctgggatactatcgagaggccgagcgtcaggctgcgaacgggactgatccaagcagacctgaacgtatcatggaaggactgcgaattctggcgcgagatcatgcccgactgccgatgcagtgggatgattctcccaacgccggatttacaacaggaacaccatggatgcgcactcacgacctgtacagagacatcaacgtgaagaagcaggagtcagatcctcaaagtatactttcgttctggaagaaggtactgcggctgcgcaaggaataccgcgagttattcatccatggtgcgtttgaggtggtggactttgagaatctcgagaccttttgctttgtgaagtccagggaggagaagcgggcattggttgccttgaacttcacctcttcacctcagccacttacacaggctagtatggcaggggagatgaagctcttggtcagcaactatccttcctcgaaactgggtacattacagccgtacgaggggaggatctacatatcgtga

SEQ ID NO: 1922 - protein, 583 aa, Aspergillus fumigatus
MSPHAITTVPTGANNWWKEATVYQVYPASFKDSNGDGWGDIPGLISKVPYLHSLGVDVVWLSPHYDSPMHDMGYDISDYEKVLPAYGTVADVKKLIDECHARGMKLILDLVVNHTSDEHAWFKESRSSRDNEKRDWYFWRPARYDEHGNRLPPTNYRGYFAGSTWTWDEQTQEYYLHLYAKEQPDLNWDNRATREAIYNSAIRFWLDRGVDGFRVDTVNKYSKRTDFPDAPVTDPKSYIQPAVEMWCNGPRIHEFLREMYDEALAPYGDVMTVGELANTPDPNDVLKYVGASAKQLSMVFHLDIGHIGMGSSLEDKYIFQPWKLTELKAIVGKWQSFVEGTDGWTTAFCENHDNGRSVSRFGSDDPEFRERSAKMLALMMVAMTGTLFLYQGQEIGMINAPRDWSIGEYKDIEGLGYYREAERQAANGTDPSRPERIMEGLRILARDHARLPMQWDDSPNAGFTTGTPWMRTHDLYRDINVKKQESDPQSILSFWKKVLRLRKEYRELFIHGAFEVVDFENLETFCFVKSREEKRALVALNFTSSPQPLTQASMAGEMKLLVSNYPSSKLGTLQPYEGRIYIS

SEQ ID NO: 1923 - DNA, 1497 bp, Aspergillus niger
atggtcgcgtggtggtctctatttctgtacggccttcaggtcgcggcacctgctttggctgcaacgcctgcggactggcgatcgcaatccatttatttccttctcacggatcgatttgcaaggacggatgggtcgacgactgcgacttgtaatactgcggatcagaaatactgtggtggaacatggcagggcatcatcgacaagttggactatatccagggaatgggcttcacagccatctggatcacccccgttacagcccagctgccccagaccaccgcatatggagatgcctaccatggctactggcagcaggatatatactctctgaacgaaaactacggcactgcagatgacttgaaggcgctctcttcggcccttcatgagagggggatgtatcttatggtcgatgtggttgctaaccatatgggctatgatggagcgggtagctcagtcgattacagtgtgtttaaaccgttcagttcccaagactacttccacccgttctgtttcattcaaaactatgaagatcagactcaggttgaggattgctggctaggagataacactgtctccttgcctgatctcgataccaccaaggatgtggtcaagaatgaatggtacgactgggtgggatcattggtatcgaactactccattgacggcctccgtatcgacacagtaaaacacgtccagaaggacttctggcccgggtacaacaaagccgcaggcgtgtactgtatcggcgaggtgctcgacggtgatccggcctacacttgtccctaccagaacgtcatggacggcgtactgaactatcccatttactatccactcctcaacgccttcaagtcaacctccggcagcatggacgacctctacaacatgatcaacaccgtcaaatccgactgtccagactcaacactcctgggcacattcgtcgagaaccacgacaacccacggttcgcttcttacaccaacgacatagccctcgccaagaacgtcgcagcattcatcatcctcaacgacggaatccccatcatctacgccggccaagaacagcactacgccggcggaaacgaccccgcgaaccgcgaagcaacctggctctcgggctacccgaccgacagcgagctgtacaagttaattgcctccgcgaacgcaatccggaactatgccattagcaaagatacaggattcgtgacctacaagaactggcccatctacaaagacgacacaacgatcgccatgcgcaagggcacagatgggtcgcagatcgtgactatcttgtccaacaagggtgcttcgggtgattcgtataccctctccttgagtggtgcgggttacacagccggccagcaattgacggaggtcattggctgcacgaccgtgacggttggttcggatggaaatgtgcctgttcctatggcaggtgggctacctagggtattgtatccgactgagaagttggcaggtagcaagatctgtagtagctcgtga

SEQ ID NO: 1924 - protein, 498 aa, Aspergillus niger
MVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 1925 - DNA, 1518 bp, Aspergillus nomius
atgagattatcgacttcgagtctcttcctttccgtgtctctgctggggaagctggccctcgggctgtcggctgcagaatggcgcactcagtcgatttacttcctattgacggatcggttcggtaggacggacaattcgacgacagctacatgcgatacgggtgaccaaatctattgtggtggcagttggcaaggaatcatcaaccatctggattatatccagggcatgggattcacggccatctggatctcgcctatcactgaacagctgccccaggatactgctgatggtgaagcttaccatggatattggcagcagaagatatacgacgtgaactccaacttcggcactgcagatgacctcaagtccctctcagatgcgcttcatgcccgcggaatgtacctcatggtggacgtcgtccctaaccacatgggctacgccggcaacggcaacgatgtagactacagcgtcttcgaccccttcgattcctcctcctacttccacccatactgcctgatcacagattgggacaacttgaccatggtccaagattgttgggagggtgacaccatcgtatctctgccagacctaaacaccaccgaaactgccgtgagaacaatctggtatgactgggtagccgacctggtatccaattattcagtcgacggactccgcatcgacagtgtcctcgaagtcgaaccagacttcttcccgggctaccaggaagcagcaggtgtctactgcgtcggcgaagtcgacaacggcaaccctgccctcgactgcccataccagaaggtcctggacggcgtcctcaactatccgatctactggcaactcctctacgccttcgaatcctccagcggcagcatcagcaacctctacaacatgatcaaatccgtcgcaagcgactgctccgatccgacactactcggcaacttcatcgaaaaccacgacaatccccgtttcgcctcctacacctccgactactcgcaagccaaaaacgtcctcagctacatcttcctctccgacggcatccccatcgtctacgccggcgaagaacagcactactccggcggcaaggtgccctacaaccgcgaagcgacctggctttcaggctacgacacctccgcagagctgtacacctggatagccaccacgaacgcgatccgcaaactagccatctcagctgactcggcctacattacctacgcgaatgatgcattctacactgacagcaacaccatcgcaatgcgcaaaggcacctcagggagccaagtcatcaccgtcctctccaacaaaggctcctcaggaagcagctacaccctgaccctcagcggaagcggctacacatccggcacgaagctgatcgaagcgtacacatgcacatccgtgaccgtggactcgagcggcgatattcccgtgccgatggcgtcgggattaccgagagttcttctgcccgcgtccgtcgtcgatagctcttcgctctgtggcgggagcggaagattatacgtcgagtaa

SEQ ID NO: 1926 - protein, 505 aa, Aspergillus nomius
MRLSTSSLFLSVSLLGKLALGLSAAEWRTQSIYFLLTDRFGRTDNSTTATCDTGDQIYCGGSWQGIINHLDYIQGMGFTAIWISPITEQLPQDTADGEAYHGYWQQKIYDVNSNFGTADDLKSLSDALHARGMYLMVDVVPNHMGYAGNGNDVDYSVFDPFDSSSYFHPYCLITDWDNLTMVQDCWEGDTIVSLPDLNTTETAVRTIWYDWVADLVSNYSVDGLRIDSVLEVEPDFFPGYQEAAGVYCVGEVDNGNPALDCPYQKVLDGVLNYPIYWQLLYAFESSSGSISNLYNMIKSVASDCSDPTLLGNFIENHDNPRFASYTSDYSQAKNVLSYIFLSDGIPIVYAGEEQHYSGGKVPYNREATWLSGYDTSAELYTWIATTNAIRKLAISADSAYITYANDAFYTDSNTIAMRKGTSGSQVITVLSNKGSSGSSYTLTLSGSGYTSGTKLIEAYTCTSVTVDSSGDIPVPMASGLPRVLLPASVVDSSSLCGGSGRLYVE

SEQ ID NO: 1927 - DNA, 1138 bp, Aspergillus nomius
ggatcgatttgcaaggacggatggatcgacaactgcggcttgtaataccgaggatcgggtctgctgctccctcccagcgttcaggaagtggaaaacgaaactgacttgatatagaaatactgtggtggaacatggcagggcatcatcgacaaggtaaaccacctccgcatcttaaaagaataataccaaaaaaagaagtctcgtctaaaccatcatgtagctggactatatccagggaatgggcttcacagccatctggatcacccccgttacaggccagctgccccagaacaccgcatacggagaggcctaccatggctactggcagcaggatatgtaggtcgattcctctgcgcacccacccatcttttacgtagaaatgaactaacttggtgggtttagctattccttgaacgaaaactacggcactccagatgatttgaaggctcttgcttcggcccttcatacgagggggatgtatctcatggtcgatgtggttgctaaccatatggtttgtggacctctttcactaacttcgcaagcatacttgattttaatactgacaatgtaaacccagggctatgatggagcgggcgcctccgttgattacagcgtgttcaaaccattcaattcccaagaatatttccacccgttctgtctcattcaaaactataacgaccagacccagagcgaggattgctggctaggagataacagtgtctccttgcccgatcttgacaccaccaaagatgaggtcaagaacgaatggtacgaatgggtgggatcattggtatcgaactactccagtaagacctctaccctacaatccaactcatcaaccatacttacaaaaacccagtcgacggcctccgtgtcgacacagtgaaacacgtccagaaggacttctggccggggtacaacaaagccgcaggcgtgtactgcatcggcgaagtcctcaacggtgacccggcatacacatgtccctaccaggacgtcatggacggcgtactgaactacccaatgtatgacctcccatgactcttcttgcagtctcttcctctaacaaaccggatgaaaaccagttactaccccctcctcaacgccttcaaatccacctccggcagcatggacgacctct

SEQ ID NO: 1928 - DNA, 1138 bp, Aspergillus nomius
ggatcgatttgcaagggacggatggatcgacaactgcggcttgtaataccgaggatcgggtctgctgctccctcccagcgttcaggaagtggaaaacgaaactgacttgatatagaaatactgtggtggaacatggcagggcatcatcgacaaggtaacccgcctccacatccaaaagaataataccaaaaaaaagaagtctcgtctaaaccatcatgtagctggactatatccagggaatgggcttcacagccatctggatcacccccgttacaggccagctgccccagaacaccgcatacggagaggcctaccatggctactggcagcaggatatgtaggtcgattcctctgcgcacccacccatcttttacgtagaaatgaactaacttggtgggtttagctattccttgaacgaaaactacggcactccagatgatttgaaggctcttgcttcggcccttcatacgagggggatgtatctcatggtcgatgtggttgctaaccatatggtttgtggacctctttcactaacttcgaagcatacttgatttaatactgacaatgtaaacccagggctatgatggagcgggcgcctccgttgattacagcgtgttcaaaccattcaattcccaagaatatttccacccgttctgtctcattcaaaactatgacgaccagacccagagcgaggattgctggctaggagataacagtgtctccttgcccgatcttgacaccaccaaagatgaggtcaagaacgaatggtacgaatgggtgggatcattggtatcgaactactccagtaagacctcttaccctacaatccaactcatcaaccatacttacaaaaacccagtcgacggcctccgtgtcgacacagtgaaacacgtccagaaggacttctggcctggatacaacaaagccgcaggcgtgtactgcatcggcgaagtcctcaacggtgacccggcatacacatgtccctaccaggacgtcatggacggcgtactgaactacccaatgtatgacctcccatgactcttcttgcagtctcttcctctaacaaaccggatgaaaaccagttactaccccctcctcaacgccttcaaatccacctccggcagcatggacgacctct

SEQ ID NO: 1929 - DNA, 1138 bp, Aspergillus nomius; identical to SEQ ID NO: 1928

(The sequence listing continues in the following parts.)

What is claimed is:

1. A method of degrading a plant biomass sample so as to release fermentable sugars therein, the method comprising obtaining a plant degrading enzyme cocktail comprising plant cell extracts comprising active plant degrading enzymes recombinantly expressed in chloroplasts of plant cells, and admixing said plant degrading enzyme cocktail with said biomass sample, wherein said cocktail comprises recombinant CelD cellulase encoded by sequences obtained from *Clostridium thermocellum*, ligninase, recombinant beta-glucosidase encoded by sequences obtained from *Trichoderma reesei*, hemicellulase, xylanase encoded by sequences obtained from *Trichoderma reesei*, recombinant alpha amylase encoded by sequences obtained from *Bacillus* ssp., amyloglucosidase, recombinant PelB and PelD pectate lyases encoded by sequences obtained from *Fusarium solani*, lipase encoded by sequences obtained from *Mycobacterium tuberculosis*, maltogenic alpha-amylase encoded by sequences obtained from *Bacillus* ssp., acetyl xylan esterase encoded by sequences obtained from *Trichoderma reesei*, cutinase encoded by sequences obtained from *Fusarium solani*, and swollenin encoded by sequences obtained from *Trichoderma reesei*, wherein said CelD, PelB, and PelD exhibit elevated levels of enzymatic activity at higher temperatures and/or broader pH ranges relative to *E. coli*-expressed CelD, PelB, and PelD enzymes, respectively, said plant degrading enzyme cocktail acting synergistically to release fermentable sugars produced from said biomass sample.

2. The method of claim 1, comprising at least one bacterial cell extract comprising a second plant degrading enzyme.

3. The method of claim 1, wherein said plant degrading enzyme cocktail comprises at least one additional chloroplast-expressed recombinant cellulase selected from the group consisting of CelO exoglucanase encoded by sequences obtained from *Clostridium thermocellum*, egI endoglucanase, egII endoglucanase, each being encoded by sequences obtained from *Trichoderma reesei*.

4. The method of claim 1, wherein said plant biomass sample comprises grain and/or grain residues, sugar beet, sugar cane, grasses, wood-based biomass, fruits and/or fruit waste residues, or a combination thereof.

5. The method of claim 4, wherein said plant biomass is corn, wheat, barley, or citrus, or waste residues obtained therefrom.

6. The method of claim 4, wherein said plant biomass is switchgrass.

7. A method of degrading a plant biomass sample so as to release fermentable sugars therein, the method comprising obtaining a plant degrading enzyme cocktail comprising plant cell extracts comprising active plant degrading enzyme recombinantly expressed in chloroplasts of plant cells, and admixing said plant degrading enzyme cocktail with said biomass sample, wherein said plant biomass is sawdust or a wood-based biomass and said plant degrading enzymes consist of CelD endoglucanase, CelO exoglucanase each being encoded by sequences obtained from *Clostridium thermocellum*; beta-glucosidase, xylanase, acetyl xylan esterase each being encoded by sequences obtained from *Trichoderma reesei*; PelA pectate lyase, PelB pectate lyase, PelD pectate lyase each being encoded by sequences obtained from *Fusarium solani*; and swollenin encoded by sequences obtained from *Trichoderma reesei*, and said plant degrading enzyme cocktail is effective to release 100% fermentable sugars produced from said sawdust or wood-based biomass.

8. The method of claim 4, wherein said plant biomass is sugar cane.

9. A method of degrading a plant biomass sample so as to release fermentable sugars therein, the method comprising obtaining a plant degrading enzyme cocktail comprising plant cell extracts comprising active plant degrading enzyme recombinantly expressed in chloroplasts of plant cells, and admixing said plant degrading enzyme cocktail with said biomass sample, wherein said plant biomass is citrus peel and said plant degrading cocktail contains enzymes consisting of CelD endoglucanase, CelO exoglucanase each being encoded by sequences obtained from *Clostridium thermocellum*; beta-glucosidase, xylanase, acetyl xylan esterase each being encoded by sequences obtained from *Trichoderma reesei*; lipase encoded by sequences obtained from *Mycobacterium tuberculosis*, PelA pectate lysase, PelB pectate lyase, PelD pectate lyase each being encoded by sequences obtained from *Fusarium solani*; cutinase encoded by a sequence obtained from *Fusarium solani*, and swollenin encoded by sequences obtained from *Trichoderma reesei*, and said plant degrading enzyme cocktail is effective to release 100% fermentable sugars from said citrus peel biomass.

10. The method of claim 4, wherein said plant biomass is sugar beet.

11. The method of claim 1, wherein said plant degrading cocktail further comprises rubisco.

12. A plant material useful for degrading a processed wood biomass, said material comprising chloroplast-expressed CelD endoglucanase, CelO exoglucanase each being encoded by sequences obtained from *Clostridium thermocellum*; beta-glucosidase, xylanase, acetyl xylan esterase each being encoded by sequences obtained from *Trichoderma reesei*; PelA pectate lyase, PelB pectate lysase, PelD pectate lyase, each being encoded by sequences obtained from *Fusarium solani*; and swollenin encoded by a sequence obtained from *Trichoderma reesei*, and said plant degrading enzyme cocktail being effective to release 100% fermentable sugars produced from said sawdust or wood-based biomass.

13. A plant material for degrading a citrus peel biomass wherein said plant material comprises chloroplast expressed CelD endoglucanase, CelO exoglucanase each being encoded by sequences obtained from *Clostridium thermocellum*; beta-glucosidase, xylanase, acetyl xylan esterase each being encoded by sequences obtained from *Trichoderma reesei*; lipase encoded by sequences obtained from *Mycobacterium tuberculosis*, PelA pectate lysase, PelB pectate lyase, PelD pectate lyase each being encoded by sequences obtained from *Fusarium solani*; cutinase encoded by sequences obtained from *Fusarium solani*, and swollenin encoded by sequences obtained from *Trichoderma reesei*, and said plant degrading enzyme cocktail is effective to release 100% fermentable sugars from said citrus peel biomass.

14. The homogenized plant material of claim 12, in powdered form.

15. The method of claim 13, wherein said plant material is in powdered form.

\* \* \* \* \*